United States Patent 9,719,131 (METHOD FOR DETERMINING THE DEGREE OF METHYLATION OF DEFINED CYTOSINES IN GENOMIC DNA IN THE SEQUENCE CONTEXT OF 5'-CPG-3') - sequence listing, part 12

SEQ ID NO: 36410 - DNA, 824 bp, Artificial Sequence
  chemically treated genomic DNA (Homo sapiens) CpG-island No: 36410
atactccaaactaactcattccttcccccaccccgctcaaaactaaaaacatacctacgctaaaaactaaaacaactacacttccgcaaacgtaaaaaacgaactcctaaaactcaaaatcgactaaaattaaattcctatcccgcacgcgtaacccgcccgaaacccgctacataataacgcgtcaaccctaaaaaaacaaaacgcaaaattattacgatacccaaacctacgccgaaaacctccgactattccgctaaacgcgacgcctatacctcgcgcaaccccgaaacgaacaccgccgcccgccccccgaaccgccgaaaactactctacccctccgttctaaccgccgaaaacaaaaaaactcgaaacgaacaaaactcgtaaaaacaccgaacgaacccaacccctaatcgaacccacgaaccgaccgaacgccctccccgcgaaaaaccgaaaaccgaaaactaaaaatacactcaccgcgcaactccaactaacaaaaaaacctacgacctacgacgaacgcacaaaccaaaaaaacgacgcgaaacgaaaaaaaaaacaaaaaaatcgcgaaacccgcaaccaatcccgaaaaaactctaaacaaaaacgaaacgcgcaaccgatcccctaaaaaaatcgaataactcaaccaatcccgaaaaaatcctaaacgaaacgaaataaaaaaccgcgacacgcacaaccaatcccgaataaaacgaaacgaacccgaccattaactatcgatatccgaaaccgacctaaatataactcatacaataacacgaaaataaaccatatctacgcgcgaa

SEQ ID NO: 36411 - DNA, 824 bp, Artificial Sequence
  chemically treated genomic DNA (Homo sapiens) CpG-island No: 36411
gtgttttaggttgatttatttttttttttatttcgtttaaggttaggaatatatttgcgttaagaattgaggtagttgtattttcgtagacgtaagagacgaatttttggagtttaaggtcggttggggttgggtttttgtttcgtacgcgtggttcgttcgaaattcgttatatagtggcgcgttagttttggggaagtaaagcgtaaaattgttacggtgtttagatttgcgtcgggaattttcggttgtttcgttgggcgcggcgtttgtgtttcgcgtagtttcgggacgggtatcgtcgttcgtttttcgggtcgtcgagggttgttttattttttcgttttggtcgtcgggagtagaggagttcgaggcgggtaaagttcgtggggatatcgggcgagtttagtttttgatcggatttacgggtcggtcgggcgtttttttcgcgggagatcgaaagtcgaagattggagatgtatttatcgcgtaattttagttgataaagaggtttgcgatttgcgacgggcgtataaattagagaggcggcgcggggcggggagggaagtaggagggtcgcgaggttcgtagttaatttcgggaagattttgggtaagggcggggcgcgtagtcgattttttggagaggtcgggtagtttagttaatttcgggaagattttgagcggggcggggtggagggtcgcggtacgtatagttaatttcggatggggcgggacgggttcggttattggttgtcggtgttcggggtcggtttaggtgtggtttatgtagtagtacggggataagttatgtttgcgcgcgga

SEQ ID NO: 36412 - DNA, 824 bp, Artificial Sequence
  chemically treated genomic DNA (Homo sapiens) CpG-island No: 36412
tccgcgcgcaaacataacttatccccgtactactacataaaccacacctaaaccgaccccgaacaccgacaaccaataaccgaacccgtcccgccccatccgaaattaactatacgtaccgcgaccctccaccccgccccgctcaaaatcttcccgaaattaactaaactacccgacctctccaaaaaatcgactacgcgccccgcccttacccaaaatcttcccgaaattaactacgaacctcgcgaccctcctacttccctccccgccccgcgccgcctctctaatttatacgcccgtcgcaaatcgcaaacctctttatcaactaaaattacgcgataaatacatctccaatcttcgactttcgatctcccgcgaaaaaaacgcccgaccgacccgtaaatccgatcaaaaactaaactcgcccgatatccccacgaactttacccgcctcgaactcctctactcccgacgaccaaaacgaaaaaataaaacaaccctcgacgacccgaaaaacgaacgacgatacccgtcccgaaactacgcgaaacacaaacgccgcgcccaacgaaacaaccgaaaattcccgacgcaaatctaaacaccgtaacaattttacgctttacttccccaaaactaacgcgccactatataacgaatttcgaacgaaccacgcgtacgaaacaaaaacccaaccccaaccgaccttaaactccaaaaattcgtctcttacgtctacgaaaatacaactacctcaattcttaacgcaaatatattcctaaccttaaacgaaataaaaaaaaaaataaatcaacctaaaacac

SEQ ID NO: 36413 - DNA, 641 bp, Artificial Sequence
  chemically treated genomic DNA (Homo sapiens) CpG-island No: 36413
tcggtcggtgatatttaagaggcgattttttcgttttttcgtttttggagggtgggcggtcgggggtgggggttatagtggttagcgttttcggagggcgtcggtttttaggtgcgggtggggttgcgtttcgtcgggttcggagaatttttattgggcgttcgcggcgcgtagataatgggtcggggaagcgttttatcgcggcgcgtaggtttttttcgagcgcggcgggaggcggcggcgttttcgcgggttagggtcgttagtttttcgtttttcggtcgttcgtcgttttttggttaggtttcgtcgtcgtcgttcgttgttttttttcgttttttttttttgcgatttcgcggttttttggcgaggcgcggtcggcggaaaagtttggtggggtggtcgcggtagcgatacgcgcggtcggtttcgggaaaataaaggggggatgtgtgtggtttagagttcggaaatggggcgtcggtgggggtcggggcggcgtagttttgttttttggagtttattgtttgtcgggtgtatatgtatacgcgtttaataagaaattaatatattttgtcgtcgtttatttatttatcgatggttaaatagacggcgtagttattttgtacggagagggtttt

SEQ ID NO: 36414 - DNA, 641 bp, Artificial Sequence
  chemically treated genomic DNA (Homo sapiens) CpG-island No: 36414
aaaaccctctccgtacaaaataactacgccgtctatttaaccatcgataaataaataaacgacgacaaaatatattaatttcttattaaacgcgtatacatatacacccgacaaacaataaactccaaaaaacaaaactacgccgccccgacccccaccgacgccccatttccgaactctaaaccacacacatcccccctttattttcccgaaaccgaccgcgcgtatcgctaccgcgaccaccccaccaaacttttccgccgaccgcgcctcgccaaaaaaccgcgaaatcgcaaaaaaaaaaaacgaaaaaaaacaacgaacgacgacgacgaaacctaaccaaaaaacgacgaacgaccgaaaaacgaaaaactaacgaccctaacccgcgaaaacgccgccgcctcccgccgcgctcgaaaaaaacctacgcgccgcgataaaacgcttccccgacccattatctacgcgccgcgaacgcccaataaaaattctccgaacccgacgaaacgcaaccccacccgcacctaaaaaccgacgccctccgaaaacgctaaccactataacccccacccccgaccgcccaccctccaaaaacgaaaaaacgaaaaaatcgcctcttaaatatcaccgaccga

SEQ ID NO: 36415 - DNA, 641 bp, Artificial Sequence
  chemically treated genomic DNA (Homo sapiens) CpG-island No: 36415
aaagtttttttcgtgtaaagtgattgcgtcgtttgtttggttatcgatggatagataagcggcggtaggatgtgttaattttttgttaagcgcgtgtgtatgtgtattcggtaaataataggttttaggaggtagagttgcgtcgtttcggtttttatcggcgttttattttcggattttgggttatatatattttttttttgttttttcggggtcggtcgcgcgtgtcgttgtcgcggttattttattaagttttttcgtcggtcgcgtttcgttaggaggtcgcgaggtcgtagggaggaagagcgggaggaagtagcgggcggcggcggcggggtttggttagggggcggcgggcgatcgggggacgggggattggcggttttggttcgcggaagcgtcgtcgtttttcgtcgcgttcggggaaggtttgcgcgtcgcgataaggcgttttttcggtttattgtttgcgcgtcgcggacgtttagtgaaagtttttcgggttcggcggggcgtagttttattcgtatttggaagtcggcgtttttcggggacgttggttattgtgatttttattttcggtcgtttattttttaaaagcggaagggcggaggggtcgttttttgggtgttatcggtcgg

SEQ ID NO: 36416 - DNA, 641 bp, Artificial Sequence
  chemically treated genomic DNA (Homo sapiens) CpG-island No: 36416
ccgaccgataacacccaaaaaacgacccctccgcccttccgcttttaaaaaataaacgaccgaaaataaaaatcacaataaccaacgtccccgaaaaacgccgacttccaaatacgaataaaactacgccccgccgaacccgaaaaactttcactaaacgtccgcgacgcgcaaacaataaaccgaaaaaacgccttatcgcgacgcgcaaaccttccccgaacgcgacgaaaaacgacgacgcttccgcgaaccaaaaccgccaatcccccgtcccccgatcgcccgccgccccctaaccaaaccccgccgccgccgcccgctacttcctcccgctcttcctccctacgacctcgcgacctcctaacgaaacgcgaccgacgaaaaaacttaataaaataaccgcgacaacgacacgcgcgaccgaccccgaaaaaacaaaaaaaaaatatatataacccaaaatccgaaaataaaacgccgataaaaaccgaaacgacgcaactctacctcctaaaacctattatttaccgaatacacatacacacgcgcttaacaaaaaattaacacatcctaccgccgcttatctatccatcgataaccaaacaaacgacgcaatcactttacacgaaaaaaacttt

SEQ ID NO: 36417 - DNA, 541 bp, Artificial Sequence
  chemically treated genomic DNA (Homo sapiens) CpG-island No: 36417
cgtcgatcgtcgtttttatagtttcggtttcggttgttggatgagaattagcgtggttcgtttaagggggaggggataggcgttgtaaggagtagagtcgcgggaagtaattttttaagttataatgttagtcgcgaatataggaaaaagtttatttcgtcgtcgcgggttttatgttttcgtcggtaatgattatgtttgtgggagtaacggttatcggcgcgcggttttttgggagttgtttgtttcggcgggtacgttcgtcggttatcggaaggattttattggtcggtgcgtgtaggtgagtttggcggttttaaggttggcgcggaggttttattgttagtcgggtgcggtcggagcgtaggattaggttagagtcgttttaagtgatttgggcgtgtcggagaaacgagtagggtttgcgggggttttttatgcggcgaggtcgagtaagggtaggggtttgatgggatcgagattttttcggttttagggacggggaaggtcggtttagttaggttttttttgtaggagcgtt

SEQ ID NO: 36418 - DNA, 541 bp, Artificial Sequence
  chemically treated genomic DNA (Homo sapiens) CpG-island No: 36418
aacgctcctacaaaaaaaacctaactaaaccgaccttccccgtccctaaaaccgaaaaaatctcgatcccatcaaacccctacccttactcgacctcgccgcataaaaaacccccgcaaaccctactcgtttctccgacacgcccaaatcacttaaaacgactctaacctaatcctacgctccgaccgcacccgactaacaataaaacctccgcgccaaccttaaaaccgccaaactcacctacacgcaccgaccaataaaatccttccgataaccgacgaacgtacccgccgaaacaaacaactcccaaaaaaccgcgcgccgataaccgttactcccacaaacataatcattaccgacgaaaacataaaacccgcgacgacgaaataaactttttcctatattcgcgactaacattataacttaaaaaattacttcccgcgactctactccttacaacgcctatcccctcccccttaaacgaaccacgctaattctcatccaacaaccgaaaccgaaactataaaaacgacgatcgacg

SEQ ID NO: 36419 - DNA, 541 bp, Artificial Sequence
  chemically treated genomic DNA (Homo sapiens) CpG-island No: 36419
ggcgtttttgtaggggaaatttgattggatcggtttttttcgtttttgaggtcggagagatttcgattttattaggtttttgtttttgttcggtttcgtcgtatgagggattttcgtaggttttgttcgttttttcggtacgtttagattatttggggcggttttggtttggttttgcgtttcggtcgtattcggttaatagtgaaattttcgcgttaattttgaggtcgttagatttatttgtacgtatcggttaatggggttttttcggtggtcggcggacgtgttcgtcggaataaataatttttagaaggtcgcgcgtcggtagtcgttgtttttataggtatagttattgtcggcgggagtatggggttcgcggcggcgggatgagtttttttttgtgttcgcgattagtattgtggtttagggagttgtttttcgcggttttgttttttgtagcgtttgtttttttttttttaaacgggttacgttggtttttatttagtaatcgaagtcgagattgtggaggcggcggtcggcg

SEQ ID NO: 36420 - DNA, 541 bp, Artificial Sequence
  chemically treated genomic DNA (Homo sapiens) CpG-island No: 36420
cgccgaccgccgcctccacaatctcgacttcgattactaaataaaaaccaacgtaacccgtttaaaaaaaaaaaaacaaacgctacaaaaaacaaaaccgcgaaaaacaactccctaaaccacaatactaatcgcgaacacaaaaaaaaactcatcccgccgccgcgaaccccatactcccgccgacaataactatacctataaaaacaacgactaccgacgcgcgaccttctaaaaattatttattccgacgaacacgtccgccgaccaccgaaaaaaccccattaaccgatacgtacaaataaatctaacgacctcaaaattaacgcgaaaatttcactattaaccgaatacgaccgaaacgcaaaaccaaaccaaaaccgccccaaataatctaaacgtaccgaaaaaacgaacaaaacctacgaaaatccctcatacgacgaaaccgaacaaaaacaaaaacctaataaaatcgaaatctctccgacctcaaaaacgaaaaaaaccgatccaatcaaatttcccctacaaaaacgcc

SEQ ID NO: 36421 - DNA, 522 bp, Artificial Sequence
  chemically treated genomic DNA (Homo sapiens) CpG-island No: 36421
gatcgtcgagggatatcgacgagtattttttttttgttgttcggtttcgttgtcgtttttaatcggttagttaagatggtcgtcgttgggtgaggtaagtggcgttcgcgggggcgtttgggagttgtagttcgggacggcggttgacgtattttttcgtcggtcgacgggcgttattgtagcgcgcgcgtcgggtgagtgtcgcgcgaaatttgcgttcgtcggggattgcgttgggcgggtttagaatcgttagttgggggcgagcgcggtttttgtatttttcgtcgagttcgggtattttgagtcggtcgtgtttgtagttttttcgtcgttttgtgggatgggtcggtgattcggaatttcgaggggagatagtgttttcggggcgtcgcggtggagagaatagatcgtttcggaagcgtggggtttgggttagggaggcgatttttttcgatgcgcgggatagaggaggttcggtgttttttcggggaggggaaaattggttttatttagttttgt

SEQ ID NO: 36422 - DNA, 522 bp, Artificial Sequence
  chemically treated genomic DNA (Homo sapiens) CpG-island No: 36422
acaaaactaaataaaaccaattttcccctccccgaaaaaacaccgaacctcctctatcccgcgcatcgaaaaaaatcgcctccctaacccaaaccccacgcttccgaaacgatctattctctccaccgcgacgccccgaaaacactatctcccctcgaaattccgaatcaccgacccatcccacaaaacgacgaaaaaactacaaacacgaccgactcaaaatacccgaactcgacgaaaaatacaaaaaccgcgctcgcccccaactaacgattctaaacccgcccaacgcaatccccgacgaacgcaaatttcgcgcgacactcacccgacgcgcgcgctacaataacgcccgtcgaccgacgaaaaaatacgtcaaccgccgtcccgaactacaactcccaaacgcccccgcgaacgccacttacctcacccaacgacgaccatcttaactaaccgattaaaaacgacaacgaaaccgaacaacaaaaaaaaaatactcgtcgatatccctcgacgatc

SEQ ID NO: 36423 - DNA, 522 bp, Artificial Sequence
  chemically treated genomic DNA (Homo sapiens) CpG-island No: 36423
ataggattggataggattagttttttttttttcgagaagatatcgagttttttttgtttcgcgtatcggaggggatcgtttttttggtttagattttacgttttcggagcgatttgttttttttatcgcggcgtttcgaaagtattgttttttttcggggtttcgggttatcgatttattttatagagcggcgggaggattgtaggtacggtcggtttagggtattcgagttcggcggaaaatgtagaggtcgcgttcgtttttaattaacggttttggattcgtttagcgtagttttcgacggacgtaggtttcgcgcggtatttattcggcgcgcgcgttataatggcgttcgtcggtcggcggggaagtgcgttagtcgtcgtttcgaattataatttttagacgttttcgcgggcgttatttgttttatttagcggcggttattttgattggtcggttaggggcggtagcgaagtcggatagtaggaggaggatattcgtcgatgtttttcggcggtt

SEQ ID NO: 36424 - DNA, 522 bp, Artificial Sequence
  chemically treated genomic DNA (Homo sapiens) CpG-island No: 36424
aaccgccgaaaaacatcgacgaatatcctcctcctactatccgacttcgctaccgcccctaaccgaccaatcaaaataaccgccgctaaataaaacaaataacgcccgcgaaaacgtctaaaaattataattcgaaacgacgactaacgcacttccccgccgaccgacgaacgccattataacgcgcgcgccgaataaataccgcgcgaaacctacgtccgtcgaaaactacgctaaacgaatccaaaaccgttaattaaaaacgaacgcgacctctacattttccgccgaactcgaataccctaaaccgaccgtacctacaatcctcccgccgctctataaaataaatcgataacccgaaaccccgaaaaaaaacaatactttcgaaacgccgcgataaaaaaaacaaatcgctccgaaaacgtaaaatctaaaccaaaaaaacgatcccctccgatacgcgaaacaaaaaaaactcgatatcttctcgaaaaaaaaaaaactaatcctatccaatcctat

SEQ ID NO: 36425 - DNA, 612 bp, Artificial Sequence
  chemically treated genomic DNA (Homo sapiens) CpG-island No: 36425
tttttattcgttttttttttttcgtacgtatttattcgtattaaggatatagagttttcgatttaatttgaaagggaagtagttttcgtttttgaaagagtagcgagggagggcgagcgaacgaacgtttcggattttattcgcgtttcggtttagattcgcgtttcggtttagattcgaattcgcggaagcgttttcgttgatgttttcgttcggattgttggagtcggggtcgtttcgggtttttttttttgtacgtagttttagggttacggttaggagcgagggcgaggggttttaggtttcggttcgcgtcgtttaggtttcgggaggcgagttttgtagcggtcggatttagggataaattttttcggcgggcgtcgtttatcgtgtgcgtagagtagggcgttaagtagtagcgcgttttattgtcgttttatggtgtcgttcgcgtcgttcgttcggggtttcgtcggttttcgtcggacggcgcggcggataagttcgcggagggttttcgagggggaagcgtttcgggtgtacggcggtttgcgcgtttcgtaagtcgttttcgggtcgtcgtcgtttttagtgttgttagagtcgacgttg

SEQ ID NO: 36426 - DNA, 612 bp, Artificial Sequence
  chemically treated genomic DNA (Homo sapiens) CpG-island No: 36426
caacgtcgactctaacaacactaaaaacgacgacgacccgaaaacgacttacgaaacgcgcaaaccgccgtacacccgaaacgcttccccctcgaaaaccctccgcgaacttatccgccgcgccgtccgacgaaaaccgacgaaaccccgaacgaacgacgcgaacgacaccataaaacgacaataaaacgcgctactacttaacgccctactctacgcacacgataaacgacgcccgccgaaaaaatttatccctaaatccgaccgctacaaaactcgcctcccgaaacctaaacgacgcgaaccgaaacctaaaacccctcgccctcgctcctaaccgtaaccctaaaactacgtacaaaaaaaaaaacccgaaacgaccccgactccaacaatccgaacgaaaacatcaacgaaaacgcttccgcgaattcgaatctaaaccgaaacgcgaatctaaaccgaaacgcgaataaaatccgaaacgttcgttcgctcgccctccctcgctactctttcaaaaacgaaaactacttccctttcaaattaaatcgaaaactctatatccttaatacgaataaatacgtacgaaaaaaaaaaaacgaataaaaa

SEQ ID NO: 36427 - DNA, 612 bp, Artificial Sequence
  chemically treated genomic DNA (Homo sapiens) CpG-island No: 36427
tagcgtcggttttggtagtattggaggcggcggcggttcgagggcgatttgcggggcgcgtaggtcgtcgtgtattcgggacgtttttttttcggggatttttcgcgggtttattcgtcgcgtcgttcggcgggagtcggcgggatttcgggcgagcggcgcgggcggtattatgaggcggtagtggggcgcgttgttgtttggcgttttgttttgcgtatacggtaagcggcgttcgtcgggaaagtttgtttttgggttcggtcgttgtaggattcgtttttcgggatttggacggcgcgggtcggggtttgagatttttcgttttcgtttttagtcgtggttttggggttgcgtgtaggggagaggattcggagcggtttcggttttagtagttcgagcgggggtattagcggaggcgttttcgcgggttcgggtttgggtcggggcgcgggtttgggtcggggcgcgggtaaggttcggggcgttcgttcgttcgttttttttcgttgtttttttaagagcgggggttgttttttttttaggttaggtcgggggttttgtgtttttggtgcgaatgaatgcgtgcgaagaaagggaggcgggtgagga

SEQ ID NO: 36428 - DNA, 612 bp, Artificial Sequence
  chemically treated genomic DNA (Homo sapiens) CpG-island No: 36428
tcctcacccgcctccctttcttcgcacgcattcattcgcaccaaaaacacaaaacccccgacctaacctaaaaaaaaaacaacccccgctcttaaaaaaacaacgaaaaaaaacgaacgaacgaacgccccgaaccttacccgcgccccgacccaaacccgcgccccgacccaaacccgaacccgcgaaaacgcctccgctaatacccccgctcgaactactaaaaccgaaaccgctccgaatcctctcccctacacgcaaccccaaaaccacgactaaaaacgaaaacgaaaaatctcaaaccccgacccgcgccgtccaaatcccgaaaaacgaatcctacaacgaccgaacccaaaaacaaactttcccgacgaacgccgcttaccgtatacgcaaaacaaaacgccaaacaacaacgcgccccactaccgcctcataataccgcccgcgccgctcgcccgaaatcccgccgactcccgccgaacgacgcgacgaataaacccgcgaaaaatccccgaaaaaaaaacgtcccgaatacacgacgacctacgcgccccgcaaatcgccctcgaaccgccgccgcctccaatactaccaaaaccgacgcta

SEQ ID NO: 36429 - DNA, 731 bp, Artificial Sequence
  chemically treated genomic DNA (Homo sapiens) CpG-island No: 36429
gtttatttatttatttatttgataattacgcgagaggtattttagtagggtcggttttcggggttttcgttttagttttggtaaatcgttgtcgttaggcgcggttttgtatcgttcgcgtttcgcggacgttgttattcgcgttacgttgcggcgcgttttggttatttggagtttaatttcggttttcgtcgtatacgagcgtttacgttttcggttttgttcgtcgtaggtttttcggttttcggttcgtttcgtcgttttagatttgtcgggttcgtggggtaagtggggcgcgcgtttggagatttttagtcgtttaggatttaggggtttttttgcgcgcgcgatgtttgtattcgagggtttcgcgggtggggtaggtttatcgattatttattttagttgggttagaattaagcggtttgttttaagtcgtttgaaatcgtttgggtcgtcgtatatttcgtagtgttttcgttttttattggttttcgacggatcgtttatcggatttttattggtttatttgaaaggtttgtgggtacgcgtcgttcgtagttttaaaggggtcgcgcgtagtcgtgtttttttttggattagacgtcgtttgtacgggtggggacgttggtcgttgtcgggggtaagtttgtcgattttagaaagaaaggcgaaagaatgtgtgtagattcgggtatttttggtcgttagtatgtttgttttatttaatt

SEQ ID NO: 36430 - DNA, 731 bp, Artificial Sequence
  chemically treated genomic DNA (Homo sapiens) CpG-island No: 36430
aattaaataaaacaaacatactaacgaccaaaaatacccgaatctacacacattctttcgcctttctttctaaaatcgacaaacttacccccgacaacgaccaacgtccccacccgtacaaacgacgtctaatccaaaaaaaaacacgactacgcgcgacccctttaaaactacgaacgacgcgtacccacaaacctttcaaataaaccaataaaaatccgataaacgatccgtcgaaaaccaataaaaaacgaaaacactacgaaatatacgacgacccaaacgatttcaaacgacttaaaacaaaccgcttaattctaacccaactaaaataaataatcgataaacctaccccacccgcgaaaccctcgaatacaaacatcgcgcgcgcaaaaaaacccctaaatcctaaacgactaaaaatctccaaacgcgcgccccacttaccccacgaacccgacaaatctaaaacgacgaaacgaaccgaaaaccgaaaaacctacgacgaacaaaaccgaaaacgtaaacgctcgtatacgacgaaaaccgaaattaaactccaaataaccaaaacgcgccgcaacgtaacgcgaataacaacgtccgcgaaacgcgaacgatacaaaaccgcgcctaacgacaacgatttaccaaaactaaaacgaaaaccccgaaaaccgaccctactaaaatacctctcgcgtaattatcaaataaataaataaataaac

SEQ ID NO: 36431 - DNA, 731 bp, Artificial Sequence
  chemically treated genomic DNA (Homo sapiens) CpG-island No: 36431
aattaaataaagtaaatatgttgacgattaaggatgttcgggtttatatatattttttcgtttttttttttggagtcggtagatttgttttcggtagcgattagcgtttttattcgtgtaggcggcgtttggtttagagggaaatacggttgcgcgcggtttttttaaggttgcgggcggcgcgtgtttataggttttttaaatggattaataaaagttcgatgggcggttcgtcgaggattaataaagaacgaggatattgcggggtgtgcggcggtttaagcggttttaaacggtttagagtaggtcgtttggttttgatttagttgaggtgagtggtcggtgggtttgttttattcgcgaggttttcgagtgtaggtatcgcgcgcgtagaggagtttttgaattttgggcggttggaggtttttagacgcgcgttttatttgttttacgaattcggtaggtttgaggcggcgaagcgagtcggaggtcgggggatttgcggcgggtagggtcgggggcgtgggcgttcgtgtgcggcggaggtcggggttgggttttaggtggttagagcgcgtcgtagcgtggcgcgggtggtagcgttcgcggggcgcgggcggtgtagggtcgcgtttggcggtagcgatttattaagattagggcgggggtttcgagagtcggttttgttagagtgtttttcgcgtaattgttaagtgaatgaataagtaagt

SEQ ID NO: 36432 - DNA, 731 bp, Artificial Sequence
  chemically treated genomic DNA (Homo sapiens) CpG-island No: 36432
acttacttattcattcacttaacaattacgcgaaaaacactctaacaaaaccgactctcgaaacccccgccctaatcttaataaatcgctaccgccaaacgcgaccctacaccgcccgcgccccgcgaacgctaccacccgcgccacgctacgacgcgctctaaccacctaaaacccaaccccgacctccgccgcacacgaacgcccacgcccccgaccctacccgccgcaaatcccccgacctccgactcgcttcgccgcctcaaacctaccgaattcgtaaaacaaataaaacgcgcgtctaaaaacctccaaccgcccaaaattcaaaaactcctctacgcgcgcgatacctacactcgaaaacctcgcgaataaaacaaacccaccgaccactcacctcaactaaatcaaaaccaaacgacctactctaaaccgtttaaaaccgcttaaaccgccgcacaccccgcaatatcctcgttctttattaatcctcgacgaaccgcccatcgaacttttattaatccatttaaaaaacctataaacacgcgccgcccgcaaccttaaaaaaaccgcgcgcaaccgtatttccctctaaaccaaacgccgcctacacgaataaaaacgctaatcgctaccgaaaacaaatctaccgactccaaaaaaaaaaacgaaaaaatatatataaacccgaacatccttaatcgtcaacatatttactttatttaatt

SEQ ID NO: 36433 - DNA, 780 bp, Artificial Sequence
  chemically treated genomic DNA (Homo sapiens) CpG-island No: 36433
tcgcggcggtttcgcgagttcgtcgggtgggtttagtttagcgtacgtcggagtcgagcgtagggggcggggaagggatttgttgtagttgtagtcgtttgggcgtttttggagcgcgcggtgattttttcggtcggttcgttttatgtagtttcgttgcggaagtgtagcggggggaggcggcggttatcgcggtattaagtacgagaggtcggggttcggttttttgtagtattaggttttgggagtcgcgcgcggcgcgttttagtggttcgattcgtcgtgcgttcggcgtttatcgtagtttgtatgtttcgcgttgcgttttgttcggttttcgtagttttttgttcgtatcgttgtagtcgggcgtcggagtaatatgtttattcgagtgaaatttgtcgtggttaattttatgggcggtattatggttggtagtttaggtttcgagtacggcggcggtagttgcggaggttcggatttgtttttgcgttttttttacgggcggttagagtttttggggttgttttaggacgaggtggagtgtagcgtcgattatatcgttcgttttatttttatttttaaggagattcggcggttgttttgggttattggttacgtagagtgagtgtagcgatatcggcggcgtttttgtttttttcgcggttttttttcgtacggttttagttttttttttttttgtttttcggtttagggttttattagttgcggcgtttaggttcggcgggagtttttatttatttggtattttttttt

SEQ ID NO: 36434 - DNA, 780 bp, Artificial Sequence
  chemically treated genomic DNA (Homo sapiens) CpG-island No: 36434
aaaaaaaaataccaaataaataaaaactcccgccgaacctaaacgccgcaactaataaaaccctaaaccgaaaaacaaaaaaaaaaaaaactaaaaccgtacgaaaaaaaaccgcgaaaaaaacaaaaacgccgccgatatcgctacactcactctacgtaaccaataacccaaaacaaccgccgaatctccttaaaaataaaaataaaacgaacgatataatcgacgctacactccacctcgtcctaaaacaaccccaaaaactctaaccgcccgtaaaaaaaacgcaaaaacaaatccgaacctccgcaactaccgccgccgtactcgaaacctaaactaccaaccataataccgcccataaaattaaccacgacaaatttcactcgaataaacatattactccgacgcccgactacaacgatacgaacaaaaaactacgaaaaccgaacaaaacgcaacgcgaaacatacaaactacgataaacgccgaacgcacgacgaatcgaaccactaaaacgcgccgcgcgcgactcccaaaacctaatactacaaaaaaccgaaccccgacctctcgtacttaataccgcgataaccgccgcctccccccgctacacttccgcaacgaaactacataaaacgaaccgaccgaaaaaatcaccgcgcgctccaaaaacgcccaaacgactacaactacaacaaatcccttccccgccccctacgctcgactccgacgtacgctaaactaaacccacccgacgaactcgcgaaaccgccgcga

SEQ ID NO: 36435 - DNA, 780 bp, Artificial Sequence
  chemically treated genomic DNA (Homo sapiens) CpG-island No: 36435
aaaaggaaatgttaggtaagtaagagttttcgtcgagtttggacgtcgtagttagtggagttttgggtcgagaagtaggagagaagagggttggaatcgtgcggggaagggtcgcgaggagagtaggggcgtcgtcggtgtcgttgtatttattttgcgtagttagtggtttagggtagtcgtcgagtttttttgaggatgaggatggggcgggcgatgtggtcggcgttgtattttatttcgttttgagatagttttaggaattttggtcgttcgtaggggaaacgtaggggtaggttcgagttttcgtagttgtcgtcgtcgtgttcggagtttgagttgttagttatgatgtcgtttatgaaattggttacggtagattttattcgagtgagtatattatttcggcgttcggttgtagcggtgcgagtaggaggttgcgggggtcgggtaaggcgtagcgcggggtatgtaggttgcggtgggcgtcgggcgtacggcgagtcgggttattgggacgcgtcgcgcgcggtttttagagtttagtgttgtagggggtcgagtttcggtttttcgtgtttagtgtcgcggtggtcgtcgttttttttcgttatattttcgtaacggagttgtatggagcgggtcgatcgggggagttatcgcgcgttttaggagcgtttaggcggttgtagttgtagtaggtttttttttcgttttttgcgttcggtttcggcgtgcgttgaattgagtttattcggcgagttcgcggagtcgtcgcgg

SEQ ID NO: 36436 - DNA, 780 bp, Artificial Sequence
  chemically treated genomic DNA (Homo sapiens) CpG-island No: 36436
ccgcgacgactccgcgaactcgccgaataaactcaattcaacgcacgccgaaaccgaacgcaaaaaacgaaaaaaaaacctactacaactacaaccgcctaaacgctcctaaaacgcgcgataactcccccgatcgacccgctccatacaactccgttacgaaaatataacgaaaaaaaacgacgaccaccgcgacactaaacacgaaaaaccgaaactcgaccccctacaacactaaactctaaaaaccgcgcgcgacgcgtcccaataacccgactcgccgtacgcccgacgcccaccgcaacctacataccccgcgctacgccttacccgacccccgcaacctcctactcgcaccgctacaaccgaacgccgaaataatatactcactcgaataaaatctaccgtaaccaatttcataaacgacatcataactaacaactcaaactccgaacacgacgacgacaactacgaaaactcgaacctacccctacgtttcccctacgaacgaccaaaattcctaaaactatctcaaaacgaaataaaatacaacgccgaccacatcgcccgccccatcctcatcctcaaaaaaactcgacgactaccctaaaccactaactacgcaaaataaatacaacgacaccgacgacgcccctactctcctcgcgacccttccccgcacgattccaaccctcttctctcctacttctcgacccaaaactccactaactacgacgtccaaactcgacgaaaactcttacttacctaacatttcctttt

SEQ ID NO: 36437 - DNA, 554 bp, Artificial Sequence
  chemically treated genomic DNA (Homo sapiens) CpG-island No: 36437
ggttgaggattttattgttacgttattatttgttgatgaagtggtttatttttagtttttcggtggtattatcggtatatcgaaattgatttcgcgtatttataacgattattattatagcgtgcgtcgtagcgtcgagatttgttagtttatataatagatacgttatttgtgcgcgatttcggcggtttataattacgttatgagttcgttaggatcgttgggcgttttttttgtcggaggaacggttgttttggcggtcgattttagcgttacgttttgttttttattgattgaaaaatattaggttaacgttatcgcgttggtgttattcgtagttagtttgtggttgtaggcgttgatcgaaggcgaaagtcgggcgtagtttgtttcgttgaaattgttataggtcggcggcgtacgtttttttgttatttttgcggcgcgtattttcgttgagattggttgttagttgtagtaggtgtttggtatggcggaagggttggtgaattatattcgatttgatgatagcgcggagaaattatttatattta

SEQ ID NO: 36438 - DNA, 554 bp, Artificial Sequence
  chemically treated genomic DNA (Homo sapiens) CpG-island No: 36438
taaatataaataatttctccgcgctatcatcaaatcgaatataattcaccaacccttccgccataccaaacacctactacaactaacaaccaatctcaacgaaaatacgcgccgcaaaaataacaaaaaaacgtacgccgccgacctataacaatttcaacgaaacaaactacgcccgactttcgccttcgatcaacgcctacaaccacaaactaactacgaataacaccaacgcgataacgttaacctaatatttttcaatcaataaaaaacaaaacgtaacgctaaaatcgaccgccaaaacaaccgttcctccgacaaaaaaaacgcccaacgatcctaacgaactcataacgtaattataaaccgccgaaatcgcgcacaaataacgtatctattatataaactaacaaatctcgacgctacgacgcacgctataataataatcgttataaatacgcgaaatcaatttcgatataccgataataccaccgaaaaactaaaaataaaccacttcatcaacaaataataacgtaacaataaaatcctcaacc

SEQ ID NO: 36439 - DNA, 554 bp, Artificial Sequence
  chemically treated genomic DNA (Homo sapiens) CpG-island No: 36439
tgggtatggataattttttcgcgttattattaagtcgggtgtagtttattagttttttcgttatgttaaatatttgttgtaattgatagttaattttagcgggaatacgcgtcgtaagggtggtagaaagacgtgcgtcgtcgatttgtaatagttttagcgaggtaagttgcgttcggttttcgttttcgattagcgtttgtaattataggttgattgcgggtggtattagcgcggtaacgttaatttgatgttttttaattaatgggaaatagagcgtggcgttgggatcggtcgttagaataatcgttttttcggtaagaaagacgtttagcgattttggcgaatttatggcgtagttatgagtcgtcgggatcgcgtataggtagcgtgtttgttgtgtgaattgataaatttcgacgttacgacgtacgttgtagtagtagtcgttatgagtgcgcgggattagtttcggtgtgtcggtggtgttatcggaaagttggaaataggttattttattagtaggtgatggcgtggtagtaaaatttttagtt

SEQ ID NO: 36440 - DNA, 554 bp, Artificial Sequence
  chemically treated genomic DNA (Homo sapiens) CpG-island No: 36440
aactaaaaattttactaccacgccatcacctactaataaaataacctatttccaactttccgataacaccaccgacacaccgaaactaatcccgcgcactcataacgactactactacaacgtacgtcgtaacgtcgaaatttatcaattcacacaacaaacacgctacctatacgcgatcccgacgactcataactacgccataaattcgccaaaatcgctaaacgtctttcttaccgaaaaaacgattattctaacgaccgatcccaacgccacgctctatttcccattaattaaaaaacatcaaattaacgttaccgcgctaataccacccgcaatcaacctataattacaaacgctaatcgaaaacgaaaaccgaacgcaacttacctcgctaaaactattacaaatcgacgacgcacgtctttctaccacccttacgacgcgtattcccgctaaaattaactatcaattacaacaaatatttaacataacgaaaaaactaataaactacacccgacttaataataacgcgaaaaaattatccataccca

SEQ ID NO: 36441 - DNA, 513 bp, Artificial Sequence
  chemically treated genomic DNA (Homo sapiens) CpG-island No: 36441
aaaaatcgttagagggatagcgttcggaaagtatatttagcgtggcgttaaaaatacgttttggtagatttttttacggtgcggtacggcgtacgcgggagtattattcgtttatttgtaatgtatttatcgtcgcggcggtaacggtttgttgcgtaaggacgtcgagaggattatgcggtggtgttaggttttttagtttgtttgcgaatatatattttataatgattgcggaatcgattaaattacgtcgggtacggggggaaaaatagttttttagatatatcgttaatttgatgttcggcgcgattaatgcgttgtaatttattggtaatagaaagcggcgttgttatttgaattattagatttatcgcgtttatattaatttttagtttaagattggaggttgcgatacgtagcgtaatttattcgattttagcgattgttcggtgattgttcgttgttttttagatacggagtcgtggtgtgatcggtaataaaacgtcgttattt

SEQ ID NO: 36442 - DNA, 513 bp, Artificial Sequence
  chemically treated genomic DNA (Homo sapiens) CpG-island No: 36442
aaataacgacgttttattaccgatcacaccacgactccgtatctaaaaaacaacgaacaatcaccgaacaatcgctaaaatcgaataaattacgctacgtatcgcaacctccaatcttaaactaaaaattaatataaacgcgataaatctaataattcaaataacaacgccgctttctattaccaataaattacaacgcattaatcgcgccgaacatcaaattaacgatatatctaaaaaactatttttccccccgtacccgacgtaatttaatcgattccgcaatcattataaaatatatattcgcaaacaaactaaaaaacctaacaccaccgcataatcctctcgacgtccttacgcaacaaaccgttaccgccgcgacgataaatacattacaaataaacgaataatactcccgcgtacgccgtaccgcaccgtaaaaaaatctaccaaaacgtatttttaacgccacgctaaatatactttccgaacgctatccctctaacgattttt

SEQ ID NO: 36443 - DNA, 513 bp, Artificial Sequence
  chemically treated genomic DNA (Homo sapiens) CpG-island No: 36443
aagtagcgacgttttattgtcggttatattacggtttcgtgtttaaagaataacgagtaattatcgaatagtcgttgaaatcgggtgaattacgttgcgtgtcgtaatttttagttttgaattggggattgatatgggcgcggtggatttggtgatttaggtggtaacgtcgttttttgttgttagtgggttataacgtattggtcgcgtcggatattaggttggcggtgtatttaaagggttgttttttttttcgtattcggcgtgatttagtcgatttcgtagttattgtagagtgtatgttcgtaggtaggttggaaaatttgatattatcgtataattttttcgacgtttttgcgtagtaaatcgttgtcgtcgcggcgatggatgtattataggtagacgaatggtattttcgcgtacgtcgtgtcgtatcgtggaaagatttgttaagacgtgtttttgacgttacgttggatatgtttttcgggcgttatttttttggcgattttt

SEQ ID NO: 36444 - DNA, 513 bp, Artificial Sequence
  chemically treated genomic DNA (Homo sapiens) CpG-island No: 36444
aaaaatcgccaaaaaaataacgcccgaaaaacatatccaacgtaacgtcaaaaacacgtcttaacaaatctttccacgatacgacacgacgtacgcgaaaataccattcgtctacctataatacatccatcgccgcgacgacaacgatttactacgcaaaaacgtcgaaaaaattatacgataatatcaaattttccaacctacctacgaacatacactctacaataactacgaaatcgactaaatcacgccgaatacgaaaaaaaaaacaaccctttaaatacaccgccaacctaatatccgacgcgaccaatacgttataacccactaacaacaaaaaacgacgttaccacctaaatcaccaaatccaccgcgcccatatcaatccccaattcaaaactaaaaattacgacacgcaacgtaattcacccgatttcaacgactattcgataattactcgttattctttaaacacgaaaccgtaatataaccgacaataaaacgtcgctactt

SEQ ID NO: 36445 - DNA, 783 bp, Artificial Sequence
  chemically treated genomic DNA (Homo sapiens) CpG-island No: 36445
  misc_feature (776)..(776): n is either a, c, g or t
cgcggggtagagtcgcggttcggattttttttttttcggcgtttcgagttgcggaagtttaggtcgttcgtcgtttttcggcgtacgcggtcgcgtttcgtcgtttttttcggtaatttttttcggggcggagttttcgggttttttttattatcggtatttgtcgcgggcgttcgagttgcgggtacggggtattttgaggttgtgtattcgggatttcggcgcgtattgttcgcgggttacgcggtgagggtggttgcgggcgagagggtttatgttttaggggaagtttaaggttcgttagtcgcggcggttgcgacgagatttggtaagagttaaacgtcggttttaggagtagcgagtgcgcgcgattttttagatcgacgcgttttttttgtttttcgtttttttttttagttagcgtttcgttcgcgtttcgttcggttgttgcggaggcggttttttaggaattttttaggaatcggttttacgtgatcgcgggtttcgttattgttttaaagaggttcggtcgtaatatataggttttagggaagatcgggtgagagcgttcgggtgtagggcgggcggtgtgtacgtcggggtcggtttgtttttggttttatatttcggggtgttcgggcgtaagttagagattttttcggtcgtcggttatagttaatttcgtttcggcggtcggagtttgttttttattcgggttagttgagcgttcgggtttagggaaggatagcgatttttggtttttggtttgttacggnggtgggt

SEQ ID NO: 36446 - DNA, 783 bp, Artificial Sequence
  chemically treated genomic DNA (Homo sapiens) CpG-island No: 36446
  misc_feature (8)..(8): n is either a, c, g or t
acccaccnccgtaacaaaccaaaaaccaaaaatcgctatccttccctaaacccgaacgctcaactaacccgaataaaaaacaaactccgaccgccgaaacgaaattaactataaccgacgaccgaaaaaatctctaacttacgcccgaacaccccgaaatataaaaccaaaaacaaaccgaccccgacgtacacaccgcccgccctacacccgaacgctctcacccgatcttccctaaaacctatatattacgaccgaacctctttaaaacaataacgaaacccgcgatcacgtaaaaccgattcctaaaaaattcctaaaaaaccgcctccgcaacaaccgaacgaaacgcgaacgaaacgctaactaaaaaaaaaaacgaaaaacaaaaaaaacgcgtcgatctaaaaaatcgcgcgcactcgctactcctaaaaccgacgtttaactcttaccaaatctcgtcgcaaccgccgcgactaacgaaccttaaacttcccctaaaacataaaccctctcgcccgcaaccaccctcaccgcgtaacccgcgaacaatacgcgccgaaatcccgaatacacaacctcaaaataccccgtacccgcaactcgaacgcccgcgacaaataccgataataaaaaaaacccgaaaactccgccccgaaaaaaattaccgaaaaaaacgacgaaacgcgaccgcgtacgccgaaaaacgacgaacgacctaaacttccgcaactcgaaacgccgaaaaaaaaaaaatccgaaccgcgactctaccccgcg

SEQ ID NO: 36447 - DNA, 783 bp, Artificial Sequence
  chemically treated genomic DNA (Homo sapiens) CpG-island No: 36447
  misc_feature (8)..(8): n is either a, c, g or t
atttattntcgtggtaggttaagggttaaggatcgttatttttttttgaattcgggcgtttagttggttcgggtagggggtaggtttcggtcgtcgaaacggggttggttgtagtcggcggtcggggagatttttagtttgcgttcgagtatttcggggtgtggggttagaggtaggtcgatttcggcgtgtatatcgttcgttttgtattcgagcgtttttattcggttttttttgaagtttgtgtattgcgatcgagtttttttaaagtagtagcggggttcgcggttacgtgaggtcgatttttggaaagtttttggaaagtcgttttcgtagtagtcgggcggggcgcgagcggagcgttgattggggagggaggcggggagtaagggaggcgcgtcggtttgggaagtcgcgcgtattcgttgtttttgggatcgacgtttaatttttgttaagtttcgtcgtagtcgtcgcggttggcgggttttgggttttttttgaagtatgagttttttcgttcgtagttatttttatcgcgtggttcgcggatagtgcgcgtcggggtttcgggtgtatagttttaggatatttcgtgttcgtagttcgggcgttcgcggtaggtatcggtagtgggggaagttcgaaggtttcgtttcgaggagagttatcggggagggcggcgaggcgcggtcgcgtgcgtcggggagcggcggacggtttgggttttcgtagttcggagcgtcggggaagagagagttcgaatcgcggttttgtttcgcg

SEQ ID NO: 36448 - DNA, 783 bp, Artificial Sequence
  chemically treated genomic DNA (Homo sapiens) CpG-island No: 36448
  misc_feature (776)..(776): n is either a, c, g or t
cgcgaaacaaaaccgcgattcgaactctctcttccccgacgctccgaactacgaaaacccaaaccgtccgccgctccccgacgcacgcgaccgcgcctcgccgccctccccgataactctcctcgaaacgaaaccttcgaacttcccccactaccgatacctaccgcgaacgcccgaactacgaacacgaaatatcctaaaactatacacccgaaaccccgacgcgcactatccgcgaaccacgcgataaaaataactacgaacgaaaaaactcatacttcaaaaaaaacccaaaacccgccaaccgcgacgactacgacgaaacttaacaaaaattaaacgtcgatcccaaaaacaacgaatacgcgcgacttcccaaaccgacgcgcctcccttactccccgcctccctccccaatcaacgctccgctcgcgccccgcccgactactacgaaaacgactttccaaaaactttccaaaaatcgacctcacgtaaccgcgaaccccgctactactttaaaaaaactcgatcgcaatacacaaacttcaaaaaaaaccgaataaaaacgctcgaatacaaaacgaacgatatacacgccgaaatcgacctacctctaaccccacaccccgaaatactcgaacgcaaactaaaaatctccccgaccgccgactacaaccaaccccgtttcgacgaccgaaacctaccccctacccgaaccaactaaacgcccgaattcaaaaaaaaataacgatccttaacccttaacctaccacganaataaat

SEQ ID NO: 36449 - DNA, 826 bp, Artificial Sequence
  chemically treated genomic DNA (Homo sapiens) CpG-island No: 36449
cgattatggaagtcgcgttcggcgggggtttcgtagtttattttcgacgttcgggtagtcgttttcgcggtagtgttagtttttgaatttggtcgttaagattttgggttgtagtcgtagtttcgttcgggagttagatgttgttgggtttgcggggttcgcggtatcgatttgttgattgtatttcgtgtaaagggaggcgttcgacgtttttttcggtcggggttcgagttcgggagtttaattttgagtagttgcggaaaatagtaaattttttagcgtgttaagaagttatttttaagaagtttttttcgcgttttgcgtttcgttaggtttgagtttttggagaattattttttttacgtatttttaaggatttaggattttgcgagcgtgtttttcgcggttttttggaagtaagggacgtatttttattttattttttgttttttatttcgatttcgttttttagttgtttttttggggaggcgttttttttcgtacgcgtcgcggtcgatcggttttttatttgtttgatcgagttttcgtagggttttcgttagacgcgtcgtttgcggggatggttttttcgtcgatttcgcggttttttattggtttcgcgtttttttttcgttattttcggagggtttaaggtatcgtagggttatgagagaagggttatcgcggtaaagataggtggtcgttcgagttggggttagagaagggttcgcgtttttttttgaagttagtgcgaattttaaaacgagtttttgcggggtgttcgaaatggtggtagagagagaagggatggggtttttttttttta

SEQ ID NO: 36450 - DNA, 826 bp, Artificial Sequence
  chemically treated genomic DNA (Homo sapiens) CpG-island No: 36450
taaaaaaaaaaaaccccatcccttctctctctaccaccatttcgaacaccccgcaaaaactcgttttaaaattcgcactaacttcaaaaaaaaacgcgaacccttctctaaccccaactcgaacgaccacctatctttaccgcgataacccttctctcataaccctacgataccttaaaccctccgaaaataacgaaaaaaaaacgcgaaaccaataaaaaaccgcgaaatcgacgaaaaaaccatccccgcaaacgacgcgtctaacgaaaaccctacgaaaactcgatcaaacaaataaaaaaccgatcgaccgcgacgcgtacgaaaaaaaacgcctccccaaaaaaacaactaaaaaacgaaatcgaaataaaaaacaaaaaataaaataaaaatacgtcccttacttccaaaaaaccgcgaaaaacacgctcgcaaaatcctaaatccttaaaaatacgtaaaaaaaataattctccaaaaactcaaacctaacgaaacgcaaaacgcgaaaaaaacttcttaaaaataacttcttaacacgctaaaaaatttactattttccgcaactactcaaaattaaactcccgaactcgaaccccgaccgaaaaaaacgtcgaacgcctccctttacacgaaatacaatcaacaaatcgataccgcgaaccccgcaaacccaacaacatctaactcccgaacgaaactacgactacaacccaaaatcttaacgaccaaattcaaaaactaacactaccgcgaaaacgactacccgaacgtcgaaaataaactacgaaacccccgccgaacgcgacttccataatcg

SEQ ID NO: 36451 - DNA, 826 bp, Artificial Sequence
  chemically treated genomic DNA (Homo sapiens) CpG-island No: 36451
tggggagaaagagttttattttttttttttttgttattatttcggatatttcgtagggattcgttttgggattcgtattgattttaaggaaggacgcgaatttttttttgattttagttcgggcggttatttgtttttgtcgcggtgattttttttttatgattttgcggtgttttgagtttttcgggaatggcggggaagggacgcggagttagtgggggatcgcggggtcggcggaggagttattttcgtaggcggcgcgtttggcgaaggttttgcgggagttcggttagataggtagggagtcgatcggtcgcgacgcgtgcgggagggagcgtttttttaaggaagtagttaggaagcggggtcgaggtgggaagtaaagaataagatggaaatacgttttttgtttttaagggatcgcggagagtacgttcgtagggttttgggtttttgggaatgcgtaaggaaagtggttttttagggatttaggtttggcggagcgtagagcgcgggaagagttttttggaaatagttttttagtacgttggaagatttattgtttttcgtagttgtttagggttaggttttcgggttcgaatttcggtcggggaaagcgtcgggcgtttttttttgtacggggtgtaattagtaagtcggtgtcgcgggtttcgtaggtttagtagtatttggttttcgggcggagttgcggttgtagtttaggattttggcggttaagtttagggattgatattgtcgcgagggcggttgttcgggcgtcgagagtaggttgcgaagttttcgtcgagcgcggtttttatggtcg

SEQ ID NO: 36452 - DNA, 826 bp, Artificial Sequence
  chemically treated genomic DNA (Homo sapiens) CpG-island No: 36452
cgaccataaaaaccgcgctcgacgaaaacttcgcaacctactctcgacgcccgaacaaccgccctcgcgacaatatcaatccctaaacttaaccgccaaaatcctaaactacaaccgcaactccgcccgaaaaccaaatactactaaacctacgaaacccgcgacaccgacttactaattacaccccgtacaaaaaaaaacgcccgacgctttccccgaccgaaattcgaacccgaaaacctaaccctaaacaactacgaaaaacaataaatcttccaacgtactaaaaaactatttccaaaaaactcttcccgcgctctacgctccgccaaacctaaatccctaaaaaaccactttccttacgcattcccaaaaacccaaaaccctacgaacgtactctccgcgatcccttaaaaacaaaaaacgtatttccatcttattctttacttcccacctcgaccccgcttcctaactacttccttaaaaaaacgctccctcccgcacgcgtcgcgaccgatcgactccctacctatctaaccgaactcccgcaaaaccttcgccaaacgcgccgcctacgaaaataactcctccgccgaccccgcgatcccccactaactccgcgtcccttccccgccattcccgaaaaactcaaaacaccgcaaaatcataaaaaaaaaatcaccgcgacaaaaacaaataaccgcccgaactaaaatcaaaaaaaaattcgcgtccttccttaaaatcaatacgaatcccaaaacgaatccctacgaaatatccgaaataataacaaaaaaaaaaaaaataaaactctttctcccca

SEQ ID NO: 36453 - DNA, 608 bp, Artificial Sequence
  chemically treated genomic DNA (Homo sapiens) CpG-island No: 36453
gattttttcggtgcgttttttagcgcggtttttttcggtgcgttagttatcgtggtttttttcggcgcgtttttcggcgcggtttttttcggggttttttagcgcggcgtttttttgggggtttttcggcgtagtttttttcggggatttttcggcgtcgtttttttcggggtattcggggtttttcggcgcggtttttttcgggggtttttcggcgcggttgttttcgggggtttttcggcgcggtttttttcgggggtttttcgtcgcggttttgtttttttcgggggttttttagtatggttttttttcgcgcggttttttttgggtttttttagcgcggtatttttttgggggttttttagcgcggtatttttttcgggggttttttagcgcggtattttttcggcggttttttagtgcggtttttttagattttttttagcgcggttttttttatttttttgggagggtttgaatacggttagtacggatttgggcggacggcgcgggacgggtgattattggcgttgttgaggtgagttgtgtgtttcgcggtcgttttagattataggcgttagtagtgtagtttggtttgggtagtgcgt

SEQ ID NO: 36454 - DNA, 608 bp, Artificial Sequence
  chemically treated genomic DNA (Homo sapiens) CpG-island No: 36454
acgcactacccaaaccaaactacactactaacgcctataatctaaaacgaccgcgaaacacacaactcacctcaacaacgccaataatcacccgtcccgcgccgtccgcccaaatccgtactaaccgtattcaaaccctcccaaaaaaataaaaaaaaccgcgctaaaaaaaatctaaaaaaaccgcactaaaaaaccgccgaaaaaataccgcgctaaaaaacccccgaaaaaaataccgcgctaaaaaacccccaaaaaaataccgcgctaaaaaaacccaaaaaaaaccgcgcgaaaaaaaaccatactaaaaaacccccgaaaaaaacaaaaccgcgacgaaaaacccccgaaaaaaaccgcgccgaaaaacccccgaaaacaaccgcgccgaaaaacccccgaaaaaaaccgcgccgaaaaaccccgaataccccgaaaaaaacgacgccgaaaaatccccgaaaaaaactacgccgaaaaacccccaaaaaaacgccgcgctaaaaaaccccgaaaaaaaccgcgccgaaaaacgcgccgaaaaaaaccacgataactaacgcaccgaaaaaaaccgcgctaaaaaacgcaccgaaaaaatc

SEQ ID NO: 36455 - DNA, 608 bp, Artificial Sequence
  chemically treated genomic DNA (Homo sapiens) CpG-island No: 36455
gcgtattgtttaggttaggttgtattgttgacgtttgtgatttgggacggtcgcggggtatatagtttattttagtaacgttagtgattattcgtttcgcgtcgttcgtttaggttcgtgttgatcgtgtttaaatttttttagagagatggggagggtcgcgttgaggagagtttgggagaatcgtattgaggagtcgtcgggagagtgtcgcgttgaggagttttcggggagagtgtcgcgttgaggagtttttaggagagtgtcgcgttgaggaggtttagggaggatcgcgcggaggagaattatgttgaggagttttcggggagaatagaatcgcggcgagaggttttcggagagaatcgcgtcgaagaattttcggggataatcgcgtcgaagaattttcggggagaatcgcgtcgaaaagtttcgggtgtttcgaggagaacggcgtcgaggagttttcggggagaattgcgtcgaggagtttttagaagagcgtcgcgttgaggagtttcgaggagaatcgcgtcgaggggcgcgtcggggagaattacgatgattgacgtatcgaggaggatcgcgttgaggggcgtatcgggagaatt

SEQ ID NO: 36456 - DNA, 608 bp, Artificial Sequence
  chemically treated genomic DNA (Homo sapiens) CpG-island No: 36456
aattctcccgatacgcccctcaacgcgatcctcctcgatacgtcaatcatcgtaattctccccgacgcgcccctcgacgcgattctcctcgaaactcctcaacgcgacgctcttctaaaaactcctcgacgcaattctccccgaaaactcctcgacgccgttctcctcgaaacacccgaaacttttcgacgcgattctccccgaaaattcttcgacgcgattatccccgaaaattcttcgacgcgattctctccgaaaacctctcgccgcgattctattctccccgaaaactcctcaacataattctcctccgcgcgatcctccctaaacctcctcaacgcgacactctcctaaaaactcctcaacgcgacactctccccgaaaactcctcaacgcgacactctcccgacgactcctcaatacgattctcccaaactctcctcaacgcgaccctccccatctctctaaaaaaatttaaacacgatcaacacgaacctaaacgaacgacgcgaaacgaataatcactaacgttactaaaataaactatataccccgcgaccgtcccaaatcacaaacgtcaacaatacaacctaacctaaacaatacgc

SEQ ID NO: 36457 - DNA, 503 bp, Artificial Sequence
  chemically treated genomic DNA (Homo sapiens) CpG-island No: 36457
gagggtgggagtggcgcgggtagggagcggaggggggggtgggggggggcggggtgggtcgtcgtttgttgttgtgtgatgtgagagtgttaagagtagcggacggggggggtagtggggcgggaggggagcggggaggggatttagtgtagtgggtgggaggcggcgcgtcgtagggaacgggcgggggggtgggattggggaagggagttgtggtggttaagcgtggaggtggagtgtgtggaggggagttagcgggcgtcgggtgaggtcgggttgacgtataagggtaggagtttgtttagaagcgcggggtgttaggtgcgtagagtgggggtcgtttgtgtttttagcgttagtttgtgtttgagaatcgatgagtagaagaaggaagggtagattcgtgggttcgttgcgtttcgtttgggttcgtgatttgttttagtgatattcgtagtaggtagggttatgatttttattaaaagtttttttagttttttttg

SEQ ID NO: 36458 - DNA, 503 bp, Artificial Sequence
  chemically treated genomic DNA (Homo sapiens) CpG-island No: 36458
caaaaaaaactaaaaaaacttttaataaaaatcataaccctacctactacgaatatcactaaaacaaatcacgaacccaaacgaaacgcaacgaacccacgaatctacccttccttcttctactcatcgattctcaaacacaaactaacgctaaaaacacaaacgacccccactctacgcacctaacaccccgcgcttctaaacaaactcctacccttatacgtcaacccgacctcacccgacgcccgctaactcccctccacacactccacctccacgcttaaccaccacaactcccttccccaatcccacccccccgcccgttccctacgacgcgccgcctcccacccactacactaaatcccctccccgctcccctcccgccccactaccccccccgtccgctactcttaacactctcacatcacacaacaacaaacgacgacccaccccgcccccccccacccccccctccgctccctacccgcgccactcccaccctc

SEQ ID NO: 36459 - DNA, 503 bp, Artificial Sequence
  chemically treated genomic DNA (Homo sapiens) CpG-island No: 36459
taaagaggattgaggaggtttttgatagggattatagttttgtttgttgcggatattattggagtaggttacgggtttaagcgaagcgtagcgaatttacgagtttgttttttttttttttgtttatcggtttttaggtataggttgacgttggagatataaacgatttttattttgcgtatttaatatttcgcgtttttggataggtttttatttttatacgttagttcgattttattcggcgttcgttgatttttttttatatattttatttttacgtttaattattataatttttttttttaattttattttttcgttcgttttttacggcgcgtcgttttttatttattatattaaatttttttttcgtttttttttcgttttattgtttttttcgttcgttgtttttagtatttttatattatatagtaataaacggcgatttatttcgtttttttttattttttttttcgttttttattcgcgttatttttattttt

SEQ ID NO: 36460 - DNA, 503 bp, Artificial Sequence
  chemically treated genomic DNA (Homo sapiens) CpG-island No: 36460
aaaaataaaaataacgcgaataaaaaacgaaaaaaaaaataaaaaaaaacgaaataaatcgccgtttattactatataatataaaaatactaaaaacaacgaacgaaaaaaacaataaaacgaaaaaaaaacgaaaaaaaaatttaatataataaataaaaaacgacgcgccgtaaaaaacgaacgaaaaaataaaattaaaaaaaaaaattataataattaaacgtaaaaataaaatatataaaaaaaaatcaacgaacgccgaataaaatcgaactaacgtataaaaataaaaacctatccaaaaacgcgaaatattaaatacgcaaaataaaaatcgtttatatctccaacgtcaacctatacctaaaaaccgataaacaaaaaaaaaaaaaacaaactcgtaaattcgctacgcttcgcttaaacccgtaacctactccaataatatccgcaacaaacaaaactataatccctatcaaaaacctcctcaatcctcttta

SEQ ID NO: 36461 - DNA, 746 bp, Artificial Sequence
  chemically treated genomic DNA (Homo sapiens) CpG-island No: 36461
ttgcggaggagggcgggggtcgggtaagtagagggcgtttagttcgggggcgtcggtttgggttgggcgtttagagtttatttcggcgcgcgggtcgcgggcgcgtggggtagtggtttttttagtcgggaagttgttgtttacgtttcggtggttgttgcggtttcgttagggttgtatcggggtttcgcgtagacgttttttcgcgatttgttgtagtttaggcggtggcggtggcggtagtagcggcggcggtggaggtggcgcgggcgatagttcggttcggcgcggtttttgaattgtttaatttttgttcgcgtcgggtttaagcgttcggtcgttgttttcgcgttgagcgtttgcgtatcgggtttcgtttaggtgaggggcgtgtgttcggagttcgttgggcgcgttcggttcggttcggtttcgtcgtacgttcgtttttttggtttggtcgaggatttcggggtttggacgtgttaacgttattttcgcgcgtcgaagttgtgacggtttattaagtagagatttgcgaggtatatagagagggaatgaggcggaatcgttcgggggttcgttgatattgtagagtttttcgtagtatcgttgttttaaatttcgtttttttaggcgtgcgcgtatagcgagttagaggaggtttcgtttcgatttggggtttttcgcggtttttagttcgggggttcgggttttcgaagagatttttggtaatggtagaggtt

SEQ ID NO: 36462 - DNA, 746 bp, Artificial Sequence
  chemically treated genomic DNA (Homo sapiens) CpG-island No: 36462
aacctctaccattaccaaaaatctcttcgaaaacccgaacccccgaactaaaaaccgcgaaaaaccccaaatcgaaacgaaacctcctctaactcgctatacgcgcacgcctaaaaaaacgaaatttaaaacaacgatactacgaaaaactctacaatatcaacgaacccccgaacgattccgcctcattccctctctatatacctcgcaaatctctacttaataaaccgtcacaacttcgacgcgcgaaaataacgttaacacgtccaaaccccgaaatcctcgaccaaaccaaaaaaacgaacgtacgacgaaaccgaaccgaaccgaacgcgcccaacgaactccgaacacacgcccctcacctaaacgaaacccgatacgcaaacgctcaacgcgaaaacaacgaccgaacgcttaaacccgacgcgaacaaaaattaaacaattcaaaaaccgcgccgaaccgaactatcgcccgcgccacctccaccgccgccgctactaccgccaccgccaccgcctaaactacaacaaatcgcgaaaaaacgtctacgcgaaaccccgatacaaccctaacgaaaccgcaacaaccaccgaaacgtaaacaacaacttcccgactaaaaaaaccactaccccacgcgcccgcgacccgcgcgccgaaataaactctaaacgcccaacccaaaccgacgcccccgaactaaacgccctctacttacccgacccccgccctcctccgcaa

SEQ ID NO: 36463 - DNA, 746 bp, Artificial Sequence
  chemically treated genomic DNA (Homo sapiens) CpG-island No: 36463
gatttttgttattgttaaggattttttcggggattcgagttttcgggttgaggatcgcgggggattttaggtcgggacggagttttttttggttcgttgtgcgcgtacgtttggaaaggcgggatttaaggtagcgatgttgcgggaggttttgtagtgttaacgagttttcgaacggtttcgttttattttttttttgtgtgtttcgtaagtttttgtttagtaaatcgttatagtttcggcgcgcgagagtggcgttggtacgtttaaatttcggggttttcggttaggttaggggggcgggcgtgcggcggggtcgggtcgggtcgggcgcgtttagcgggtttcgggtatacgttttttatttgggcgaggttcggtgcgtaggcgtttagcgcgggggtagcggtcgggcgtttaagttcggcgcgggtaagagttggatagtttaggggtcgcgtcgggtcgagttgtcgttcgcgttatttttatcgtcgtcgttgttatcgttatcgttatcgtttgggttgtagtagatcgcgggagaacgtttgcgcgaagtttcggtgtagttttggcgggatcgtagtaattatcggagcgtgagtaatagtttttcggttggaggagttattgttttacgcgttcgcggttcgcgcgtcgaggtaagttttgggcgtttagtttagatcggcgttttcggattgggcgttttttgtttgttcggttttcgttttttttcgtag

SEQ ID NO: 36464 - DNA, 746 bp, Artificial Sequence
  chemically treated genomic DNA (Homo sapiens) CpG-island No: 36464
ctacgaaaaaaaacgaaaaccgaacaaacaaaaaacgcccaatccgaaaacgccgatctaaactaaacgcccaaaacttacctcgacgcgcgaaccgcgaacgcgtaaaacaataactcctccaaccgaaaaactattactcacgctccgataattactacgatcccgccaaaactacaccgaaacttcgcgcaaacgttctcccgcgatctactacaacccaaacgataacgataacgataacaacgacgacgataaaaataacgcgaacgacaactcgacccgacgcgacccctaaactatccaactcttacccgcgccgaacttaaacgcccgaccgctacccccgcgctaaacgcctacgcaccgaacctcgcccaaataaaaaacgtatacccgaaacccgctaaacgcgcccgacccgacccgaccccgccgcacgcccgcccccctaacctaaccgaaaaccccgaaatttaaacgtaccaacgccactctcgcgcgccgaaactataacgatttactaaacaaaaacttacgaaacacacaaaaaaaaaataaaacgaaaccgttcgaaaactcgttaacactacaaaacctcccgcaacatcgctaccttaaatcccgcctttccaaacgtacgcgcacaacgaaccaaaaaaaactccgtcccgacctaaaatcccccgcgatcctcaacccgaaaactcgaatccccgaaaaaatccttaacaataacaaaaatc

SEQ ID NO: 36465 - DNA, 649 bp, Artificial Sequence
  chemically treated genomic DNA (Homo sapiens) CpG-island No: 36465
agagttcgcgggagaagtcgagttcgggaggttttttttggcggtcgtcgtttttagtttattttcgtcgttggttttcgtcgtttatattttaggattattattagcggcgagtttggttttttgtagttttttttgcgaagaatttgtttttgacgttggttcggtcgttatttcgtgttttagcggttgtaggttttcggggttgttttttatatcgggtcgttcgtttttagttttatggagatcgcggttattttttcgtagttagcgttttggacgttatgatagttgtattggtagtaatagcgttttggcgcggtttcggttaggtacgttatcggggagagtattaagaacgcgcgcgggcgcgcgttatcgttttgttcgtgcgttttgagtttgttttcgtttgattgcgcgttgagaggcgaaggcgaattatttagtagtcgtttacgtggtttagtttttttcgtgcgttcgatcgagttcgttttcggaaggtcgggcgtggagggcgtggttaggagggcgcggtcggggggcgcgttttcgcggtttagttttagtaggaaaatatttttttattatgtggtcggaagttgaatttcggggtagtttttttgtgtgcggtttttttaaaggg

SEQ ID NO: 36466 - DNA, 649 bp, Artificial Sequence
  chemically treated genomic DNA (Homo sapiens) CpG-island No: 36466
ccctttaaaaaaaccgcacacaaaaaaactaccccgaaattcaacttccgaccacataataaaaaaatattttcctactaaaactaaaccgcgaaaacgcgccccccgaccgcgccctcctaaccacgccctccacgcccgaccttccgaaaacgaactcgatcgaacgcacgaaaaaaactaaaccacgtaaacgactactaaataattcgccttcgcctctcaacgcgcaatcaaacgaaaacaaactcaaaacgcacgaacaaaacgataacgcgcgcccgcgcgcgttcttaatactctccccgataacgtacctaaccgaaaccgcgccaaaacgctattactaccaatacaactatcataacgtccaaaacgctaactacgaaaaaataaccgcgatctccataaaactaaaaacgaacgacccgatataaaaaacaaccccgaaaacctacaaccgctaaaacacgaaataacgaccgaaccaacgtcaaaaacaaattcttcgcaaaaaaaactacaaaaaaccaaactcgccgctaataataatcctaaaatataaacgacgaaaaccaacgacgaaaataaactaaaaacgacgaccgccaaaaaaaacctcccgaactcgacttctcccgcgaactct

SEQ ID NO: 36467 - DNA, 649 bp, Artificial Sequence
  chemically treated genomic DNA (Homo sapiens) CpG-island No: 36467
ttttttaaagaagtcgtatataagggagttgtttcggagtttaattttcggttatatagtgagaggatgtttttttattggagttgagtcgcgggggcgcgtttttcggtcgcgtttttttagttacgttttttacgttcggtttttcgagagcgagttcggtcggacgtacggaaagggttgggttacgtgggcggttgttgagtggttcgttttcgttttttagcgcgtagttaggcggaggtaagtttagagcgtacggatagagcggtagcgcgcgttcgcgcgcgtttttagtatttttttcggtgacgtgtttgatcgaggtcgcgttagggcgttgttgttgttaatatagttgttatggcgtttaaggcgttggttgcggagaagtggtcgcggtttttatagagttgggggcgggcggttcggtatggagagtagtttcgagagtttgtagtcgttagaatacggggtggcggtcgggttagcgttagggataggtttttcgtaggaagggttataggagattaggttcgtcgttggtgatggttttggggtatgggcggcggagattagcggcgggaatgggttgggggcggcggtcgttaggaggagtttttcggattcggtttttttcgcgggtttt

SEQ ID NO: 36468 - DNA, 649 bp, Artificial Sequence
  chemically treated genomic DNA (Homo sapiens) CpG-island No: 36468
aaaacccgcgaaaaaaaccgaatccgaaaaactcctcctaacgaccgccgcccccaacccattcccgccgctaatctccgccgcccataccccaaaaccatcaccaacgacgaacctaatctcctataacccttcctacgaaaaacctatccctaacgctaacccgaccgccaccccgtattctaacgactacaaactctcgaaactactctccataccgaaccgcccgcccccaactctataaaaaccgcgaccacttctccgcaaccaacgccttaaacgccataacaactatattaacaacaacaacgccctaacgcgacctcgatcaaacacgtcaccgaaaaaaatactaaaaacgcgcgcgaacgcgcgctaccgctctatccgtacgctctaaacttacctccgcctaactacgcgctaaaaaacgaaaacgaaccactcaacaaccgcccacgtaacccaaccctttccgtacgtccgaccgaactcgctctcgaaaaaccgaacgtaaaaaacgtaactaaaaaaacgcgaccgaaaaacgcgcccccgcgactcaactccaataaaaaaacatcctctcactatataaccgaaaattaaactccgaaacaactcccttatatacgacttctttaaaaaa

SEQ ID NO: 36469 - DNA, 1003 bp, Artificial Sequence
  chemically treated genomic DNA (Homo sapiens) CpG-island No: 36469
agtttttacgacggggaaaggtcgtattgatagagaaggaagttatacgaagtggtagtggtcggattcgagtttcgagtttagtatacgcgggggaaaaggaagcgggcggtttttggagaaacggggatggagttgtagatgcgagttcgcgaggtaggtttcgtggtgttcgggtatcggtaggaagaatggaggaggggaggcgaggttgcgaggtgtcggggagtcgggcggcgggtcggttcgcggtcgattttattttagttcgcgttcgggatttttttagtttcggtattcggcgtgcgtttcgcgtgcgtcgatttttttcggaggaatagttatcgttttatattcggggattggagaaattcggtaattttgcgcgagaaatgttttttattttgtagtacgtcgagaaagaaaaaaatgttaggcgatgacggcggaggaaggatgatttatttatgttgtttttcgagggtgaggaatcggcggggcgaggcgaaggtttgtggtgcgggcggcgcggttttgtgttttttttttattttcgtttttttcgtagttagggagggattcgcggggggcgtcgcggggaggagtagttggtgttttgtaggcggcgcggtcgagcggggacgagcggcggggggcggggcggggcggggcggggcgggattggcgggcgtattgcgggcggatcggtttcgagcggcgggcggcggaggcgtggaatcggtttgaagagtttcggtttcgattcgtagtttacgagcgtttcgttttttttatcgagtatgtttagtgttttttttatttttttttttgtggcgagcgaggttaagcgtgcgggtgggcgtgtgtttgtagatcggttgtagcgcggtagaggatttttatggcggtcgtttgagaggcggagggcgggttcggagaaaatagggaatggggatattgagttcgatttgttagtagaggatttatcgttgttttgtttttt

SEQ ID NO: 36470 - DNA, 1003 bp, Artificial Sequence
  chemically treated genomic DNA (Homo sapiens) CpG-island No: 36470
aaaaaacaaaacaacgataaatcctctactaacaaatcgaactcaatatccccattccctattttctccgaacccgccctccgcctctcaaacgaccgccataaaaatcctctaccgcgctacaaccgatctacaaacacacgcccacccgcacgcttaacctcgctcgccacaaaaaaaaaaataaaaaaaacactaaacatactcgataaaaaaaacgaaacgctcgtaaactacgaatcgaaaccgaaactcttcaaaccgattccacgcctccgccgcccgccgctcgaaaccgatccgcccgcaatacgcccgccaatcccgccccgccccgccccgccccgccccccgccgctcgtccccgctcgaccgcgccgcctacaaaacaccaactactcctccccgcgacgccccccgcgaatccctccctaactacgaaaaaaacgaaaataaaaaaaaaacacaaaaccgcgccgcccgcaccacaaaccttcgcctcgccccgccgattcctcaccctcgaaaaacaacataaataaatcatccttcctccgccgtcatcgcctaacatttttttctttctcgacgtactacaaaataaaaaacatttctcgcgcaaaattaccgaatttctccaatccccgaatataaaacgataactattcctccgaaaaaaatcgacgcacgcgaaacgcacgccgaataccgaaactaaaaaaatcccgaacgcgaactaaaataaaatcgaccgcgaaccgacccgccgcccgactccccgacacctcgcaacctcgcctcccctcctccattcttcctaccgatacccgaacaccacgaaacctacctcgcgaactcgcatctacaactccatccccgtttctccaaaaaccgcccgcttccttttcccccgcgtatactaaactcgaaactcgaatccgaccactaccacttcgtataacttccttctctatcaatacgacctttccccgtcgtaaaaact

SEQ ID NO: 36471 - DNA, 1003 bp, Artificial Sequence
  chemically treated genomic DNA (Homo sapiens) CpG-island No: 36471
ggaaagtaaggtagcggtgagttttttgttagtagatcgggtttaatatttttattttttgtttttttcgggttcgtttttcgttttttaggcggtcgttatgaagattttttgtcgcgttgtagtcggtttgtaaatatacgtttattcgtacgtttagtttcgttcgttatagagggaggggtggaaaaggtattgagtatgttcggtggggagggcggggcgttcgtgggttgcgagtcggggtcggagttttttaggtcggttttacgttttcgtcgttcgtcgttcggagtcggttcgttcgtagtgcgttcgttagtttcgtttcgtttcgtttcgtttcgtttttcgtcgttcgttttcgttcggtcgcgtcgtttgtagagtattagttgttttttttcgcggcgtttttcgcgggtttttttttggttgcgggagagacggaggtagagggaggatatagagtcgcgtcgttcgtattatagattttcgtttcgtttcgtcggttttttattttcggggagtaatatgggtaagttatttttttttcgtcgttatcgtttgatatttttttttttttcggcgtgttgtagggtgggaagtatttttcgcgtaaagttgtcggatttttttagttttcgggtgtgagacggtggttgttttttcggggagagtcggcgtacgcggaacgtacgtcgggtgtcggggttgggagggtttcgagcgcgggttggggtggggtcggtcgcggatcgattcgtcgttcggtttttcggtatttcgtagtttcgtttttttttttttattttttttgtcggtgttcgggtattacggagtttgtttcgcgggttcgtatttgtagttttattttcgtttttttagaggtcgttcgtttttttttttttcgcgtgtattgagttcgaggttcgggttcgattattattatttcgtgtaatttttttttttgttagtgcgattttttttcgtcgtggagatt

SEQ ID NO: 36472 - DNA, 1003 bp, Artificial Sequence
  chemically treated genomic DNA (Homo sapiens) CpG-island No: 36472
aatctccacgacgaaaaaaaatcgcactaacaaaaaaaaaaattacacgaaataataataatcgaacccgaacctcgaactcaatacacgcgaaaaaaaaaaaaacgaacgacctctaaaaaaacgaaaataaaactacaaatacgaacccgcgaaacaaactccgtaatacccgaacaccgacaaaaaaaataaaaaaaaaaaaacgaaactacgaaataccgaaaaaccgaacgacgaatcgatccgcgaccgaccccaccccaacccgcgctcgaaaccctcccaaccccgacacccgacgtacgttccgcgtacgccgactctccccgaaaaaacaaccaccgtctcacacccgaaaactaaaaaaatccgacaactttacgcgaaaaatacttcccaccctacaacacgccgaaaaaaaaaaaaatatcaaacgataacgacgaaaaaaaaataacttacccatattactccccgaaaataaaaaaccgacgaaacgaaacgaaaatctataatacgaacgacgcgactctatatcctccctctacctccgtctctcccgcaaccaaaaaaaaacccgcgaaaaacgccgcgaaaaaaaacaactaatactctacaaacgacgcgaccgaacgaaaacgaacgacgaaaaacgaaacgaaacgaaacgaaacgaaactaacgaacgcactacgaacgaaccgactccgaacgacgaacgacgaaaacgtaaaaccgacctaaaaaactccgaccccgactcgcaacccacgaacgccccgccctccccaccgaacatactcaataccttttccacccctccctctataacgaacgaaactaaacgtacgaataaacgtatatttacaaaccgactacaacgcgacaaaaaatcttcataacgaccgcctaaaaaacgaaaaacgaacccgaaaaaaacaaaaaataaaaatattaaacccgatctactaacaaaaaactcaccgctaccttactttcc

SEQ ID NO: 36473 - DNA, 651 bp, Artificial Sequence
  chemically treated genomic DNA (Homo sapiens) CpG-island No: 36473
  misc_feature (222)..(222): n is either a, c, g or t
gcgtcggtgacggacgtggtaacgagtgcggttcgtttcgtcgggagttgattggttgcgcggggcggtttcgagggttcggtcgtaggagtttcgcgtattttagttttgtagttttcggagttagtgtcgcgcgttcgtcgtttcgcgtttttttgttcgtcgtattttcgggagtcggggcgtatttagttcgtagcgtcgttttttcgttcgcgtcgntttcgatcgtaggtcgagggtcgttattggtcggggggatcgggtagtagtttgcggtcgcggagtcgggtaacgttggggattgcgttttttgttttcggaggtttttggaagtttgcggtaggacgcgcgcggggaggcggcggaggtagtttcgacgtcgcggagaatagggcgtagagtcggtatgggtatcgggcgtagcgaggggggtcgtcgcggggtagttttgggcgtgttgttggcgttgggcgcggcgtttttggtcgtgggttcggttagcgagtacgattacgtgagtttttagtcggatatcggttcgtattagagcgggcgtttttatattaagttattttagtgcgtggatattttcgcggatttgcggttgtgttataacgtgggttataagaagatggtgttgtttaattt

SEQ ID NO: 36474 - DNA, 651 bp, Artificial Sequence
  chemically treated genomic DNA (Homo sapiens) CpG-island No: 36474
  misc_feature (430)..(430): n is either a, c, g or t
aaattaaacaacaccatcttcttataacccacgttataacacaaccgcaaatccgcgaaaatatccacgcactaaaataacttaatataaaaacgcccgctctaatacgaaccgatatccgactaaaaactcacgtaatcgtactcgctaaccgaacccacgaccaaaaacgccgcgcccaacgccaacaacacgcccaaaactaccccgcgacgacccccctcgctacgcccgatacccataccgactctacgccctattctccgcgacgtcgaaactacctccgccgcctccccgcgcgcgtcctaccgcaaacttccaaaaacctccgaaaacaaaaaacgcaatccccaacgttacccgactccgcgaccgcaaactactacccgatccccccgaccaataacgaccctcgacctacgatcgaaancgacgcgaacgaaaaaacgacgctacgaactaaatacgccccgactcccgaaaatacgacgaacaaaaaaacgcgaaacgacgaacgcgcgacactaactccgaaaactacaaaactaaaatacgcgaaactcctacgaccgaaccctcgaaaccgccccgcgcaaccaatcaactcccgacgaaacgaaccgcactcgttaccacgtccgtcaccgacgc

SEQ ID NO: 36475 - DNA, 651 bp, Artificial Sequence
  chemically treated genomic DNA (Homo sapiens) CpG-island No: 36475
  misc_feature (430)..(430): n is either a, c, g or t
aggttgggtagtattatttttttgtagtttacgttgtggtatagtcgtaggttcgcggggatgtttacgtattgaggtggtttggtgtagaagcgttcgttttggtacgggtcgatgttcgattggaagtttacgtagtcgtattcgttggtcgagtttacggttagaagcgtcgcgtttagcgttagtagtacgtttagggttgtttcgcggcggtttttttcgttgcgttcgatgtttatgtcggttttgcgttttgtttttcgcgacgtcggggttgttttcgtcgttttttcgcgcgcgttttgtcgtaaatttttagggattttcggggataaaaggcgtagtttttagcgttgttcggtttcgcggtcgtaagttgttgttcggttttttcggttagtggcggttttcggtttgcggtcgaagncggcgcgggcggggaggcggcgttgcgggttgggtgcgtttcggttttcggaggtgcggcgagtaggaaggcgcggggcggcgggcgcgcggtattgatttcggaggttgtagggttggagtgcgcggggtttttacggtcgagttttcggagtcgtttcgcgtagttaattagttttcggcggggcgagtcgtattcgttattacgttcgttatcggcgt

SEQ ID NO: 36476 - DNA, 651 bp, Artificial Sequence
  chemically treated genomic DNA (Homo sapiens) CpG-island No: 36476
  misc_feature (222)..(222): n is either a, c, g or t
acgccgataacgaacgtaataacgaatacgactcgccccgccgaaaactaattaactacgcgaaacgactccgaaaactcgaccgtaaaaaccccgcgcactccaaccctacaacctccgaaatcaataccgcgcgcccgccgccccgcgccttcctactcgccgcacctccgaaaaccgaaacgcacccaacccgcaacgccgcctccccgcccgcgccgncttcgaccgcaaaccgaaaaccgccactaaccgaaaaaaccgaacaacaacttacgaccgcgaaaccgaacaacgctaaaaactacgccttttatccccgaaaatccctaaaaatttacgacaaaacgcgcgcgaaaaaacgacgaaaacaaccccgacgtcgcgaaaaacaaaacgcaaaaccgacataaacatcgaacgcaacgaaaaaaaccgccgcgaaacaaccctaaacgtactactaacgctaaacgcgacgcttctaaccgtaaactcgaccaacgaatacgactacgtaaacttccaatcgaacatcgacccgtaccaaaacgaacgcttctacaccaaaccacctcaatacgtaaacatccccgcgaacctacgactataccacaacgtaaactacaaaaaaataatactacccaacct

SEQ ID NO: 36477 - DNA, 538 bp, Artificial Sequence
  chemically treated genomic DNA (Homo sapiens) CpG-island No: 36477
atcggtttatttattcgtgtcgttggttttgcgaggtcgtgcgcgattcgtgcgagtcggttatgtagtttttcggtttttattggttcgagatgtttaagtgtgataagtttttcgagggggacgtttgtatcgttatgacgtcgtttaatgttatcgaagtttttaagttttaaggtaaggttgtttttttttacgtgcgcgagtcgttttttttatttttcggtcggagttgtaggagaattcgcgttattttacgttcgttcgtcgttgggtttcggtgttggggattgagggttcgaggttgttcgtatgttgtgtacgtgatttttaagcgcgtttggtttgttttaggtatcgtttagcgtttttcgcgatttaggtgtacggcggggttggttcgggagcggtagttttgcgttttggtttcgtagggattcgttgtggttttcggagtcgttttttttgggatttaatttcgttttttttatatttgaaataaagttttgcgttttaaataataggggagttttttttt

SEQ ID NO: 36478 - DNA, 538 bp, Artificial Sequence
  chemically treated genomic DNA (Homo sapiens) CpG-island No: 36478
aaaaaaaaactcccctattatttaaaacgcaaaactttatttcaaatataaaaaaaacgaaattaaatcccaaaaaaaacgactccgaaaaccacaacgaatccctacgaaaccaaaacgcaaaactaccgctcccgaaccaaccccgccgtacacctaaatcgcgaaaaacgctaaacgatacctaaaacaaaccaaacgcgcttaaaaatcacgtacacaacatacgaacaacctcgaaccctcaatccccaacaccgaaacccaacgacgaacgaacgtaaaataacgcgaattctcctacaactccgaccgaaaaataaaaaaaacgactcgcgcacgtaaaaaaaaacaaccttaccttaaaacttaaaaacttcgataacattaaacgacgtcataacgatacaaacgtccccctcgaaaaacttatcacacttaaacatctcgaaccaataaaaaccgaaaaactacataaccgactcgcacgaatcgcgcacgacctcgcaaaaccaacgacacgaataaataaaccgat

SEQ ID NO: 36479 - DNA, 538 bp, Artificial Sequence
  chemically treated genomic DNA (Homo sapiens) CpG-island No: 36479
agagggaagtttttttgttatttaaagcgtaaggttttgttttaggtatgggaaaggcgaagttggattttaggaagagcggtttcggggattatagcgagtttttgcgaggttaaggcgtagagttgtcgttttcgggttagtttcgtcgtgtatttgggtcgcgaggggcgttgagcgatatttgggatagattagacgcgtttaggaattacgtgtatagtatgcgagtaatttcgggtttttagtttttagtatcgggatttagcggcgggcgggcgtagggtggcgcgggtttttttgtagtttcggtcgggggatggagggggcggttcgcgtacgtgggaggaggtagttttattttggggtttggaggtttcggtggtattgggcggcgttatggcgatgtagacgtttttttcggggaatttgttatatttaagtatttcgggttagtagaagtcgaagaattgtatgatcggttcgtacgagtcgcgtacggtttcgtagagttagcgatacgggtagatgggtcggt

SEQ ID NO: 36480 - DNA, 538 bp, Artificial Sequence
  chemically treated genomic DNA (Homo sapiens) CpG-island No: 36480
accgacccatctacccgtatcgctaactctacgaaaccgtacgcgactcgtacgaaccgatcatacaattcttcgacttctactaacccgaaatacttaaatataacaaattccccgaaaaaaacgtctacatcgccataacgccgcccaataccaccgaaacctccaaaccccaaaataaaactacctcctcccacgtacgcgaaccgccccctccatcccccgaccgaaactacaaaaaaacccgcgccaccctacgcccgcccgccgctaaatcccgatactaaaaactaaaaacccgaaattactcgcatactatacacgtaattcctaaacgcgtctaatctatcccaaatatcgctcaacgcccctcgcgacccaaatacacgacgaaactaacccgaaaacgacaactctacgccttaacctcgcaaaaactcgctataatccccgaaaccgctcttcctaaaatccaacttcgcctttcccatacctaaaacaaaaccttacgctttaaataacaaaaaaacttccctct

SEQ ID NO: 36481 - DNA, 522 bp, Artificial Sequence
  chemically treated genomic DNA (Homo sapiens) CpG-island No: 36481
gcgtcgggagggagcgtatcgcgttacgtgttcgttcggcgtttcgtttttatttcggttacgtttttcgcgttttttttaaagtttcgttttttagtttcgttattttcgttcgtttcgtttttcgtagttttaagtttagcgttttcggaggcgcggacggtggggtttcgcgttttttgtgtcgggttttgatcgtcgcgcgcgtttatttattttagcggtcgcgggcggaggggcgtacgcgcgcgtagttttttcggagggcggtggggcgaatagtaacgcgcgtattttagtttttggttgttgtgttgagattagttcgcgcgttcgcgcgtttttttttcgaggattcggagtcgttcgcgtattcgttaggggtcgtcgtttcgagttttaggcggacgcgtacgcgttttcgtcgttcggattttagttagttcgtttttcggttatttttggatttttggttgtatttttttttttttttttttttttttttttttttttttttttttt

SEQ ID NO: 36482 - DNA, 522 bp, Artificial Sequence
  chemically treated genomic DNA (Homo sapiens) CpG-island No: 36482
aaaaaaaaaaaaaaaaaaaaaaaaaaaaaaaaaaaaaaaaaaaatacaaccaaaaatccaaaaataaccgaaaaacgaactaactaaaatccgaacgacgaaaacgcgtacgcgtccgcctaaaactcgaaacgacgacccctaacgaatacgcgaacgactccgaatcctcgaaaaaaaaacgcgcgaacgcgcgaactaatctcaacacaacaaccaaaaactaaaatacgcgcgttactattcgccccaccgccctccgaaaaaactacgcgcgcgtacgcccctccgcccgcgaccgctaaaataaataaacgcgcgcgacgatcaaaacccgacacaaaaaacgcgaaaccccaccgtccgcgcctccgaaaacgctaaacttaaaactacgaaaaacgaaacgaacgaaaataacgaaactaaaaaacgaaactttaaaaaaaacgcgaaaaacgtaaccgaaataaaaacgaaacgccgaacgaacacgtaacgcgatacgctccctcccgacgc

SEQ ID NO: 36483 - DNA, 522 bp, Artificial Sequence
  chemically treated genomic DNA (Homo sapiens) CpG-island No: 36483
aaaaggaaagggaggggagagagaaagagagaaaagaggaaagatataattaaaagtttagaggtggtcggggggcgagttggttggggttcgggcggcgggaacgcgtgcgcgttcgtttgagattcggggcggcggtttttggcgagtgcgcgggcggtttcgagttttcgagggagaggcgcgcgggcgcgcgggttagttttagtatagtagttaagagttagggtacgcgcgttgttgttcgttttatcgtttttcgaggggattgcgcgcgcgtgcgttttttcgttcgcggtcgttgaggtgaatgagcgcgcgcggcggttaaagttcgatataaaaggcgcggggttttatcgttcgcgttttcgggagcgttgagtttgaggttgcgaggggcggggcggacgagagtggcggggttgaggggcggggttttgagggaagcgcgaggggcgtggtcggggtgggggcggggcgtcgggcgggtacgtggcgcggtgcgttttttttcggcgt

SEQ ID NO: 36484 - DNA, 522 bp, Artificial Sequence
  chemically treated genomic DNA (Homo sapiens) CpG-island No: 36484
acgccgaaaaaaaacgcaccgcgccacgtacccgcccgacgccccgcccccaccccgaccacgcccctcgcgcttccctcaaaaccccgcccctcaaccccgccactctcgtccgccccgcccctcgcaacctcaaactcaacgctcccgaaaacgcgaacgataaaaccccgcgccttttatatcgaactttaaccgccgcgcgcgctcattcacctcaacgaccgcgaacgaaaaaacgcacgcgcgcgcaatcccctcgaaaaacgataaaacgaacaacaacgcgcgtaccctaactcttaactactatactaaaactaacccgcgcgcccgcgcgcctctccctcgaaaactcgaaaccgcccgcgcactcgccaaaaaccgccgccccgaatctcaaacgaacgcgcacgcgttcccgccgcccgaaccccaaccaactcgccccccgaccacctctaaacttttaattatatctttcctcttttctctctttctctctcccctccctttcctttt

SEQ ID NO: 36485 - DNA, 511 bp, Artificial Sequence
  chemically treated genomic DNA (Homo sapiens) CpG-island No: 36485
cgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcggtcgacgtttttttttatgcgatttttgtattaggaagtagtttagtagtaggttgaggtcgttgagtatcgtcgtcgtaaggaatggtgtatgtaaggagatggcgtttaatagtttttcggttacggggtttgttattatatttacgtcgaaataagcgtttatgagttcgaagtggcgagttcgattttttttatcggtgatgtcggcgatataggcgttagtaatcgtatttgtggcgtcggtgatgtcggttacgatgcgttcggcgtagaggatttgttgttttaaaattttatgtttagtaaaattattatttagaaatgaa

SEQ ID NO: 36486 - DNA, 511 bp, Artificial Sequence
  chemically treated genomic DNA (Homo sapiens) CpG-island No: 36486
ttcatttctaaataataattttactaaacataaaattttaaaacaacaaatcctctacgccgaacgcatcgtaaccgacatcaccgacgccacaaatacgattactaacgcctatatcgccgacatcaccgataaaaaaaatcgaactcgccacttcgaactcataaacgcttatttcgacgtaaatataataacaaaccccgtaaccgaaaaactattaaacgccatctccttacatacaccattccttacgacgacgatactcaacgacctcaacctactactaaactacttcctaatacaaaaatcgcataaaaaaaaacgtcgaccgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcg

SEQ ID NO: 36487 - DNA, 511 bp, Artificial Sequence
  chemically treated genomic DNA (Homo sapiens) CpG-island No: 36487
tttatttttaaataataattttattggatataggattttagggtagtagattttttacgtcggacgtatcgtggtcggtattatcggcgttataggtgcggttgttggcgtttatatcgtcgatattatcgatggggaagatcgggttcgttatttcgggtttatgagcgtttgtttcggcgtgggtatggtggtaggtttcgtggtcgggggattgttgggcgttatttttttgtatgtattattttttgcggcggcggtgtttaacggttttaatttattattgggttgttttttaatgtaggagtcgtataagggagagcgtcgatcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcg

SEQ ID NO: 36488 - DNA, 511 bp, Artificial Sequence
  chemically treated genomic DNA (Homo sapiens) CpG-island No: 36488
cgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgatcgacgctctcccttatacgactcctacattaaaaaacaacccaataataaattaaaaccgttaaacaccgccgccgcaaaaaataatacatacaaaaaaataacgcccaacaatcccccgaccacgaaacctaccaccatacccacgccgaaacaaacgctcataaacccgaaataacgaacccgatcttccccatcgataatatcgacgatataaacgccaacaaccgcacctataacgccgataataccgaccacgatacgtccgacgtaaaaaatctactaccctaaaatcctatatccaataaaattattatttaaaaataaa

SEQ ID NO: 36489 - DNA, 529 bp, Artificial Sequence
  chemically treated genomic DNA (Homo sapiens) CpG-island No: 36489
tatgtcgacgtcgacgcgggcgtttagtagtgggtggaggcggatgtttttagcgtcgggtgtaaggtttttcgttggttttttttcgttaatgcgttcggttcgggattaagatatcgcgttttgagcgtcggcggcgattttagttttttttttcgcgtttcgtttttcgggaggacgcgtcgggcgtcgcgtcgtatttgtgttttacggggcggttttgttttatcgtttttcggaggcgatgttcggttcgagaggataggcgcgggcgtttttttcggggtagcgggggtagatttggcgtcgcggggacgtttttagcgcgttagacgtcgcgcgtttatttggggtcgtcgtttcgttatcggtaattttatttttcgtcgtagttttttttttcgtcgttatcgtaggagttatttggtcggtttcgtagtttcgcggttggtagtatggaggagtttcgggttcgttttgtttcggtttaggcggcggttttggagtagggaagcggggattggcgggt

SEQ ID NO: 36490 - DNA, 529 bp, Artificial Sequence
  chemically treated genomic DNA (Homo sapiens) CpG-island No: 36490
acccgccaatccccgcttccctactccaaaaccgccgcctaaaccgaaacaaaacgaacccgaaactcctccatactaccaaccgcgaaactacgaaaccgaccaaataactcctacgataacgacgaaaaaaaaaactacgacgaaaaataaaattaccgataacgaaacgacgaccccaaataaacgcgcgacgtctaacgcgctaaaaacgtccccgcgacgccaaatctacccccgctaccccgaaaaaaacgcccgcgcctatcctctcgaaccgaacatcgcctccgaaaaacgataaaacaaaaccgccccgtaaaacacaaatacgacgcgacgcccgacgcgtcctcccgaaaaacgaaacgcgaaaaaaaaaactaaaatcgccgccgacgctcaaaacgcgatatcttaatcccgaaccgaacgcattaacgaaaaaaaaccaacgaaaaaccttacacccgacgctaaaaacatccgcctccacccactactaaacgcccgcgtcgacgtcgacata

SEQ ID NO: 36491 - DNA, 529 bp, Artificial Sequence
  chemically treated genomic DNA (Homo sapiens) CpG-island No: 36491
gttcgttagttttcgtttttttgttttagagtcgtcgtttgggtcggggtagggcgggttcggggtttttttatgttgttagtcgcggggttgcggagtcgattaagtggtttttgcgatggcggcggaagaggaggttgcggcgggaggtgaggttgtcggtggcgaggcgacggttttaggtgggcgcgcggcgtttgacgcgttgggggcgttttcgcgacgttaggtttgttttcgttgtttcgagggaagcgttcgcgtttgttttttcgggtcgggtatcgttttcgaggggcggtgggataaggtcgtttcgtggggtataggtgcggcgcggcgttcggcgcgttttttcggggagcgggacgcggggaggggagttggggtcgtcgtcggcgtttaggacgcggtgttttggtttcgggtcgggcgtattggcgaaagggagttagcgggggattttgtattcggcgttgggagtattcgtttttatttattgttgggcgttcgcgtcggcgtcggtatg

SEQ ID NO: 36492 - DNA, 529 bp, Artificial Sequence
  chemically treated genomic DNA (Homo sapiens) CpG-island No: 36492
cataccgacgccgacgcgaacgcccaacaataaataaaaacgaatactcccaacgccgaatacaaaatcccccgctaactccctttcgccaatacgcccgacccgaaaccaaaacaccgcgtcctaaacgccgacgacgaccccaactcccctccccgcgtcccgctccccgaaaaaacgcgccgaacgccgcgccgcacctataccccacgaaacgaccttatcccaccgcccctcgaaaacgatacccgacccgaaaaaacaaacgcgaacgcttccctcgaaacaacgaaaacaaacctaacgtcgcgaaaacgcccccaacgcgtcaaacgccgcgcgcccacctaaaaccgtcgcctcgccaccgacaacctcacctcccgccgcaacctcctcttccgccgccatcgcaaaaaccacttaatcgactccgcaaccccgcgactaacaacataaaaaaaccccgaacccgccctaccccgacccaaacgacgactctaaaacaaaaaaacgaaaactaacgaac

SEQ ID NO: 36493 - DNA, 696 bp, Artificial Sequence
  chemically treated genomic DNA (Homo sapiens) CpG-island No: 36493
  misc_feature (196)..(196): n is either a, c, g or t
gatttggaagtatgttcgcgtgataatttaaaaattgtattcgattggcgttgtcgtgtcgatattatacgttaagtggacggtgttgcgttttatatgtttgcgcgggcgaatatcgatattcgtgacgtatcgttgtatgtatcgagtagttattgattttttgcgtatttcgtgtttatcgaacgcgttggtnataggttggatgattagtgatgcgcgaagtcggtttagttcgaaattatcggagttatagttataagatgtagattcgggatatttgttatatttgagtcgagtttggtaattcggataaaattttgttttttagtcgttgttatcgtatagatagatgcgattattgagacggattggacgtcggaaatggtgtaattagtataaagattatgatgttatggtcggtcggtttcggcgtagaattcgtcgggagttgcggtgagatagttagtatcgttttttgattgtttttaatttgtggagggattcgagttacgtgtgttcgttattcgcgggagaatgcgtaggagacgtttgtgaatggcgcgtatgatataagtgttagtgtgatcgtgcgcgtgtatggcgcgtgatgattttggtgttatttgtttttagggttaaaatggtagatttggagttataatcgtagaatcgcgaatggagttagtttttaaa

SEQ ID NO: 36494 - DNA, 696 bp, Artificial Sequence
  chemically treated genomic DNA (Homo sapiens) CpG-island No: 36494
  misc_feature (501)..(501): n is either a, c, g or t
tttaaaaactaactccattcgcgattctacgattataactccaaatctaccattttaaccctaaaaacaaataacaccaaaatcatcacgcgccatacacgcgcacgatcacactaacacttatatcatacgcgccattcacaaacgtctcctacgcattctcccgcgaataacgaacacacgtaactcgaatccctccacaaattaaaaacaatcaaaaaacgatactaactatctcaccgcaactcccgacgaattctacgccgaaaccgaccgaccataacatcataatctttatactaattacaccatttccgacgtccaatccgtctcaataatcgcatctatctatacgataacaacgactaaaaaacaaaattttatccgaattaccaaactcgactcaaatataacaaatatcccgaatctacatcttataactataactccgataatttcgaactaaaccgacttcgcgcatcactaatcatccaacctatnaccaacgcgttcgataaacacgaaatacgcaaaaaatcaataactactcgatacatacaacgatacgtcacgaatatcgatattcgcccgcgcaaacatataaaacgcaacaccgtccacttaacgtataatatcgacacgacaacgccaatcgaatacaatttttaaattatcacgcgaacatacttccaaatc

SEQ ID NO: 36495 - DNA, 696 bp, Artificial Sequence
  chemically treated genomic DNA (Homo sapiens) CpG-island No: 36495
  misc_feature (501)..(501): n is either a, c, g or t
tttgggaattggttttattcgcggttttgcgattatggttttaggtttgttattttggttttgggagtagatgatattagggttattacgcgttatgtacgcgtacggttatattagtatttgtgttatgcgcgttatttataggcgttttttgcgtattttttcgcggataacgggtatacgtggttcgaatttttttataggttagagatagttaggaagcggtattaattgttttatcgtagttttcgacgggttttacgtcggggtcggtcggttatgatattatggtttttgtattagttatattattttcgacgtttagttcgttttaatggtcgtatttatttgtgcgatggtagcggttggagagtaggattttattcggattgttagattcgatttagatatggtagatgtttcgagtttgtattttatagttgtgatttcggtaatttcgagttaggtcggtttcgcgtattattggttatttagtttgtnattagcgcgttcggtaagtacggagtacgtagaggattaatggttattcgatatatgtagcggtgcgttacgaatatcggtattcgttcgcgtagatatgtgaaacgtaatatcgtttatttggcgtatgatgtcggtacggtagcgttagtcggatataatttttgggttattacgcgagtatgtttttaggtt

SEQ ID NO: 36496 - DNA, 696 bp, Artificial Sequence
  chemically treated genomic DNA (Homo sapiens) CpG-island No: 36496
  misc_feature (196)..(196): n is either a, c, g or t
aacctaaaaacatactcgcgtaataacccaaaaattatatccgactaacgctaccgtaccgacatcatacgccaaataaacgatattacgtttcacatatctacgcgaacgaataccgatattcgtaacgcaccgctacatatatcgaataaccattaatcctctacgtactccgtacttaccgaacgcgctaatnacaaactaaataaccaataatacgcgaaaccgacctaactcgaaattaccgaaatcacaactataaaatacaaactcgaaacatctaccatatctaaatcgaatctaacaatccgaataaaatcctactctccaaccgctaccatcgcacaaataaatacgaccattaaaacgaactaaacgtcgaaaataatataactaatacaaaaaccataatatcataaccgaccgaccccgacgtaaaacccgtcgaaaactacgataaaacaattaataccgcttcctaactatctctaacctataaaaaaattcgaaccacgtatacccgttatccgcgaaaaaatacgcaaaaaacgcctataaataacgcgcataacacaaatactaatataaccgtacgcgtacataacgcgtaataaccctaatatcatctactcccaaaaccaaaataacaaacctaaaaccataatcgcaaaaccgcgaataaaaccaattcccaaa

SEQ ID NO: 36497 - DNA, 642 bp, Artificial Sequence
  chemically treated genomic DNA (Homo sapiens) CpG-island No: 36497
atttacggcggttttgggcgggtttatttatcgtgtcggagacgcgtttttattcgttcgcggtttcgcggttcgtacggattgggcgtagcgggggtttttaaatttgtttcgtaggtcggggatttatcgttttagcggtgttttcggttcggtattcgatttttttttttaggtatcgtcgtttcggttttatagtttcggttttatttcgtttttcgcgcgtttatttttcgtcgcggcgtaacgtcggtcgcggaagattagtttatcgtcgtattttcgtcgttttagcggaaattttttcgagttttttgtttttgttaagagtttcgacgtttttaagggggcggggtacgtgatttttcgcggagggattttgtattttttttacggattttaaaaaagagtttcgtttttaagttgtcgtttcgagtttttttcgcggtttttttagttttttttggttttgtcgagttagttttttcgtttggcgttagggcggagagcggaatttgggcgtcgggtttatttcgcgattgatttgcgttggggaacgggggaagatagaggggcggaaggagatcgtttttggttttattacgttttttaaaggttttcgatttgttttgttttcgttgt

SEQ ID NO: 36498 - DNA, 642 bp, Artificial Sequence
  chemically treated genomic DNA (Homo sapiens) CpG-island No: 36498
acaacgaaaacaaaacaaatcgaaaacctttaaaaaacgtaataaaaccaaaaacgatctccttccgcccctctatcttcccccgttccccaacgcaaatcaatcgcgaaataaacccgacgcccaaattccgctctccgccctaacgccaaacgaaaaaactaactcgacaaaaccaaaaaaaactaaaaaaaccgcgaaaaaaactcgaaacgacaacttaaaaacgaaactcttttttaaaatccgtaaaaaaaatacaaaatccctccgcgaaaaatcacgtaccccgcccccttaaaaacgtcgaaactcttaacaaaaacaaaaaactcgaaaaaatttccgctaaaacgacgaaaatacgacgataaactaatcttccgcgaccgacgttacgccgcgacgaaaaataaacgcgcgaaaaacgaaataaaaccgaaactataaaaccgaaacgacgatacctaaaaaaaaaaatcgaataccgaaccgaaaacaccgctaaaacgataaatccccgacctacgaaacaaatttaaaaacccccgctacgcccaatccgtacgaaccgcgaaaccgcgaacgaataaaaacgcgtctccgacacgataaataaacccgcccaaaaccgccgtaaat

SEQ ID NO: 36499 - DNA, 642 bp, Artificial Sequence
  chemically treated genomic DNA (Homo sapiens) CpG-island No: 36499
atagcgaaaataaaataaatcggggatttttaaaaggcgtaatgagattagaaacgattttttttcgtttttttgttttttttcgttttttaacgtagattaatcgcggaataagttcgacgtttagatttcgtttttcgttttagcgttaggcgggaggattggttcggtaaagttaaggagagttagggaggtcgcgagagaggttcgagacggtagtttaggggcgggatttttttttaaagttcgtggaggaagtgtaggattttttcgcggggagttacgtgtttcgtttttttgggggcgtcgaaatttttaataaaaataaggggttcggggaggttttcgttgaggcggcgggggtgcggcggtgggttggtttttcgcggtcggcgttgcgtcgcggcggagggtgggcgcgcggggagcgggatggagtcggggttgtgaggtcgaggcggcggtgtttgggaggaagggtcggatgtcggatcgggggtatcgttgaggcggtgggttttcgatttgcgagataggtttggaagttttcgttgcgtttagttcgtgcggatcgcgaggtcgcgggcgggtggaggcgcgttttcggtacggtgagtggattcgtttagggtcgtcgtgggt

SEQ ID NO: 36500 - DNA, 642 bp, Artificial Sequence
  chemically treated genomic DNA (Homo sapiens) CpG-island No: 36500
acccacgacgaccctaaacgaatccactcaccgtaccgaaaacgcgcctccacccgcccgcgacctcgcgatccgcacgaactaaacgcaacgaaaacttccaaacctatctcgcaaatcgaaaacccaccgcctcaacgatacccccgatccgacatccgacccttcctcccaaacaccgccgcctcgacctcacaaccccgactccatcccgctccccgcgcgcccaccctccgccgcgacgcaacgccgaccgcgaaaaaccaacccaccgccgcacccccgccgcctcaacgaaaacctccccgaaccccttatttttattaaaaatttcgacgcccccaaaaaaacgaaacacgtaactccccgcgaaaaaatcctacacttcctccacgaactttaaaaaaaaatcccgcccctaaactaccgtctcgaacctctctcgcgacctccctaactctccttaactttaccgaaccaatcctcccgcctaacgctaaaacgaaaaacgaaatctaaacgtcgaacttattccgcgattaatctacgttaaaaaacgaaaaaaaacaaaaaaacgaaaaaaaatcgtttctaatctcattacgccttttaaaaatccccgatttattttattttcgctat

SEQ ID NO: 36501 - DNA, 501 bp, Artificial Sequence
  chemically treated genomic DNA (Homo sapiens) CpG-island No: 36501
agcgttcggtcgttttttttttttttaggcgtatgcgtagcgtatttttcggttatcgtacgtttttttagtgggggtttagagacgttgacgttatcgtgcggtttgtaagtaattttttcgtttttttaaggaaaatgagtttacggattttcggttttttttagttacgagaaaacgttttttttttttttattttagtgttaacgatttttttagttcgttttttttcggtcgtatttttttgtattttcgttggatcgggaaggcggcggggaggaataggaagggtgaaagattaagttcgcgtagtttataaggagtgggcgagtttaggaatcggttcgcgagggcggagtcgaggaagtcggtatttttttttttttttttttttttttttttttttttttagtttttttcgcgagcggacgcggtagcgtttttgtttcgtttttttttattttttttttttttttttttttttttttttttttttttttt

SEQ ID NO: 36502 - DNA, 501 bp, Artificial Sequence
  chemically treated genomic DNA (Homo sapiens) CpG-island No: 36502
aaaaaaaaaaaaaaaaaaaaaaaaaaaaaaaaaaaaaaaaataaaaaaaaacgaaacaaaaacgctaccgcgtccgctcgcgaaaaaaactaaaaaaaaaaaaaaaaaaaaaaaaaaaaaaaaaaaaataccgacttcctcgactccgccctcgcgaaccgattcctaaactcgcccactccttataaactacgcgaacttaatctttcacccttcctattcctccccgccgccttcccgatccaacgaaaatacaaaaaaatacgaccgaaaaaaaacgaactaaaaaaatcgttaacactaaaataaaaaaaaaaaaaacgttttctcgtaactaaaaaaaaccgaaaatccgtaaactcattttccttaaaaaaacgaaaaaattacttacaaaccgcacgataacgtcaacgtctctaaacccccactaaaaaaacgtacgataaccgaaaaatacgctacgcatacgcctaaaaaaaaaaaaaacgaccgaacgct

SEQ ID NO: 36503 - DNA, 501 bp, Artificial Sequence
  chemically treated genomic DNA (Homo sapiens) CpG-island No: 36503
gaaaagaaaaaaaaaaaaagaaaggggaaaggggggaaaaataagaaaaagcgagatagaggcgttgtcgcgttcgttcgcggggaaggttggggagggaggggaagagaggggaagggaggaagaagtgtcggttttttcggtttcgttttcgcggatcgatttttagattcgtttattttttgtaaattacgcggatttggttttttattttttttgttttttttcgtcgttttttcggtttaacgaaagtatagagaagtgcggtcgaaaggagacgggttggggaagtcgttggtattaggatggaaggagggaggacgttttttcgtggttaagaaaagtcgaaggttcgtggatttattttttttgaaggagcggaagggttgtttgtagatcgtacggtgacgttagcgtttttgggtttttattgagggggcgtgcggtggtcggagagtgcgttgcgtatgcgtttggggaagaaagaagcggtcgagcgtt

SEQ ID NO: 36504 - DNA, 501 bp, Artificial Sequence
  chemically treated genomic DNA (Homo sapiens) CpG-island No: 36504
aacgctcgaccgcttctttcttccccaaacgcatacgcaacgcactctccgaccaccgcacgccccctcaataaaaacccaaaaacgctaacgtcaccgtacgatctacaaacaacccttccgctccttcaaaaaaaataaatccacgaaccttcgacttttcttaaccacgaaaaaacgtcctccctccttccatcctaataccaacgacttccccaacccgtctcctttcgaccgcacttctctatactttcgttaaaccgaaaaaacgacgaaaaaaaacaaaaaaaataaaaaaccaaatccgcgtaatttacaaaaaataaacgaatctaaaaatcgatccgcgaaaacgaaaccgaaaaaaccgacacttcttcctcccttcccctctcttcccctccctccccaaccttccccgcgaacgaacgcgacaacgcctctatctcgctttttcttatttttcccccctttcccctttctttttttttttttcttttc

SEQ ID NO: 36505 - DNA, 528 bp, Artificial Sequence
  chemically treated genomic DNA (Homo sapiens) CpG-island No: 36505
tgggttcgagttcgagtcgtagtcgggggagttagttagttttcggttaaggtagtaggttagttttaggaagggcgggcgattgagtcgagggagtcggcggttgggtttttttttcggttcgcgattttcggcgtcgtcgtcgtcgttatcgttatcgttatcgttttcgttttgtcgtcgtcgtcgttgtagagtatcgtagtttcgtcgcgttttcgcgttcgcgtcgttagtcgtttgggagttcgagcgtcgagttcggggcggaggagaggggcgttggcgcgagagttcgggcgagggagtcgcgaagggagaagggggcgggcggagggaggagtagggagagtgggagaagggggagggagagaggagagcgagggagagttggagagagcgagagtaaagagcgagcgagggagaggagagagagagagaggagagagaaagatatacgtacgtagagatatacggttattggaattttattagaaaaaagtgagtcgagtaagggttagcgggaga

SEQ ID NO: 36506 - DNA, 528 bp, Artificial Sequence
  chemically treated genomic DNA (Homo sapiens) CpG-island No: 36506
tctcccgctaacccttactcgactcacttttttctaataaaattccaataaccgtatatctctacgtacgtatatctttctctctcctctctctctctctcctctccctcgctcgctctttactctcgctctctccaactctccctcgctctcctctctccctcccccttctcccactctccctactcctccctccgcccgcccccttctcccttcgcgactccctcgcccgaactctcgcgccaacgcccctctcctccgccccgaactcgacgctcgaactcccaaacgactaacgacgcgaacgcgaaaacgcgacgaaactacgatactctacaacgacgacgacgacaaaacgaaaacgataacgataacgataacgacgacgacgacgccgaaaatcgcgaaccgaaaaaaaaacccaaccgccgactccctcgactcaatcgcccgcccttcctaaaactaacctactaccttaaccgaaaactaactaactcccccgactacgactcgaactcgaaccca

SEQ ID NO: 36507 - DNA, 528 bp, Artificial Sequence
  chemically treated genomic DNA (Homo sapiens) CpG-island No: 36507
tttttcgttaatttttgttcggtttatttttttttaatggaattttagtgatcgtgtgtttttgcgtgcgtgtgtttttttttttttttttttttttttttttttttttcgttcgttttttgttttcgttttttttagttttttttcgtttttttttttttttttttttttttttattttttttgttttttttttcgttcgttttttttttttttcgcggttttttcgttcgggttttcgcgttagcgtttttttttttcgtttcgggttcggcgttcgggtttttaggcggttggcggcgcgggcgcgggagcgcggcggagttacgatgttttgtagcggcggcggcgataaggcgaaggcggtggcggtggcggtggcggcggcggcggcgtcggggatcgcgggtcgagaggagagtttagtcgtcggttttttcggtttaatcgttcgttttttttgggattgatttgttgttttggtcggaaattgattggttttttcggttacggttcgggttcgaattta

SEQ ID NO: 36508 - DNA, 528 bp, Artificial Sequence
  chemically treated genomic DNA (Homo sapiens) CpG-island No: 36508
taaattcgaacccgaaccgtaaccgaaaaaaccaatcaatttccgaccaaaacaacaaatcaatcccaaaaaaaacgaacgattaaaccgaaaaaaccgacgactaaactctcctctcgacccgcgatccccgacgccgccgccgccgccaccgccaccgccaccgccttcgccttatcgccgccgccgctacaaaacatcgtaactccgccgcgctcccgcgcccgcgccgccaaccgcctaaaaacccgaacgccgaacccgaaacgaaaaaaaaaaacgctaacgcgaaaacccgaacgaaaaaaccgcgaaaaaaaaaaaaaacgaacgaaaaaaaaaacaaaaaaaataaaaaaaaaaaaaaaaaaaaaaaaaaacgaaaaaaaactaaaaaaaacgaaaacaaaaaacgaacgaaaaaaaaaaaaaaaaaaaaaaaaaaaaaaaaaaacacacgcacgcaaaaacacacgatcactaaaattccattaaaaaaaaataaaccgaacaaaaattaacgaaaaa

SEQ ID NO: 36509 - DNA, 659 bp, Artificial Sequence
  chemically treated genomic DNA (Homo sapiens) CpG-island No: 36509
ttatcgcgaaaggtcggtttggttgcgatagtttgggtaagaggtgtaggtcggtttggttttttgttattcggagttgggtaagcgggtgggagaatagcgaagatagcgtgagtttgggtcgttgtttcgaggttttcgttcggttttttttgtcgattcgttacgtttgtttggatttaatttttaggttgtcggcgttcgttcgttcgttggtttcgcggtgtgagagggaagtattcgtgtttgtggttggtggttggcgtttggagggttcgtatattcgttcggtcgcgtcgtttgttcgcggtagtcgcgtttttgaatcgcggagtcgtgtttgtgtttgattcgcgggcgtcggtggcgcgcggtcgaggtcggtgtcggcggggcggggcggtcgcggcggaggtagaggaagagggagcgggagttttgcgaggtcgggcgtcgttatggaattgggttcggagttttcgtatcgtcgtcgtatgtttttcgtttgtagtttttttttcgcgtcgtagttcgtcgtgaaggcgttatttggcgttttagtcgtcgggggattgtcgtttgttattaatttgatcgttattatggattagttgtagggtttgggtaggtaaggagagatcggcgggcggtgtttcggg

SEQ ID NO: 36510 - DNA, 659 bp, Artificial Sequence
  chemically treated genomic DNA (Homo sapiens) CpG-island No: 36510
cccgaaacaccgcccgccgatctctccttacctacccaaaccctacaactaatccataataacgatcaaattaataacaaacgacaatcccccgacgactaaaacgccaaataacgccttcacgacgaactacgacgcgaaaaaaaaactacaaacgaaaaacatacgacgacgatacgaaaactccgaacccaattccataacgacgcccgacctcgcaaaactcccgctccctcttcctctacctccgccgcgaccgccccgccccgccgacaccgacctcgaccgcgcgccaccgacgcccgcgaatcaaacacaaacacgactccgcgattcaaaaacgcgactaccgcgaacaaacgacgcgaccgaacgaatatacgaaccctccaaacgccaaccaccaaccacaaacacgaatacttccctctcacaccgcgaaaccaacgaacgaacgaacgccgacaacctaaaaattaaatccaaacaaacgtaacgaatcgacaaaaaaaaccgaacgaaaacctcgaaacaacgacccaaactcacgctatcttcgctattctcccacccgcttacccaactccgaataacaaaaaaccaaaccgacctacacctcttacccaaactatcgcaaccaaaccgacctttcgcgataa

SEQ ID NO: 36511 - DNA, 659 bp, Artificial Sequence
  chemically treated genomic DNA (Homo sapiens) CpG-island No: 36511
ttcggagtatcgttcgtcggtttttttttatttgtttagattttgtagttggtttatagtgacggttaggttggtgataggcgatagtttttcggcggttgaagcgttaaatagcgtttttacgacgggttgcgacgcgggaggggggttgtaggcgaagagtatgcggcggcggtgcgggggtttcgggtttagttttatggcggcgttcggtttcgtagagttttcgttttttttttttttgttttcgtcgcgatcgtttcgtttcgtcgatatcggtttcggtcgcgcgttatcggcgttcgcgggttaaatataaatacgatttcgcggtttagggacgcggttgtcgcgggtaagcggcgcggtcgggcgggtgtgcggattttttaggcgttagttattagttataggtacgggtgttttttttttatatcgcgaggttagcgggcgggcgggcgtcggtaatttgaagattaaatttaaataaacgtggcgggtcggtaagagaagtcgggcgagagtttcgaggtaacggtttaggtttacgttgttttcgttgtttttttattcgtttgtttagtttcgggtagtagaaaattaagtcgatttatattttttatttaggttgtcgtagttaggtcggtttttcgcggtaa

SEQ ID NO: 36512 - DNA, 659 bp, Artificial Sequence
  chemically treated genomic DNA (Homo sapiens) CpG-island No: 36512
ttaccgcgaaaaaccgacctaactacgacaacctaaataaaaaatataaatcgacttaattttctactacccgaaactaaacaaacgaataaaaaaacaacgaaaacaacgtaaacctaaaccgttacctcgaaactctcgcccgacttctcttaccgacccgccacgtttatttaaatttaatcttcaaattaccgacgcccgcccgcccgctaacctcgcgatataaaaaaaaaacacccgtacctataactaataactaacgcctaaaaaatccgcacacccgcccgaccgcgccgcttacccgcgacaaccgcgtccctaaaccgcgaaatcgtatttatatttaacccgcgaacgccgataacgcgcgaccgaaaccgatatcgacgaaacgaaacgatcgcgacgaaaacaaaaaaaaaaaaaacgaaaactctacgaaaccgaacgccgccataaaactaaacccgaaacccccgcaccgccgccgcatactcttcgcctacaacccccctcccgcgtcgcaacccgtcgtaaaaacgctatttaacgcttcaaccgccgaaaaactatcgcctatcaccaacctaaccgtcactataaaccaactacaaaatctaaacaaataaaaaaaaaccgacgaacgatactccgaa

SEQ ID NO: 36513 - DNA, 761 bp, Artificial Sequence
  chemically treated genomic DNA (Homo sapiens) CpG-island No: 36513
  misc_feature (524)..(524): n is either a, c, g or t
  misc_feature (671)..(671): n is either a, c, g or t
gttagtagttcgggtagttttacgtttagtacgttttcggggtttttaggcgtcgcgcgtttttagtttcgtcggcgttcgttttcgggtgttcgtttcgggcgtcgtttatcgtttcgtagtgtcgcgttgttttttcggtcgaggcgggttgggtgttcgcgttgatttcgggcggtttagttcgcgttagcgtttttttgaggggacgcggtttttagcgttcgttttcgttcgggacggtggcgttattacgcggggcgggagcggcgtgggtttggggttggtacgttatcgggagcggcggggtggatattgacgttatcgcgcggggcggtcgtgggcgggtcggagatattggagtgggtcgggtagcgtacgacgttattacgcgagcgttgtgtttcggttggcgggacggggacgggaaaggagagtgttcggtgcgtgggttgcgcgtgttgcgttttttcgagttttacgggtattttttttatttgtttgtggttcggagtacgcgcggntttttgttcggcgtcgcgttcgacgcgttttcgggtgcgtggttgcgttcgtttgaggttcgggatagtgtcgtcgttaaatttaaaggttgatcgtttttgggagttgttggtaaacgtgggggtgcgcggtcgttgagttatcgngggtggcggtgggatgagagggcggcgtttttgtttgcggttattttgcggttaggaggacgggtgagagggcgtcgcgtttcggaggtt

SEQ ID NO: 36514 - DNA, 761 bp, Artificial Sequence
  chemically treated genomic DNA (Homo sapiens) CpG-island No: 36514
  misc_feature (91)..(91): n is either a, c, g or t
  misc_feature (238)..(238): n is either a, c, g or t
aacctccgaaacgcgacgccctctcacccgtcctcctaaccgcaaaataaccgcaaacaaaaacgccgccctctcatcccaccgccacccncgataactcaacgaccgcgcacccccacgtttaccaacaactcccaaaaacgatcaacctttaaatttaacgacgacactatcccgaacctcaaacgaacgcaaccacgcacccgaaaacgcgtcgaacgcgacgccgaacaaaaanccgcgcgtactccgaaccacaaacaaataaaaaaaatacccgtaaaactcgaaaaaacgcaacacgcgcaacccacgcaccgaacactctcctttcccgtccccgtcccgccaaccgaaacacaacgctcgcgtaataacgtcgtacgctacccgacccactccaatatctccgacccgcccacgaccgccccgcgcgataacgtcaatatccaccccgccgctcccgataacgtaccaaccccaaacccacgccgctcccgccccgcgtaataacgccaccgtcccgaacgaaaacgaacgctaaaaaccgcgtcccctcaaaaaaacgctaacgcgaactaaaccgcccgaaatcaacgcgaacacccaacccgcctcgaccgaaaaaacaacgcgacactacgaaacgataaacgacgcccgaaacgaacacccgaaaacgaacgccgacgaaactaaaaacgcgcgacgcctaaaaaccccgaaaacgtactaaacgtaaaactacccgaactactaac

SEQ ID NO: 36515 - DNA, 761 bp, Artificial Sequence
  chemically treated genomic DNA (Homo sapiens) CpG-island No: 36515
  misc_feature (91)..(91): n is either a, c, g or t
  misc_feature (238)..(238): n is either a, c, g or t
gattttcgaagcgcggcgtttttttattcgtttttttggtcgtaaaatgatcgtaaatagggacgtcgtttttttattttatcgttatttncggtggtttagcggtcgcgtatttttacgtttgttagtagtttttagaggcggttagtttttgggtttgacgacggtattatttcgggttttaggcgagcgtagttacgtattcggaagcgcgtcgggcgcgacgtcgagtaaaaantcgcgcgtgtttcgagttataggtaagtggggagggtgttcgtggagttcgaggggacgtagtacgcgtagtttacgtatcgagtatttttttttttcgttttcgtttcgttagtcgagatataacgttcgcgtgatgacgtcgtgcgttgttcggtttattttagtattttcgattcgtttacggtcgtttcgcgcgatgacgttagtatttatttcgtcgttttcggtgacgtgttagttttaggtttacgtcgttttcgtttcgcgtgatgacgttatcgtttcgggcggaggcgggcgttgggagtcgcgtttttttagaggggcgttggcgcgggttgagtcgttcgggattagcgcgagtatttagttcgtttcggtcgggagggtagcgcggtattgcggggcgatgagcggcgttcggggcgagtattcggaggcgggcgtcggcggggttgggggcgcgcggcgtttgagaatttcgggggcgtgttgagcgtggagttgttcgggttgttggt

SEQ ID NO: 36516 - DNA, 761 bp, Artificial Sequence
  chemically treated genomic DNA (Homo sapiens) CpG-island No: 36516
  misc_feature (524)..(524): n is either a, c, g or t
  misc_feature (671)..(671): n is either a, c, g or t
accaacaacccgaacaactccacgctcaacacgcccccgaaattctcaaacgccgcgcgcccccaaccccgccgacgcccgcctccgaatactcgccccgaacgccgctcatcgccccgcaataccgcgctaccctcccgaccgaaacgaactaaatactcgcgctaatcccgaacgactcaacccgcgccaacgcccctctaaaaaaacgcgactcccaacgcccgcctccgcccgaaacgataacgtcatcacgcgaaacgaaaacgacgtaaacctaaaactaacacgtcaccgaaaacgacgaaataaatactaacgtcatcgcgcgaaacgaccgtaaacgaatcgaaaatactaaaataaaccgaacaacgcacgacgtcatcacgcgaacgttatatctcgactaacgaaacgaaaacgaaaaaaaaaaatactcgatacgtaaactacgcgtactacgtcccctcgaactccacgaacaccctccccacttacctataactcgaaacacgcgcgantttttactcgacgtcgcgcccgacgcgcttccgaatacgtaactacgctcgcctaaaacccgaaataataccgtcgtcaaacccaaaaactaaccgcctctaaaaactactaacaaacgtaaaaatacgcgaccgctaaaccaccgnaaataacgataaaataaaaaaacgacgtccctatttacgatcattttacgaccaaaaaaacgaataaaaaaacgccgcgcttcgaaaatc

SEQ ID NO: 36517 - DNA, 1263 bp, Artificial Sequence
  chemically treated genomic DNA (Homo sapiens) CpG-island No: 36517
gcgttttgcggatcgattttcgggtgaagtcgtttatttttttcgaggtcgagatggcggcgttggtagttttcgtcggcggcgacgacgacgatattttcgcggttttgacgtttggtagtttcggttgttgtttgtaaggtacgggtagcggcggagacggtaggaggaggcgggggagaggcgcggggtgttcgcgtttttgcgtttcggttttacggtttttcggtttcgggacgtcgtcgagttttttttcgtcgttcgttaacgttttacggttatattttagcgtcggaggtttttggttttcggcgcgcggcgagttttcggggttgacggagggaagggcgggggcggaggggggtgaagaagttgttgattttgggcgcgtagagcgggtggaagagagttcgaagtttagataattgaggcgggggtacgggggtgcgggtgtcgagcgcgtttttcgtcgtttttgttttcgtcgttagttagtcggtcggttagtattttagcggtcgttgttagcgtagttcgttttgtttggagtttttttttagggcgttgttatcgcgggttttttcggagttattgtcgcggtgttcgtttttttcggttaacgtcggttttttatcgttcggggcgttgtttcgtagtttcggttttttgcgtgtatatattcgttttttgtcgcgttgggcggttcgaatttttttttttacgcgttcgtcggtcgtttacggagaattttaggcgagcgatcgttataatttgagaaggtggttggtataggcgattggggagtgtgtgcgcgtgtgcgcgcgttagggcgcgcggttcggggaggggtttcgtaaggggtgggaaggaggggtttgattgataattttcgcggggtttcgttcgttttttggtgcggcggcggggaagggggcgggaaagtatgttagtttttttagttaattatacggttaagcggtagcgacggcgtgaggtgcggttttttgaggtagaggagtggggcgggttgtgtgacgggtttcggttatagttaatcgtaagtgaagacggcgagcggggtgtttttgcgttagaataaatgcggtaaatcgtttgggagggaggggaagcgtttttttattagcgggtatttttgcgtttacgcgcgattgttttaggttgttattgtttttttgatcgtttacgagaagattgggaaatttgagagggtgcgtttagagagtaaaatagagcgtttttttt

SEQ ID NO: 36518 - DNA, 1263 bp, Artificial Sequence
  chemically treated genomic DNA (Homo sapiens) CpG-island No: 36518
aaaaaaaacgctctattttactctctaaacgcaccctctcaaatttcccaatcttctcgtaaacgatcaaaaaaacaataacaacctaaaacaatcgcgcgtaaacgcaaaaatacccgctaataaaaaaacgcttcccctccctcccaaacgatttaccgcatttattctaacgcaaaaacaccccgctcgccgtcttcacttacgattaactataaccgaaacccgtcacacaacccgccccactcctctacctcaaaaaaccgcacctcacgccgtcgctaccgcttaaccgtataattaactaaaaaaactaacatactttcccgcccccttccccgccgccgcaccaaaaaacgaacgaaaccccgcgaaaattatcaatcaaacccctccttcccaccccttacgaaacccctccccgaaccgcgcgccctaacgcgcgcacacgcgcacacactccccaatcgcctataccaaccaccttctcaaattataacgatcgctcgcctaaaattctccgtaaacgaccgacgaacgcgtaaaaaaaaaaattcgaaccgcccaacgcgacaaaaaacgaatatatacacgcaaaaaaccgaaactacgaaacaacgccccgaacgataaaaaaccgacgttaaccgaaaaaaacgaacaccgcgacaataactccgaaaaaacccgcgataacaacgccctaaaaaaaaactccaaacaaaacgaactacgctaacaacgaccgctaaaatactaaccgaccgactaactaacgacgaaaacaaaaacgacgaaaaacgcgctcgacacccgcacccccgtacccccgcctcaattatctaaacttcgaactctcttccacccgctctacgcgcccaaaatcaacaacttcttcacccccctccgcccccgcccttccctccgtcaaccccgaaaactcgccgcgcgccgaaaaccaaaaacctccgacgctaaaatataaccgtaaaacgttaacgaacgacgaaaaaaaactcgacgacgtcccgaaaccgaaaaaccgtaaaaccgaaacgcaaaaacgcgaacaccccgcgcctctcccccgcctcctcctaccgtctccgccgctacccgtaccttacaaacaacaaccgaaactaccaaacgtcaaaaccgcgaaaatatcgtcgtcgtcgccgccgacgaaaactaccaacgccgccatctcgacctcgaaaaaaataaacgacttcacccgaaaatcgatccgcaaaacgc

SEQ ID NO: 36519 - DNA, 1263 bp, Artificial Sequence
  chemically treated genomic DNA (Homo sapiens) CpG-island No: 36519
ggaaggggcgttttattttgttttttgaacgtatttttttaagttttttagttttttcgtagacggttaggagagtaatgatagtttggagtagtcgcgcgtgagcgtaaaaatgttcgttggtggaggagcgtttttttttttttttaagcgatttgtcgtatttgttttgacgtaggggtatttcgttcgtcgtttttatttacgattggttgtggtcgaagttcgttatatagttcgttttatttttttgttttaagaggtcgtattttacgtcgtcgttgtcgtttagtcgtgtgattggttaagagggttggtatgttttttcgttttttttttcgtcgtcgtattaagaggcgggcgggatttcgcggaagttgttagttaaattttttttttttattttttgcgaggttttttttcgggtcgcgcgttttggcgcgcgtatacgcgtatatattttttagtcgtttgtattaattatttttttaagttgtagcggtcgttcgtttggggtttttcgtgggcggtcgacgggcgcgtgggggagggggttcgggtcgtttagcgcggtaaggagcgagtgtgtgtacgtagagggtcggggttacggggtagcgtttcgggcgatgaggggtcggcgttgatcgggaagagcgggtatcgcggtagtggtttcgaggggattcgcgatggtagcgttttgagaggaggttttaggtagggcgggttgcgttggtagcggtcgttgaggtgttggtcggtcggttggttggcgacgggggtagaagcgacgagaggcgcgttcggtattcgtattttcgtgttttcgttttagttgtttaaatttcgggtttttttttattcgttttgcgcgtttagagttaataatttttttattttttttcgttttcgttttttttttcgttagtttcgggagttcgtcgcgcgtcggggattaggaattttcggcgttgagatgtggtcgtgaggcgttggcgggcggcgaggagaagttcggcggcgtttcggggtcggagggtcgtggggtcggggcgtaggggcgcgagtatttcgcgtttttttttcgtttttttttgtcgttttcgtcgttgttcgtgttttgtaagtagtagtcggagttgttaagcgttagggtcgcggagatgtcgtcgtcgtcgtcgtcggcgggggttgttagcgtcgttatttcggtttcggagaaagtggacggttttattcggaaatcggttcgtaaggcgt

SEQ ID NO: 36520 - DNA, 1263 bp, Artificial Sequence
  chemically treated genomic DNA (Homo sapiens) CpG-island No: 36520
acgccttacgaaccgatttccgaataaaaccgtccactttctccgaaaccgaaataacgacgctaacaacccccgccgacgacgacgacgacgacatctccgcgaccctaacgcttaacaactccgactactacttacaaaacacgaacaacgacgaaaacgacaaaaaaaaacgaaaaaaaaacgcgaaatactcgcgcccctacgccccgaccccacgaccctccgaccccgaaacgccgccgaacttctcctcgccgcccgccaacgcctcacgaccacatctcaacgccgaaaattcctaatccccgacgcgcgacgaactcccgaaactaacgaaaaaaaaaacgaaaacgaaaaaaaataaaaaaattattaactctaaacgcgcaaaacgaataaaaaaaaacccgaaatttaaacaactaaaacgaaaacacgaaaatacgaataccgaacgcgcctctcgtcgcttctacccccgtcgccaaccaaccgaccgaccaacacctcaacgaccgctaccaacgcaacccgccctacctaaaacctcctctcaaaacgctaccatcgcgaatcccctcgaaaccactaccgcgatacccgctcttcccgatcaacgccgacccctcatcgcccgaaacgctaccccgtaaccccgaccctctacgtacacacactcgctccttaccgcgctaaacgacccgaaccccctcccccacgcgcccgtcgaccgcccacgaaaaaccccaaacgaacgaccgctacaacttaaaaaaataattaatacaaacgactaaaaaatatatacgcgtatacgcgcgccaaaacgcgcgacccgaaaaaaaacctcgcaaaaaataaaaaaaaaaaatttaactaacaacttccgcgaaatcccgcccgcctcttaatacgacgacgaaaaaaaaaacgaaaaaacataccaaccctcttaaccaatcacacgactaaacgacaacgacgacgtaaaatacgacctcttaaaacaaaaaaataaaacgaactatataacgaacttcgaccacaaccaatcgtaaataaaaacgacgaacgaaatacccctacgtcaaaacaaatacgacaaatcgcttaaaaaaaaaaaaaaacgctcctccaccaacgaacatttttacgctcacgcgcgactactccaaactatcattactctcctaaccgtctacgaaaaaactaaaaaacttaaaaaaatacgttcaaaaaacaaaataaaacgccccttcc

SEQ ID NO: 36521 - DNA, 599 bp, Artificial Sequence
  chemically treated genomic DNA (Homo sapiens) CpG-island No: 36521
atcgtcggtttttcgttttatatagaggataacgagaattttaagttcgacgagaaggggaattagttcgagaatagcgaagattcggagttcgatcggaagaagtcgggtaacgcgtgtgataacgatatgaattgtaacgacgacggttatagttttagtaattcggatagtcgcgatagcgacgatagtttcgagtattcggattttgagaattttaaggcgggcgaggacggtttcggtgttttgggcgcgatgtagattaaggtggagcgttacgtggagagcgagtcggatttgcggttgtagaattgcgagttatttacgttcgatagcgttaaggattcggatagcgtaggcgaggcgggcgcgtaggtttttagtaagtattagaagcgtaagaaaaggcggaaacggtaaaagggcggtagcgttagtcgtcggcgtttgtttagcgcgtcgagtttaggcggtttggacgcgggtttggtggagttttcgcggttgttgtttttttttaatagtgtttcggtgtttaagattaagacggagattttagaatttattaatttcgataatgatagtagtatttggaatta

SEQ ID NO: 36522 - DNA, 599 bp, Artificial Sequence
  chemically treated genomic DNA (Homo sapiens) CpG-island No: 36522
taattccaaatactactatcattatcgaaattaataaattctaaaatctccgtcttaatcttaaacaccgaaacactattaaaaaaaaacaacaaccgcgaaaactccaccaaacccgcgtccaaaccgcctaaactcgacgcgctaaacaaacgccgacgactaacgctaccgcccttttaccgtttccgccttttcttacgcttctaatacttactaaaaacctacgcgcccgcctcgcctacgctatccgaatccttaacgctatcgaacgtaaataactcgcaattctacaaccgcaaatccgactcgctctccacgtaacgctccaccttaatctacatcgcgcccaaaacaccgaaaccgtcctcgcccgccttaaaattctcaaaatccgaatactcgaaactatcgtcgctatcgcgactatccgaattactaaaactataaccgtcgtcgttacaattcatatcgttatcacacgcgttacccgacttcttccgatcgaactccgaatcttcgctattctcgaactaattccccttctcgtcgaacttaaaattctcgttatcctctatataaaacgaaaaaccgacgat

SEQ ID NO: 36523 - DNA, 599 bp, Artificial Sequence
  chemically treated genomic DNA (Homo sapiens) CpG-island No: 36523
tagttttagatgttgttgttattgtcgaaattgatgggttttgagattttcgttttgattttgagtatcgaggtattgttgggggaggatagtagtcgcgggggttttattaggttcgcgtttaggtcgtttgggttcgacgcgttggataggcgtcggcggttggcgttgtcgtttttttgtcgttttcgtttttttttgcgtttttggtgtttgttggaggtttgcgcgttcgtttcgtttgcgttgttcgagtttttggcgttgtcggacgtgagtgattcgtagttttgtagtcgtaggttcgattcgttttttacgtagcgttttattttgatttgtatcgcgtttagagtatcgaagtcgttttcgttcgttttggggtttttaaagttcgagtgttcgaagttgtcgtcgttgtcgcggttgttcgggttattggagttgtggtcgtcgtcgttgtagtttatgtcgttgttatacgcgttgttcgatttttttcggtcgggtttcgggttttcgttgttttcggattggttttttttttcgtcggatttggagttttcgttgttttttgtgtggggcggggggtcggcggt

SEQ ID NO: 36524 - DNA, 599 bp, Artificial Sequence
  chemically treated genomic DNA (Homo sapiens) CpG-island No: 36524
accgccgaccccccgccccacacaaaaaacaacgaaaactccaaatccgacgaaaaaaaaaaccaatccgaaaacaacgaaaacccgaaacccgaccgaaaaaaatcgaacaacgcgtataacaacgacataaactacaacgacgacgaccacaactccaataacccgaacaaccgcgacaacgacgacaacttcgaacactcgaactttaaaaaccccaaaacgaacgaaaacgacttcgatactctaaacgcgatacaaatcaaaataaaacgctacgtaaaaaacgaatcgaacctacgactacaaaactacgaatcactcacgtccgacaacgccaaaaactcgaacaacgcaaacgaaacgaacgcgcaaacctccaacaaacaccaaaaacgcaaaaaaaaacgaaaacgacaaaaaaacgacaacgccaaccgccgacgcctatccaacgcgtcgaacccaaacgacctaaacgcgaacctaataaaacccccgcgactactatcctcccccaacaatacctcgatactcaaaatcaaaacgaaaatctcaaaacccatcaatttcgacaataacaacaacatctaaaacta

SEQ ID NO: 36525 - DNA, 535 bp, Artificial Sequence
  chemically treated genomic DNA (Homo sapiens) CpG-island No: 36525
cgtagtagtcgtcggttcgcggtagagattattagatttcggtaggtacgagtcgtagtcgtggtgcgtaggaagagttcgtagtcgtttatgttgttcgatgttttttagttttagttttagttttttttttttagcgtcgtagggatatatacgtttgatgacgttattggttcgcgataacgtgtagtatttattgcgtttgcgcggtttttcgtagtaggggatggagaggttagaagggcgggaaggttattatttgtcgcgtttaaggttttagttacgtgtatttggttggttcgcgtcgtttgatgacgttatacgtttacgtttttcgtcggttttattgcgtttgcgcggttaaaggagttggtcggaggaaattgtaggttcggggtcgcgggtatttcggcgggtataatttttggtcgtcgtgacggcggtgacggatttgttttttatatattagcggttgtttttataaatgttagttatgggaaatttttttgtgtatagaaatttaaaggtcggttta

SEQ ID NO: 36526 - DNA, 535 bp, Artificial Sequence
  chemically treated genomic DNA (Homo sapiens) CpG-island No: 36526
taaaccgacctttaaatttctatacacaaaaaaatttcccataactaacatttataaaaacaaccgctaatatataaaaaacaaatccgtcaccgccgtcacgacgaccaaaaattatacccgccgaaatacccgcgaccccgaacctacaatttcctccgaccaactcctttaaccgcgcaaacgcaataaaaccgacgaaaaacgtaaacgtataacgtcatcaaacgacgcgaaccaaccaaatacacgtaactaaaaccttaaacgcgacaaataataaccttcccgcccttctaacctctccatcccctactacgaaaaaccgcgcaaacgcaataaatactacacgttatcgcgaaccaataacgtcatcaaacgtatatatccctacgacgctaaaaaaaaaaaactaaaactaaaactaaaaaacatcgaacaacataaacgactacgaactcttcctacgcaccacgactacgactcgtacctaccgaaatctaataatctctaccgcgaaccgacgactactacg

SEQ ID NO: 36527 - DNA, 535 bp, Artificial Sequence
  chemically treated genomic DNA (Homo sapiens) CpG-island No: 36527
tgagtcggtttttaggtttttgtatatagggagattttttatggttggtatttatggaaataatcgttggtatgtgaaaaataggttcgttatcgtcgttacgacggttagagattatattcgtcgagatgttcgcggtttcgggtttataatttttttcggttagtttttttggtcgcgtaagcgtagtggggtcggcgggaagcgtaggcgtgtgacgttattaggcggcgcgggttagttaggtgtacgtgattaaggttttgggcgcggtaggtggtagttttttcgtttttttggtttttttattttttgttgcgggggatcgcgtaagcgtagtgagtattgtacgttgtcgcgggttagtaacgttattagacgtgtgtgtttttgcggcgttaagaaggggagattgaggttgaggttggggaatatcgggtagtatgagcggttgcgggttttttttgcgtattacggttgcggttcgtgtttgtcggggtttggtggtttttatcgcgaatcggcggttattgcg

SEQ ID NO: 36528 - DNA, 535 bp, Artificial Sequence
  chemically treated genomic DNA (Homo sapiens) CpG-island No: 36528
cgcaataaccgccgattcgcgataaaaaccaccaaaccccgacaaacacgaaccgcaaccgtaatacgcaaaaaaaacccgcaaccgctcatactacccgatattccccaacctcaacctcaatctccccttcttaacgccgcaaaaacacacacgtctaataacgttactaacccgcgacaacgtacaatactcactacgcttacgcgatcccccgcaacaaaaaataaaaaaaccaaaaaaacgaaaaaactaccacctaccgcgcccaaaaccttaatcacgtacacctaactaacccgcgccgcctaataacgtcacacgcctacgcttcccgccgaccccactacgcttacgcgaccaaaaaaactaaccgaaaaaaattataaacccgaaaccgcgaacatctcgacgaatataatctctaaccgtcgtaacgacgataacgaacctatttttcacataccaacgattatttccataaataccaaccataaaaaatctccctatatacaaaaacctaaaaaccgactca

SEQ ID NO: 36529 - DNA, 860 bp, Artificial Sequence
  chemically treated genomic DNA (Homo sapiens) CpG-island No: 36529
cgcgtcggattgtttatcgtacgggtcgtaagaggggttgttacgggtgggagggggtcggcgattttgggggggttcgggttattttcgtatattatttgacgttattttcgttttcgtttaggtgcgaaattttttgtttttcggttgggcgcgcgattttaaaggcgttttgaagaaattcgagtttcgaagatttttttagtgggttgggggttgtgacggaagagattcgggagagggggttggggtagaggaaaggcggggggcgtttggagttggtttgagcgaggcggcggttttggagtggaatttcgggatttcgttttaatttcgtcgggcgggttttttcggattttttagagtttggttttttcgtttttcggttttcgtttgttcggtgttagttttcgttcgtcgtagtttcgcggtttttttttttttaatttttcggttttttttattttttttagatttcgtttggggttttgttggtttttgggagataaaaatcgttttaaatagcggcggcgcgttgttaggataaatagggtcgggcgggttatgtgcgtttggttatcggtttcgggtcgggacgtcgggttttagcgggttcgggaaggggtagcgggcggagtttcgggtatttaggtttcggtgacgatttttaaagtagggggttttttttagaagcggtttgcgcgttttttcggttttcgtttaggtcgtagggaggggtcggcggagatcgttcgttaagcgttcggagtttatagggcgtgggttacggtcgttgcgttgtttggttagtcgcgttttttggtgaagttattgggtgagcgcgtcgggtttggatttgg

SEQ ID NO: 36530 - DNA, 860 bp, Artificial Sequence
  chemically treated genomic DNA (Homo sapiens) CpG-island No: 36530
ccaaatccaaacccgacgcgctcacccaataacttcaccaaaaaacgcgactaaccaaacaacgcaacgaccgtaacccacgccctataaactccgaacgcttaacgaacgatctccgccgacccctccctacgacctaaacgaaaaccgaaaaaacgcgcaaaccgcttctaaaaaaaaccccctactttaaaaatcgtcaccgaaacctaaatacccgaaactccgcccgctaccccttcccgaacccgctaaaacccgacgtcccgacccgaaaccgataaccaaacgcacataacccgcccgaccctatttatcctaacaacgcgccgccgctatttaaaacgatttttatctcccaaaaaccaacaaaaccccaaacgaaatctaaaaaaaataaaaaaaaccgaaaaattaaaaaaaaaaaaaccgcgaaactacgacgaacgaaaactaacaccgaacaaacgaaaaccgaaaaacgaaaaaaccaaactctaaaaaatccgaaaaaacccgcccgacgaaattaaaacgaaatcccgaaattccactccaaaaccgccgcctcgctcaaaccaactccaaacgccccccgcctttcctctaccccaaccccctctcccgaatctcttccgtcacaacccccaacccactaaaaaaatcttcgaaactcgaatttcttcaaaacgcctttaaaatcgcgcgcccaaccgaaaaacaaaaaatttcgcacctaaacgaaaacgaaaataacgtcaaataatatacgaaaataacccgaacccccccaaaatcgccgaccccctcccacccgtaacaacccctcttacgacccgtacgataaacaatccgacgcg

SEQ ID NO: 36531 - DNA, 860 bp, Artificial Sequence
  chemically treated genomic DNA (Homo sapiens) CpG-island No: 36531
ttaagtttaggttcggcgcgtttatttagtaattttattagggggcgcggttggttaggtaacgtagcgatcgtgatttacgttttatgggtttcgagcgtttagcgggcggttttcgtcggtttttttttacgatttgggcgggaatcgagagagcgcgtaggtcgtttttaaaaggggttttttattttgggagtcgttatcggagtttgggtgttcggagtttcgttcgttattttttttcgggttcgttggagttcggcgtttcgattcggggtcggtaattaggcgtatatggttcgttcggttttgtttgttttggtagcgcgtcgtcgttatttgaagcggtttttattttttagaaattagtaaaattttaagcggagtttagggaagatgaaaggggtcgaagggttggggaggggaggatcgcgaggttgcggcgggcgggagttggtatcggataggcggagatcgggaggcgagagggttagattttggggggttcggaggagttcgttcggcggggttgaggcgggatttcggggttttattttagggtcgtcgtttcgtttagattagttttaagcgtttttcgttttttttttgttttagttttttttttcgggtttttttcgttatagtttttagtttattaaagaagttttcggaattcggatttttttaaagcgtttttgaagtcgcgcgtttagtcggagggtaggagatttcgtatttgggcgggggcgggagtggcgttaggtgatgtgcgggggtaattcgagtttttttaggatcgtcggtttttttttattcgtagtagttttttttgcgattcgtgcggtggatagttcgacgcg

SEQ ID NO: 36532 - DNA, 860 bp, Artificial Sequence
  chemically treated genomic DNA (Homo sapiens) CpG-island No: 36532
cgcgtcgaactatccaccgcacgaatcgcaaaaaaaactactacgaataaaaaaaaaccgacgatcctaaaaaaactcgaattacccccgcacatcacctaacgccactcccgcccccgcccaaatacgaaatctcctaccctccgactaaacgcgcgacttcaaaaacgctttaaaaaaatccgaattccgaaaacttctttaataaactaaaaactataacgaaaaaaacccgaaaaaaaaaactaaaacaaaaaaaaaacgaaaaacgcttaaaactaatctaaacgaaacgacgaccctaaaataaaaccccgaaatcccgcctcaaccccgccgaacgaactcctccgaaccccccaaaatctaaccctctcgcctcccgatctccgcctatccgataccaactcccgcccgccgcaacctcgcgatcctcccctccccaacccttcgacccctttcatcttccctaaactccgcttaaaattttactaatttctaaaaaataaaaaccgcttcaaataacgacgacgcgctaccaaaacaaacaaaaccgaacgaaccatatacgcctaattaccgaccccgaatcgaaacgccgaactccaacgaacccgaaaaaaaataacgaacgaaactccgaacacccaaactccgataacgactcccaaaataaaaaaccccttttaaaaacgacctacgcgctctctcgattcccgcccaaatcgtaaaaaaaaaccgacgaaaaccgcccgctaaacgctcgaaacccataaaacgtaaatcacgatcgctacgttacctaaccaaccgcgccccctaataaaattactaaataaacgcgccgaacctaaacttaa

SEQ ID NO: 36533 - DNA, 899 bp, Artificial Sequence
  chemically treated genomic DNA (Homo sapiens) CpG-island No: 36533
gttcgtagtttacgtaataggcggagttttagggttttagcgacggcgggttttggggattagaggatgcgggcgtcgcgggttagacgtttagaaggacggaaagtgttttgcggtcgtagattttcggggtcgtgtattcgcgatttggattataggagattggggtagtaaaaggtgggggaaggcgcggtaaagttgtagggtcgttcggagaagttttcggagcgcgtagggaggtggggacgttagttaggtatttgtaggagttcggacgtatttagttagtttcgttttgcgacgtcgtttgttcgcgttgtagggattaggtttcgcggcgcggtttcgcgtttgtcgtcgcggcggcgaggagagcggggtggttcgcgtcggtcggtttgttcgtcggtttcgtttcgttagagcgaggttttcgggagttgcgggcggggcggggtcggacgggacggggcggggttcgtcgttcggtcgtcgttttattggtcgtagtttcgttagtttttcgtttcgggttcgtagtcgggcgtttcgggtcgagggcgcgggcggttgaggattgcggggtttcgatcgttagataggcggatagatttatagatttagatgttgttttgtcggtcgcgcgttttcgtttaggtttaagtgtagagttatttcggagcggtaggcgttgttcgggtgggattaggagcgcgtttcgcgttttttatttgcgcgtttttttgggtcggaagcgtcgtggttttgcgggaaaaagatgatttttttcgcggtttcggcggttggggtaatcgtttttttaaagtcgcggtttaagcgatattttgttaatttgtttggatttttttaggaaatcgcgaggtttaaatttgttttaa

SEQ ID NO: 36534 - DNA, 899 bp, Artificial Sequence
  chemically treated genomic DNA (Homo sapiens) CpG-island No: 36534
ttaaaacaaatttaaacctcgcgatttcctaaaaaaatccaaacaaattaacaaaatatcgcttaaaccgcgactttaaaaaaacgattaccccaaccgccgaaaccgcgaaaaaaatcatctttttcccgcaaaaccacgacgcttccgacccaaaaaaacgcgcaaataaaaaacgcgaaacgcgctcctaatcccacccgaacaacgcctaccgctccgaaataactctacacttaaacctaaacgaaaacgcgcgaccgacaaaacaacatctaaatctataaatctatccgcctatctaacgatcgaaaccccgcaatcctcaaccgcccgcgccctcgacccgaaacgcccgactacgaacccgaaacgaaaaactaacgaaactacgaccaataaaacgacgaccgaacgacgaaccccgccccgtcccgtccgaccccgccccgcccgcaactcccgaaaacctcgctctaacgaaacgaaaccgacgaacaaaccgaccgacgcgaaccaccccgctctcctcgccgccgcgacgacaaacgcgaaaccgcgccgcgaaacctaatccctacaacgcgaacaaacgacgtcgcaaaacgaaactaactaaatacgtccgaactcctacaaatacctaactaacgtccccacctccctacgcgctccgaaaacttctccgaacgaccctacaactttaccgcgccttcccccaccttttactaccccaatctcctataatccaaatcgcgaatacacgaccccgaaaatctacgaccgcaaaacactttccgtccttctaaacgtctaacccgcgacgcccgcatcctctaatccccaaaacccgccgtcgctaaaaccctaaaactccgcctattacgtaaactacgaac

SEQ ID NO: 36535 - DNA, 899 bp, Artificial Sequence
  chemically treated genomic DNA (Homo sapiens) CpG-island No: 36535
ttaaaataagtttgggtttcgcgattttttgaggaaatttaggtaaattagtaaagtgtcgtttgggtcgcgattttagaaaggcggttgttttagtcgtcggggtcgcgggggaggttatttttttttcgtagggttacggcgttttcggtttaggagggcgcgtaggtgggaggcgcggggcgcgtttttggttttattcggatagcgtttgtcgtttcggggtgattttgtatttgggtttgggcgggggcgcgcggtcggtagggtagtatttaggtttatgggtttgttcgtttgtttggcggtcggagtttcgtagtttttagtcgttcgcgttttcggttcggggcgttcggttgcgggttcgaagcgaggggttggcggagttgcgattaatggggcggcggtcgagcggcgggtttcgtttcgtttcgttcggtttcgtttcgttcgtagttttcgggagtttcgttttagcggggcgggatcgacggatagatcggtcgacgcgggttatttcgtttttttcgtcgtcgcggcggtaggcgcggggtcgcgtcgcgaggtttgatttttgtagcgcgggtaggcggcgtcgtagagcggagttagttggatgcgttcggatttttgtaggtatttggttggcgtttttatttttttgcgcgtttcggagattttttcgggcgattttgtaattttatcgcgtttttttttattttttgttgttttagttttttgtggtttaggtcgcgggtgtacgatttcgagggtttacggtcgtagagtatttttcgtttttttgggcgtttggttcgcggcgttcgtattttttggtttttagagttcgtcgtcgttggagttttaaggtttcgtttgttgcgtgaattgcgggt

SEQ ID NO: 36536 - DNA, 899 bp, Artificial Sequence
  chemically treated genomic DNA (Homo sapiens) CpG-island No: 36536
acccgcaattcacgcaacaaacgaaaccttaaaactccaacgacgacgaactctaaaaaccaaaaaatacgaacgccgcgaaccaaacgcccaaaaaaacgaaaaatactctacgaccgtaaaccctcgaaatcgtacacccgcgacctaaaccacaaaaaactaaaacaacaaaaaataaaaaaaaacgcgataaaattacaaaatcgcccgaaaaaatctccgaaacgcgcaaaaaaataaaaacgccaaccaaatacctacaaaaatccgaacgcatccaactaactccgctctacgacgccgcctacccgcgctacaaaaatcaaacctcgcgacgcgaccccgcgcctaccgccgcgacgacgaaaaaaacgaaataacccgcgtcgaccgatctatccgtcgatcccgccccgctaaaacgaaactcccgaaaactacgaacgaaacgaaaccgaacgaaacgaaacgaaacccgccgctcgaccgccgccccattaatcgcaactccgccaacccctcgcttcgaacccgcaaccgaacgccccgaaccgaaaacgcgaacgactaaaaactacgaaactccgaccgccaaacaaacgaacaaacccataaacctaaatactaccctaccgaccgcgcgcccccgcccaaacccaaatacaaaatcaccccgaaacgacaaacgctatccgaataaaaccaaaaacgcgccccgcgcctcccacctacgcgccctcctaaaccgaaaacgccgtaaccctacgaaaaaaaaataacctcccccgcgaccccgacgactaaaacaaccgcctttctaaaatcgcgacccaaacgacactttactaatttacctaaatttcctcaaaaaatcgcgaaacccaaacttattttaa

SEQ ID NO: 36537 - DNA, 916 bp, Artificial Sequence
  chemically treated genomic DNA (Homo sapiens) CpG-island No: 36537
gttttcgttaatttttttcggtttattgttaatatttatacgtttagtattataaggtttgagtatgggtaacgggcgttttcgtagttgtttaggcgcgtgtgtacgttcgtgcgtttttgtgtttttgtgtatttgtgcgtggttgtgaaattttttttttagttcggaggggtgggggagagaaggaatgtcgtcggcggggcgtttacgtgggtacgtgggcgttaagagggtcggttgtgtattcggcgtgggcggtatagaacgatttcgtttcgttcgttgggtttttaagttcgttttgtatagtcgggtttcggttatttcggtttttaattcggcgtttcggttttgaattttcgttttcgttttttgttttatatttttttttttttcgttttcgttttttttagtttttaagtcgcggcgttttcgcggtcgagaggttttagcgttcgttttttcggttttcgtttttattttcgttttcggttttgtttacgtttttcgttcgttagttcggtagttagcgtagtttcgggtttcgttttttgtgcgttttgcgggggcggaggcgcggagagggcgtaagcgtagtcggggagggtgggggggtagaggtatagatagaggcgcggaggttcggagagagaagacgtggagggagggatagagtttggatagcggtggattacggtatcgtgcgcggggaagagggtagtacgtagtaggcgtcgagcgtcgggtatcgagaagggtattcggggtgattttcggttcgtttatgtatagagcgtttttttttatagtcgagtagtcgtcgggcggaggggatagcgttcgtcggattttgtagtttatatttaagttagtgggtaaagggaggtagcggggagtggagatgggtggagtt

SEQ ID NO: 36538 - DNA, 916 bp, Artificial Sequence
  chemically treated genomic DNA (Homo sapiens) CpG-island No: 36538
aactccacccatctccactccccgctacctccctttacccactaacttaaatataaactacaaaatccgacgaacgctatcccctccgcccgacgactactcgactataaaaaaaaacgctctatacataaacgaaccgaaaatcaccccgaatacccttctcgatacccgacgctcgacgcctactacgtactaccctcttccccgcgcacgataccgtaatccaccgctatccaaactctatccctccctccacgtcttctctctccgaacctccgcgcctctatctatacctctacccccccaccctccccgactacgcttacgccctctccgcgcctccgcccccgcaaaacgcacaaaaaacgaaacccgaaactacgctaactaccgaactaacgaacgaaaaacgtaaacaaaaccgaaaacgaaaataaaaacgaaaaccgaaaaaacgaacgctaaaacctctcgaccgcgaaaacgccgcgacttaaaaactaaaaaaaacgaaaacgaaaaaaaaaaaaatataaaacaaaaaacgaaaacgaaaattcaaaaccgaaacgccgaattaaaaaccgaaataaccgaaacccgactatacaaaacgaacttaaaaacccaacgaacgaaacgaaatcgttctataccgcccacgccgaatacacaaccgaccctcttaacgcccacgtacccacgtaaacgccccgccgacgacattccttctctcccccacccctccgaactaaaaaaaaaatttcacaaccacgcacaaatacacaaaaacacaaaaacgcacgaacgtacacacgcgcctaaacaactacgaaaacgcccgttacccatactcaaaccttataatactaaacgtataaatattaacaataaaccgaaaaaaattaacgaaaac

SEQ ID NO: 36539 - DNA, 916 bp, Artificial Sequence
  chemically treated genomic DNA (Homo sapiens) CpG-island No: 36539
agttttatttatttttatttttcgttgtttttttttgtttattaatttgagtatgggttgtagggttcggcgggcgttgtttttttcgttcggcggttgttcgattgtgggggaaggcgttttgtgtatgaacgggtcgaagattatttcgggtgtttttttcggtgttcggcgttcggcgtttgttgcgtgttgttttttttttcgcgtacgatgtcgtggtttatcgttgtttaggttttgtttttttttttacgtttttttttttcgagttttcgcgtttttgtttgtgtttttgtttttttatttttttcgattgcgtttgcgtttttttcgcgttttcgttttcgtaggacgtatagggagcgaggttcggagttgcgttggttgtcgggttggcgggcggagggcgtgggtagagtcgggggcgggggtgggggcgggggtcggggaggcgggcgttggggtttttcggtcgcggagacgtcgcggtttagagattgggagaggcggagacggggggggagggggtgtggagtaggaggcgggggcggggatttagagtcggggcgtcgaattggggatcgaggtgatcgaggttcggttgtgtagggcgggtttggggatttagcgggcggggcgaggtcgttttgtgtcgtttacgtcggatgtatagtcggtttttttggcgtttacgtatttacgtgagcgtttcgtcggcgatatttttttttttttttattttttcgagttgagagaggagttttataattacgtataagtatataaagatatagaagcgtacggacgtgtatacgcgtttaaataattacggggacgttcgttgtttatatttaggttttgtggtgttggacgtgtgaatgttagtagtgagtcgggaaaagttagcgaaggt

SEQ ID NO: 36540 - DNA, 916 bp, Artificial Sequence
  chemically treated genomic DNA (Homo sapiens) CpG-island No: 36540
accttcgctaacttttcccgactcactactaacattcacacgtccaacaccacaaaacctaaatataaacaacgaacgtccccgtaattatttaaacgcgtatacacgtccgtacgcttctatatctttatatacttatacgtaattataaaactcctctctcaactcgaaaaaataaaaaaaaaaaaaaatatcgccgacgaaacgctcacgtaaatacgtaaacgccaaaaaaaccgactatacatccgacgtaaacgacacaaaacgacctcgccccgcccgctaaatccccaaacccgccctacacaaccgaacctcgatcacctcgatccccaattcgacgccccgactctaaatccccgcccccgcctcctactccacaccccctccccccccgtctccgcctctcccaatctctaaaccgcgacgtctccgcgaccgaaaaaccccaacgcccgcctccccgacccccgcccccacccccgcccccgactctacccacgccctccgcccgccaacccgacaaccaacgcaactccgaacctcgctccctatacgtcctacgaaaacgaaaacgcgaaaaaaacgcaaacgcaatcgaaaaaaataaaaaaacaaaaacacaaacaaaaacgcgaaaactcgaaaaaaaaaaacgtaaaaaaaaaaacaaaacctaaacaacgataaaccacgacatcgtacgcgaaaaaaaaaacaacacgcaacaaacgccgaacgccgaacaccgaaaaaaacacccgaaataatcttcgacccgttcatacacaaaacgccttcccccacaatcgaacaaccgccgaacgaaaaaaacaacgcccgccgaaccctacaacccatactcaaattaataaacaaaaaaaaacaacgaaaaataaaaataaataaaact

SEQ ID NO: 36541 - DNA, 514 bp, Artificial Sequence
  chemically treated genomic DNA (Homo sapiens) CpG-island No: 36541
cgaatttcgtttcgatatgtagagggagtagtcgagcggtaatgttagaggattagatgtagttcgaaaacggtagtatcgagatatcgtggacgtcgatcgcgtgggtcgacgtattcgagtcgtatcgtcgggtttatggtatttatcgagtcgaacggtttatatcgttggatgattcgatgtgtaaatagttcggtagacgtgcggtggttgtttattagtagttaattatcgatgtgcgtgcgtcggtttttattttcgttacgttatatgggttgtcgttagttattattttcgtgtatattattaaagttatttcgttattatttggtcgcgtcgttatttcgtcgtcgggcgttttgatatttgtagtcgtaatagacgttgtttcgtcgtacgttttattatggttaggtagcgtacgttttatttattatttgtttgttatatattagttcgtttaggttatgtgagagggtttgcggtttcgggatagaggtatagatataag

SEQ ID NO: 36542 - DNA, 514 bp, Artificial Sequence
  chemically treated genomic DNA (Homo sapiens) CpG-island No: 36542
cttatatctatacctctatcccgaaaccgcaaaccctctcacataacctaaacgaactaatatataacaaacaaataataaataaaacgtacgctacctaaccataataaaacgtacgacgaaacaacgtctattacgactacaaatatcaaaacgcccgacgacgaaataacgacgcgaccaaataataacgaaataactttaataatatacacgaaaataataactaacgacaacccatataacgtaacgaaaataaaaaccgacgcacgcacatcgataattaactactaataaacaaccaccgcacgtctaccgaactatttacacatcgaatcatccaacgatataaaccgttcgactcgataaataccataaacccgacgatacgactcgaatacgtcgacccacgcgatcgacgtccacgatatctcgatactaccgttttcgaactacatctaatcctctaacattaccgctcgactactccctctacatatcgaaacgaaattcg

SEQ ID NO: 36543 - DNA, 514 bp, Artificial Sequence
  chemically treated genomic DNA (Homo sapiens) CpG-island No: 36543
tttgtgtttatgtttttgtttcgaagtcgtagatttttttatatagtttgaacgagttagtgtgtggtaggtagataatgagtgaggcgtgcgttatttagttatgatgaggcgtacggcgaaataacgtttgttacgattatagatattaggacgttcgacgacgggatgacgacgcggttagatggtgacgaggtaattttgatgatgtgtacgaaggtggtggttgacgataatttatgtggcgtaacgaggatgaagatcgacgtacgtatatcgatgattgattgttgatggataattatcgtacgtttgtcggattgtttatatatcggattatttaacggtatagatcgttcgattcgatggatgttatggattcgacggtacggttcgggtacgtcgatttacgcgatcggcgtttacgatatttcgatgttatcgttttcggattatatttagttttttgatattgtcgttcggttattttttttatatgtcgaagcggagttcg

SEQ ID NO: 36544 - DNA, 514 bp, Artificial Sequence
  chemically treated genomic DNA (Homo sapiens) CpG-island No: 36544
cgaactccgcttcgacatataaaaaaaataaccgaacgacaatatcaaaaaactaaatataatccgaaaacgataacatcgaaatatcgtaaacgccgatcgcgtaaatcgacgtacccgaaccgtaccgtcgaatccataacatccatcgaatcgaacgatctataccgttaaataatccgatatataaacaatccgacaaacgtacgataattatccatcaacaatcaatcatcgatatacgtacgtcgatcttcatcctcgttacgccacataaattatcgtcaaccaccaccttcgtacacatcatcaaaattacctcgtcaccatctaaccgcgtcgtcatcccgtcgtcgaacgtcctaatatctataatcgtaacaaacgttatttcgccgtacgcctcatcataactaaataacgcacgcctcactcattatctacctaccacacactaactcgttcaaactatataaaaaaatctacgacttcgaaacaaaaacataaacacaaa

SEQ ID NO: 36545 - DNA, 637 bp, Artificial Sequence
  chemically treated genomic DNA (Homo sapiens) CpG-island No: 36545
cggtttcgggacgttttttgggagtcgtcgtcgagggtttgttgggattttcgggggatttcgtcgtcggggtagtttttacgttcggcgtcgtcgtcgataacgcgcgtcgttgttgcgtatttgtaggggagtcggcgattgagggcgaggtagggagggagtaagcggggttgggagggttgttggcgcgggttcggtttgtgtatggtttatcgtaggtagttgatttttgaggaggaaatcgttgtttttcgtttttttttgtagtaatagtcgtcgttgtcgtcgtcgttaggaatttcggtcgggagcgagatcgcggggcgtagagcggttcggttgtcgattgtgcggttttattaggtgggtgattcggtggcgcgttttcggcggcgttagaagtgggatattttattgtcgtttcgcgattttcggtattcggagttcgacggtcgggcgtacgcgggaattagttacggtattgcgagggagttgtttagcgtagacgagggacggggggacgtggggataggggtcggggatgaaagtagaggttagggagggcgcgtttttggtacgtttcggagagggagtattgtcgggttggattcggggagtattagtgtatagatgg

SEQ ID NO: 36546 - DNA, 637 bp, Artificial Sequence
  chemically treated genomic DNA (Homo sapiens) CpG-island No: 36546
ccatctatacactaatactccccgaatccaacccgacaatactccctctccgaaacgtaccaaaaacgcgccctccctaacctctactttcatccccgacccctatccccacgtccccccgtccctcgtctacgctaaacaactccctcgcaataccgtaactaattcccgcgtacgcccgaccgtcgaactccgaataccgaaaatcgcgaaacgacaataaaatatcccacttctaacgccgccgaaaacgcgccaccgaatcacccacctaataaaaccgcacaatcgacaaccgaaccgctctacgccccgcgatctcgctcccgaccgaaattcctaacgacgacgacaacgacgactattactacaaaaaaaaacgaaaaacaacgatttcctcctcaaaaatcaactacctacgataaaccatacacaaaccgaacccgcgccaacaaccctcccaaccccgcttactccctccctacctcgccctcaatcgccgactcccctacaaatacgcaacaacgacgcgcgttatcgacgacgacgccgaacgtaaaaactaccccgacgacgaaatcccccgaaaatcccaacaaaccctcgacgacgactcccaaaaaacgtcccgaaaccg

SEQ ID NO: 36547 - DNA, 637 bp, Artificial Sequence
  chemically treated genomic DNA (Homo sapiens) CpG-island No: 36547
ttatttgtgtattagtgtttttcgggtttagttcgatagtgtttttttttcgaggcgtgttaggaacgcgttttttttggtttttgtttttattttcgatttttgtttttacgttttttcgtttttcgtttgcgttgggtaattttttcgtagtgtcgtgattgattttcgcgtgcgttcggtcgtcgagtttcgggtgtcggaggtcgcggggcggtagtagagtgttttatttttggcgtcgtcgaggacgcgttatcgggttatttatttggtggggtcgtatagtcggtagtcgggtcgttttgcgtttcgcggtttcgttttcggtcggggtttttggcggcggcggtagcggcggttgttattataggaaggagcggagagtagcgattttttttttaaaggttagttgtttgcgatagattatatataggtcgagttcgcgttagtagtttttttagtttcgtttgttttttttttgtttcgtttttagtcgtcggtttttttgtaagtgcgtaatagcggcgcgcgttatcggcggcggcgtcgggcgtgggggttgtttcgacggcggggtttttcgggagttttagtaggttttcggcggcggtttttagggagcgtttcggaatcg

SEQ ID NO: 36548 - DNA, 637 bp, Artificial Sequence
  chemically treated genomic DNA (Homo sapiens) CpG-island No: 36548
cgattccgaaacgctccctaaaaaccgccgccgaaaacctactaaaactcccgaaaaaccccgccgtcgaaacaacccccacgcccgacgccgccgccgataacgcgcgccgctattacgcacttacaaaaaaaccgacgactaaaaacgaaacaaaaaaaaaacaaacgaaactaaaaaaactactaacgcgaactcgacctatatataatctatcgcaaacaactaacctttaaaaaaaaaatcgctactctccgctccttcctataataacaaccgccgctaccgccgccgccaaaaaccccgaccgaaaacgaaaccgcgaaacgcaaaacgacccgactaccgactatacgaccccaccaaataaataacccgataacgcgtcctcgacgacgccaaaaataaaacactctactaccgccccgcgacctccgacacccgaaactcgacgaccgaacgcacgcgaaaatcaatcacgacactacgaaaaaattacccaacgcaaacgaaaaacgaaaaaacgtaaaaacaaaaatcgaaaataaaaacaaaaaccaaaaaaaacgcgttcctaacacgcctcgaaaaaaaaacactatcgaactaaacccgaaaaacactaatacacaaataa

SEQ ID NO: 36549 - DNA, 509 bp, Artificial Sequence
  chemically treated genomic DNA (Homo sapiens) CpG-island No: 36549
gcgagcgttgaggtttcgggtttttaggttatcgtttgtttcgttttcgtatcgtttcggtttcgttttttttttttttcgtttcgtttcgttttattttttgttgtttttttcgattttttttcgcgtcgttaagttttttcgttcgtcgtttcgtttagagtcggggtcgggttagagcggcgtttcgttgttttgttttcgcgtgtagatttcgggttcggttcggtttttcgttaagttatgttgtgcggtcgttggagggttgtcgtcgttcgttcgaggagtttttagtggtcgtttaggtcgtagtttaagtcgcggcgtcggtcgttttttcgttttcgtcgatttttttcgatggcggtattaagaggttcgggttgcgggcgttgaagaagatgggttagtgacgggtaaggggcggtggggtgggcgcggatcgtttttagaggtttagtttggggcgttttagggagtagttcgtggattttttaggttgtacgggg

SEQ ID NO: 36550 - DNA, 509 bp, Artificial Sequence
  chemically treated genomic DNA (Homo sapiens) CpG-island No: 36550
ccccgtacaacctaaaaaatccacgaactactccctaaaacgccccaaactaaacctctaaaaacgatccgcgcccaccccaccgccccttacccgtcactaacccatcttcttcaacgcccgcaacccgaacctcttaataccgccatcgaaaaaaatcgacgaaaacgaaaaaacgaccgacgccgcgacttaaactacgacctaaacgaccactaaaaactcctcgaacgaacgacgacaaccctccaacgaccgcacaacataacttaacgaaaaaccgaaccgaacccgaaatctacacgcgaaaacaaaacaacgaaacgccgctctaacccgaccccgactctaaacgaaacgacgaacgaaaaaacttaacgacgcgaaaaaaaatcgaaaaaaacaacaaaaaataaaacgaaacgaaacgaaaaaaaaaaaaaacgaaaccgaaacgatacgaaaacgaaacaaacgataacctaaaaacccgaaacctcaacgctcgc

SEQ ID NO: 36551 - DNA, 509 bp, Artificial Sequence
  chemically treated genomic DNA (Homo sapiens) CpG-island No: 36551
tttcgtgtagtttggggaatttacgaattgttttttggagcgttttagattgggtttttgggaacggttcgcgtttattttatcgttttttgttcgttattgatttattttttttagcgttcgtagttcgggttttttggtgtcgttatcggagggagtcggcggggacgggagagcgatcggcgtcgcgatttgggttgcgatttgggcggttattgggggtttttcgggcgggcggcggtaattttttagcggtcgtatagtatggtttggcggggggtcgggtcgggttcggggtttgtacgcggggatagggtagcggggcgtcgttttggttcggtttcggttttgagcgaggcggcgagcgaagaaatttagcggcgcgggagggagtcggaggaggtagtaggaggtggggcggggcggggcgggaagggaagggggcggggtcggggcggtgcgagggcggggtaggcggtggtttggaagttcggagttttagcgttcgt

SEQ ID NO: 36552 - DNA, 509 bp, Artificial Sequence
  chemically treated genomic DNA (Homo sapiens) CpG-island No: 36552
acgaacgctaaaactccgaacttccaaaccaccgcctaccccgccctcgcaccgccccgaccccgcccccttcccttcccgccccgccccgccccacctcctactacctcctccgactccctcccgcgccgctaaatttcttcgctcgccgcctcgctcaaaaccgaaaccgaaccaaaacgacgccccgctaccctatccccgcgtacaaaccccgaacccgacccgaccccccgccaaaccatactatacgaccgctaaaaaattaccgccgcccgcccgaaaaacccccaataaccgcccaaatcgcaacccaaatcgcgacgccgatcgctctcccgtccccgccgactccctccgataacgacaccaaaaaacccgaactacgaacgctaaaaaaaataaatcaataacgaacaaaaaacgataaaataaacgcgaaccgttcccaaaaacccaatctaaaacgctccaaaaaacaattcgtaaattccccaaactacacgaaa

SEQ ID NO: 36553 - DNA, 505 bp, Artificial Sequence
  chemically treated genomic DNA (Homo sapiens) CpG-island No: 36553
  misc_feature (299)..(300): n is either a, c, g or t
  misc_feature (302)..(302): n is either a, c, g or t
  misc_feature (401)..(401): n is either a, c, g or t
acgaggacgtgcgcgttatgttgcggggttttcggtttcgtaagattcgttcgcgtacgtggtataaggagcggttgtatcggttgtaggaggacggtttgagcgtgtggttttagcggcgtatttcgcgtgcgttatcgtagtatatttgtgagaggtcggggagcgtcgggcggatagggaggtgggataggttcggtttttcgttttgattcgattttttttttagttttcgtgtagtatatcgaggcggttcgcgagggttattagttcgagggtttgcgcgtttcgggggtgtnntntgtttagtcgttgttttattatcgtttttaaggtcgtcgtaagaatttggatttgcggttttacggttgaggaagcgtagttgggtggcggtttgattnaagtcgcgcgcgtttggacgttatgagttagcgcgagcggttagattaatattttgtcggggttgggagggagggttttatttttggagagttttaattttgga

SEQ ID NO: 36554 - DNA, 505 bp, Artificial Sequence
  chemically treated genomic DNA (Homo sapiens) CpG-island No: 36554
  misc_feature (105)..(105): n is either a, c, g or t
  misc_feature (204)..(204): n is either a, c, g or t
  misc_feature (206)..(207): n is either a, c, g or t
tccaaaattaaaactctccaaaaataaaaccctccctcccaaccccgacaaaatattaatctaaccgctcgcgctaactcataacgtccaaacgcgcgcgacttnaatcaaaccgccacccaactacgcttcctcaaccgtaaaaccgcaaatccaaattcttacgacgaccttaaaaacgataataaaacaacgactaaacanannacacccccgaaacgcgcaaaccctcgaactaataaccctcgcgaaccgcctcgatatactacacgaaaactaaaaaaaaaatcgaatcaaaacgaaaaaccgaacctatcccacctccctatccgcccgacgctccccgacctctcacaaatatactacgataacgcacgcgaaatacgccgctaaaaccacacgctcaaaccgtcctcctacaaccgatacaaccgctccttataccacgtacgcgaacgaatcttacgaaaccgaaaaccccgcaacataacgcgcacgtcctcgt

SEQ ID NO: 36555 - DNA, 505 bp, Artificial Sequence
  chemically treated genomic DNA (Homo sapiens) CpG-island No: 36555
  misc_feature (105)..(105): n is either a, c, g or t
  misc_feature (204)..(204): n is either a, c, g or t
  misc_feature (206)..(207): n is either a, c, g or t
tttaaggttagggttttttaaggatggggtttttttttttagtttcggtaggatattggtttagtcgttcgcgttggtttatggcgtttaggcgcgcgcgatttnggttagatcgttatttagttgcgtttttttagtcgtgggatcgtaggtttaggtttttgcggcggttttgaaggcgatggtgaggtagcggttgagtangnngtattttcgaagcgcgtaggttttcggattggtggttttcgcggatcgtttcgatgtgttgtacgaagattgagaggagggtcgggttagggcggaggatcgggtttgttttatttttttgttcgttcggcgtttttcggttttttatagatgtgttgcgatggcgtacgcgggatgcgtcgttggaattatacgtttaggtcgtttttttgtagtcggtatagtcgttttttgtgttacgtgcgcgagcggattttgcggagtcgggagtttcgtagtatggcgcgtacgttttcgt

SEQ ID NO: 36556 - DNA, 505 bp, Artificial Sequence
  chemically treated genomic DNA (Homo sapiens) CpG-island No: 36556
  misc_feature (299)..(300): n is either a, c, g or t
  misc_feature (302)..(302): n is either a, c, g or t
  misc_feature (401)..(401): n is either a, c, g or t
acgaaaacgtacgcgccatactacgaaactcccgactccgcaaaatccgctcgcgcacgtaacacaaaaaacgactataccgactacaaaaaaacgacctaaacgtataattccaacgacgcatcccgcgtacgccatcgcaacacatctataaaaaaccgaaaaacgccgaacgaacaaaaaaataaaacaaacccgatcctccgccctaacccgaccctcctctcaatcttcgtacaacacatcgaaacgatccgcgaaaaccaccaatccgaaaacctacgcgcttcgaaaatacnncntactcaaccgctacctcaccatcgccttcaaaaccgccgcaaaaacctaaacctacgatcccacgactaaaaaaacgcaactaaataacgatctaaccnaaatcgcgcgcgcctaaacgccataaaccaacgcgaacgactaaaccaatatcctaccgaaactaaaaaaaaaaaccccatccttaaaaaaccctaaccttaaa

SEQ ID NO: 36557 - DNA, 902 bp, Artificial Sequence
  chemically treated genomic DNA (Homo sapiens) CpG-island No: 36557
  misc_feature (492)..(493): n is either a, c, g or t
  misc_feature (496)..(496): n is either a, c, g or t
aggaggttcggtcggttttgggttttagttagcggttcgcggagattttggttttcgaaggtttttgacgtcgggtatttcgcgagttgcgcgttttttttagtcgcgttatttgcgttcggagttttgtcgcgttattcgcgttcggagtttagtcgtatcgcgttgtgtcgagtttaggcgtttagggtttttcgttttcgattcgagttttcgcgttttttttagcgggtcgtcgtagcgtcgtttcgttttaggttcgtcggcggcgtagtttacgtgatcgcgttttgggtttgcggtcgttgtcggtttttttagttatcgagcgagagggaagaaataagatggcggttgaaggcgattcggagtggggttttagtaattcggattgagttttttttttttattcgttttcgtcggtcgggtttttttcgttcggttcgcgtgttttttattcggtttcggcgttttttatcgatttttttgcgnncgntttttttttttcgtttttttttttttttcgtttcggtttcgatatgaggggtcggcggggtaggcgttttaagtagttcgcggtttcgttgcgacgttgcgtttcggtttcgcgttatcgtcgtcgtcgtttacgttcggatttatcgggggtttcgttcgcggtatcgcgtagtagtcggggtaggtgggacgtcgtttaggttgaggtggcgtttaagacgcggttgagttcgtttagggggggtagtagtagtcggaggaaagtcgtttcgtcgcgtcggttttttttagtattagcgtttcgggtcggggggggcgaggaggcgggggcggtaggacggggggggggggcggcggcgttatttggttcggattattcgcggagggtcgttaataaagtggtg

SEQ ID NO: 36558 - DNA, 902 bp, Artificial Sequence
  chemically treated genomic DNA (Homo sapiens) CpG-island No: 36558
  misc_feature (407)..(407): n is either a, c, g or t
  misc_feature (410)..(411): n is either a, c, g or t
caccactttattaacgaccctccgcgaataatccgaaccaaataacgccgccgccccccccccccgtcctaccgcccccgcctcctcgccccccccgacccgaaacgctaatactaaaaaaaaccgacgcgacgaaacgactttcctccgactactactaccccccctaaacgaactcaaccgcgtcttaaacgccacctcaacctaaacgacgtcccacctaccccgactactacgcgataccgcgaacgaaacccccgataaatccgaacgtaaacgacgacgacgataacgcgaaaccgaaacgcaacgtcgcaacgaaaccgcgaactacttaaaacgcctaccccgccgacccctcatatcgaaaccgaaacgaaaaaaaaaaaaaaacgaaaaaaaaaaancgnncgcaaaaaaatcgataaaaaacgccgaaaccgaataaaaaacacgcgaaccgaacgaaaaaaacccgaccgacgaaaacgaataaaaaaaaaaaactcaatccgaattactaaaaccccactccgaatcgccttcaaccgccatcttatttcttccctctcgctcgataactaaaaaaaccgacaacgaccgcaaacccaaaacgcgatcacgtaaactacgccgccgacgaacctaaaacgaaacgacgctacgacgacccgctaaaaaaaacgcgaaaactcgaatcgaaaacgaaaaaccctaaacgcctaaactcgacacaacgcgatacgactaaactccgaacgcgaataacgcgacaaaactccgaacgcaaataacgcgactaaaaaaaacgcgcaactcgcgaaatacccgacgtcaaaaaccttcgaaaaccaaaatctccgcgaaccgctaactaaaacccaaaaccgaccgaacctcct

SEQ ID NO: 36559 - DNA, 902 bp, Artificial Sequence
  chemically treated genomic DNA (Homo sapiens) CpG-island No: 36559
  misc_feature (407)..(407): n is either a, c, g or t
  misc_feature (410)..(411): n is either a, c, g or t
tattattttgttgacggtttttcgcgggtggttcgggttaggtggcgtcgtcgtttttttttttcgttttgtcgttttcgttttttcgtttttttcggttcggggcgttggtgttggggggggtcggcgcggcggggcggttttttttcggttattgttgttttttttgggcgagtttagtcgcgttttgggcgttattttagtttgggcggcgttttatttgtttcggttgttgcgcggtgtcgcgagcggagttttcgatgggttcggacgtgggcggcggcggcggtggcgcggggtcggggcgtagcgtcgtagcgggatcgcgggttgtttgaggcgtttgtttcgtcggttttttatgtcggagtcgaggcggggggagaaggaaagcgaagggggagggncgnncgtagggggatcggtgggaagcgtcgggatcgggtgggaagtacgcgggtcgggcgggaggggttcggtcgacggaagcgggtggagggagaaggtttaattcgaattgttggggttttatttcggatcgtttttagtcgttattttgttttttttttttcgttcggtgattgggggaatcgatagcggtcgtaggtttagagcgcggttacgtgagttgcgtcgtcgacgagtttgggacggagcgacgttgcgacggttcgttagggggagcgcgggagttcgagtcgggggcggggagttttgggcgtttgggttcggtatagcgcggtgcggttggatttcgggcgcgggtggcgcggtaaaatttcgggcgtaggtggcgcggttgagaggggcgcgtagttcgcgaaatgttcggcgttaaaggttttcggagattaaagttttcgcggatcgttggttggagtttaaagtcggtcggatttttt

SEQ ID NO: 36560 - DNA, 902 bp, Artificial Sequence
  chemically treated genomic DNA (Homo sapiens) CpG-island No: 36560
  misc_feature (492)..(493): n is either a, c, g or t
  misc_feature (496)..(496): n is either a, c, g or t
aaaaaatccgaccgactttaaactccaaccaacgatccgcgaaaactttaatctccgaaaacctttaacgccgaacatttcgcgaactacgcgcccctctcaaccgcgccacctacgcccgaaattttaccgcgccacccgcgcccgaaatccaaccgcaccgcgctataccgaacccaaacgcccaaaactccccgcccccgactcgaactcccgcgctccccctaacgaaccgtcgcaacgtcgctccgtcccaaactcgtcgacgacgcaactcacgtaaccgcgctctaaacctacgaccgctatcgattcccccaatcaccgaacgaaaaaaaaaaaacaaaataacgactaaaaacgatccgaaataaaaccccaacaattcgaattaaaccttctccctccacccgcttccgtcgaccgaacccctcccgcccgacccgcgtacttcccacccgatcccgacgcttcccaccgatccccctacgnncgnccctcccccttcgctttccttctccccccgcctcgactccgacataaaaaaccgacgaaacaaacgcctcaaacaacccgcgatcccgctacgacgctacgccccgaccccgcgccaccgccgccgccgcccacgtccgaacccatcgaaaactccgctcgcgacaccgcgcaacaaccgaaacaaataaaacgccgcccaaactaaaataacgcccaaaacgcgactaaactcgcccaaaaaaaacaacaataaccgaaaaaaaaccgccccgccgcgccgaccccccccaacaccaacgccccgaaccgaaaaaaacgaaaaaacgaaaacgacaaaacgaaaaaaaaaaacgacgacgccacctaacccgaaccacccgcgaaaaaccgtcaacaaaataata

SEQ ID NO: 36561 - DNA, 683 bp, Artificial Sequence
  chemically treated genomic DNA (Homo sapiens) CpG-island No: 36561
gtaattttcgtattaggtatttaagaacgtgttttggatatattcggcggtgggagcgggtgtttggtttgtattagggatgaggggtggagtagcgaaagtttcggagcgtaatttatttatattttttaagttagggcgcggtcgttttgggcgcgaggttttaagttaagtttcgcgttcggttaggagtcggggagtattttaggttttcggtttggggtcgtcgttattttattttgcggcgcgtatttttgatttggtttcgttttcggcggcgcgagtagcgggcggagcgtaagtagagaggcgttttgggttgtgcggtatcgttttttttcggtgtttggggagggacggagggatcgggcgggagagagagaaagtttgatcgatcggttggcgaagagttgtatgtaatcggtgggaggtcgggtcggttgggtttggggttcgggtttaggttcgtatcgtttttcggtaggtttttggcggtgagcgcggacggttcggaggcggcggttttgagttggtaggcggagggttgttttttgcgttcgtttgttcggcgcggttcgaggatgcgggggggcgatgttcggggttagggacgcgttttgttattaggcgttgtagttgttggtcgagttttgtgttcgtggggttttggagtacgatagttg

SEQ ID NO: 36562 - DNA, 683 bp, Artificial Sequence
  chemically treated genomic DNA (Homo sapiens) CpG-island No: 36562
caactatcgtactccaaaaccccacgaacacaaaactcgaccaacaactacaacgcctaataacaaaacgcgtccctaaccccgaacatcgcccccccgcatcctcgaaccgcgccgaacaaacgaacgcaaaaaacaaccctccgcctaccaactcaaaaccgccgcctccgaaccgtccgcgctcaccgccaaaaacctaccgaaaaacgatacgaacctaaacccgaaccccaaacccaaccgacccgacctcccaccgattacatacaactcttcgccaaccgatcgatcaaactttctctctctcccgcccgatccctccgtccctccccaaacaccgaaaaaaaacgataccgcacaacccaaaacgcctctctacttacgctccgcccgctactcgcgccgccgaaaacgaaaccaaatcaaaaatacgcgccgcaaaataaaataacgacgaccccaaaccgaaaacctaaaatactccccgactcctaaccgaacgcgaaacttaacttaaaacctcgcgcccaaaacgaccgcgccctaacttaaaaaatataaataaattacgctccgaaactttcgctactccacccctcatccctaatacaaaccaaacacccgctcccaccgccgaatatatccaaaacacgttcttaaatacctaatacgaaaattac

SEQ ID NO: 36563 - DNA, 683 bp, Artificial Sequence
  chemically treated genomic DNA (Homo sapiens) CpG-island No: 36563
tagttgtcgtgttttagggttttacgggtatagagttcggttagtagttgtagcgtttggtgatagagcgcgtttttggtttcgggtatcgttttttcgtattttcggatcgcgtcgggtaggcgggcgtaggagatagtttttcgtttgttagtttagagtcgtcgttttcgggtcgttcgcgtttatcgttagggatttgtcgagaaacggtgcgagtttgagttcgagttttagatttagtcggttcggttttttatcggttgtatgtagtttttcgttagtcggtcggttaggttttttttttttttcgttcggttttttcgtttttttttagatatcgaggagaggcggtgtcgtatagtttagagcgtttttttgtttgcgtttcgttcgttattcgcgtcgtcgggggcggggttaggttaggagtgcgcgtcgtagggtaggatagcggcggttttagatcggggatttggggtatttttcggtttttggtcgagcgcgagatttggtttgggatttcgcgtttagagcggtcgcgttttggtttggggagtgtgagtgagttgcgtttcggagttttcgttattttattttttatttttgatgtaaattaagtattcgtttttatcgtcgagtgtgtttaaagtacgtttttggatgtttagtgcgaaggttat

SEQ ID NO: 36564 - DNA, 683 bp, Artificial Sequence
  chemically treated genomic DNA (Homo sapiens) CpG-island No: 36564
ataaccttcgcactaaacatccaaaaacgtactttaaacacactcgacgataaaaacgaatacttaatttacatcaaaaataaaaaataaaataacgaaaactccgaaacgcaactcactcacactccccaaaccaaaacgcgaccgctctaaacgcgaaatcccaaaccaaatctcgcgctcgaccaaaaaccgaaaaataccccaaatccccgatctaaaaccgccgctatcctaccctacgacgcgcactcctaacctaaccccgcccccgacgacgcgaataacgaacgaaacgcaaacaaaaaaacgctctaaactatacgacaccgcctctcctcgatatctaaaaaaaaacgaaaaaaccgaacgaaaaaaaaaaaaaacctaaccgaccgactaacgaaaaactacatacaaccgataaaaaaccgaaccgactaaatctaaaactcgaactcaaactcgcaccgtttctcgacaaatccctaacgataaacgcgaacgacccgaaaacgacgactctaaactaacaaacgaaaaactatctcctacgcccgcctacccgacgcgatccgaaaatacgaaaaaacgatacccgaaaccaaaaacgcgctctatcaccaaacgctacaactactaaccgaactctatacccgtaaaaccctaaaacacgacaacta

SEQ ID NO: 36565 - DNA, 617 bp, Artificial Sequence
  chemically treated genomic DNA (Homo sapiens) CpG-island No: 36565
ttttcgagcgtttttttcgttttcgcgtcgtttggatttttcggggagttcggtcgcgattggcgggcgcggagttttttttttttcggagtttaggaaggcggtttttcgcggcgtcggtcgcgcgcgcgttcgtttttattttgattggacgcggttatttcggtgagtttgtttcgcgaggatatacgtagaggatttgcgcggtaggtcgcggagtggcgcgtagttgtcgttattatttggttttcggtacgtggggtagatgtttttatttttacggcggtagcggaagagggagggtcgggcgcgtcgcggttgtttgtagttttcgtaagcggttatattatagagtttagcgtgcggtgttataggtttcgcggtttcgtttaatagatgtatcgagatgcgcgtgcgtagaaagcgtttcgggggtgaggttttttttttcgttttttttttattttcgttttatttttttttatttttttttttttatttatcgcggtcgtcggggttcgttcgtttagtatttggaggcgagtttttgacgcgattgcgatttaattttcgtttggtgaagaatattttatttatgatttattgaaaataaagat

SEQ ID NO: 36566 - DNA, 617 bp, Artificial Sequence
  chemically treated genomic DNA (Homo sapiens) CpG-island No: 36566
atctttattttcaataaatcataaataaaatattcttcaccaaacgaaaattaaatcgcaatcgcgtcaaaaactcgcctccaaatactaaacgaacgaaccccgacgaccgcgataaataaaaaaaaaaaaataaaaaaaaataaaacgaaaataaaaaaaaaacgaaaaaaaaaacctcacccccgaaacgctttctacgcacgcgcatctcgatacatctattaaacgaaaccgcgaaacctataacaccgcacgctaaactctataatataaccgcttacgaaaactacaaacaaccgcgacgcgcccgaccctccctcttccgctaccgccgtaaaaataaaaacatctaccccacgtaccgaaaaccaaataataacgacaactacgcgccactccgcgacctaccgcgcaaatcctctacgtatatcctcgcgaaacaaactcaccgaaataaccgcgtccaatcaaaataaaaacgaacgcgcgcgcgaccgacgccgcgaaaaaccgccttcctaaactccgaaaaaaaaaaaactccgcgcccgccaatcgcgaccgaactccccgaaaaatccaaacgacgcgaaaacgaaaaaaacgctcgaaaa

SEQ ID NO: 36567 - DNA, 617 bp, Artificial Sequence
  chemically treated genomic DNA (Homo sapiens) CpG-island No: 36567
gtttttatttttagtgagttataggtaaaatattttttattaggcgaggattgagtcgtagtcgcgttaggaattcgtttttaggtattgagcgagcgagtttcgacggtcgcggtgggtggaggggggaaagtgggggagagtggggcgggagtagagggagagcgagggagggagttttattttcgggacgttttttgcgtacgcgtatttcggtgtatttgttgggcgggatcgcggggtttgtgatatcgtacgttgagttttgtgatgtagtcgtttgcggagattgtaagtagtcgcggcgcgttcggttttttttttttcgttgtcgtcgtgggaatggaaatatttgttttacgtgtcggaagttaagtggtggcgataattgcgcgttatttcgcggtttatcgcgtagattttttacgtgtgttttcgcgagataagtttatcgaaatggtcgcgtttagttaaggtaagggcgggcgcgcgcgcggtcggcgtcgcggggagtcgtttttttgggtttcggaaggggaagggtttcgcgttcgttagtcgcgatcgagtttttcggggagtttaagcggcgcggggacggggagggcgttcgggga

SEQ ID NO: 36568 - DNA, 617 bp, Artificial Sequence
  chemically treated genomic DNA (Homo sapiens) CpG-island No: 36568
tccccgaacgccctccccgtccccgcgccgcttaaactccccgaaaaactcgatcgcgactaacgaacgcgaaacccttccccttccgaaacccaaaaaaacgactccccgcgacgccgaccgcgcgcgcgcccgcccttaccttaactaaacgcgaccatttcgataaacttatctcgcgaaaacacacgtaaaaaatctacgcgataaaccgcgaaataacgcgcaattatcgccaccacttaacttccgacacgtaaaacaaatatttccattcccacgacgacaacgaaaaaaaaaaaaccgaacgcgccgcgactacttacaatctccgcaaacgactacatcacaaaactcaacgtacgatatcacaaaccccgcgatcccgcccaacaaatacaccgaaatacgcgtacgcaaaaaacgtcccgaaaataaaactccctccctcgctctccctctactcccgccccactctcccccactttcccccctccacccaccgcgaccgtcgaaactcgctcgctcaatacctaaaaacgaattcctaacgcgactacgactcaatcctcgcctaataaaaaatattttacctataactcactaaaaataaaaac

SEQ ID NO: 36569 - DNA, 633 bp, Artificial Sequence
  chemically treated genomic DNA (Homo sapiens) CpG-island No: 36569
agatgaatcgtttgtatcgtttgtattatttgtatcgttattttggttcgattttttttacgttcgtttcgggtttatttggttttgattaatcgggtgttgcggcgtagtttttttagcgtttagcgttgtgcgtttcgtttaggtttggttttcggcgcgcgggtttttagggggcggggtttagggagcgggcggggttgtgggggcggggttgtgggggcgaggagggggtagcgggcgcgcggttggcgcgcgggggcgggttttggggtacgggggcggggttcgtttagtagtatttgggaaacgttcgcgcggtttggggtaggcgtggtcgtcggggcggagggcggtggtcggtcgcggttcgggcgttaggtcgggcggcgggggcggtagggaggcggcgttttggggtcgtaggcggacgtattttgtgagcggcgttcgggcgtttgggtaggcgtttttcgagtatcggcgtttattttgttcgttcgttaaggagattcgtgcgcggtttatacgtttgggggatagttttttaagacgatattttcgcgaacgtcggttttttgagttagggggacgtttttttgaaagttagttttaaaatagttaaggttttat

SEQ ID NO: 36570 - DNA, 633 bp, Artificial Sequence
  chemically treated genomic DNA (Homo sapiens) CpG-island No: 36570
ataaaaccttaactattttaaaactaactttcaaaaaaacgtccccctaactcaaaaaaccgacgttcgcgaaaatatcgtcttaaaaaactatcccccaaacgtataaaccgcgcacgaatctccttaacgaacgaacaaaataaacgccgatactcgaaaaacgcctacccaaacgcccgaacgccgctcacaaaatacgtccgcctacgaccccaaaacgccgcctccctaccgcccccgccgcccgacctaacgcccgaaccgcgaccgaccaccgccctccgccccgacgaccacgcctaccccaaaccgcgcgaacgtttcccaaatactactaaacgaaccccgcccccgtaccccaaaacccgcccccgcgcgccaaccgcgcgcccgctaccccctcctcgcccccacaaccccgcccccacaaccccgcccgctccctaaaccccgccccctaaaaacccgcgcgccgaaaaccaaacctaaacgaaacgcacaacgctaaacgctaaaaaaactacgccgcaacacccgattaatcaaaaccaaataaacccgaaacgaacgtaaaaaaaatcgaaccaaaataacgatacaaataatacaaacgatacaaacgattcatct

SEQ ID NO: 36571 - DNA, 633 bp, Artificial Sequence
  chemically treated genomic DNA (Homo sapiens) CpG-island No: 36571
ataaaattttaattgttttgggattgatttttaaaagagcgtttttttggtttaagaggtcggcgttcgcggagatgtcgttttaaagggttgttttttaagcgtgtaggtcgcgtacgggtttttttagcgggcgggtaaaatgggcgtcggtattcgggaggcgtttgtttaggcgttcgggcgtcgtttatagagtacgttcgtttgcggttttagagcgtcgtttttttgtcgttttcgtcgttcggtttgacgttcggatcgcggtcggttatcgtttttcgtttcgacggttacgtttgttttaaatcgcgcgggcgttttttaggtgttgttgggcgggtttcgttttcgtgttttaaggttcgttttcgcgcgttagtcgcgcgttcgttgtttttttttcgtttttatagtttcgtttttatagtttcgttcgttttttaagtttcgttttttaggaattcgcgcgtcgaaggttaggtttgggcggagcgtatagcgttgggcgttggggaggttgcgtcgtagtattcggttggttaggattaagtgggttcgaggcggacgtgagaagggtcgggttaagatggcggtgtaggtggtgtaggcggtgtaggcggtttattt

SEQ ID NO: 36572 - DNA, 633 bp, Artificial Sequence
  chemically treated genomic DNA (Homo sapiens) CpG-island No: 36572
aaataaaccgcctacaccgcctacaccacctacaccgccatcttaacccgacccttctcacgtccgcctcgaacccacttaatcctaaccaaccgaatactacgacgcaacctccccaacgcccaacgctatacgctccgcccaaacctaaccttcgacgcgcgaattcctaaaaaacgaaacttaaaaaacgaacgaaactataaaaacgaaactataaaaacgaaaaaaaaacaacgaacgcgcgactaacgcgcgaaaacgaaccttaaaacacgaaaacgaaacccgcccaacaacacctaaaaaacgcccgcgcgatttaaaacaaacgtaaccgtcgaaacgaaaaacgataaccgaccgcgatccgaacgtcaaaccgaacgacgaaaacgacaaaaaaacgacgctctaaaaccgcaaacgaacgtactctataaacgacgcccgaacgcctaaacaaacgcctcccgaataccgacgcccattttacccgcccgctaaaaaaacccgtacgcgacctacacgcttaaaaaacaaccctttaaaacgacatctccgcgaacgccgacctcttaaaccaaaaaaacgctcttttaaaaatcaatcccaaaacaattaaaattttat

SEQ ID NO: 36573 - DNA, 774 bp, Artificial Sequence
  chemically treated genomic DNA (Homo sapiens) CpG-island No: 36573
gttcgcgggattcggcgtcgtaggttagggtcgtttcgtgaagggtagtttgtgtttacgttttgttttattggtattattcggatattttattttcgttcgattttttgtacgggttcgtatttgttttttcgattgttcgttattttagtttttagagtttttttttgcgtcggtttcggcgtgtcgtaggttttttcgcgttattatcggcgtcgtatattttttgtttaaattaatttacggcggttcggacgcgtttattcgtcggacgttttttttttttttcgcggttttttttcgcggttttgttcgtcggcgcgcgttatatcgtcgttttcggtcgttttttcgttatttttcgtttttcgttcgtttcgttgttttttttcgtttttcgcgttttgttcggcgtttcgtttttttcgttagtttttttttttttttttcgtttcgacgtatttttcgcgttagcgttcgtatgtgtttagtataatttttttttcggtacgtttttgtttcgttttgtttcgtagtcgtgtcgtttcgtttttttttttcggcgtttacgtcgttttgttttttttattgcgtttttttatgtttatttttgttttttcgttttttttttagttcgtttttttttcgtattttatcgtttcgatttatttttttttttacgtatatttaattattattataatatttatattttttttatttatgtttttttattatttttttttttattttattttattttaatttattttt

SEQ ID NO: 36574 - DNA, 774 bp, Artificial Sequence
  chemically treated genomic DNA (Homo sapiens) CpG-island No: 36574
aaaaataaattaaaataaaataaaataaaaaaaaaaataataaaaaaacataaataaaaaaaatataaatattataataataattaaatatacgtaaaaaaaaaaataaatcgaaacgataaaatacgaaaaaaaaacgaactaaaaaaaaaacgaaaaaacaaaaataaacataaaaaaacgcaataaaaaaaacaaaacgacgtaaacgccgaaaaaaaaaaacgaaacgacacgactacgaaacaaaacgaaacaaaaacgtaccgaaaaaaaaattatactaaacacatacgaacgctaacgcgaaaaatacgtcgaaacgaaaaaaaaaaaaaaaaactaacgaaaaaaacgaaacgccgaacaaaacgcgaaaaacgaaaaaaaacaacgaaacgaacgaaaaacgaaaaataacgaaaaaacgaccgaaaacgacgatataacgcgcgccgacgaacaaaaccgcgaaaaaaaaccgcgaaaaaaaaaaaaaacgtccgacgaataaacgcgtccgaaccgccgtaaattaatttaaacaaaaaatatacgacgccgataataacgcgaaaaaacctacgacacgccgaaaccgacgcaaaaaaaaactctaaaaactaaaataacgaacaatcgaaaaaacaaatacgaacccgtacaaaaaatcgaacgaaaataaaatatccgaataataccaataaaacaaaacgtaaacacaaactacccttcacgaaacgaccctaacctacgacgccgaatcccgcgaac

SEQ ID NO: 36575 - DNA, 774 bp, Artificial Sequence
  chemically treated genomic DNA (Homo sapiens) CpG-island No: 36575
aggggtgggttggaatagagtgaggtgaggggggaggtaatggaggggtatgagtggggagggtgtgggtgttgtggtggtggttgggtgtgcgtgagggggagggtggatcggggcggtgggatgcgggagaggagcgagttgggggggggacgggagagtagaggtggatatgagagggcgtagtgagagagataggacggcgtgaacgtcgaggaagaaggacggggcggtacgattacgagataagacgaggtagagacgtgtcggggagggagttgtgttggatatatacggacgttggcgcgaagagtgcgtcggggcgagggaggggggaggggattggcggggggagcggggcgtcgggtaaggcgcgaggagcgggaggggatagcgagacgagcgaggggcggggagtggcgggagggcggtcgggggcggcgatgtgacgcgcgtcggcgggtagggtcgcggaggggagtcgcgaggagaggagaggacgttcgacgggtggacgcgttcgggtcgtcgtgagttggtttgggtaggaggtgtgcggcgtcgatgatgacgcgaggagatttgcggtacgtcggggtcggcgtagagagagattttgggagttagggtagcgggtagtcggggagataagtgcgagttcgtgtaaagggtcggacggggatagagtgttcgagtggtattagtagggtaggacgtaggtatagattattttttacggagcggttttggtttgcggcgtcgagtttcgcgggt

SEQ ID NO: 36576 - DNA, 774 bp, Artificial Sequence
  chemically treated genomic DNA (Homo sapiens) CpG-island No: 36576
acccgcgaaactcgacgccgcaaaccaaaaccgctccgtaaaaaataatctatacctacgtcctaccctactaataccactcgaacactctatccccgtccgaccctttacacgaactcgcacttatctccccgactacccgctaccctaactcccaaaatctctctctacgccgaccccgacgtaccgcaaatctcctcgcgtcatcatcgacgccgcacacctcctacccaaaccaactcacgacgacccgaacgcgtccacccgtcgaacgtcctctcctctcctcgcgactcccctccgcgaccctacccgccgacgcgcgtcacatcgccgcccccgaccgccctcccgccactccccgcccctcgctcgtctcgctatcccctcccgctcctcgcgccttacccgacgccccgctccccccgccaatcccctcccccctccctcgccccgacgcactcttcgcgccaacgtccgtatatatccaacacaactccctccccgacacgtctctacctcgtcttatctcgtaatcgtaccgccccgtccttcttcctcgacgttcacgccgtcctatctctctcactacgccctctcatatccacctctactctcccgtcccccccccaactcgctcctctcccgcatcccaccgccccgatccaccctccccctcacgcacacccaaccaccaccacaacacccacaccctccccactcatacccctccattacctcccccctcacctcactctattccaacccacccct

SEQ ID NO: 36577 - DNA, 521 bp, Artificial Sequence
  chemically treated genomic DNA (Homo sapiens) CpG-island No: 36577
gcggagtcgggttcggggttgttttttcgcgggcgaggtttatttgtttcggttcggttttttttcgcgttttaggtggtttagggtagggaggagtcgcgtttcgtttcgcgcggtagtagttaacgtcggttttaggcgggtgcgttgggagtttgggtcgggagtcgggtgagggcgtcgagaggttcggtgggcgcgggcggcgaggtgagttgggttagcgtagtaggcgggggcggtggtgggttcgggacggtttatttcgcgtcggagcgagtgcggggtcgcgcgattgcggcgggagatgcgttgcgttttttttgggcgcgttggggtagttaggagttcgcggggtcgcggggtcgcggggtcgcggggtcgcggcgtagtggcggggtcggggtttggtcgttgtttcgaggcgagtagttgttaatatttggacgggacgggagtagggggtcggggtaaggttggagcggtgtgggtttttaatcgtttagagttttgcggggtta

SEQ ID NO: 36578 - DNA, 521 bp, Artificial Sequence
  chemically treated genomic DNA (Homo sapiens) CpG-island No: 36578
taaccccgcaaaactctaaacgattaaaaacccacaccgctccaaccttaccccgaccccctactcccgtcccgtccaaatattaacaactactcgcctcgaaacaacgaccaaaccccgaccccgccactacgccgcgaccccgcgaccccgcgaccccgcgaccccgcgaactcctaactaccccaacgcgcccaaaaaaaacgcaacgcatctcccgccgcaatcgcgcgaccccgcactcgctccgacgcgaaataaaccgtcccgaacccaccaccgcccccgcctactacgctaacccaactcacctcgccgcccgcgcccaccgaacctctcgacgccctcacccgactcccgacccaaactcccaacgcacccgcctaaaaccgacgttaactactaccgcgcgaaacgaaacgcgactcctccctaccctaaaccacctaaaacgcgaaaaaaaaccgaaccgaaacaaataaacctcgcccgcgaaaaaacaaccccgaacccgactccgc

SEQ ID NO: 36579 - DNA, 521 bp, Artificial Sequence
  chemically treated genomic DNA (Homo sapiens) CpG-island No: 36579
tggtttcgtagggttttggacgattagagatttatatcgttttagttttgtttcggttttttgttttcgtttcgtttagatgttggtagttgttcgtttcgaggtagcgattagatttcgatttcgttattgcgtcgcggtttcgcggtttcgcggtttcgcggtttcgcgagtttttggttgttttagcgcgtttagaaggggcgtagcgtatttttcgtcgtagtcgcgcggtttcgtattcgtttcggcgcggggtgagtcgtttcgaatttattatcgttttcgtttgttgcgttggtttagtttatttcgtcgttcgcgtttatcgagtttttcggcgtttttattcggttttcggtttaggtttttagcgtattcgtttggggtcggcgttggttgttatcgcgcggggcggggcgcggtttttttttgttttgaattatttggggcgcgggagggggtcgggtcgggataggtgagtttcgttcgcgagggagtagtttcgggttcggtttcgt

SEQ ID NO: 36580 - DNA, 521 bp, Artificial Sequence
  chemically treated genomic DNA (Homo sapiens) CpG-island No: 36580
acgaaaccgaacccgaaactactccctcgcgaacgaaactcacctatcccgacccgaccccctcccgcgccccaaataattcaaaacaaaaaaaaaccgcgccccgccccgcgcgataacaaccaacgccgaccccaaacgaatacgctaaaaacctaaaccgaaaaccgaataaaaacgccgaaaaactcgataaacgcgaacgacgaaataaactaaaccaacgcaacaaacgaaaacgataataaattcgaaacgactcaccccgcgccgaaacgaatacgaaaccgcgcgactacgacgaaaaatacgctacgccccttctaaacgcgctaaaacaaccaaaaactcgcgaaaccgcgaaaccgcgaaaccgcgaaaccgcgacgcaataacgaaatcgaaatctaatcgctacctcgaaacgaacaactaccaacatctaaacgaaacgaaaacaaaaaaccgaaacaaaactaaaacgatataaatctctaatcgtccaaaaccctacgaaacca

SEQ ID NO: 36581 - DNA, 774 bp, Artificial Sequence
  chemically treated genomic DNA (Homo sapiens) CpG-island No: 36581
gggaagtagttttttcgttttggagttcggttggggcgtgagggtcgcgcgggttttacgttttaaggttaagtagtcgaaagtatagcgcgttcggggttaaatcgggttgtatcgtaggcgtagatggcgcgtcgggcggaagttggaggtcgtcggtttaatacgtttcgtattcgggattggggttcggtttgtagttttagcgagtaggcgataagggcggcgttatagaggtcgacgcgtttttcgttcgtttgagcgcgtcgtaatagttatttcgttttattcgtttcggggcggggtcgggggcgcggcgtcggggttttttggtttttttcggtttcgtcggtttcgttttttttttgttttcgttttcgaggggttgagggggagggaggggcgacgtatttcggtcgcgttgtacgttcgtcgttttttttagtttcgcgtgcgcgcgcgcgttcgttttaagtttcgcggagtttaatataatgtcgacgtttacgtcgtgcgtaacgtttcggtcggcgtaatagtttcggcgtcgggggcgggggtggtttagatagggagagagggagagggatgagcgcgcgcgagagtcggagatagcgcgagattcgaggaggtcggaagcgcgcgtgcgcgttttcgttcgcgagcgggaggcggagtcgtagtagtagcggtagtagttgtaggagtcgttgtagttgggagaagcgttagagaggtcgggtttgtttcggtcggatcggatttatttttttt

SEQ ID NO: 36582 - DNA, 774 bp, Artificial Sequence
  chemically treated genomic DNA (Homo sapiens) CpG-island No: 36582
aaaaaaaataaatccgatccgaccgaaacaaacccgacctctctaacgcttctcccaactacaacgactcctacaactactaccgctactactacgactccgcctcccgctcgcgaacgaaaacgcgcacgcgcgcttccgacctcctcgaatctcgcgctatctccgactctcgcgcgcgctcatccctctccctctctccctatctaaaccacccccgcccccgacgccgaaactattacgccgaccgaaacgttacgcacgacgtaaacgtcgacattatattaaactccgcgaaacttaaaacgaacgcgcgcgcgcacgcgaaactaaaaaaaacgacgaacgtacaacgcgaccgaaatacgtcgcccctccctccccctcaacccctcgaaaacgaaaacaaaaaaaaaacgaaaccgacgaaaccgaaaaaaaccaaaaaaccccgacgccgcgcccccgaccccgccccgaaacgaataaaacgaaataactattacgacgcgctcaaacgaacgaaaaacgcgtcgacctctataacgccgcccttatcgcctactcgctaaaactacaaaccgaaccccaatcccgaatacgaaacgtattaaaccgacgacctccaacttccgcccgacgcgccatctacgcctacgatacaacccgatttaaccccgaacgcgctatactttcgactacttaaccttaaaacgtaaaacccgcgcgaccctcacgccccaaccgaactccaaaacgaaaaaactacttccc

SEQ ID NO: 36583 - DNA, 774 bp, Artificial Sequence
  chemically treated genomic DNA (Homo sapiens) CpG-island No: 36583
ggaggggatggattcggttcgatcggagtaggttcggtttttttggcgttttttttagttgtagcggtttttatagttgttgtcgttattgttgcggtttcgtttttcgttcgcgggcgggggcgcgtacgcgcgttttcggttttttcgggtttcgcgttgttttcggttttcgcgcgcgtttatttttttttttttttttttgtttgggttattttcgttttcggcgtcggggttgttgcgtcggtcggggcgttgcgtacggcgtaggcgtcggtattgtgttaaatttcgcgggatttggggcgagcgcgcgcgcgtacgcgggattgagggaagcggcgagcgtgtaacgcggtcggagtgcgtcgttttttttttttttttagtttttcggggacggggatagggagggggcggggtcggcgagatcggagggggttagagggtttcggcgtcgcgttttcggtttcgtttcggggcgggtgggacgaggtggttgttgcggcgcgtttaggcgggcgggggacgcgtcggtttttgtggcgtcgtttttgtcgtttgttcgttgaggttgtaggtcgggttttagtttcgggtacggagcgtgttgagtcggcggtttttagttttcgttcgacgcgttatttgcgtttgcgatatagttcggtttggtttcgagcgcgttgtgttttcggttgtttagttttggggcgtgggattcgcgcggtttttacgttttaatcggattttaaggcggggaggttgtttttt

SEQ ID NO: 36584 - DNA, 774 bp, Artificial Sequence
  chemically treated genomic DNA (Homo sapiens) CpG-island No: 36584
aaaaaacaacctccccgccttaaaatccgattaaaacgtaaaaaccgcgcgaatcccacgccccaaaactaaacaaccgaaaacacaacgcgctcgaaaccaaaccgaactatatcgcaaacgcaaataacgcgtcgaacgaaaactaaaaaccgccgactcaacacgctccgtacccgaaactaaaacccgacctacaacctcaacgaacaaacgacaaaaacgacgccacaaaaaccgacgcgtcccccgcccgcctaaacgcgccgcaacaaccacctcgtcccacccgccccgaaacgaaaccgaaaacgcgacgccgaaaccctctaaccccctccgatctcgccgaccccgccccctccctatccccgtccccgaaaaactaaaaaaaaaaaaaaaacgacgcactccgaccgcgttacacgctcgccgcttccctcaatcccgcgtacgcgcgcgcgctcgccccaaatcccgcgaaatttaacacaataccgacgcctacgccgtacgcaacgccccgaccgacgcaacaaccccgacgccgaaaacgaaaataacccaaacaaaaaaaaaaaaaaaaaaataaacgcgcgcgaaaaccgaaaacaacgcgaaacccgaaaaaaccgaaaacgcgcgtacgcgcccccgcccgcgaacgaaaaacgaaaccgcaacaataacgacaacaactataaaaaccgctacaactaaaaaaaacgccaaaaaaaccgaacctactccgatcgaaccgaatccatcccctcc

SEQ ID NO: 36585 - DNA, 871 bp, Artificial Sequence
  chemically treated genomic DNA (Homo sapiens) CpG-island No: 36585
tagttcgcggttttgtcgtcgaagtagtagcggcggtagtagtaggaggcggcggcgaggcgtcggaaggattacgtatttgacgggttcgtttttgagggttttagcgcgggacgtttatcggtcgtcgtcgtttagggcgtatttcgcggtggcggcgggaagggagggatcggttacggggaatcgaacgcgaatcgtttttttttttttttttttttttatttttttttcgattcgtcgttcgttttttcggttttcgtttttttttttttttataaaatttcggatggaggcgtcgtcgattcgtcgtcgtttggtttcgggggatggttttgttaagcggttagagtttcggcgttaggcgtagtcgtcgtcgttttcgcgaggcgtttttgttttcgttttttagaatcgggttttcgagtggttcgggtttttcgtttgtttgtattcgtagttttggtacgagggttattcgtcgtttttgttgttatcgtttttgtcggaatcgtttgcgagtttcggtggttttcgtttttttatcgttttttcggattttgggttgggggtggtacgtgggtatcggtttcgggaggcggaggcggtgcgcgtttatttgtcgtcggtgttgttgcggcggggggtgtggaggaggcgtttttgggtagtttcggtcgtgttgtttttttcgtcgtcgtcgtttttgtttttcgttgttgttgttgttgttgtcgtcgcggtcggtgttttcggcgcggcggcggcggcggcggcggggttttttttgttcggttacgttaaggttatatgatcgagagagcggagagattagtgtaaagaggttgcgagcggttttcgtcggggggga

SEQ ID NO: 36586 - DNA, 871 bp, Artificial Sequence
  chemically treated genomic DNA (Homo sapiens) CpG-island No: 36586
tcccccccgacgaaaaccgctcgcaacctctttacactaatctctccgctctctcgatcatataaccttaacgtaaccgaacaaaaaaaaccccgccgccgccgccgccgccgcgccgaaaacaccgaccgcgacgacaacaacaacaacaacaacgaaaaacaaaaacgacgacgacgaaaaaaacaacacgaccgaaactacccaaaaacgcctcctccacaccccccgccgcaacaacaccgacgacaaataaacgcgcaccgcctccgcctcccgaaaccgatacccacgtaccacccccaacccaaaatccgaaaaaacgataaaaaaacgaaaaccaccgaaactcgcaaacgattccgacaaaaacgataacaacaaaaacgacgaataaccctcgtaccaaaactacgaatacaaacaaacgaaaaacccgaaccactcgaaaacccgattctaaaaaacgaaaacaaaaacgcctcgcgaaaacgacgacgactacgcctaacgccgaaactctaaccgcttaacaaaaccatcccccgaaaccaaacgacgacgaatcgacgacgcctccatccgaaattttataaaaaaaaaaaaaaacgaaaaccgaaaaaacgaacgacgaatcgaaaaaaaaataaaaaaaaaaaaaaaaaaaaaaacgattcgcgttcgattccccgtaaccgatccctcccttcccgccgccaccgcgaaatacgccctaaacgacgacgaccgataaacgtcccgcgctaaaaccctcaaaaacgaacccgtcaaatacgtaatccttccgacgcctcgccgccgcctcctactactaccgccgctactacttcgacgacaaaaccgcgaacta

SEQ ID NO: 36587 - DNA, 871 bp, Artificial Sequence
  chemically treated genomic DNA (Homo sapiens) CpG-island No: 36587
tttttttcggcgggagtcgttcgtagtttttttgtattagttttttcgttttttcggttatgtgattttaacgtaatcggataggaaaagtttcgtcgtcgtcgtcgtcgtcgcgtcggagatatcgatcgcggcggtagtagtagtagtagtagcgagaggtagaggcggcggcggcggggaggatagtacggtcgaggttgtttagaggcgttttttttatatttttcgtcgtagtagtatcggcgataggtaagcgcgtatcgttttcgtttttcggggtcggtgtttacgtgttatttttagtttagggttcgggaaggcggtgggggggcgggggttatcggagttcgtaaacggtttcggtagaggcggtggtaataaagacgacgaatgattttcgtattagggttacgggtgtaggtaggcggaaggttcgggttattcggggattcggttttgggaagcgagggtaggggcgtttcgcgggggcggcggcggttgcgtttggcgtcggggttttggtcgtttgataaaattatttttcggagttaggcggcggcgagtcggcggcgtttttattcggggttttgtgggagggggaggggacggaagtcgagagggcgggcggcggatcggagggagggtgggagggaggaaggggaggggggcgattcgcgttcggtttttcgtggtcggttttttttttttcgtcgttatcgcgaagtgcgttttgggcggcggcggtcggtgagcgtttcgcgttggagtttttagaggcgggttcgttaggtgcgtaattttttcgacgtttcgtcgtcgttttttgttgttgtcgtcgttgttgtttcggcggtaaggtcgcgagttg

SEQ ID NO: 36588 - DNA, 871 bp, Artificial Sequence
  chemically treated genomic DNA (Homo sapiens) CpG-island No: 36588
caactcgcgaccttaccgccgaaacaacaacgacgacaacaacaaaaaacgacgacgaaacgtcgaaaaaattacgcacctaacgaacccgcctctaaaaactccaacgcgaaacgctcaccgaccgccgccgcccaaaacgcacttcgcgataacgacgaaaaaaaaaaaaccgaccacgaaaaaccgaacgcgaatcgcccccctccccttcctccctcccaccctccctccgatccgccgcccgccctctcgacttccgtcccctccccctcccacaaaaccccgaataaaaacgccgccgactcgccgccgcctaactccgaaaaataattttatcaaacgaccaaaaccccgacgccaaacgcaaccgccgccgcccccgcgaaacgcccctaccctcgcttcccaaaaccgaatccccgaataacccgaaccttccgcctacctacacccgtaaccctaatacgaaaatcattcgtcgtctttattaccaccgcctctaccgaaaccgtttacgaactccgataacccccgcccccccaccgccttcccgaaccctaaactaaaaataacacgtaaacaccgaccccgaaaaacgaaaacgatacgcgcttacctatcgccgatactactacgacgaaaaatataaaaaaaacgcctctaaacaacctcgaccgtactatcctccccgccgccgccgcctctacctctcgctactactactactactaccgccgcgatcgatatctccgacgcgacgacgacgacgacgacgaaacttttcctatccgattacgttaaaatcacataaccgaaaaaacgaaaaaactaatacaaaaaaactacgaacgactcccgccgaaaaaaa

SEQ ID NO: 36589 - DNA, 509 bp, Artificial Sequence
  chemically treated genomic DNA (Homo sapiens) CpG-island No: 36589
aatcgaaggcgtttgcggaaagttggggacgggttggcgaagaagacgggcgaggagggcggcgaacgttgggcggcggggcgcgcgcggggttaggggttcgggtaggaacgtttcgtttttagtcgttatcgttatcgggaaggttattagttgtagtttcgggatgcggttttaggttcgcggtcgttatcgcggggcggtttttcggcgggcgttggggagtgcgtcgtttatttcgttaggtttacgtaggtcgtttgtttagttcgcgttcgcgggttttatttcgttttgtcgtttcggttttttcgcgttcgcgttgagaaagtttttagggcggggcgggtttggggcgtcgtacggttttggtggggattttttcgtagattttaaagtcgttcgcgttggttttaatgtttttataatcgtcggacgcgtttttataaatattagggatatttttaaatttgtggggatatttttgtaaatttttcgtggtgttgata

SEQ ID NO: 36590 - DNA, 509 bp, Artificial Sequence
  chemically treated genomic DNA (Homo sapiens) CpG-island No: 36590
tatcaacaccacgaaaaatttacaaaaatatccccacaaatttaaaaatatccctaatatttataaaaacgcgtccgacgattataaaaacattaaaaccaacgcgaacgactttaaaatctacgaaaaaatccccaccaaaaccgtacgacgccccaaacccgccccgccctaaaaactttctcaacgcgaacgcgaaaaaaccgaaacgacaaaacgaaataaaacccgcgaacgcgaactaaacaaacgacctacgtaaacctaacgaaataaacgacgcactccccaacgcccgccgaaaaaccgccccgcgataacgaccgcgaacctaaaaccgcatcccgaaactacaactaataaccttcccgataacgataacgactaaaaacgaaacgttcctacccgaacccctaaccccgcgcgcgccccgccgcccaacgttcgccgccctcctcgcccgtcttcttcgccaacccgtccccaactttccgcaaacgccttcgatt

SEQ ID NO: 36591 - DNA, 509 bp, Artificial Sequence
  chemically treated genomic DNA (Homo sapiens) CpG-island No: 36591
tgttaatattacggggagtttgtaggagtgtttttatagatttgggggtgtttttggtgtttgtggggacgcgttcggcgattgtgaggatattagagttaacgcgggcggttttggggtttgcgggagagtttttattagagtcgtgcggcgttttagattcgtttcgttttgggggtttttttagcgcgaacgcggaagggtcgaggcgatagggcggggtggggttcgcgggcgcgggttgggtaggcggtttgcgtgggtttggcggggtgggcggcgtattttttagcgttcgtcgaggggtcgtttcgcgatggcggtcgcgggtttaaggtcgtatttcggagttgtaattggtggttttttcggtggcggtggcggttgaggacgaggcgtttttgttcgagtttttggtttcgcgcgcgtttcgtcgtttagcgttcgtcgtttttttcgttcgtttttttcgttagttcgtttttaatttttcgtagacgttttcggtt

SEQ ID NO: 36592 - DNA, 509 bp, Artificial Sequence
  chemically treated genomic DNA (Homo sapiens) CpG-island No: 36592
aaccgaaaacgtctacgaaaaattaaaaacgaactaacgaaaaaaacgaacgaaaaaaacgacgaacgctaaacgacgaaacgcgcgcgaaaccaaaaactcgaacaaaaacgcctcgtcctcaaccgccaccgccaccgaaaaaaccaccaattacaactccgaaatacgaccttaaacccgcgaccgccatcgcgaaacgacccctcgacgaacgctaaaaaatacgccgcccaccccgccaaacccacgcaaaccgcctacccaacccgcgcccgcgaaccccaccccgccctatcgcctcgacccttccgcgttcgcgctaaaaaaacccccaaaacgaaacgaatctaaaacgccgcacgactctaataaaaactctcccgcaaaccccaaaaccgcccgcgttaactctaatatcctcacaatcgccgaacgcgtccccacaaacaccaaaaacacccccaaatctataaaaacactcctacaaactccccgtaatattaaca

SEQ ID NO: 36593 - DNA, 1541 bp, Artificial Sequence
  chemically treated genomic DNA (Homo sapiens) CpG-island No: 36593
tgttgttggtataagtagtggcgtattatgtgcgcgtttaagatgatggcgatttgttttaacgtggtgcgcggcggggcgacgttttatttcgtaaatacgtgatggattattcggagttggcgatttagtttttattttacggtagtttcgttattatgttcggttcgttttgttttttacgtttgttgggtcgtttcgatcgcgttatcgtttttaagtggattatcgtcgtttattcgttgattagtttgttgattttcgttatttcggcggagtatatcgcgtttatttttgtttttaatattttgtttttgttcgtttttaatattattacgtcgttgtagtggttgatggtttttgacgtggtggattacgaggagagtcgtagcggtcgtcgtttcgacgggttggtgttttttatttatttgtttagtttgaagattggtttggcgattggcggggcggtggtgggttggattttggcgtacgttaattatttcgttagtagtagcgtgtagtcggttgaggtgtttattattattaaaattttgttttgcgtggtgtcggtggtgttttacgcgggtatgtttattatgttgtcgttttataagtttatcgatgttcgcgtggaggttattagtcggtagttgattaagtatcgcgcggcgtagggcgaggtcgttttcgacgtcgcgatagtcgtattttattaatcggaggtaatatggaaattattaattcgatatttatcggttttaattcggattcgtttttgtgtcgttagggcgaggattattatatcgttatttcgattttcgagtggttttcgggcgtgcgtatttattattttcgtgatttgaaaaattggtcgttggttagtatttcgttggatcgcgtgtcgatgttggatatgaagggtaattcggatttcggcggtatttgggcgtcgtgtttgagttacgtcgacggtaaattttggttgttttatatcgacgtgaagattgtcgattcgtcgtggaaaaacggtcgtaattttttcgttatcgcgttttttatcgaggggttatggagcgagttaatttcgatgggtaacggcgggtttgattcgtttttgttttacgacgacgatggtcgtaaatattatatttatcgttcgtgggggtcgcgttattatagtaattcgtataatattatcgtgttataggcgtttgattcgtagatcggtacgttttcgttcgagcgtaaaacgttgtttatcggtacgtcgttttgttatatcgaaggcgcgtatttgtatcgttacgcgggatggtattatttgatggtcgtcgagggcggtattagttacgagtacgtcgtcgtggtgttgcgttttaaaaatatcgacgggttcgtacgagttgattcggacgtaacgatgatgattaagttggatttgtcggagaattcgttgtagaagagcgggtacggttcgttgttgtagacgtatacgggtgaatggtatatgggttatttaataagtcggtcgttgcgttttg

SEQ ID NO: 36594 - DNA, 1541 bp, Artificial Sequence
  chemically treated genomic DNA (Homo sapiens) CpG-island No: 36594
caaaacgcaacgaccgacttattaaataacccatataccattcacccgtatacgtctacaacaacgaaccgtacccgctcttctacaacgaattctccgacaaatccaacttaatcatcatcgttacgtccgaatcaactcgtacgaacccgtcgatatttttaaaacgcaacaccacgacgacgtactcgtaactaataccgccctcgacgaccatcaaataataccatcccgcgtaacgatacaaatacgcgccttcgatataacaaaacgacgtaccgataaacaacgttttacgctcgaacgaaaacgtaccgatctacgaatcaaacgcctataacacgataatattatacgaattactataataacgcgacccccacgaacgataaatataatatttacgaccatcgtcgtcgtaaaacaaaaacgaatcaaacccgccgttacccatcgaaattaactcgctccataacccctcgataaaaaacgcgataacgaaaaaattacgaccgtttttccacgacgaatcgacaatcttcacgtcgatataaaacaaccaaaatttaccgtcgacgtaactcaaacacgacgcccaaataccgccgaaatccgaattacccttcatatccaacatcgacacgcgatccaacgaaatactaaccaacgaccaatttttcaaatcacgaaaataataaatacgcacgcccgaaaaccactcgaaaatcgaaataacgatataataatcctcgccctaacgacacaaaaacgaatccgaattaaaaccgataaatatcgaattaataatttccatattacctccgattaataaaatacgactatcgcgacgtcgaaaacgacctcgccctacgccgcgcgatacttaatcaactaccgactaataacctccacgcgaacatcgataaacttataaaacgacaacataataaacatacccgcgtaaaacaccaccgacaccacgcaaaacaaaattttaataataataaacacctcaaccgactacacgctactactaacgaaataattaacgtacgccaaaatccaacccaccaccgccccgccaatcgccaaaccaatcttcaaactaaacaaataaataaaaaacaccaacccgtcgaaacgacgaccgctacgactctcctcgtaatccaccacgtcaaaaaccatcaaccactacaacgacgtaataatattaaaaacgaacaaaaacaaaatattaaaaacaaaaataaacgcgatatactccgccgaaataacgaaaatcaacaaactaatcaacgaataaacgacgataatccacttaaaaacgataacgcgatcgaaacgacccaacaaacgtaaaaaacaaaacgaaccgaacataataacgaaactaccgtaaaataaaaactaaatcgccaactccgaataatccatcacgtatttacgaaataaaacgtcgccccgccgcgcaccacgttaaaacaaatcgccatcatcttaaacgcgcacataatacgccactacttataccaacaaca

SEQ ID NO: 36595 - DNA, 1541 bp, Artificial Sequence
  chemically treated genomic DNA (Homo sapiens) CpG-island No: 36595
taaggcgtaacggtcggtttgttaagtagtttatgtattatttattcgtatgcgtttgtagtagcgagtcgtgttcgtttttttgtagcgggtttttcggtaggtttaatttggttattatcgttacgttcgggttagttcgtacgggttcgtcgatatttttggaacgtagtattacgacggcgtgttcgtagttggtgtcgttttcggcggttattaggtagtattatttcgcgtggcgatataggtgcgcgttttcggtgtagtagagcggcgtgtcggtaaatagcgttttgcgttcgggcgagagcgtgtcggtttgcgggttaaacgtttgtaatacgatggtgttgtgcgggttgttgtggtggcgcggtttttacgggcggtagatatagtatttgcggttatcgtcgtcgtggaatagggacgggttaaattcgtcgttgtttatcgggattggttcgttttatggtttttcgatggagggcgcggtgacgaggaagttgcggtcgtttttttacggcgagtcgataatttttacgtcggtgtagagtagttagaatttatcgtcggcgtagtttaggtacggcgtttagatgtcgtcggagttcgggttgttttttatgtttagtatcgatacgcggtttaacggggtgttgattagcgattagttttttaggttacgggagtggtagatgcgtacgttcgggaattattcgaaggtcgaggtggcgatgtagtagttttcgttttggcggtatagggacgggttcgggttgaagtcggtgagtatcgggttagtgatttttatattgttttcggttaatgggatgcggttgtcgcggcgtcgggaacggtttcgttttgcgtcgcgcggtgtttaattagttgtcggttgatggtttttacgcgggtatcggtgagtttgtagagcgatagtatgatgaatatgttcgcgtagagtattatcggtattacgtagaatagaattttgatggtggtgagtattttaatcggttgtacgttgttgttggcggaatagttgacgtacgttaggatttagtttattatcgtttcgttaatcgttaggttaatttttaggttgaataggtaggtggagaatattagttcgtcgaggcggcgatcgttgcggtttttttcgtagtttattacgttagaagttattagttattgtagcggcgtggtggtattaaagacgaataggaataggatgttgagggtaaaaatgagcgcgatgtgtttcgtcggggtgacgaaaattagtaggttgattagcgagtaggcgacgatgatttatttgaaggcggtgacgcggtcgaagcggtttagtaggcgtgaggagtaaagcgagtcgaatatggtggcgaggttgtcgtaaagtaaaaattgggtcgttaatttcgggtgatttattacgtatttacgaagtagagcgtcgtttcgtcgcgtattacgttggagtaggtcgttattattttgaacgcgtatatgatgcgttattgtttgtgttaatagta

SEQ ID NO: 36596 - DNA, 1541 bp, Artificial Sequence
  chemically treated genomic DNA (Homo sapiens) CpG-island No: 36596
tactattaacacaaacaataacgcatcatatacgcgttcaaaataataacgacctactccaacgtaatacgcgacgaaacgacgctctacttcgtaaatacgtaataaatcacccgaaattaacgacccaatttttactttacgacaacctcgccaccatattcgactcgctttactcctcacgcctactaaaccgcttcgaccgcgtcaccgccttcaaataaatcatcgtcgcctactcgctaatcaacctactaattttcgtcaccccgacgaaacacatcgcgctcatttttaccctcaacatcctattcctattcgtctttaataccaccacgccgctacaataactaataacttctaacgtaataaactacgaaaaaaaccgcaacgatcgccgcctcgacgaactaatattctccacctacctattcaacctaaaaattaacctaacgattaacgaaacgataataaactaaatcctaacgtacgtcaactattccgccaacaacaacgtacaaccgattaaaatactcaccaccatcaaaattctattctacgtaataccgataatactctacgcgaacatattcatcatactatcgctctacaaactcaccgatacccgcgtaaaaaccatcaaccgacaactaattaaacaccgcgcgacgcaaaacgaaaccgttcccgacgccgcgacaaccgcatcccattaaccgaaaacaatataaaaatcactaacccgatactcaccgacttcaacccgaacccgtccctataccgccaaaacgaaaactactacatcgccacctcgaccttcgaataattcccgaacgtacgcatctaccactcccgtaacctaaaaaactaatcgctaatcaacaccccgttaaaccgcgtatcgatactaaacataaaaaacaacccgaactccgacgacatctaaacgccgtacctaaactacgccgacgataaattctaactactctacaccgacgtaaaaattatcgactcgccgtaaaaaaacgaccgcaacttcctcgtcaccgcgccctccatcgaaaaaccataaaacgaaccaatcccgataaacaacgacgaatttaacccgtccctattccacgacgacgataaccgcaaatactatatctaccgcccgtaaaaaccgcgccaccacaacaacccgcacaacaccatcgtattacaaacgtttaacccgcaaaccgacacgctctcgcccgaacgcaaaacgctatttaccgacacgccgctctactacaccgaaaacgcgcacctatatcgccacgcgaaataatactacctaataaccgccgaaaacgacaccaactacgaacacgccgtcgtaatactacgttccaaaaatatcgacgaacccgtacgaactaacccgaacgtaacgataataaccaaattaaacctaccgaaaaacccgctacaaaaaaacgaacacgactcgctactacaaacgcatacgaataaataatacataaactacttaacaaaccgaccgttacgcctta

SEQ ID NO: 36597 - DNA, 908 bp, Artificial Sequence
  chemically treated genomic DNA (Homo sapiens) CpG-island No: 36597
ttcggcggtaggattacgttattcgggtttttacgtcgttttgttcgcgtaggtattgcggaagcgcgttcggcgttcggacgtttgttattatttaaggttttcgtttatcgtttggtcggttacggttatggcgtttagatgtagtaggtcgaggtcgcgtaggtggagtattattttcggtacgtcgttcgcgaggaaggcgcgtacggtcgggtgatagttcgggtcgttgggtagtacgtttattagacgcggtattttacggttgatgcgcgtttagtgtttaacgttcgggatcgtgtagttcgtcgcgtgggcgatggtcggaatgtgtagtagtaaattggtggagtcgtcgaacgtcgcgtggattattatcgcgttttcgatggttttatcggagaggatatttcgcgtggtgatgtcgcggttatttagttcgttgatcgcgcgcgtcgattggcgggcgatttttagttatatcgtttgttcggacggcgttagcgcggagtgcggtagcgttagatttagcgttttcgcgattatttgcgaggtgttcgtcgtgtcgaggaattgatattcgtcgttcggcgaggcgtaggcgcgatagtttagttcggcggttttttgtagggagagttcgtggttggcgaaacgcgcgtcgatggtttgtattttgttcgcgtttttttcgacggtcggcggtagcgtcgtttcgttcggtattagaatagtcggtaggtcgtgtatcgcggttagcgtaattatggtggcggtagttttttatcgtaggtcgttacgtcgattatcgtcgtcgcgtcggtagggagcggataagcggcgaaatacgatcgtcgcgtcgttgcggtacggtagggaatcgaatatatcgtgcgtgtttttgt

SEQ ID NO: 36598 - DNA, 908 bp, Artificial Sequence
  chemically treated genomic DNA (Homo sapiens) CpG-island No: 36598
acaaaaacacgcacgatatattcgattccctaccgtaccgcaacgacgcgacgatcgtatttcgccgcttatccgctccctaccgacgcgacgacgataatcgacgtaacgacctacgataaaaaactaccgccaccataattacgctaaccgcgatacacgacctaccgactattctaataccgaacgaaacgacgctaccgccgaccgtcgaaaaaaacgcgaacaaaatacaaaccatcgacgcgcgtttcgccaaccacgaactctccctacaaaaaaccgccgaactaaactatcgcgcctacgcctcgccgaacgacgaatatcaattcctcgacacgacgaacacctcgcaaataatcgcgaaaacgctaaatctaacgctaccgcactccgcgctaacgccgtccgaacaaacgatataactaaaaatcgcccgccaatcgacgcgcgcgatcaacgaactaaataaccgcgacatcaccacgcgaaatatcctctccgataaaaccatcgaaaacgcgataataatccacgcgacgttcgacgactccaccaatttactactacacattccgaccatcgcccacgcgacgaactacacgatcccgaacgttaaacactaaacgcgcatcaaccgtaaaataccgcgtctaataaacgtactacccaacgacccgaactatcacccgaccgtacgcgccttcctcgcgaacgacgtaccgaaaataatactccacctacgcgacctcgacctactacatctaaacgccataaccgtaaccgaccaaacgataaacgaaaaccttaaataataacaaacgtccgaacgccgaacgcgcttccgcaatacctacgcgaacaaaacgacgtaaaaacccgaataacgtaatcctaccgccgaa

SEQ ID NO: 36599 - DNA, 908 bp, Artificial Sequence
  chemically treated genomic DNA (Homo sapiens) CpG-island No: 36599
gtaagggtacgtacggtatgttcgattttttgtcgtatcgtaacgacgcggcgatcgtgtttcgtcgtttattcgttttttgtcgacgcggcggcggtgatcggcgtagcgatttgcgataaagggttgtcgttattatgattgcgttggtcgcgatgtacgatttgtcgattattttggtgtcgggcggggcgacgttgtcgtcgatcgtcggggaagacgcgggtaaggtgtagattatcggcgcgcgtttcgttaattacgaattttttttgtaggaggtcgtcgaattgggttgtcgcgtttgcgtttcgtcgggcggcgggtgttagtttttcggtacggcgggtatttcgtaggtggtcgcggaggcgttgggtttggcgttgtcgtatttcgcgttggcgtcgttcgggtaggcggtgtggttggagatcgttcgttagtcggcgcgcgcggttagcgagttggatagtcgcggtattattacgcgggatatttttttcgataaagttatcgaaaacgcgatggtgatttacgcggcgttcggcggttttattaatttattgttgtatatttcggttatcgtttacgcggcgggttgtacgatttcggacgttgagtattggacgcgtattaatcgtaaagtgtcgcgtttggtgagcgtgttgtttaacggttcggattattattcgatcgtgcgcgtttttttcgcgggcggcgtgtcggaggtgatgttttatttgcgcgatttcggtttgttgtatttggacgttatgatcgtgatcggttagacggtgggcgagaattttgaatggtggtaggcgttcgagcgtcgggcgcgttttcgtagtgtttgcgcgagtaggacggcgtaaaagttcggatgacgtgattttgtcgtcgga

SEQ ID NO: 36600 - DNA, 908 bp, Artificial Sequence
  chemically treated genomic DNA (Homo sapiens) CpG-island No: 36600
tccgacgacaaaatcacgtcatccgaacttttacgccgtcctactcgcgcaaacactacgaaaacgcgcccgacgctcgaacgcctaccaccattcaaaattctcgcccaccgtctaaccgatcacgatcataacgtccaaatacaacaaaccgaaatcgcgcaaataaaacatcacctccgacacgccgcccgcgaaaaaaacgcgcacgatcgaataataatccgaaccgttaaacaacacgctcaccaaacgcgacactttacgattaatacgcgtccaatactcaacgtccgaaatcgtacaacccgccgcgtaaacgataaccgaaatatacaacaataaattaataaaaccgccgaacgccgcgtaaatcaccatcgcgttttcgataactttatcgaaaaaaatatcccgcgtaataataccgcgactatccaactcgctaaccgcgcgcgccgactaacgaacgatctccaaccacaccgcctacccgaacgacgccaacgcgaaatacgacaacgccaaacccaacgcctccgcgaccacctacgaaatacccgccgtaccgaaaaactaacacccgccgcccgacgaaacgcaaacgcgacaacccaattcgacgacctcctacaaaaaaaattcgtaattaacgaaacgcgcgccgataatctacaccttacccgcgtcttccccgacgatcgacgacaacgtcgccccgcccgacaccaaaataatcgacaaatcgtacatcgcgaccaacgcaatcataataacgacaaccctttatcgcaaatcgctacgccgatcaccgccgccgcgtcgacaaaaaacgaataaacgacgaaacacgatcgccgcgtcgttacgatacgacaaaaaatcgaacataccgtacgtacccttac

SEQ ID NO: 36601 - DNA, 953 bp, Artificial Sequence
  chemically treated genomic DNA (Homo sapiens) CpG-island No: 36601
cggagaacggtaagtatcgtttcggtatgaagttggtcgagcgcggttattttgtcgtgggttttatcgatattcggtagaaggtaaaaggttggttgacggagttgtttcggcggatcgggtagattatttatttggggattttggacgggcgtaaggggtttatatcgagaagattgaaggtaagttggtcgttatcgtttatttacgtatcggtcgtcgtttgtcggtgtacgttatcgttatcggtaaggtgttgattgtttggttgggcgaggtcgagttgaacgttttgttggagggttattagtatattatttttacgttcgttattttcgcgtttcgcgaagttttaatgagcgttttggcgtagattcgcgagtaaggttacgttttggatagcgaagagaacgagtagggcgtgcgttgcgtggcggtgtcggtgtggaattacgagtttcgcgttatcgtcgttttgagtttgtcgacgttgatttttcgcgtggacgacgcggagttggttaattttcgcgagtagttttagtaggtcgggttcgcgttttcgcgcgcgttgggttattcggtttgagtcgttagatcggttcgtaggtgaagtagtcgaagttcgcgtagtagtcgtcgtcgttgatgttttcgtagtgtaggtttataaacgcgtcggtgaagaagtcgcgttcgtcgatgtagtcgttcgatagtttttacgttttatacgttatcggtacggtgtgttacgtttcgttattaaacgagtagttgtagcggtagattagcgtatttacgtttattcgtagttagacgtttttcgtatgtttcggtatcggaatgggttgttcgtgtagcggttacgacggtacgttgtggtcgagttggataattttgatgggtttattttgttttttttcgtagtttataaagtagtagttttagtt

SEQ ID NO: 36602 - DNA, 953 bp, Artificial Sequence
  chemically treated genomic DNA (Homo sapiens) CpG-island No: 36602
aactaaaactactactttataaactacgaaaaaaaacaaaataaacccatcaaaattatccaactcgaccacaacgtaccgtcgtaaccgctacacgaacaacccattccgataccgaaacatacgaaaaacgtctaactacgaataaacgtaaatacgctaatctaccgctacaactactcgtttaataacgaaacgtaacacaccgtaccgataacgtataaaacgtaaaaactatcgaacgactacatcgacgaacgcgacttcttcaccgacgcgtttataaacctacactacgaaaacatcaacgacgacgactactacgcgaacttcgactacttcacctacgaaccgatctaacgactcaaaccgaataacccaacgcgcgcgaaaacgcgaacccgacctactaaaactactcgcgaaaattaaccaactccgcgtcgtccacgcgaaaaatcaacgtcgacaaactcaaaacgacgataacgcgaaactcgtaattccacaccgacaccgccacgcaacgcacgccctactcgttctcttcgctatccaaaacgtaaccttactcgcgaatctacgccaaaacgctcattaaaacttcgcgaaacgcgaaaataacgaacgtaaaaataatatactaataaccctccaacaaaacgttcaactcgacctcgcccaaccaaacaatcaacaccttaccgataacgataacgtacaccgacaaacgacgaccgatacgtaaataaacgataacgaccaacttaccttcaatcttctcgatataaaccccttacgcccgtccaaaatccccaaataaataatctacccgatccgccgaaacaactccgtcaaccaaccttttaccttctaccgaatatcgataaaacccacgacaaaataaccgcgctcgaccaacttcataccgaaacgatacttaccgttctccg

SEQ ID NO: 36603 - DNA, 953 bp, Artificial Sequence
  chemically treated genomic DNA (Homo sapiens) CpG-island No: 36603
aattggagttattgttttgtggattacgaggagggatagggtagatttattaaagttatttagttcgattataacgtgtcgtcgtggtcgttgtacgagtagtttatttcggtgtcggaatatgcggagagcgtttggttgcgggtggacgtggatacgttggtttatcgttatagttattcgtttgatggcgagacgtggtatatcgtgtcggtgacgtatgaggcgtggaagttgtcggacgattatatcggcgggcgcggtttttttatcggcgcgtttgtgggtttgtattgcgaggatattagcggcgacggttgttacgcggatttcgattattttatttacgagtcggtttaacggtttaggtcgggtagtttagcgcgcgcgagagcgcgagttcggtttgttgaagttgttcgcggaaattagttagtttcgcgtcgtttacgcgggaggttagcgtcgataggtttagggcggcgatgacgcgggattcgtggttttatatcggtatcgttacgtagcgtacgttttgttcgtttttttcgttgtttagggcgtagttttgttcgcgggtttgcgttagggcgtttattaaggtttcgcgagacgcgagggtggcgggcgtaaaggtagtgtattgatagttttttagtagggcgtttagttcggtttcgtttagttaggtaattaatattttgtcgatggcggtggcgtgtatcggtaggcggcggtcgatgcgtgaataggcgatggcggttagtttgtttttaattttttcgatatagattttttacgttcgtttaggatttttagatgggtggtttgttcggttcgtcgggatagtttcgttagttagttttttgttttttgtcgaatatcgatggagtttacgataaaatggtcgcgttcgattagttttatgtcgaggcgatatttgtcgtttttcg

SEQ ID NO: 36604 - DNA, 953 bp, Artificial Sequence
  chemically treated genomic DNA (Homo sapiens) CpG-island No: 36604
cgaaaaacgacaaatatcgcctcgacataaaactaatcgaacgcgaccattttatcgtaaactccatcgatattcgacaaaaaacaaaaaactaactaacgaaactatcccgacgaaccgaacaaaccacccatctaaaaatcctaaacgaacgtaaaaaatctatatcgaaaaaattaaaaacaaactaaccgccatcgcctattcacgcatcgaccgccgcctaccgatacacgccaccgccatcgacaaaatattaattacctaactaaacgaaaccgaactaaacgccctactaaaaaactatcaatacactacctttacgcccgccaccctcgcgtctcgcgaaaccttaataaacgccctaacgcaaacccgcgaacaaaactacgccctaaacaacgaaaaaaacgaacaaaacgtacgctacgtaacgataccgatataaaaccacgaatcccgcgtcatcgccgccctaaacctatcgacgctaacctcccgcgtaaacgacgcgaaactaactaatttccgcgaacaacttcaacaaaccgaactcgcgctctcgcgcgcgctaaactacccgacctaaaccgttaaaccgactcgtaaataaaataatcgaaatccgcgtaacaaccgtcgccgctaatatcctcgcaatacaaacccacaaacgcgccgataaaaaaaccgcgcccgccgatataatcgtccgacaacttccacgcctcatacgtcaccgacacgatataccacgtctcgccatcaaacgaataactataacgataaaccaacgtatccacgtccacccgcaaccaaacgctctccgcatattccgacaccgaaataaactactcgtacaacgaccacgacgacacgttataatcgaactaaataactttaataaatctaccctatccctcctcgtaatccacaaaacaataactccaatt

SEQ ID NO: 36605 - DNA, 524 bp, Artificial Sequence
  chemically treated genomic DNA (Homo sapiens) CpG-island No: 36605
tgaagtcggaggcgtgcgttgtttcggtcgtagtaggaggcgttgattagtttttgggaacggggcgggatttagttgggggggtttcgttttaggaggcgagtttagttcggatttttatttcgcgcgttgtttaagatggcgttggtggtttttgtgcgagttcggcgcgcgttttgtttcggcggtgtaaattcgggtgggtagggatcgggtcgggcggggtaggatcggaattaacgggttttttacgttgttttcgtagggttcggttttcggcggtttttcggcggatcggagcgggcggtcgcgcggagatcgcgcgtttacgtggagtagcgggtgttgtggagtcggacgcggttaggtgagcggcgtcgagggagggcggcgtggggttatgatcgcggggttcgttcgggggtgttgtcggagaattacgttgtcgacgttcggtttgtgtttagaatttaagtttcgaaatagaattttgtcgttttatttgggttcgttcgttatgagat

SEQ ID NO: 36606 - DNA, 524 bp, Artificial Sequence
  chemically treated genomic DNA (Homo sapiens) CpG-island No: 36606
atctcataacgaacgaacccaaataaaacgacaaaattctatttcgaaacttaaattctaaacacaaaccgaacgtcgacaacgtaattctccgacaacacccccgaacgaaccccgcgatcataaccccacgccgccctccctcgacgccgctcacctaaccgcgtccgactccacaacacccgctactccacgtaaacgcgcgatctccgcgcgaccgcccgctccgatccgccgaaaaaccgccgaaaaccgaaccctacgaaaacaacgtaaaaaacccgttaattccgatcctaccccgcccgacccgatccctacccacccgaatttacaccgccgaaacaaaacgcgcgccgaactcgcacaaaaaccaccaacgccatcttaaacaacgcgcgaaataaaaatccgaactaaactcgcctcctaaaacgaaacccccccaactaaatcccgccccgttcccaaaaactaatcaacgcctcctactacgaccgaaacaacgcacgcctccgacttca

SEQ ID NO: 36607 - DNA, 524 bp, Artificial Sequence
  chemically treated genomic DNA (Homo sapiens) CpG-island No: 36607
attttatgacgaacgaatttaggtagagcggtaaggttttgtttcgaaatttgggttttaaatataaatcgagcgtcgatagcgtggtttttcgatagtattttcgagcgagtttcgcggttatgattttacgtcgttttttttcggcgtcgtttatttggtcgcgttcggttttatagtattcgttgttttacgtaagcgcgcggttttcgcgcggtcgttcgtttcgattcgtcgagggatcgtcgggagtcgggttttgcgaaggtagcgtggggagttcgttagtttcggttttgtttcgttcggttcgatttttgtttattcgggtttgtatcgtcggagtagaacgcgcgtcggattcgtatagaagttattagcgttattttgagtaacgcgcgggataaaggttcgggttgagttcgttttttggggcggagtttttttaattaggtttcgtttcgtttttagaggttggttaacgttttttattacggtcgaaatagcgtacgttttcggtttta

SEQ ID NO: 36608 - DNA, 524 bp, Artificial Sequence
  chemically treated genomic DNA (Homo sapiens) CpG-island No: 36608
taaaaccgaaaacgtacgctatttcgaccgtaataaaaaacgttaaccaacctctaaaaacgaaacgaaacctaattaaaaaaactccgccccaaaaaacgaactcaacccgaacctttatcccgcgcgttactcaaaataacgctaataacttctatacgaatccgacgcgcgttctactccgacgatacaaacccgaataaacaaaaatcgaaccgaacgaaacaaaaccgaaactaacgaactccccacgctaccttcgcaaaacccgactcccgacgatccctcgacgaatcgaaacgaacgaccgcgcgaaaaccgcgcgcttacgtaaaacaacgaatactataaaaccgaacgcgaccaaataaacgacgccgaaaaaaaacgacgtaaaatcataaccgcgaaactcgctcgaaaatactatcgaaaaaccacgctatcgacgctcgatttatatttaaaacccaaatttcgaaacaaaaccttaccgctctacctaaattcgttcgtcataaaat

SEQ ID NO: 36609 - DNA, 696 bp, Artificial Sequence
  chemically treated genomic DNA (Homo sapiens) CpG-island No: 36609
atgtttcgggcgtcgcggagtcgtgtttgagtcgtcgtaggagtcgtcgaggtttcgttatttatgaattagattttcggggcgcgtttgtagggatttcgggatcgaggggtgggtttacgtcggtgttttatttgtcgattacgtttaggtatacgtcgtagagcgcgtcgattttcgttacggtttgatgcggcgcgcgtgtagcggattagtattaggttttgtgttgttgcgggaaggggtgggggcgttagagttcggcgggaggggaggcggggtcgtttatcggttcgggggtcgagaatttgattacgaagggttcgcggttgaagacgttttcggggtttggtataggtaggtgttacgacgatatcgcgttttttttaggagatggggaggatcgttgagtttcgatttgcgtttcggcgtttttttttgcggttcgtttttatttgtatacgaataggtatatttttttgtattggtttcggtttagggcgtggttgtttataaagttgtattcgtgttcggatacgttgtggagataggggttcgtttaggtcggggcgcgcgcgggtagatttcggggagtcgcgagaggggtttgtattatatttgttgatttgttttatgagcgcggatacggttgtaggtgtttggtgtttcgtattttttgtattagcgcgaggttat

SEQ ID NO: 36610 - DNA, 696 bp, Artificial Sequence
  chemically treated genomic DNA (Homo sapiens) CpG-island No: 36610
ataacctcgcgctaatacaaaaaatacgaaacaccaaacacctacaaccgtatccgcgctcataaaacaaatcaacaaatataatacaaacccctctcgcgactccccgaaatctacccgcgcgcgccccgacctaaacgaacccctatctccacaacgtatccgaacacgaatacaactttataaacaaccacgccctaaaccgaaaccaatacaaaaaaatatacctattcgtatacaaataaaaacgaaccgcaaaaaaaaacgccgaaacgcaaatcgaaactcaacgatcctccccatctcctaaaaaaaacgcgatatcgtcgtaacacctacctataccaaaccccgaaaacgtcttcaaccgcgaacccttcgtaatcaaattctcgacccccgaaccgataaacgaccccgcctcccctcccgccgaactctaacgcccccaccccttcccgcaacaacacaaaacctaatactaatccgctacacgcgcgccgcatcaaaccgtaacgaaaatcgacgcgctctacgacgtatacctaaacgtaatcgacaaataaaacaccgacgtaaacccacccctcgatcccgaaatccctacaaacgcgccccgaaaatctaattcataaataacgaaacctcgacgactcctacgacgactcaaacacgactccgcgacgcccgaaacat

SEQ ID NO: 36611 - DNA, 696 bp, Artificial Sequence
  chemically treated genomic DNA (Homo sapiens) CpG-island No: 36611
atgatttcgcgttggtgtaggaggtgcgagatattagatatttgtagtcgtgttcgcgtttatggagtagattaataggtgtggtgtaggtttttttcgcgatttttcgggatttgttcgcgcgcgtttcgatttgagcgggtttttgtttttatagcgtgttcgagtacgagtatagttttgtgagtagttacgttttgggtcgggattagtataaggagatgtatttgttcgtgtataggtgagggcgggtcgtagggaggggcgtcggggcgtaggtcggggtttagcggttttttttattttttaggaaagacgcggtgtcgtcgtggtatttatttgtattagatttcgaggacgtttttagtcgcgagtttttcgtggttaagttttcggttttcggatcggtgagcggtttcgttttttttttcgtcgagttttgacgtttttattttttttcgtagtagtatagaatttggtgttgattcgttgtacgcgcgtcgtattaagtcgtggcggagatcgacgcgttttacgacgtgtatttggacgtgatcgataagtggggtatcgacgtaagtttatttttcggtttcggggtttttgtaggcgcgtttcgggggtttggtttatgagtggcgggatttcgacggtttttgcggcggtttagatacggtttcgcggcgttcgagatat

SEQ ID NO: 36612 - DNA, 696 bp, Artificial Sequence
  chemically treated genomic DNA (Homo sapiens) CpG-island No: 36612
atatctcgaacgccgcgaaaccgtatctaaaccgccgcaaaaaccgtcgaaatcccgccactcataaaccaaacccccgaaacgcgcctacaaaaaccccgaaaccgaaaaataaacttacgtcgataccccacttatcgatcacgtccaaatacacgtcgtaaaacgcgtcgatctccgccacgacttaatacgacgcgcgtacaacgaatcaacaccaaattctatactactacgaaaaaaaataaaaacgtcaaaactcgacgaaaaaaaaaacgaaaccgctcaccgatccgaaaaccgaaaacttaaccacgaaaaactcgcgactaaaaacgtcctcgaaatctaatacaaataaataccacgacgacaccgcgtctttcctaaaaaataaaaaaaaccgctaaaccccgacctacgccccgacgcccctccctacgacccgccctcacctatacacgaacaaatacatctccttatactaatcccgacccaaaacgtaactactcacaaaactatactcgtactcgaacacgctataaaaacaaaaacccgctcaaatcgaaacgcgcgcgaacaaatcccgaaaaatcgcgaaaaaaacctacaccacacctattaatctactccataaacgcgaacacgactacaaatatctaatatctcgcacctcctacaccaacgcgaaatcat

SEQ ID NO: 36613 - DNA, 577 bp, Artificial Sequence
  chemically treated genomic DNA (Homo sapiens) CpG-island No: 36613
tcggcgttggggtggagtcggcggggtcgtcgtgtcgttcgtggtcgttggggacgttggtgttttttcgtttcgtttattttttcgtcggttcgtttttggttagagaagtcgtagttcgtagtgttcgatttagtcgtttcgcgtcggagtcggtttcgtagcgtgttatggtttgttatatttattagttgtttttttgggtgttggacgatttgtgtcgtaatatggacgcgtttagcgagtgggattggatggagttcggtgagtgcggttcgggaggggaggggattagggcgatcggagtttttagcgatttcgtttggagcggtcgttaagttttttcgggtattcgggtttagcgggtttcgattcgagggcgtgcgagttgagttttttggatcgggttcgtcgcggatttcggtttgttatttgaaggtgtcgcgtggtttttgaggacgtttgtcgacgagtaggggtcgtcgttattgcgttttgagtttagagaacggtgggtacgggggtttttttgttagcgttgttggttcggtgacgtttttaggtggttttttattta

SEQ ID NO: 36614 - DNA, 577 bp, Artificial Sequence
  chemically treated genomic DNA (Homo sapiens) CpG-island No: 36614
taaataaaaaaccacctaaaaacgtcaccgaaccaacaacgctaacaaaaaaacccccgtacccaccgttctctaaactcaaaacgcaataacgacgacccctactcgtcgacaaacgtcctcaaaaaccacgcgacaccttcaaataacaaaccgaaatccgcgacgaacccgatccaaaaaactcaactcgcacgccctcgaatcgaaacccgctaaacccgaatacccgaaaaaacttaacgaccgctccaaacgaaatcgctaaaaactccgatcgccctaatcccctcccctcccgaaccgcactcaccgaactccatccaatcccactcgctaaacgcgtccatattacgacacaaatcgtccaacacccaaaaaaacaactaataaatataacaaaccataacacgctacgaaaccgactccgacgcgaaacgactaaatcgaacactacgaactacgacttctctaaccaaaaacgaaccgacgaaaaaataaacgaaacgaaaaaacaccaacgtccccaacgaccacgaacgacacgacgaccccgccgactccaccccaacgccga

SEQ ID NO: 36615 - DNA, 577 bp, Artificial Sequence
  chemically treated genomic DNA (Homo sapiens) CpG-island No: 36615
tggatgagaggttatttggggacgttatcgagttagtagcgttgataggagggttttcgtatttatcgttttttggatttagagcgtagtggcggcggtttttgttcgtcgatagacgtttttagagattacgcggtatttttaggtgataggtcgaggttcgcggcggattcggtttaggaggtttagttcgtacgttttcggatcgggattcgttgaattcgggtgttcgagggagtttggcggtcgttttaggcgggatcgttgggggtttcggtcgttttggtttttttttttttcgggtcgtatttatcgaattttatttagttttattcgttgagcgcgtttatgttgcggtataggtcgtttagtatttaggagggtagttggtagatgtagtaggttatggtacgttacggggtcggtttcggcgcgggacgattgggtcggatattgcgggttgcggtttttttagttaggggcggatcggcggggaagtgggcggggcgggagggtattagcgtttttagcggttacgggcggtacgacggtttcgtcggttttattttagcgtcgg

SEQ ID NO: 36616 - DNA, 577 bp, Artificial Sequence
  chemically treated genomic DNA (Homo sapiens) CpG-island No: 36616
ccgacgctaaaataaaaccgacgaaaccgtcgtaccgcccgtaaccgctaaaaacgctaataccctcccgccccgcccacttccccgccgatccgcccctaactaaaaaaaccgcaacccgcaatatccgacccaatcgtcccgcgccgaaaccgaccccgtaacgtaccataacctactacatctaccaactaccctcctaaatactaaacgacctataccgcaacataaacgcgctcaacgaataaaactaaataaaattcgataaatacgacccgaaaaaaaaaaaaaccaaaacgaccgaaacccccaacgatcccgcctaaaacgaccgccaaactccctcgaacacccgaattcaacgaatcccgatccgaaaacgtacgaactaaacctcctaaaccgaatccgccgcgaacctcgacctatcacctaaaaataccgcgtaatctctaaaaacgtctatcgacgaacaaaaaccgccgccactacgctctaaatccaaaaaacgataaatacgaaaaccctcctatcaacgctactaactcgataacgtccccaaataacctctcatcca

SEQ ID NO: 36617 - DNA, 621 bp, Artificial Sequence
  chemically treated genomic DNA (Homo sapiens) CpG-island No: 36617
  misc_feature (292)..(292): n is either a, c, g or t
tgattcgttcgttttggtgcgtacgattataggaattgtaaggagagttagtatagttcgtcggaaagtagtatcgtagtcggaagggtaaatatttaggttattagaatgttggttacggttttacgttgtaagtcgttattatttattattatcgttttcgcgatagaagaggagagtacgtgagtagtggaaatcggtatttcggtataattcgttaggtcgatagatattgtcgtcgttatttgggtagatattttttgagcgtaggttatgttttttttatcgattnttttatcgatagtcgttgttatacggcgttagttaattatcgtatcgatatttaacgttagcgcgatcgttatgatgatttatatcggtgtatattcgatggtgttaagtatgtcggattttagttttttttataggcgttgatcgttagtatttacgttaggtatttttattattttgtcgatagtgttagaaacgtatagtataatgcggcgtatttggttacgttgattaagcgatagttggtcgtaattttttatatggggggtaatatatttttaagcggttgacgcggtattgttttttacggatggaggggattttcgagtt

SEQ ID NO: 36618 - DNA, 621 bp, Artificial Sequence
  chemically treated genomic DNA (Homo sapiens) CpG-island No: 36618
  misc_feature (330)..(330): n is either a, c, g or t
aactcgaaaatcccctccatccgtaaaaaacaataccgcgtcaaccgcttaaaaatatattaccccccatataaaaaattacgaccaactatcgcttaatcaacgtaaccaaatacgccgcattatactatacgtttctaacactatcgacaaaataataaaaatacctaacgtaaatactaacgatcaacgcctataaaaaaaactaaaatccgacatacttaacaccatcgaatatacaccgatataaatcatcataacgatcgcgctaacgttaaatatcgatacgataattaactaacgccgtataacaacgactatcgataaaanaatcgataaaaaaaacataacctacgctcaaaaaatatctacccaaataacgacgacaatatctatcgacctaacgaattataccgaaataccgatttccactactcacgtactctcctcttctatcgcgaaaacgataataataaataataacgacttacaacgtaaaaccgtaaccaacattctaataacctaaatatttacccttccgactacgatactactttccgacgaactatactaactctccttacaattcctataatcgtacgcaccaaaacgaacgaatca

SEQ ID NO: 36619 - DNA, 621 bp, Artificial Sequence
  chemically treated genomic DNA (Homo sapiens) CpG-island No: 36619
  misc_feature (330)..(330): n is either a, c, g or t
aattcggaagttttttttattcgtgaaaaataatatcgcgttaatcgtttgaaagtatgttgttttttatgtgaaaagttacggttagttgtcgtttgattaacgtagttagatgcgtcgtattatgttgtgcgtttttgatattatcgataaagtggtgaagatgtttggcgtgagtgttgacgattagcgtttgtgaaagaaattgaagttcgatatgtttagtattatcgagtatgtatcggtgtggattattatggcggtcgcgttggcgttaggtatcggtacgatgattggttggcgtcgtgtggtaacgattatcggtgaganaatcggtaagaaaggtatgatttacgtttaggggatgtttgtttagatgacggcggtagtgtttatcggtttggcgagttatatcgggatgtcggtttttattatttacgtattttttttttttgtcgcggggacgatggtggtagatggtggcggtttatagcgtaaaatcgtgattagtattttgatggtttgggtgtttattttttcggttgcggtattgtttttcggcgggttgtattggttttttttgtagtttttgtaatcgtacgtattaaaacgagcgggtta

SEQ ID NO: 36620 - DNA, 621 bp, Artificial Sequence
  chemically treated genomic DNA (Homo sapiens) CpG-island No: 36620
  misc_feature (292)..(292): n is either a, c, g or t
taacccgctcgttttaatacgtacgattacaaaaactacaaaaaaaaccaatacaacccgccgaaaaacaataccgcaaccgaaaaaataaacacccaaaccatcaaaatactaatcacgattttacgctataaaccgccaccatctaccaccatcgtccccgcgacaaaaaaaaaaaatacgtaaataataaaaaccgacatcccgatataactcgccaaaccgataaacactaccgccgtcatctaaacaaacatcccctaaacgtaaatcatacctttcttaccgattntctcaccgataatcgttaccacacgacgccaaccaatcatcgtaccgatacctaacgccaacgcgaccgccataataatccacaccgatacatactcgataatactaaacatatcgaacttcaatttctttcacaaacgctaatcgtcaacactcacgccaaacatcttcaccactttatcgataatatcaaaaacgcacaacataatacgacgcatctaactacgttaatcaaacgacaactaaccgtaacttttcacataaaaaacaacatactttcaaacgattaacgcgatattatttttcacgaataaaaaaaacttccgaatt

SEQ ID NO: 36621 - DNA, 759 bp, Artificial Sequence
  chemically treated genomic DNA (Homo sapiens) CpG-island No: 36621
ttcgtacggcgatagcgtttgttatgaagcgatggttttgatggcgtaatcgtttttttatcgttattcgttggttgatggttaggggaattggggcgcgtcggacgattcgaaatcgttcgcggtaatgcgttatatcgaatttcggttgtcgaaatatttcgagttgttattgagcgagttggggtaggggacggttgattgggtgttaaatttcgacggtattttgtaggagtcgaaaatgttatttgttcgtttgttaaatattttgtttaacggtattatcggtattgtcgtcggtatggcgatcgatattttatcgtataatttgcgtgaagtggtttaggcggtaatcgtattaatcgattagtcgaaattacgttcgattagttgttggatatcgtgtaggggtcggattattcgattgaagcggaaattattatttcgcgcgtcgagattcgtaaaatttacgagaacggacgtggtttagtgcgtatgcgcgcggtgtggaagaaagaagatggcgcggtggttattagcgtattgtcgtattaggttttaggtgcgcgcgtattggagtaaattgttgcgtaaatgcgtaataaaaagttgtttatggttgacgatttgcgcgatgaatttgattacgagaattcgattcgtttggtgattgtgtcgcgttttaatcgcgtggatatggattaggtgatgaattattttttcgttattatcgatttggaaaagagttatcgtattaat

SEQ ID NO: 36622 - DNA, 759 bp, Artificial Sequence
  chemically treated genomic DNA (Homo sapiens) CpG-island No: 36622
attaatacgataactcttttccaaatcgataataacgaaaaaataattcatcacctaatccatatccacgcgattaaaacgcgacacaatcaccaaacgaatcgaattctcgtaatcaaattcatcgcgcaaatcgtcaaccataaacaactttttattacgcatttacgcaacaatttactccaatacgcgcgcacctaaaacctaatacgacaatacgctaataaccaccgcgccatcttctttcttccacaccgcgcgcatacgcactaaaccacgtccgttctcgtaaattttacgaatctcgacgcgcgaaataataatttccgcttcaatcgaataatccgacccctacacgatatccaacaactaatcgaacgtaatttcgactaatcgattaatacgattaccgcctaaaccacttcacgcaaattatacgataaaatatcgatcgccataccgacgacaataccgataataccgttaaacaaaatatttaacaaacgaacaaataacattttcgactcctacaaaataccgtcgaaatttaacacccaatcaaccgtcccctaccccaactcgctcaataacaactcgaaatatttcgacaaccgaaattcgatataacgcattaccgcgaacgatttcgaatcgtccgacgcgccccaattcccctaaccatcaaccaacgaataacgataaaaaaacgattacgccatcaaaaccatcgcttcataacaaacgctatcgccgtacgaa

SEQ ID NO: 36623 - DNA, 759 bp, Artificial Sequence
  chemically treated genomic DNA (Homo sapiens) CpG-island No: 36623
gttaatacgatagtttttttttagatcggtggtagcgaagaggtggtttattatttgatttatatttacgcggttggaacgcggtataattattaggcgggtcgggttttcgtggttagatttatcgcgtagatcgttaattataggtagttttttgttgcgtatttgcgtagtaatttgttttagtacgcgcgtatttgaaatttgatgcggtaatgcgttgataattatcgcgttatttttttttttttatatcgcgcgtatacgtattgaattacgttcgttttcgtagattttacggatttcggcgcgcgaagtgataattttcgttttagtcggataattcggtttttgtacgatatttagtagttgatcgagcgtggtttcggttggtcgattaatgcgattgtcgtttgagttattttacgtaggttatgcggtggaatatcggtcgttatgtcgacggtaatatcggtggtgtcgttaagtaaaatgtttggtagacgggtaggtagtattttcggtttttgtaaagtgtcgtcgaagtttggtatttagttagtcgttttttgttttagttcgtttaatagtagttcggaatatttcgataatcgggattcggtgtaacgtattgtcgcgaacgatttcggatcgttcggcgcgttttagtttttttgattattaattagcggataacggtaagagaacggttgcgttattaggattatcgttttataataggcgttatcgtcgtgcgga

SEQ ID NO: 36624 - DNA, 759 bp, Artificial Sequence
  chemically treated genomic DNA (Homo sapiens) CpG-island No: 36624
tccgcacgacgataacgcctattataaaacgataatcctaataacgcaaccgttctcttaccgttatccgctaattaataatcaaaaaaactaaaacgcgccgaacgatccgaaatcgttcgcgacaatacgttacaccgaatcccgattatcgaaatattccgaactactattaaacgaactaaaacaaaaaacgactaactaaataccaaacttcgacgacactttacaaaaaccgaaaatactacctacccgtctaccaaacattttacttaacgacaccaccgatattaccgtcgacataacgaccgatattccaccgcataacctacgtaaaataactcaaacgacaatcgcattaatcgaccaaccgaaaccacgctcgatcaactactaaatatcgtacaaaaaccgaattatccgactaaaacgaaaattatcacttcgcgcgccgaaatccgtaaaatctacgaaaacgaacgtaattcaatacgtatacgcgcgatataaaaaaaaaaaaataacgcgataattatcaacgcattaccgcatcaaatttcaaatacgcgcgtactaaaacaaattactacgcaaatacgcaacaaaaaactacctataattaacgatctacgcgataaatctaaccacgaaaacccgacccgcctaataattataccgcgttccaaccgcgtaaatataaatcaaataataaaccacctcttcgctaccaccgatctaaaaaaaaactatcgtattaac

SEQ ID NO: 36625 - DNA, 985 bp, Artificial Sequence
  chemically treated genomic DNA (Homo sapiens) CpG-island No: 36625
  misc_feature (269)..(269): n is either a, c, g or t
  misc_feature (885)..(885): n is either a, c, g or t
  misc_feature (955)..(955): n is either a, c, g or t
gtaacgcgtggtggttatggggttgggtaatttgttgtgggtcgatgaaggtttcggcgtgcgggtggcggaacggttgtatgtttattattattggttcgagtatgtggagattgtcgatggcggtatttagggattgaatttgttggggtatgtcgaaagcgttagttatttgttgattttcgatgttattgattacgggttggaaatttggaacgttgcgaatttatgtcggaaaacgtatttcggtttattttagcgcgaagaanatgagtttgtattagaatagtttttttaagtggtggggttggcggatattcgggatatttgttagtatatattgttttcgtcggtttgtaattcgtaatgttcgacgattacggcggtagtttgagcgaattggtacgggagtaattgttcgttgcggaataggcggcgttggcgtagtttgttgcgtggggaattgtgtcgtaatcggttaatgaatcgcgttgttttaattatgattgtttgtcgatggaaaattacgaaggcgttcgtttgcgttagtatcggatgatataggaggagtagggatgagtaacgatacgttatttgatgcgttgtggtaacgaatgttggcgcgcggttggacgttagttagtgaatttcgttttgacgattggtttacgtaagcgttagacggcgtggtgttattaagtagtgattcgaaacgtacgttagaggttagcgataattcggtaatgattggcgaattattgcgcgagtttttcgattatatatggtaggtggcgattgttgattttgagtagagcgaagttatcggcgatcgttttggcgtttttcgtttttttgttattttagtgtttatcggcggaaattatncgcgcgtgttgaatggtatttattcgtgggcggaattgataaatttgatgcgcgggttttgtcgaatcgnatagggagcgtttttatgaataaaattttt

SEQ ID NO: 36626 - DNA, 985 bp, Artificial Sequence
  chemically treated genomic DNA (Homo sapiens) CpG-island No: 36626
  misc_feature (31)..(31): n is either a, c, g or t
  misc_feature (101)..(101): n is either a, c, g or t
  misc_feature (717)..(717): n is either a, c, g or t
aaaaattttattcataaaaacgctccctatncgattcgacaaaacccgcgcatcaaatttatcaattccgcccacgaataaataccattcaacacgcgcgnataatttccgccgataaacactaaaataacaaaaaaacgaaaaacgccaaaacgatcgccgataacttcgctctactcaaaatcaacaatcgccacctaccatatataatcgaaaaactcgcgcaataattcgccaatcattaccgaattatcgctaacctctaacgtacgtttcgaatcactacttaataacaccacgccgtctaacgcttacgtaaaccaatcgtcaaaacgaaattcactaactaacgtccaaccgcgcgccaacattcgttaccacaacgcatcaaataacgtatcgttactcatccctactcctcctatatcatccgatactaacgcaaacgaacgccttcgtaattttccatcgacaaacaatcataattaaaacaacgcgattcattaaccgattacgacacaattccccacgcaacaaactacgccaacgccgcctattccgcaacgaacaattactcccgtaccaattcgctcaaactaccgccgtaatcgtcgaacattacgaattacaaaccgacgaaaacaatatatactaacaaatatcccgaatatccgccaaccccaccacttaaaaaaactattctaatacaaactcatnttcttcgcgctaaaataaaccgaaatacgttttccgacataaattcgcaacgttccaaatttccaacccgtaatcaataacatcgaaaatcaacaaataactaacgctttcgacataccccaacaaattcaatccctaaataccgccatcgacaatctccacatactcgaaccaataataataaacatacaaccgttccgccacccgcacgccgaaaccttcatcgacccacaacaaattacccaaccccataaccaccacgcgttac

SEQ ID NO: 36627 - DNA, 985 bp, Artificial Sequence
  chemically treated genomic DNA (Homo sapiens) CpG-island No: 36627
  misc_feature (31)..(31): n is either a, c, g or t
  misc_feature (101)..(101): n is either a, c, g or t
  misc_feature (717)..(717): n is either a, c, g or t
aaaagttttgtttataaggacgttttttgtncggttcgataaggttcgcgtattaggtttattagtttcgtttacgggtgaatattatttagtacgcgcgnatagttttcgtcggtaaatattaaagtggtagaaaagcgaaagacgttaaagcgatcgtcgatggtttcgttttgtttaaggttagtaatcgttatttgttatgtatagtcgggaaattcgcgtagtaattcgttaattattatcggattatcgttgatttttggcgtgcgtttcgggttattgtttaataatattacgtcgtttggcgtttgcgtaagttagtcgttaagacgggatttattgattggcgtttagtcgcgcgttagtattcgttgttataacgtattaaatggcgtgtcgttgtttatttttgttttttttgtgttattcggtattggcgtaagcgaacgttttcgtaattttttatcgatagatagttataattgagatagcgcgatttattagtcggttgcggtataattttttacgtagtaagttgcgttagcgtcgtttgtttcgtagcgggtagttgttttcgtgttagttcgtttaggttatcgtcgtagtcgtcgagtattgcgggttgtagatcgacgagggtaatatgtgttggtagatgtttcgaatattcgttagttttattatttggagaaattgttttgatgtaggtttatntttttcgcgttgagataagtcggaatgcgtttttcggtataggttcgtagcgttttaggtttttagttcgtagttaatggtatcgagaattaatagatggttggcgttttcgatatattttagtaagtttagtttttgagtatcgttatcgataatttttatatattcgggttagtggtaatgggtatatagtcgtttcgttattcgtacgtcgaagtttttatcggtttatagtaggttgtttagttttatgattattacgcgttgt

SEQ ID NO: 36628 - DNA, 985 bp, Artificial Sequence
  chemically treated genomic DNA (Homo sapiens) CpG-island No: 36628
  misc_feature (269)..(269): n is either a, c, g or t
  misc_feature (885)..(885): n is either a, c, g or t
  misc_feature (955)..(955): n is either a, c, g or t
acaacgcgtaataatcataaaactaaacaacctactataaaccgataaaaacttcgacgtacgaataacgaaacgactatatacccattaccactaacccgaatatataaaaattatcgataacgatactcaaaaactaaacttactaaaatatatcgaaaacgccaaccatctattaattctcgataccattaactacgaactaaaaacctaaaacgctacgaacctataccgaaaaacgcattccgacttatctcaacgcgaaaaanataaacctacatcaaaacaatttctccaaataataaaactaacgaatattcgaaacatctaccaacacatattaccctcgtcgatctacaacccgcaatactcgacgactacgacgataacctaaacgaactaacacgaaaacaactacccgctacgaaacaaacgacgctaacgcaacttactacgtaaaaaattataccgcaaccgactaataaatcgcgctatctcaattataactatctatcgataaaaaattacgaaaacgttcgcttacgccaataccgaataacacaaaaaaaacaaaaataaacaacgacacgccatttaatacgttataacaacgaatactaacgcgcgactaaacgccaatcaataaatcccgtcttaacgactaacttacgcaaacgccaaacgacgtaatattattaaacaataacccgaaacgcacgccaaaaatcaacgataatccgataataattaacgaattactacgcgaatttcccgactatacataacaaataacgattactaaccttaaacaaaacgaaaccatcgacgatcgctttaacgtctttcgcttttctaccactttaatatttaccgacgaaaactatncgcgcgtactaaataatattcacccgtaaacgaaactaataaacctaatacgcgaaccttatcgaaccgnacaaaaaacgtccttataaacaaaactttt

SEQ ID NO: 36629 - DNA, 627 bp, Artificial Sequence
  chemically treated genomic DNA (Homo sapiens) CpG-island No: 36629
cgatgtttagttattaaataacggtagaaacgtacgcggttcgttcggagtaaattgttgttaggtgttgtcgtcgggatcgttttcgtattggacgttaattaatatgtacgattgcgtatattgttatgtatgaacgttaattttcgttatttgtcgtatttgcgaatttgcgtcgtcggtattaattattagtttcgcgcgaattattttatcgttttttagttttagtttttgaagattattatggcgatgtagcgtaattagcgagtttggtatacgtaacgttattttcggatgcgtttttagcgtttgttataacgtttgttgtaggatagtgttttttattatatagttaagtagcggtagtttaagtttagcggcgttaaatattatatgcgtcgttttttatttttacgtttttagtttgcggtaaggatggtaacgtatagtttgtattgtattttagatttttaattttttaagtaatgatatcgaagtcgcgttgatcgtcgagattcgtatcgttcggttggttattagcggataacgggcgttgttttgcgtgttcgattatcgttacggaaaatcggtgttgggttatttttaggttagggggtcggcgat

SEQ ID NO: 36630 - DNA, 627 bp, Artificial Sequence
  chemically treated genomic DNA (Homo sapiens) CpG-island No: 36630
atcgccgaccccctaacctaaaaataacccaacaccgattttccgtaacgataatcgaacacgcaaaacaacgcccgttatccgctaataaccaaccgaacgatacgaatctcgacgatcaacgcgacttcgatatcattacttaaaaaattaaaaatctaaaatacaatacaaactatacgttaccatccttaccgcaaactaaaaacgtaaaaataaaaaacgacgcatataatatttaacgccgctaaacttaaactaccgctacttaactatataataaaaaacactatcctacaacaaacgttataacaaacgctaaaaacgcatccgaaaataacgttacgtataccaaactcgctaattacgctacatcgccataataatcttcaaaaactaaaactaaaaaacgataaaataattcgcgcgaaactaataattaataccgacgacgcaaattcgcaaatacgacaaataacgaaaattaacgttcatacataacaatatacgcaatcgtacatattaattaacgtccaatacgaaaacgatcccgacgacaacacctaacaacaatttactccgaacgaaccgcgtacgtttctaccgttatttaataactaaacatcg

SEQ ID NO: 36631 - DNA, 627 bp, Artificial Sequence
  chemically treated genomic DNA (Homo sapiens) CpG-island No: 36631
gtcgtcggttttttggtttgggggtggtttagtatcgatttttcgtaacggtgatcgagtacgtagaatagcgttcgttgttcgttgatagttaatcggacggtgcggatttcggcgattagcgcggtttcggtattattgtttaaagggttaggggtttgggatgtagtataggttatgcgttgttatttttatcgtagattggaaacgtgggagtgggaaacggcgtatgtggtgtttgacgtcgttgaatttaagttatcgttgtttggttatatggtggaaaatattgttttgtaataggcgttgtggtaggcgttggaagcgtattcgaaagtaacgttacgtgtgttaggttcgttgattgcgttgtatcgttatgatgatttttaggagttggagttgaaaggcggtgaagtgattcgcgcgaagttggtgattggtgtcgacggcgtaaattcgtaggtgcggtagatggcgggaattggcgtttatgtatggtagtatgcgtagtcgtgtatgttgattagcgtttagtgcgagaacgatttcggcgatagtatttggtagtaatttatttcggacggatcgcgtgcgtttttgtcgttgtttgataattgggtatcg

SEQ ID NO: 36632 - DNA, 627 bp, Artificial Sequence
  chemically treated genomic DNA (Homo sapiens) CpG-island No: 36632
cgatacccaattatcaaacaacgacaaaaacgcacgcgatccgtccgaaataaattactaccaaatactatcgccgaaatcgttctcgcactaaacgctaatcaacatacacgactacgcatactaccatacataaacgccaattcccgccatctaccgcacctacgaatttacgccgtcgacaccaatcaccaacttcgcgcgaatcacttcaccgcctttcaactccaactcctaaaaatcatcataacgatacaacgcaatcaacgaacctaacacacgtaacgttactttcgaatacgcttccaacgcctaccacaacgcctattacaaaacaatattttccaccatataaccaaacaacgataacttaaattcaacgacgtcaaacaccacatacgccgtttcccactcccacgtttccaatctacgataaaaataacaacgcataacctatactacatcccaaacccctaaccctttaaacaataataccgaaaccgcgctaatcgccgaaatccgcaccgtccgattaactatcaacgaacaacgaacgctattctacgtactcgatcaccgttacgaaaaatcgatactaaaccacccccaaaccaaaaaaccgacgac

SEQ ID NO: 36633 - DNA, 590 bp, Artificial Sequence
  chemically treated genomic DNA (Homo sapiens) CpG-island No: 36633
ttattattagtaggtcgatattcggaaatttgaataagcgttgcgcggtttcgatattcggatttgttatagtaattagtaagtttttcggtttatttgcggtaatattcgtttggttgagtagcgtaatcgttcgttgggagatttttttcgtcgtcggatgcggggtaaaaatgacgttgttgttcgcggtaattaggttgatggcgttgttaattacggttgtcgtcgggttagtggaaggcgttatcgaagttattacgttttagggtgcgtttttaattagggttaggtcgttgtcgttagttagtatttgcggagagaggtatttaacgtttggtgtgtcgcgcgtttgagcgacgttttttgtaatttatttttaacgcgttttatgtcggttttattgacgggtagtttcgtttaatttttggcgtgtttttcgtttgttttacgaatggtagtatggttaattggcgtattgttacgttttttaattttttgttggcgattttggttgtcgtaacggcgttatttagggacgcgaaaacgtttattttatgaaaacgcgcggacggcgtgttattggtttt

SEQ ID NO: 36634 - DNA, 590 bp, Artificial Sequence
  chemically treated genomic DNA (Homo sapiens) CpG-island No: 36634
aaaaccaataacacgccgtccgcgcgttttcataaaataaacgttttcgcgtccctaaataacgccgttacgacaaccaaaatcgccaacaaaaaattaaaaaacgtaacaatacgccaattaaccatactaccattcgtaaaacaaacgaaaaacacgccaaaaattaaacgaaactacccgtcaataaaaccgacataaaacgcgttaaaaataaattacaaaaaacgtcgctcaaacgcgcgacacaccaaacgttaaatacctctctccgcaaatactaactaacgacaacgacctaaccctaattaaaaacgcaccctaaaacgtaataacttcgataacgccttccactaacccgacgacaaccgtaattaacaacgccatcaacctaattaccgcgaacaacaacgtcatttttaccccgcatccgacgacgaaaaaaatctcccaacgaacgattacgctactcaaccaaacgaatattaccgcaaataaaccgaaaaacttactaattactataacaaatccgaatatcgaaaccgcgcaacgcttattcaaatttccgaatatcgacctactaataataa

SEQ ID NO: 36635 - DNA, 590 bp, Artificial Sequence
  chemically treated genomic DNA (Homo sapiens) CpG-island No: 36635
aaagttagtgatacgtcgttcgcgcgtttttatgagatgggcgttttcgcgtttttggataacgtcgttgcggtagttaaagtcgttagtaaagggttaaaaagcgtggtaatgcgttagttagttatgttgttattcgtgaagtaggcgaaaaatacgttagagattaagcggaattgttcgttagtgaaatcggtatggggcgcgttgaagataaattgtaaaaaacgtcgtttaggcgcgcggtatattaggcgttgagtgttttttttcgtaagtgttgattggcgataacggtttgattttaattgaaaacgtattttggggcgtggtggtttcggtgacgttttttattaattcggcggtaatcgtaattaataacgttattagtttgattgtcgcgggtaatagcgttatttttgtttcgtattcggcggcgaaaaaagttttttagcgggcgattacgttgtttaattaggcgaatgttgtcgtaggtgggtcggaaaatttattggttattgtggtaaattcggatatcgaaatcgcgtaacgtttgtttaagttttcgggtatcggtttgttggtggtaa

SEQ ID NO: 36636 - DNA, 590 bp, Artificial Sequence
  chemically treated genomic DNA (Homo sapiens) CpG-island No: 36636
ttaccaccaacaaaccgatacccgaaaacttaaacaaacgttacgcgatttcgatatccgaatttaccacaataaccaataaattttccgacccacctacgacaacattcgcctaattaaacaacgtaatcgcccgctaaaaaacttttttcgccgccgaatacgaaacaaaaataacgctattacccgcgacaatcaaactaataacgttattaattacgattaccgccgaattaataaaaaacgtcaccgaaaccaccacgccccaaaatacgttttcaattaaaatcaaaccgttatcgccaatcaacacttacgaaaaaaaacactcaacgcctaatataccgcgcgcctaaacgacgttttttacaatttatcttcaacgcgccccataccgatttcactaacgaacaattccgcttaatctctaacgtatttttcgcctacttcacgaataacaacataactaactaacgcattaccacgctttttaaccctttactaacgactttaactaccgcaacgacgttatccaaaaacgcgaaaacgcccatctcataaaaacgcgcgaacgacgtatcactaacttt

SEQ ID NO: 36637 - DNA, 578 bp, Artificial Sequence
  chemically treated genomic DNA (Homo sapiens) CpG-island No: 36637
  misc_feature (313)..(313): n is either a, c, g or t
  misc_feature (456)..(456): n is either a, c, g or t
gcgtcgtttagatttaatttatatattatcgtttataatatcggtaattgtatcggtagttagataaagtcgtagaattttattagttgtaatattagcgttagtattaatagtttgcgtcgattttgatggcgagttatagtaggtattagtaaagtttttgcggtttgtttaagcgttattaatgttagtaaggaatcgttgtattgcgcgttggtattaattttaatatagaaagcgggtaattaggtaattaggttggcgtaatcgtcgttaattagatcgaagtaaatatttagcgtttacgcgcggngagtgaatattacgcgaatcggagtggttgttgttttgtgggaagaggcgatttcgcgggcgttttgttattattaggtaaagagcgtaataacggtaggtagcgtttattaggcgagtgtttgatattaggtttcgttatgntgaattaatttagggcgtatggcggtattagttttatcgcgtttattagagtcgcggattatagtttattatagtggcgtgcgttgttgaattcgcgtttattatcgaggtattatcgttga

SEQ ID NO: 36638 - DNA, 578 bp, Artificial Sequence
  chemically treated genomic DNA (Homo sapiens) CpG-island No: 36638
  misc_feature (123)..(123): n is either a, c, g or t
  misc_feature (266)..(266): n is either a, c, g or t
tcaacgataatacctcgataataaacgcgaattcaacaacgcacgccactataataaactataatccgcgactctaataaacgcgataaaactaataccgccatacgccctaaattaattcancataacgaaacctaatatcaaacactcgcctaataaacgctacctaccgttattacgctctttacctaataataacaaaacgcccgcgaaatcgcctcttcccacaaaacaacaaccactccgattcgcgtaatattcactcnccgcgcgtaaacgctaaatatttacttcgatctaattaacgacgattacgccaacctaattacctaattacccgctttctatattaaaattaataccaacgcgcaatacaacgattccttactaacattaataacgcttaaacaaaccgcaaaaactttactaatacctactataactcgccatcaaaatcgacgcaaactattaatactaacgctaatattacaactaataaaattctacgactttatctaactaccgatacaattaccgatattataaacgataatatataaattaaatctaaacgacgc

SEQ ID NO: 36639 - DNA, 578 bp, Artificial Sequence
  chemically treated genomic DNA (Homo sapiens) CpG-island No: 36639
  misc_feature (123)..(123): n is either a, c, g or t
  misc_feature (266)..(266): n is either a, c, g or t
ttagcggtgatgtttcggtgataaacgcgggtttagtagcgtacgttattgtgatgggttgtggttcgcggttttgatgggcgcggtggggttggtgtcgttatacgttttgggttagtttantatagcgaaatttggtattaaatattcgtttggtgggcgttgtttgtcgttgttgcgttttttgtttggtggtggtaaagcgttcgcgaggtcgtttttttttataagataataattatttcggttcgcgtggtatttatttntcgcgcgtggacgttgggtgtttatttcggtttgattaacggcggttacgttagtttgattgtttggttattcgttttttatattgagattggtgttagcgcgtagtatagcggttttttattggtattgatgacgtttgggtaagtcgtaggagttttgttgatgtttgttatggttcgttattaggatcggcgtaaattgttaatgttggcgttggtgttataattggtggggttttgcggttttatttggttgtcgatgtaattgtcggtattgtgggcgatggtgtgtgggttaggtttgggcggcgt

SEQ ID NO: 36640 - DNA, 578 bp, Artificial Sequence
  chemically treated genomic DNA (Homo sapiens) CpG-island No: 36640
  misc_feature (313)..(313): n is either a, c, g or t
  misc_feature (456)..(456): n is either a, c, g or t
acgccgcccaaacctaacccacacaccatcgcccacaataccgacaattacatcgacaaccaaataaaaccgcaaaaccccaccaattataacaccaacgccaacattaacaatttacgccgatcctaataacgaaccataacaaacatcaacaaaactcctacgacttacccaaacgtcatcaataccaataaaaaaccgctatactacgcgctaacaccaatctcaatataaaaaacgaataaccaaacaatcaaactaacgtaaccgccgttaatcaaaccgaaataaacacccaacgtccacgcgcganaaataaataccacgcgaaccgaaataattattatcttataaaaaaaaacgacctcgcgaacgctttaccaccaccaaacaaaaaacgcaacaacgacaaacaacgcccaccaaacgaatatttaataccaaatttcgctatantaaactaacccaaaacgtataacgacaccaaccccaccgcgcccatcaaaaccgcgaaccacaacccatcacaataacgtacgctactaaacccgcgtttatcaccgaaacatcaccgctaa

SEQ ID NO: 36641 - DNA, 940 bp, Artificial Sequence
  chemically treated genomic DNA (Homo sapiens) CpG-island No: 36641
aggagcgagttgcggtagttgttgtgtattatggtttcggaggtttttgtttcgcggttcgttaggttttggtcgggtttttagcgaagtaggtcgtttttttgcgttttttagcgggcgtgttgtgtcgtttaataggttttgtttttaagtgttaaaaatttttagtaaagtttgcgtttcgttcgtcgtttatattttagcggttttgacgttgtttttttcgcgattttcgtttttggaaaaagtgataggtaaggttacgttttcgcgagggtcggtttggagttcgtagtttttagggtttgggacggtgaggggcgtgaatgcggcggggggcggggtcgttgtcgggggagggggtcggggcgtatgcgcgttgcgtagcggggttgaatgttttttaagtgtttgaaattggtatttgggttttttacgttggataagtgcggttcggcggttagcggagcgcgttttttttcgttgttcgtttcgttttttttttttatttagtttagtgggcgagtgggtagcggcggtcgcggcgttgggttttttttcgtcggtgtgtgcgcgttcgtacgcgcggttttcggcgttagtttcgtcgtttgagagggggtttgcgtcgtcggtcggggcgtgcgttcgggagttatcgttatcgcggttcgcgtttttaggcgttggggttttcgcggattcggaggcggcggacgggttcggtagatgtagtcgtcgggtcgaagtaggagtcggcgggggggcgtcgggagagcgagggttttgtattttgtagtgttattttttgaggggggcggggggtggaggaagcggaaagtcgcgtcgagtcgtcggggattttcggggtgaattatgttgagttttgttaacggggagttagttttatttggtgaattatgtggaggattatttggat

SEQ ID NO: 36642 - DNA, 940 bp, Artificial Sequence
  chemically treated genomic DNA (Homo sapiens) CpG-island No: 36642
atccaaataatcctccacataattcaccaaataaaactaactccccgttaacaaaactcaacataattcaccccgaaaatccccgacgactcgacgcgactttccgcttcctccaccccccgcccccctcaaaaaataacactacaaaatacaaaaccctcgctctcccgacgcccccccgccgactcctacttcgacccgacgactacatctaccgaacccgtccgccgcctccgaatccgcgaaaaccccaacgcctaaaaacgcgaaccgcgataacgataactcccgaacgcacgccccgaccgacgacgcaaaccccctctcaaacgacgaaactaacgccgaaaaccgcgcgtacgaacgcgcacacaccgacgaaaaaaaacccaacgccgcgaccgccgctacccactcgcccactaaactaaataaaaaaaaaaaacgaaacgaacaacgaaaaaaaacgcgctccgctaaccgccgaaccgcacttatccaacgtaaaaaacccaaataccaatttcaaacacttaaaaaacattcaaccccgctacgcaacgcgcatacgccccgaccccctcccccgacaacgaccccgccccccgccgcattcacgcccctcaccgtcccaaaccctaaaaactacgaactccaaaccgaccctcgcgaaaacgtaaccttacctatcactttttccaaaaacgaaaatcgcgaaaaaaacaacgtcaaaaccgctaaaatataaacgacgaacgaaacgcaaactttactaaaaatttttaacacttaaaaacaaaacctattaaacgacacaacacgcccgctaaaaaacgcaaaaaaacgacctacttcgctaaaaacccgaccaaaacctaacgaaccgcgaaacaaaaacctccgaaaccataatacacaacaactaccgcaactcgctcct

SEQ ID NO: 36643 - DNA, 940 bp, Artificial Sequence
  chemically treated genomic DNA (Homo sapiens) CpG-island No: 36643
gtttaggtagttttttatatagtttattaggtggagttggtttttcgttggtaggatttaatatggtttatttcggaggttttcggcgattcggcgcggtttttcgttttttttatttttcgttttttttaaaaaatagtattgtaaaatgtaaagttttcgttttttcggcgttttttcgtcggtttttgtttcggttcggcggttatatttgtcgagttcgttcgtcgttttcgggttcgcggggattttagcgtttgagggcgcgggtcgcggtggcggtggttttcgggcgtacgtttcggtcggcggcgtaggtttttttttaggcggcggggttggcgtcgggggtcgcgcgtacgagcgcgtatatatcggcgggagagggtttagcgtcgcggtcgtcgttgtttattcgtttattgggttgggtagaagagaggagcggagcgggtagcgggaaggggcgcgtttcgttggtcgtcgagtcgtatttgtttaacgtggaaaatttaaatattagttttaaatatttgggaaatatttagtttcgttgcgtagcgcgtatgcgtttcggttttttttttcggtaacggtttcgtttttcgtcgtatttacgttttttatcgttttaggttttgggggttgcgggttttaggtcggttttcgcgggggcgtggttttgtttgttattttttttagaggcgagggtcgcggaggggatagcgttagggtcgttggggtgtggacggcgggcgaggcgtaaattttattaggagtttttggtatttggaggtagagtttgttgggcggtatagtacgttcgttgggaaacgtaggggagcggtttgtttcgttgaaaattcgattaggatttaacgggtcgcgggatagaaattttcgagattatggtatatagtaattatcgtaattcgttttt

SEQ ID NO: 36644 - DNA, 940 bp, Artificial Sequence
  chemically treated genomic DNA (Homo sapiens) CpG-island No: 36644
aaaaacgaattacgataattactatataccataatctcgaaaatttctatcccgcgacccgttaaatcctaatcgaattttcaacgaaacaaaccgctcccctacgtttcccaacgaacgtactataccgcccaacaaactctacctccaaataccaaaaactcctaataaaatttacgcctcgcccgccgtccacaccccaacgaccctaacgctatcccctccgcgaccctcgcctctaaaaaaaataacaaacaaaaccacgcccccgcgaaaaccgacctaaaacccgcaacccccaaaacctaaaacgataaaaaacgtaaatacgacgaaaaacgaaaccgttaccgaaaaaaaaaaccgaaacgcatacgcgctacgcaacgaaactaaatatttcccaaatatttaaaactaatatttaaattttccacgttaaacaaatacgactcgacgaccaacgaaacgcgccccttcccgctacccgctccgctcctctcttctacccaacccaataaacgaataaacaacgacgaccgcgacgctaaaccctctcccgccgatatatacgcgctcgtacgcgcgacccccgacgccaaccccgccgcctaaaaaaaaacctacgccgccgaccgaaacgtacgcccgaaaaccaccgccaccgcgacccgcgccctcaaacgctaaaatccccgcgaacccgaaaacgacgaacgaactcgacaaatataaccgccgaaccgaaacaaaaaccgacgaaaaaacgccgaaaaaacgaaaactttacattttacaatactattttttaaaaaaaacgaaaaataaaaaaaacgaaaaaccgcgccgaatcgccgaaaacctccgaaataaaccatattaaatcctaccaacgaaaaaccaactccacctaataaactatataaaaaactacctaaac

SEQ ID NO: 36645 - DNA, 967 bp, Artificial Sequence
  chemically treated genomic DNA (Homo sapiens) CpG-island No: 36645
agatcgacgcgaaatattaaggtacggtcgggtgatggatgggcgggggcggtcgtttttttttcggcgggttcgggcgcgtcgcggagtcgggtcggttttgtcgtggatcggaggaagcggtcggtttcgtagcggcggttttcggtaggggtaggaataaaaggtttggagcgtttttgattcgttaaggtttttgtgtgtaaagttcgggatacggaggaggaaggaggcgcgagaggtttcgttgtaaggttgcgcgattaaagcgttttttgtagtgaagtgatgaggcgggtgttgcgggggagggggcggcgggtttaagtcgcgttttttaggagggggtgtagattacggcgcgagatggagggatgtgtcggcgtttggggttatagggcgtcgagacggggttgtaggaggagggcggttgtgggtcggggttttcgcggattcggtgtttcggtttcgggtaacgtcgtttttttggttttttttcgtcgttttttatttagtttcgaatttgagtgttatataaagtatcgggtagtatttcgttcggggtaggtcggtcgttttcgtttagtttttttcggtttttatttggagttggatatcgagtaggggtcgattgcgaggggcgacgtcgtcggttgtagtttgcggaggacgagggtttttttttgtgtgtcgtagggaagggaagggaaggggaggagcggaggcggggaaggcgtttatttgcgttgcgttcgggggggcgcgggtagatcgttggtttggagaggattgtggtaggtgagaggatttgtgcgtcgttttttgtagatttggtcgtttcgggtgttagagagaggtggcgagttcgtgttcgtcgggaattgttggttgttggggaaatttttttgcgaggttagttaaggttttgggggttttgttttgaatgtggattattattcggagttta

SEQ ID NO: 36646 - DNA, 967 bp, Artificial Sequence
  chemically treated genomic DNA (Homo sapiens) CpG-island No: 36646
taaactccgaataataatccacattcaaaacaaaacccccaaaaccttaactaacctcgcaaaaaaatttccccaacaaccaacaattcccgacgaacacgaactcgccacctctctctaacacccgaaacgaccaaatctacaaaaaacgacgcacaaatcctctcacctaccacaatcctctccaaaccaacgatctacccgcgcccccccgaacgcaacgcaaataaacgccttccccgcctccgctcctccccttcccttcccttccctacgacacacaaaaaaaaaccctcgtcctccgcaaactacaaccgacgacgtcgcccctcgcaatcgacccctactcgatatccaactccaaataaaaaccgaaaaaaactaaacgaaaacgaccgacctaccccgaacgaaatactacccgatactttatataacactcaaattcgaaactaaataaaaaacgacgaaaaaaaaccaaaaaaacgacgttacccgaaaccgaaacaccgaatccgcgaaaaccccgacccacaaccgccctcctcctacaaccccgtctcgacgccctataaccccaaacgccgacacatccctccatctcgcgccgtaatctacaccccctcctaaaaaacgcgacttaaacccgccgccccctcccccgcaacacccgcctcatcacttcactacaaaaaacgctttaatcgcgcaaccttacaacgaaacctctcgcgcctccttcctcctccgtatcccgaactttacacacaaaaaccttaacgaatcaaaaacgctccaaaccttttattcctacccctaccgaaaaccgccgctacgaaaccgaccgcttcctccgatccacgacaaaaccgacccgactccgcgacgcgcccgaacccgccgaaaaaaaaacgaccgcccccgcccatccatcacccgaccgtaccttaatatttcgcgtcgatct

SEQ ID NO: 36647 - DNA, 967 bp, Artificial Sequence
  chemically treated genomic DNA (Homo sapiens) CpG-island No: 36647
taaatttcgagtggtgatttatatttaaaatagagtttttaaagttttgattgatttcgtaggaaagtttttttaatagttaataattttcggcggatacgaattcgttatttttttttgatattcggggcggttaggtttgtagagaacgacgtataggtttttttatttgttatagttttttttaagttagcgatttgttcgcgttttttcgagcgtagcgtagatgggcgtttttttcgttttcgtttttttttttttttttttttttttacggtatatagagaaaagttttcgtttttcgtaaattataatcggcggcgtcgtttttcgtagtcggtttttattcggtgtttagttttaagtgagggtcggagggggttgggcgggggcggtcgatttatttcgagcggagtattattcggtattttatgtaatatttagattcgggattgagtggggggcgacgaagaagggttagaggaacggcgttgttcgggatcgaggtatcgggttcgcgggaatttcggtttatagtcgttttttttttgtagtttcgtttcggcgttttatagttttaggcgtcggtatatttttttatttcgcgtcgtaatttgtatttttttttagaggacgcggtttggattcgtcgttttttttttcgtagtattcgttttattattttattataaagagcgttttggtcgcgtagttttgtagcgagatttttcgcgttttttttttttttcgtgtttcgggttttgtatataaggattttggcgaattaaaggcgttttagattttttgtttttgtttttgtcgagggtcgtcgttgcggagtcggtcgtttttttcggtttacggtaggatcggttcggtttcgcggcgcgttcggattcgtcgggaaggaggcggtcgttttcgtttatttattattcggtcgtattttggtatttcgcgtcgattt

SEQ ID NO: 36648 - DNA, 967 bp, Artificial Sequence
  chemically treated genomic DNA (Homo sapiens) CpG-island No: 36648
aaatcgacgcgaaataccaaaatacgaccgaataataaataaacgaaaacgaccgcctccttcccgacgaatccgaacgcgccgcgaaaccgaaccgatcctaccgtaaaccgaaaaaaacgaccgactccgcaacgacgaccctcgacaaaaacaaaaacaaaaaatctaaaacgcctttaattcgccaaaatccttatatacaaaacccgaaacacgaaaaaaaaaaaaaacgcgaaaaatctcgctacaaaactacgcgaccaaaacgctctttataataaaataataaaacgaatactacgaaaaaaaaaacgacgaatccaaaccgcgtcctctaaaaaaaaatacaaattacgacgcgaaataaaaaaatataccgacgcctaaaactataaaacgccgaaacgaaactacaaaaaaaaaacgactataaaccgaaattcccgcgaacccgatacctcgatcccgaacaacgccgttcctctaacccttcttcgtcgccccccactcaatcccgaatctaaatattacataaaataccgaataatactccgctcgaaataaatcgaccgcccccgcccaaccccctccgaccctcacttaaaactaaacaccgaataaaaaccgactacgaaaaacgacgccgccgattataatttacgaaaaacgaaaacttttctctatataccgtaaaaaaaaaaaaaaaaaaaaaaaaacgaaaacgaaaaaaacgcccatctacgctacgctcgaaaaaacgcgaacaaatcgctaacttaaaaaaaactataacaaataaaaaaacctatacgtcgttctctacaaacctaaccgccccgaatatcaaaaaaaaataacgaattcgtatccgccgaaaattattaactattaaaaaaactttcctacgaaatcaatcaaaactttaaaaactctattttaaatataaatcaccactcgaaattta

SEQ ID NO: 36649 - DNA, 693 bp, Artificial Sequence
  chemically treated genomic DNA (Homo sapiens) CpG-island No: 36649
tttgttcgcgagtgacgtttgttttttttgtttttagagattttgaaggagttagacgagtgttacgagcgttttagtcgcgagatagacggggcgtagaagcggcggatgttgtattgtgtgtagcgcgcgttgattcgtagttaggagttgggcgacgagaagatttagatcgtgagttagatggtggagttggtggagaatcgtacgcggtaggtggatagttacgtggagttgttcgaggcgtagtaggagttgggcgatatagcgggtaatagcggtaaggttggcgcggataggtttaaaggcgaggcggtagcgtaggttgataagtttaatagtaagcgtttacggcggtagcgtaataacgagaatcgtgagaacgcgtttagtaattacgattacgacgacggcgtttcgggtatatttaaggagaagaaggttaagatttttaagaagaagaagcgttttaaggttaaggcggagcgagaggcgttttttgtcgatttttttatcgattttaacgaatttacgtattgtttgtgtaattaggttttttatggggagatgatcggttgcgataacgacgagtgttttatcgagtggttttatttttcgtgcgtggggtttaattataaatttaagggtaagtggtattgttttaagtgtcggggggagaacgagaagattatg

SEQ ID NO: 36650 - DNA, 693 bp, Artificial Sequence
  chemically treated genomic DNA (Homo sapiens) CpG-island No: 36650
cataatcttctcgttctccccccgacacttaaaacaataccacttacccttaaatttataattaaaccccacgcacgaaaaataaaaccactcgataaaacactcgtcgttatcgcaaccgatcatctccccataaaaaacctaattacacaaacaatacgtaaattcgttaaaatcgataaaaaaatcgacaaaaaacgcctctcgctccgccttaaccttaaaacgcttcttcttcttaaaaatcttaaccttcttctccttaaatatacccgaaacgccgtcgtcgtaatcgtaattactaaacgcgttctcacgattctcgttattacgctaccgccgtaaacgcttactattaaacttatcaacctacgctaccgcctcgcctttaaacctatccgcgccaaccttaccgctattacccgctatatcgcccaactcctactacgcctcgaacaactccacgtaactatccacctaccgcgtacgattctccaccaactccaccatctaactcacgatctaaatcttctcgtcgcccaactcctaactacgaatcaacgcgcgctacacacaatacaacatccgccgcttctacgccccgtctatctcgcgactaaaacgctcgtaacactcgtctaactccttcaaaatctctaaaaacaaaaaaaacaaacgtcactcgcgaacaaa

SEQ ID NO: 36651 - DNA, 693 bp, Artificial Sequence
  chemically treated genomic DNA (Homo sapiens) CpG-island No: 36651
tatggttttttcgtttttttttcggtatttgggatagtattatttgtttttgggtttatgattgagttttacgtacgagaagtggaattattcgatggggtattcgtcgttgtcgtagtcgattatttttttataggagatttggttgtatagatagtacgtgggttcgttggggtcgatggggaggtcggtaggggacgtttttcgtttcgttttggttttggagcgttttttttttttggaggttttggtttttttttttttgggtgtgttcgaggcgtcgtcgtcgtggtcgtggttgttggacgcgtttttacggttttcgttgttgcgttgtcgtcgtgagcgtttgttgttgggtttgttagtttgcgttgtcgtttcgtttttgggtttgttcgcgttagttttgtcgttgttgttcgttgtgtcgtttagtttttgttgcgtttcgaatagttttacgtggttgtttatttgtcgcgtgcggttttttattagttttattatttggtttacgatttggattttttcgtcgtttagtttttggttgcggattagcgcgcgttgtatatagtgtagtattcgtcgtttttgcgtttcgtttgtttcgcgattgaagcgttcgtagtattcgtttagtttttttaggatttttgggggtaagaaggataggcgttattcgcgagtagg

SEQ ID NO: 36652 - DNA, 693 bp, Artificial Sequence
  chemically treated genomic DNA (Homo sapiens) CpG-island No: 36652
cctactcgcgaataacgcctatccttcttacccccaaaaatcctaaaaaaactaaacgaatactacgaacgcttcaatcgcgaaacaaacgaaacgcaaaaacgacgaatactacactatatacaacgcgcgctaatccgcaaccaaaaactaaacgacgaaaaaatccaaatcgtaaaccaaataataaaactaataaaaaaccgcacgcgacaaataaacaaccacgtaaaactattcgaaacgcaacaaaaactaaacgacacaacgaacaacaacgacaaaactaacgcgaacaaacccaaaaacgaaacgacaacgcaaactaacaaacccaacaacaaacgctcacgacgacaacgcaacaacgaaaaccgtaaaaacgcgtccaacaaccacgaccacgacgacgacgcctcgaacacacccaaaaaaaaaaaaaccaaaacctccaaaaaaaaaaaacgctccaaaaccaaaacgaaacgaaaaacgtcccctaccgacctccccatcgaccccaacgaacccacgtactatctatacaaccaaatctcctataaaaaaataatcgactacgacaacgacgaataccccatcgaataattccacttctcgtacgtaaaactcaatcataaacccaaaaacaaataatactatcccaaataccgaaaaaaaaacgaaaaaaccata

SEQ ID NO: 36653 - DNA, 784 bp, Artificial Sequence
  chemically treated genomic DNA (Homo sapiens) CpG-island No: 36653
  misc_feature (323)..(323): n is either a, c, g or t
  misc_feature (348)..(348): n is either a, c, g or t
atcggaattacggacgatatcgtcgttagtaaagattttcgggttgttggtttggaaggcgttgtcgttgtttttcggggcgatgatgcggttttgtgaatttagttcgacgttgtgttttgttagttattttatgttgtgtggacggaaattaaacgttatgattatcgtatttgtcggaacgatatgttcggaatttgtaacgattttcgcgcggcgacggtttttggcgttcggttcgtttatttcggtacgtattatttttacgtcgttgattttgtcgttatcgtttattttaatatttagcggttggacgttgaatntgaattttacgtttttttttcgcgncgtttttattacgcggcgggaattcggtatgttttttttattacgacgataggtataggtaacgtgtttcgttttttgatatacggacgtacgtacgtagtttatcgtagtgtcgttatcgttaaggattattacgcgtttgttttttatgttgacgaacggttcgtcgcgggttttattaaagtttattaattgtttggtgttggcgatgaggaacggtagcgttgcgtatacgttatcggcgttttcgttttttagttcgtcgcgtattgattgataagtttcgacgttaaggaatacggtatcgtaattatttagtagatcgtttagttgtacgtcgcggtttatttcggtattgagtttgaatttaatatttatgtcggtgaagattttacggcgacgcgttattatttttttttttagtttgaaggtcgga

SEQ ID NO: 36654 - DNA, 784 bp, Artificial Sequence
  chemically treated genomic DNA (Homo sapiens) CpG-island No: 36654
  misc_feature (437)..(437): n is either a, c, g or t
  misc_feature (462)..(462): n is either a, c, g or t
tccgaccttcaaactaaaaaaaaaaataataacgcgtcgccgtaaaatcttcaccgacataaatattaaattcaaactcaataccgaaataaaccgcgacgtacaactaaacgatctactaaataattacgataccgtattccttaacgtcgaaacttatcaatcaatacgcgacgaactaaaaaacgaaaacgccgataacgtatacgcaacgctaccgttcctcatcgccaacaccaaacaattaataaactttaataaaacccgcgacgaaccgttcgtcaacataaaaaacaaacgcgtaataatccttaacgataacgacactacgataaactacgtacgtacgtccgtatatcaaaaaacgaaacacgttacctatacctatcgtcgtaataaaaaaaacataccgaattcccgccgcgtaataaaaacgncgcgaaaaaaaaacgtaaaattcanattcaacgtccaaccgctaaatattaaaataaacgataacgacaaaatcaacgacgtaaaaataatacgtaccgaaataaacgaaccgaacgccaaaaaccgtcgccgcgcgaaaatcgttacaaattccgaacatatcgttccgacaaatacgataatcataacgtttaatttccgtccacacaacataaaataactaacaaaacacaacgtcgaactaaattcacaaaaccgcatcatcgccccgaaaaacaacgacaacgccttccaaaccaacaacccgaaaatctttactaacgacgatatcgtccgtaattccgat

SEQ ID NO: 36655 - DNA, 784 bp, Artificial Sequence
  chemically treated genomic DNA (Homo sapiens) CpG-island No: 36655
  misc_feature (437)..(437): n is either a, c, g or t
  misc_feature (462)..(462): n is either a, c, g or t
ttcggtttttaagttggaaaaagaggtaatgacgcgtcgtcgtgaaatttttatcggtatgggtattgaatttaaatttaatatcgaagtgggtcgcgacgtatagttggacgatttgttgagtgattacgatgtcgtgttttttggcgtcgggatttattagttaatgcgcggcgggttggaaaacgaagacgtcgatggcgtgtacgtagcgttgtcgttttttatcgttaatattaaatagttaatgggttttggtgaaattcgcgacgaatcgttcgttagtatggaaggtaaacgcgtggtggtttttggcggtggcgatattgcgatggattgcgtgcgtacgttcgtatattagggagcgaagtacgttatttatgtttatcgtcgtgatgaagagaatatgtcgggttttcgtcgcgtagtgaaaacgncgcgggaagaaggcgtagagtttanatttaacgtttagtcgttgggtattgaagtgaacggtaacggtaaagttagcggcgtaaaaatggtgcgtatcgaaatgggcgaatcggacgttaaaggtcgtcgtcgcgcggagatcgttgtaggtttcgaatatatcgtttcggtagatgcggtgattatggcgtttggttttcgtttatataatatggaatggttggtaaaatatagcgtcgagttggatttataaggtcgtattatcgtttcggaaggtagcgataacgttttttagattagtaattcgaaaatttttgttggcggcgatatcgttcgtggtttcgat

SEQ ID NO: 36656 - DNA, 784 bp, Artificial Sequence
  chemically treated genomic DNA (Homo sapiens) CpG-island No: 36656
  misc_feature (323)..(323): n is either a, c, g or t
  misc_feature (348)..(348): n is either a, c, g or t
atcgaaaccacgaacgatatcgccgccaacaaaaattttcgaattactaatctaaaaaacgttatcgctaccttccgaaacgataatacgaccttataaatccaactcgacgctatattttaccaaccattccatattatataaacgaaaaccaaacgccataatcaccgcatctaccgaaacgatatattcgaaacctacaacgatctccgcgcgacgacgacctttaacgtccgattcgcccatttcgatacgcaccatttttacgccgctaactttaccgttaccgttcacttcaatacccaacgactaaacgttaaatntaaactctacgccttcttcccgcgncgttttcactacgcgacgaaaacccgacatattctcttcatcacgacgataaacataaataacgtacttcgctccctaatatacgaacgtacgcacgcaatccatcgcaatatcgccaccgccaaaaaccaccacgcgtttaccttccatactaacgaacgattcgtcgcgaatttcaccaaaacccattaactatttaatattaacgataaaaaacgacaacgctacgtacacgccatcgacgtcttcgttttccaacccgccgcgcattaactaataaatcccgacgccaaaaaacacgacatcgtaatcactcaacaaatcgtccaactatacgtcgcgacccacttcgatattaaatttaaattcaatacccataccgataaaaatttcacgacgacgcgtcattacctctttttccaacttaaaaaccgaa

SEQ ID NO: 36657 - DNA, 581 bp, Artificial Sequence
  chemically treated genomic DNA (Homo sapiens) CpG-island No: 36657
ggttatcgggtaatagcgttagttggttagaagcgataagttttcgttcgtcgttaggttaattaatagcggattattagaacgtgtcgttagtagggtattcgggtgacgggagtttatgattattgtatcgtacgtattacgtagttgcgggatagcgttaggagcggtttttcgtagaggtttcgttttgttttaggtttttaggttcgttagatgggcggtcgtttcggtgtcggttttaggaacggagggtatcggttacgcgtttttaggttttttacgtagcggtttagtggttttcgatgagtgtcgttagtgcgtttttttaagtgtgtttagaagtagtgcggatgcgtatttatttttgaaggtttatcgtgggtcgtttagcgagtgtgagtaatattagtgtcgttatgtagaggatgtttttaagaaaaaagaagttagtatttggattttatcgaggcgagcgtaggcgggttatatgattttttgtattagtaacggttagatcggtagagttatattcgcggtattattagacgacgtaaatttttaagaaggatttttgttat

SEQ ID NO: 36658 - DNA, 581 bp, Artificial Sequence
  chemically treated genomic DNA (Homo sapiens) CpG-island No: 36658
ataacaaaaatccttcttaaaaatttacgtcgtctaataataccgcgaatataactctaccgatctaaccgttactaatacaaaaaatcatataacccgcctacgctcgcctcgataaaatccaaatactaacttcttttttcttaaaaacatcctctacataacgacactaatattactcacactcgctaaacgacccacgataaaccttcaaaaataaatacgcatccgcactacttctaaacacacttaaaaaaacgcactaacgacactcatcgaaaaccactaaaccgctacgtaaaaaacctaaaaacgcgtaaccgataccctccgttcctaaaaccgacaccgaaacgaccgcccatctaacgaacctaaaaacctaaaacaaaacgaaacctctacgaaaaaccgctcctaacgctatcccgcaactacgtaatacgtacgatacaataatcataaactcccgtcacccgaataccctactaacgacacgttctaataatccgctattaattaacctaacgacgaacgaaaacttatcgcttctaaccaactaacgctattacccgataacc

SEQ ID NO: 36659 - DNA, 581 bp, Artificial Sequence
  chemically treated genomic DNA (Homo sapiens) CpG-island No: 36659
gtagtagaaattttttttgaaggtttacgtcgtttggtaatatcgcggatatgattttgtcggtttggtcgttgttgatgtagaaggttatatgattcgtttgcgttcgtttcggtaaagtttagatgttggtttttttttttttaagaatattttttgtatggcggtattggtattgtttatattcgttgggcgatttacggtgaatttttagaagtgaatgcgtattcgtattgtttttgaatatatttgagggggcgtattaacggtatttatcgaaaattattgaatcgttgcgtgaagagtttaaaagcgcgtggtcgatatttttcgtttttgaaatcgatatcgaagcgatcgtttatttggcgaatttgggagtttgaaataaggcgggatttttgcgagaggtcgtttttggcgttatttcgtagttgcgtggtgcgtacggtatagtgattatggattttcgttattcggatattttgttggcggtacgttttggtagttcgttgttgattggtttggcgacgggcgaaaatttatcgtttttgattagttggcgttgttgttcggtgatt

SEQ ID NO: 36660 - DNA, 581 bp, Artificial Sequence
  chemically treated genomic DNA (Homo sapiens) CpG-island No: 36660
aatcaccgaacaacaacgccaactaatcaaaaacgataaattttcgcccgtcgccaaaccaatcaacaacgaactaccaaaacgtaccgccaacaaaatatccgaataacgaaaatccataatcactataccgtacgcaccacgcaactacgaaataacgccaaaaacgacctctcgcaaaaatcccgccttatttcaaactcccaaattcgccaaataaacgatcgcttcgatatcgatttcaaaaacgaaaaatatcgaccacgcgcttttaaactcttcacgcaacgattcaataattttcgataaataccgttaatacgccccctcaaatatattcaaaaacaatacgaatacgcattcacttctaaaaattcaccgtaaatcgcccaacgaatataaacaataccaataccgccatacaaaaaatattcttaaaaaaaaaaaaaccaacatctaaactttaccgaaacgaacgcaaacgaatcatataaccttctacatcaacaacgaccaaaccgacaaaatcatatccgcgatattaccaaacgacgtaaaccttcaaaaaaaatttctactac

SEQ ID NO: 36661 - DNA, 566 bp, Artificial Sequence
  chemically treated genomic DNA (Homo sapiens) CpG-island No: 36661
  misc_feature (53)..(53): n is either a, c, g or t
  misc_feature (282)..(282): n is either a, c, g or t
aacggtgatgtagcggtaatagaacgcgagttgtagtatattagcgatgtttnggggttgaattacgataagtcgtaggtagtagatagtacgtcgaaatcgtagttgaaatcgtaattcgtttaaaaagaagtggcggatattgcgttgtaatgatacgttatattcggtatggtatgtcggatgtggcgtatgttgataagacgcgttagcgtcgtattaggtaatcggttcgggcgttagatgttggatgcggcgtaatcgttttatttaatttacggngtggagtattttatagcggtgtaggtttgataagacgcgttagcgtcgtattaggtaatcggtttgggcgttagatgttcgatgcggcgttatcgtttattcgaattacggggtgaagtattttatagcggggtaggttttgatagagcgttaagcgtcgaattaggtatcggtttggacgttggattgtcgatgtcgcgtatcgttttattaatttacggggggagtattttataggggggtgggtttgaaaaaatttttaaggttttttaagtaatcggttt

SEQ ID NO: 36662 - DNA, 566 bp, Artificial Sequence
  chemically treated genomic DNA (Homo sapiens) CpG-island No: 36662
  misc_feature (285)..(285): n is either a, c, g or t
  misc_feature (514)..(514): n is either a, c, g or t
aaaccgattacttaaaaaaccttaaaaattttttcaaacccacccccctataaaatactccccccgtaaattaataaaacgatacgcgacatcgacaatccaacgtccaaaccgatacctaattcgacgcttaacgctctatcaaaacctaccccgctataaaatacttcaccccgtaattcgaataaacgataacgccgcatcgaacatctaacgcccaaaccgattacctaatacgacgctaacgcgtcttatcaaacctacaccgctataaaatactccacnccgtaaattaaataaaacgattacgccgcatccaacatctaacgcccgaaccgattacctaatacgacgctaacgcgtcttatcaacatacgccacatccgacataccataccgaatataacgtatcattacaacgcaatatccgccacttctttttaaacgaattacgatttcaactacgatttcgacgtactatctactacctacgacttatcgtaattcaaccccnaaacatcgctaatatactacaactcgcgttctattaccgctacatcaccgtt

SEQ ID NO: 36663 - DNA, 566 bp, Artificial Sequence
  chemically treated genomic DNA (Homo sapiens) CpG-island No: 36663
  misc_feature (285)..(285): n is either a, c, g or t
  misc_feature (514)..(514): n is either a, c, g or t
aaatcggttgtttaaagaattttgggggtttttttaagtttatttttttgtaaagtgtttttttcgtaggttgataaggcggtacgcggtatcgataatttaacgtttaaatcggtgtttgattcgacgtttggcgttttattaaggtttatttcgttgtgaagtgttttatttcgtagttcgaataggcggtaacgtcgtatcggatatttaacgtttaagtcggttgtttgatgcgacgttggcgcgttttattaggtttatatcgttgtgaagtgttttatntcgtaggttggataaggcggttacgtcgtatttaatatttaacgttcgagtcggttgtttgatgcgacgttggcgcgttttattagtatacgttatattcggtatattatgtcggatgtggcgtattattataacgtaatattcgttatttttttttgaacgggttgcggttttaattgcggtttcggcgtattatttgttgtttgcggtttgtcgtagtttaattttngaatatcgttggtgtattgtaattcgcgttttgttgtcgttatattatcgtt

SEQ ID NO: 36664 - DNA, 566 bp, Artificial Sequence
  chemically treated genomic DNA (Homo sapiens) CpG-island No: 36664
  misc_feature (53)..(53): n is either a, c, g or t
  misc_feature (282)..(282): n is either a, c, g or t
aacgataatataacgacaacaaaacgcgaattacaatacaccaacgatattcnaaaattaaactacgacaaaccgcaaacaacaaataatacgccgaaaccgcaattaaaaccgcaacccgttcaaaaaaaaataacgaatattacgttataataatacgccacatccgacataatataccgaatataacgtatactaataaaacgcgccaacgtcgcatcaaacaaccgactcgaacgttaaatattaaatacgacgtaaccgccttatccaacctacganataaaacacttcacaacgatataaacctaataaaacgcgccaacgtcgcatcaaacaaccgacttaaacgttaaatatccgatacgacgttaccgcctattcgaactacgaaataaaacacttcacaacgaaataaaccttaataaaacgccaaacgtcgaatcaaacaccgatttaaacgttaaattatcgataccgcgtaccgccttatcaacctacgaaaaaaacactttacaaaaaaataaacttaaaaaaacccccaaaattctttaaacaaccgattt

SEQ ID NO: 36665 - DNA, 599 bp, Artificial Sequence
  chemically treated genomic DNA (Homo sapiens) CpG-island No: 36665
  misc_feature (92)..(92): n is either a, c, g or t
tttattaggtttataatgaacgatgtagattcgataaatttttagtttcgcgtttttaacgcggcgatattcgtaggcgtggtgcgatagtntttgttaattaatcgtgcgttagcggtttgttattgcggtagataattcgttagttgcgcgtaatgtttatcgtgacgatgttaggttttgtttacggtatcgtaatgttcgttcgagttcggatatattattagcggtagtatcgttaaatcgtgtaaatgttgtaacgtagcggtggtgttttttagcgtaatatagttaatgtttagcgttattatttgcggataattcgttagtaacgtaattacgttacgtagcggcgtatcgtcgtttaggtgttcgttgtcgcgtagggtaaatgagaattacgttcgcgtacgcggatatgcggttaatagttcggttaacgttttaatttcggaaaaattcggtagggtttcgtaggttagtagatcgggttcggtatttagtaagggttttacgcgcgggcgatgaaacgtttgaaatgttttaacgttataatgataaatcgttaacggattttagagtttttcgttagatacgcg

SEQ ID NO: 36666 - DNA, 599 bp, Artificial Sequence
  chemically treated genomic DNA (Homo sapiens) CpG-island No: 36666
  misc_feature (508)..(508): n is either a, c, g or t
cgcgtatctaacgaaaaactctaaaatccgttaacgatttatcattataacgttaaaacatttcaaacgtttcatcgcccgcgcgtaaaacccttactaaataccgaacccgatctactaacctacgaaaccctaccgaatttttccgaaattaaaacgttaaccgaactattaaccgcatatccgcgtacgcgaacgtaattctcatttaccctacgcgacaacgaacacctaaacgacgatacgccgctacgtaacgtaattacgttactaacgaattatccgcaaataataacgctaaacattaactatattacgctaaaaaacaccaccgctacgttacaacatttacacgatttaacgatactaccgctaataatatatccgaactcgaacgaacattacgataccgtaaacaaaacctaacatcgtcacgataaacattacgcgcaactaacgaattatctaccgcaataacaaaccgctaacgcacgattaattaacaaanactatcgcaccacgcctacgaatatcgccgcgttaaaaacgcgaaactaaaaatttatcgaatctacatcgttcattataaacctaataaa

SEQ ID NO: 36667 - DNA, 599 bp, Artificial Sequence
  chemically treated genomic DNA (Homo sapiens) CpG-island No: 36667
  misc_feature (508)..(508): n is either a, c, g or t
cgcgtatttggcggagggttttgaaattcgttggcgatttattattgtagcgttagggtattttaggcgttttatcgttcgcgcgtggagtttttgttggatgtcgggttcgatttgttggtttgcgaaattttgtcgaattttttcgagattgaggcgttggtcgagttgttgatcgtatattcgcgtgcgcgggcgtggtttttatttattttgcgcgatagcgaatatttgagcgacggtacgtcgttgcgtgacgtggttgcgttgttggcgggttattcgtaggtggtggcgttaggtattaattgtattgcgttggaaaatattatcgttgcgttgtagtatttatacggtttaacggtgttgtcgttggtggtgtattcgaattcgggcgagtattacgatgtcgtgagtaaaatttggtatcgttacggtgaatattgcgcgtagttggcggattatttgtcgtagtggtaggtcgttggcgtacggttgattggtaggngttgtcgtattacgtttgcggatatcgtcgcgttaaaagcgcgaagttgagggtttatcgggtttatatcgtttattgtaggtttgataag

SEQ ID NO: 36668 - DNA, 599 bp, Artificial Sequence
  chemically treated genomic DNA (Homo sapiens) CpG-island No: 36668
  misc_feature (92)..(92): n is either a, c, g or t
cttatcaaacctacaataaacgatataaacccgataaaccctcaacttcgcgcttttaacgcgacgatatccgcaaacgtaatacgacaacncctaccaatcaaccgtacgccaacgacctaccactacgacaaataatccgccaactacgcgcaatattcaccgtaacgataccaaattttactcacgacatcgtaatactcgcccgaattcgaatacaccaccaacgacaacaccgttaaaccgtataaatactacaacgcaacgataatattttccaacgcaatacaattaatacctaacgccaccacctacgaataacccgccaacaacgcaaccacgtcacgcaacgacgtaccgtcgctcaaatattcgctatcgcgcaaaataaataaaaaccacgcccgcgcacgcgaatatacgatcaacaactcgaccaacgcctcaatctcgaaaaaattcgacaaaatttcgcaaaccaacaaatcgaacccgacatccaacaaaaactccacgcgcgaacgataaaacgcctaaaataccctaacgctacaataataaatcgccaacgaatttcaaaaccctccgccaaatacgcg

SEQ ID NO: 36669 - DNA, 958 bp, Artificial Sequence
  chemically treated genomic DNA (Homo sapiens) CpG-island No: 36669
ggtagcgggattcggcgaagacgcgatcgcggcgcgagttattatggtgagttggtcgcgtcgcgttttaggacgtcggattcggggacggggtaggaaatttcggcgtggtgtatttattttgggcgcgttgtcggggttaggggtggagaaggtggacgcgggagtcggtacgtcgcgagttttgattttttgtcgtttttcgtaaattcgggtcgggggagagcgagcgaggggttaaggaaaattttattttaagtcggtttttgcgtcgcgaaattttttgtggtcgggttgttatggttgttagttgtcggaagttagggtgtgggcgtatcggttgcgaggggtacggcgcgggagggggttttttttttttgttgggacgtggggggcgtagtcggtaggggaggtgttcggagattcgcgtcgtagtcgttggcggcgttttttgtttttttcgcggtcgtgttcgtttcgtttcgggtattttcgcgtcgattttttttttttttcgtcgtcgtttcgttgttcggtagcgttcgtagttgtttcgtttggtagcggtacgcgggcgggggcggtttttggttcgttttggcgaggggcggcgcgggtcgtataaaggtaggcgggggcgttaggtagggcgagtatttggcggtcggcgggttgttaagagttagggagattcgggcgcgggcggtaattacgtcgtttcggatttgtgtcgggcgtcggtttcgagggttttcgcgtttcggacgttaagtaaatattttttgaagaggattttatttttttttaagcgcgaggggatcggggtttttcggggatttaggggacgtttcgtacgggaagacgttttcgcgagtttcgagtttgttgttgttttttttttggtattttgggaatgtgtggaaggggtcgtttttttgatttgtgatttttttgttat

SEQ ID NO: 36670 - DNA, 958 bp, Artificial Sequence
  chemically treated genomic DNA (Homo sapiens) CpG-island No: 36670
ataacaaaaaaatcacaaatcaaaaaaacgaccccttccacacattcccaaaataccaaaaaaaaaacaacaacaaactcgaaactcgcgaaaacgtcttcccgtacgaaacgtcccctaaatccccgaaaaaccccgatcccctcgcgcttaaaaaaaaataaaatcctcttcaaaaaatatttacttaacgtccgaaacgcgaaaaccctcgaaaccgacgcccgacacaaatccgaaacgacgtaattaccgcccgcgcccgaatctccctaactcttaacaacccgccgaccgccaaatactcgccctacctaacgcccccgcctacctttatacgacccgcgccgcccctcgccaaaacgaaccaaaaaccgcccccgcccgcgtaccgctaccaaacgaaacaactacgaacgctaccgaacaacgaaacgacgacgaaaaaaaaaaaaaatcgacgcgaaaatacccgaaacgaaacgaacacgaccgcgaaaaaaacaaaaaacgccgccaacgactacgacgcgaatctccgaacacctcccctaccgactacgccccccacgtcccaacaaaaaaaaaaaaccccctcccgcgccgtacccctcgcaaccgatacgcccacaccctaacttccgacaactaacaaccataacaacccgaccacaaaaaatttcgcgacgcaaaaaccgacttaaaataaaattttccttaacccctcgctcgctctcccccgacccgaatttacgaaaaacgacaaaaaatcaaaactcgcgacgtaccgactcccgcgtccaccttctccacccctaaccccgacaacgcgcccaaaataaatacaccacgccgaaatttcctaccccgtccccgaatccgacgtcctaaaacgcgacgcgaccaactcaccataataactcgcgccgcgatcgcgtcttcgccgaatcccgctacc

SEQ ID NO: 36671 - DNA, 958 bp, Artificial Sequence
  chemically treated genomic DNA (Homo sapiens) CpG-island No: 36671
atagtagaaaagttataagttaaagaggcggttttttttatatatttttaaagtgttaaagggaaaatagtaataaattcgaaattcgcgagggcgttttttcgtgcgaagcgttttttggattttcgaaaagtttcgattttttcgcgtttgggaaggggtggggttttttttaggaggtgtttatttggcgttcggggcgcggagattttcggggtcggcgttcggtataggttcggggcggcgtggttgtcgttcgcgttcgagtttttttggtttttgatagttcgtcggtcgttaggtgttcgttttatttggcgttttcgtttgtttttgtgcggttcgcgtcgtttttcgttaaggcgggttagggatcgttttcgttcgcgtgtcgttgttaggcgggatagttgcgggcgttgtcgggtagcggagcggcggcggggaggagagggagtcggcgcgagggtgttcggggcggggcgggtacggtcgcggggagggtaggggacgtcgttagcggttgcggcgcgagttttcgagtattttttttgtcggttgcgttttttacgttttagtaggaggaggggattttttttcgcgtcgtgtttttcgtagtcgatgcgtttatattttggttttcgatagttggtagttatagtaattcggttatagaaagtttcgcgacgtagaaatcgatttggaataaagttttttttggtttttcgttcgttttttttcggttcgggtttacggaaagcggtaggaaattagagttcgcgacgtgtcggttttcgcgtttattttttttatttttggtttcggtagcgcgtttaaggtgggtgtattacgtcggggttttttgtttcgttttcgggttcggcgttttaggacgcggcgcggttaatttattatggtgattcgcgtcgcggtcgcgttttcgtcgggtttcgttgtt

SEQ ID NO: 36672 - DNA, 958 bp, Artificial Sequence
  chemically treated genomic DNA (Homo sapiens) CpG-island No: 36672
aacaacgaaacccgacgaaaacgcgaccgcgacgcgaatcaccataataaattaaccgcgccgcgtcctaaaacgccgaacccgaaaacgaaacaaaaaaccccgacgtaatacacccaccttaaacgcgctaccgaaaccaaaaataaaaaaaataaacgcgaaaaccgacacgtcgcgaactctaatttcctaccgctttccgtaaacccgaaccgaaaaaaaacgaacgaaaaaccaaaaaaaactttattccaaatcgatttctacgtcgcgaaactttctataaccgaattactataactaccaactatcgaaaaccaaaatataaacgcatcgactacgaaaaacacgacgcgaaaaaaaatcccctcctcctactaaaacgtaaaaaacgcaaccgacaaaaaaaatactcgaaaactcgcgccgcaaccgctaacgacgtcccctaccctccccgcgaccgtacccgccccgccccgaacaccctcgcgccgactccctctcctccccgccgccgctccgctacccgacaacgcccgcaactatcccgcctaacaacgacacgcgaacgaaaacgatccctaacccgccttaacgaaaaacgacgcgaaccgcacaaaaacaaacgaaaacgccaaataaaacgaacacctaacgaccgacgaactatcaaaaaccaaaaaaactcgaacgcgaacgacaaccacgccgccccgaacctataccgaacgccgaccccgaaaatctccgcgccccgaacgccaaataaacacctcctaaaaaaaaccccaccccttcccaaacgcgaaaaaatcgaaacttttcgaaaatccaaaaaacgcttcgcacgaaaaaacgccctcgcgaatttcgaatttattactattttccctttaacactttaaaaatatataaaaaaaaccgcctctttaacttataacttttctactat

SEQ ID NO: 36673 - DNA, 1263 bp, Artificial Sequence
  chemically treated genomic DNA (Homo sapiens) CpG-island No: 36673
tttcgaggtgagaagtagttgaggattcgcgttagaagttttaggttcgaaatggagttgttttcgaggtggggtcgtagggattggtttggttgttgttgcgtcgtacgcggagagacgttcgggattttggttcgcgtcgagttcgacgagggtcggagttgcggacgagacgggacggagtggtgtttttgcgggcggtgttttttcgggtcggtagtgttcgggcgcggcgttcgttgatttcgtttaagcggagtttagttgttttcggggttcggcggcggcgagggcggttcggcgggggtttcggcgaagagatattgcgggtgcgtttttttcgtagcggattgggagcgattgggaggtgcgggcgttagttagtattatttttttacgaggggtggggaggtgggatgggaggtggagaggacgggggagggggcgacgggcggagtaatagtttcggagtttcgggggggagggttttggagttcgggggggtcgttgttcgtattttttatttttcgcggcgagagtggatgcgtggtttcggcgaaagtcgagtcgagttttcggcgcgttcgcgtagggggcggggttcgggttagggatcggtttttgcggtgcggttttttttttttcgtttttttttttttcgtaaacggagcggggtcggtcgggatttgtcggttcggagagttgtcgcgttcgtttcgtaagttttaagtttttcgtcgtcggttgcgggtttatcgcggtcggcgcggaacgattaggcggaggacggaattcggcgtagcgttgtcgcggttttgtttcgacgtaggtaggtttttttcggggagtaaggtatttagagatttagcgtcggggtttagaagtagtcggtttagaggggttcgtttgagagtcgcggcgttcgagaggcgtttcgggggggttcgcgggagttcggtttagggcgcgttatgtacgtttcgggttttgcgtcgtttcggtcgttcgcgtcgttttttttttttcgttcgttcgtcgtcgtcggagagtttttcgtatttttttttttcgttgttttttcgtttttcgcgtcgttcgggtttcggtttatagtcgcgcgaggtcgttttcgttttcggtttggttatggttttagtttcggcgtttcgcgggtatttttaggtttggtcgcgggtattttagttttttttttttatttaaaattttcgttgcgtttttttttttttgggattaggagtcgta

SEQ ID NO: 36674 - DNA, 1263 bp, Artificial Sequence
  chemically treated genomic DNA (Homo sapiens) CpG-island No: 36674
tacgactcctaatcccaaaaaaaaaaaaacgcaacgaaaattttaaataaaaaaaaaaaactaaaatacccgcgaccaaacctaaaaatacccgcgaaacgccgaaactaaaaccataaccaaaccgaaaacgaaaacgacctcgcgcgactataaaccgaaacccgaacgacgcgaaaaacgaaaaaacaacgaaaaaaaaaaatacgaaaaactctccgacgacgacgaacgaacgaaaaaaaaaaaacgacgcgaacgaccgaaacgacgcaaaacccgaaacgtacataacgcgccctaaaccgaactcccgcgaacccccccgaaacgcctctcgaacgccgcgactctcaaacgaacccctctaaaccgactacttctaaaccccgacgctaaatctctaaataccttactccccgaaaaaaacctacctacgtcgaaacaaaaccgcgacaacgctacgccgaattccgtcctccgcctaatcgttccgcgccgaccgcgataaacccgcaaccgacgacgaaaaacttaaaacttacgaaacgaacgcgacaactctccgaaccgacaaatcccgaccgaccccgctccgtttacgaaaaaaaaaaaaacgaaaaaaaaaaaaccgcaccgcaaaaaccgatccctaacccgaaccccgccccctacgcgaacgcgccgaaaactcgactcgactttcgccgaaaccacgcatccactctcgccgcgaaaaataaaaaatacgaacaacgacccccccgaactccaaaaccctcccccccgaaactccgaaactattactccgcccgtcgccccctcccccgtcctctccacctcccatcccacctccccacccctcgtaaaaaaataatactaactaacgcccgcacctcccaatcgctcccaatccgctacgaaaaaaacgcacccgcaatatctcttcgccgaaacccccgccgaaccgccctcgccgccgccgaaccccgaaaacaactaaactccgcttaaacgaaatcaacgaacgccgcgcccgaacactaccgacccgaaaaaacaccgcccgcaaaaacaccactccgtcccgtctcgtccgcaactccgaccctcgtcgaactcgacgcgaaccaaaatcccgaacgtctctccgcgtacgacgcaacaacaaccaaaccaatccctacgaccccacctcgaaaacaactccatttcgaacctaaaacttctaacgcgaatcctcaactacttctcacctcgaaa

SEQ ID NO: 36675 - DNA, 1263 bp, Artificial Sequence
  chemically treated genomic DNA (Homo sapiens) CpG-island No: 36675
tgcggtttttagttttagggagggaggggcgtagcgagaattttaggtgaggaaggggaattggggtgttcgcggttaggtttgaggatgttcgcggggcgtcgaggttggggttatggttaggtcgggggcggaggcggtttcgcgcggttgtgagtcgaggttcgggcggcgcggggggcggggaggtagcgggaggaggggatgcggagggtttttcggcggcggcgagcgggcgagaagggaggagcggcgcgagcggtcggagcggcgtagggttcgaagcgtgtatggcgcgttttgagtcgggttttcgcgggttttttcggagcgtttttcgggcgtcgcggtttttaggcgggtttttttgggtcggttgtttttgagtttcggcgttggatttttggatgttttatttttcgggagaagtttgtttgcgtcggggtagaatcgcggtagcgttgcgtcggatttcgtttttcgtttagtcgtttcgcgtcggtcgcggtgggttcgtagtcggcgacgaggagtttggggtttgcgaagcgggcgcgatagtttttcgggtcggtaggtttcggtcggtttcgtttcgtttgcgggaaagggagaggcgagaggggaagggtcgtatcgtaggagtcggtttttgattcggatttcgttttttgcgcggacgcgtcgaaggttcggttcggttttcgtcggggttacgtatttattttcgtcgcgagaggtgggggatgcgggtaacggttttttcgggttttaggattttttttttcggggtttcggagttgttgtttcgttcgtcgttttttttttcgttttttttattttttattttatttttttatttttcgtaagaaaataatgttggttggcgttcgtattttttagtcgtttttagttcgttgcgaggaaagcgtattcgtagtgttttttcgtcgggattttcgtcgagtcgttttcgtcgtcgtcgagtttcgagagtagttgggtttcgtttaggcggaattagcgagcgtcgcgttcgggtattgtcggttcgaggaggtatcgttcgtaaggatattatttcgtttcgtttcgttcgtaatttcggttttcgtcgagttcgacgcgagttaggatttcggacgttttttcgcgtgcggcgtagtagtagttagattagtttttgcgattttatttcggaggtaattttatttcggatttgggatttttgacgcggatttttagttattttttatttcgggg

SEQ ID NO: 36676 - DNA, 1263 bp, Artificial Sequence
  chemically treated genomic DNA (Homo sapiens) CpG-island No: 36676
ccccgaaataaaaaataactaaaaatccgcgtcaaaaatcccaaatccgaaataaaattacctccgaaataaaatcgcaaaaactaatctaactactactacgccgcacgcgaaaaaacgtccgaaatcctaactcgcgtcgaactcgacgaaaaccgaaattacgaacgaaacgaaacgaaataatatccttacgaacgatacctcctcgaaccgacaatacccgaacgcgacgctcgctaattccgcctaaacgaaacccaactactctcgaaactcgacgacgacgaaaacgactcgacgaaaatcccgacgaaaaaacactacgaatacgctttcctcgcaacgaactaaaaacgactaaaaaatacgaacgccaaccaacattattttcttacgaaaaataaaaaaataaaataaaaaataaaaaaaacgaaaaaaaaaacgacgaacgaaacaacaactccgaaaccccgaaaaaaaaaatcctaaaacccgaaaaaaccgttacccgcatcccccacctctcgcgacgaaaataaatacgtaaccccgacgaaaaccgaaccgaaccttcgacgcgtccgcgcaaaaaacgaaatccgaatcaaaaaccgactcctacgatacgacccttcccctctcgcctctccctttcccgcaaacgaaacgaaaccgaccgaaacctaccgacccgaaaaactatcgcgcccgcttcgcaaaccccaaactcctcgtcgccgactacgaacccaccgcgaccgacgcgaaacgactaaacgaaaaacgaaatccgacgcaacgctaccgcgattctaccccgacgcaaacaaacttctcccgaaaaataaaacatccaaaaatccaacgccgaaactcaaaaacaaccgacccaaaaaaacccgcctaaaaaccgcgacgcccgaaaaacgctccgaaaaaacccgcgaaaacccgactcaaaacgcgccatacacgcttcgaaccctacgccgctccgaccgctcgcgccgctcctcccttctcgcccgctcgccgccgccgaaaaaccctccgcatcccctcctcccgctacctccccgccccccgcgccgcccgaacctcgactcacaaccgcgcgaaaccgcctccgcccccgacctaaccataaccccaacctcgacgccccgcgaacatcctcaaacctaaccgcgaacaccccaattccccttcctcacctaaaattctcgctacgcccctccctccctaaaactaaaaaccgca

SEQ ID NO: 36677 - DNA, 513 bp, Artificial Sequence
  chemically treated genomic DNA (Homo sapiens) CpG-island No: 36677
  misc_feature (345)..(345): n is either a, c, g or t
  misc_feature (412)..(412): n is either a, c, g or t
  misc_feature (453)..(453): n is either a, c, g or t
  misc_feature (491)..(491): n is either a, c, g or t
tcgggggttggttcgttcgtttatgggttttttttatttcgttttagtcgtacggcgaggagttgcgtttcgtggagaacggttgttacgataattttacgttggacgtggttagcgatagttagtcggagatgtaggagaagtattttagtttgaacggcggcggggtttttaacggttcggggagttggggggcgtttatggggggtaagcgggatttcgaggattcggacgtgttcgaggaggatacgtatttgtgagcgtaatcgaagcgtagggtcgagtggggtcgttagggatttaagcgaggtgggattttcggaaatcggacgggttttcggaggnttcggtaattaagtttttcgtcggttttaatttcgggttttcggttttttcgtcggggtttcggggntatttttcggtcggttcggggttttttttttttttttcggntttttttttttttcgggaattttttaattaattcgggnggggggtttttttgggggaatt

SEQ ID NO: 36678 - DNA, 513 bp, Artificial Sequence
  chemically treated genomic DNA (Homo sapiens) CpG-island No: 36678
  misc_feature (23)..(23): n is either a, c, g or t
  misc_feature (61)..(61): n is either a, c, g or t
  misc_feature (102)..(102): n is either a, c, g or t
  misc_feature (169)..(169): n is either a, c, g or t
aattcccccaaaaaaaccccccncccgaattaattaaaaaattcccgaaaaaaaaaaaaanccgaaaaaaaaaaaaaaaaccccgaaccgaccgaaaaatanccccgaaaccccgacgaaaaaaccgaaaacccgaaattaaaaccgacgaaaaacttaattaccgaancctccgaaaacccgtccgatttccgaaaatcccacctcgcttaaatccctaacgaccccactcgaccctacgcttcgattacgctcacaaatacgtatcctcctcgaacacgtccgaatcctcgaaatcccgcttaccccccataaacgccccccaactccccgaaccgttaaaaaccccgccgccgttcaaactaaaatacttctcctacatctccgactaactatcgctaaccacgtccaacgtaaaattatcgtaacaaccgttctccacgaaacgcaactcctcgccgtacgactaaaacgaaataaaaaaaacccataaacgaacgaaccaacccccga

SEQ ID NO: 36679 - DNA, 513 bp, Artificial Sequence
  chemically treated genomic DNA (Homo sapiens) CpG-island No: 36679
  misc_feature (23)..(23): n is either a, c, g or t
  misc_feature (61)..(61): n is either a, c, g or t
  misc_feature (102)..(102): n is either a, c, g or t
  misc_feature (169)..(169): n is either a, c, g or t
ggtttttttaaaaaagttttttnttcgggttggttaaaaagttttcgggggggggaaaaantcggggaaaaagggaaaggtttcgggtcggtcggaaggtgntttcggggtttcggcgggggggtcggggattcggggttagggtcggcggggggtttggttatcgggnttttcggggattcgttcggttttcgggggttttatttcgtttgggtttttggcggttttattcggttttgcgtttcggttgcgtttataggtgcgtgtttttttcgaatacgttcgagttttcggggtttcgtttgttttttatgagcgttttttagtttttcgggtcgttgagggtttcgtcgtcgtttaggttggggtgttttttttgtattttcgattggttgtcgttggttacgtttagcgtggggttgtcgtggtagtcgttttttacgaagcgtagtttttcgtcgtgcgattgaggcggggtggggagagtttatgggcgagcgagttagttttcgg

SEQ ID NO: 36680 - DNA, 513 bp, Artificial Sequence
  chemically treated genomic DNA (Homo sapiens) CpG-island No: 36680
  misc_feature (345)..(345): n is either a, c, g or t
  misc_feature (412)..(412): n is either a, c, g or t
  misc_feature (453)..(453): n is either a, c, g or t
  misc_feature (491)..(491): n is either a, c, g or t
ccgaaaactaactcgctcgcccataaactctccccaccccgcctcaatcgcacgacgaaaaactacgcttcgtaaaaaacgactaccacgacaaccccacgctaaacgtaaccaacgacaaccaatcgaaaatacaaaaaaaacaccccaacctaaacgacgacgaaaccctcaacgacccgaaaaactaaaaaacgctcataaaaaacaaacgaaaccccgaaaactcgaacgtattcgaaaaaaacacgcacctataaacgcaaccgaaacgcaaaaccgaataaaaccgccaaaaacccaaacgaaataaaacccccgaaaaccgaacgaatccccgaaaancccgataaccaaaccccccgccgaccctaaccccgaatccccgacccccccgccgaaaccccgaaancaccttccgaccgacccgaaacctttccctttttccccgantttttcccccccccgaaaactttttaaccaacccgaanaaaaaacttttttaaaaaaacc

SEQ ID NO: 36681 - DNA, 1187 bp, Artificial Sequence
  chemically treated genomic DNA (Homo sapiens) CpG-island No: 36681
  misc_feature (263)..(263): n is either a, c, g or t
  misc_feature (440)..(440): n is either a, c, g or t
  misc_feature (567)..(567): n is either a, c, g or t
  misc_feature (1099)..(1099): n is either a, c, g or t
acgggtgatcgcgcggggagagagcggtattcgggcgcgaggtgcgaggtttaggtttgcgggcggtcgggttaagttttcgagtttcggcggtgttgattggtcggtttggcgggggggacgggcggagggacggtcgttcgcgcgttcgtttcgttttcgcgggggcgcgttcgcggtacgcggtcgggcggggtcgggcgtgagtgacggttatgcggattaatggggcgggtcgggttcgtcgtcgtcgttcgcgcggnttttgacgcgggttcgggcgtcgcgtcgttgcggttgtaggcggcgacggttatattatgggtcggttgttgcgggtcgttcggttgtcgtcgttgttttcgtcgttgttgtttttgttggttgggggtgagtgcgtttcgggttcgagcgcgggagggcgggcggcggcgtgggtncggtgttgaatagtttttcgggtcgttaataaaggggttagagtgcggcgtcgtcgggagcgcgcgtgtttcggtcgggtcgcggcgtcgtttcgatatacgcgtacgaggagtgggtgcgtggggntcgcggcgggcgtttggcgtgtcgggcgattttcgataaaggcgcggcggtgaagttgggatatagtatcgtggtttttacgtcgcggtttttaggggtaggtgcgtaggttgttgtttcgcgggtcgggggggcgcgtacgtgtgggtgtgtatgtgtgtgcgtgtgtttgtgtgtgtgcgagtgtattgtgtgtttgcgtattcgggggaagaggcgtgtgtgatagttacgcggggaggaggtcgtattgtgaaggttttaggggtcgtttgcggagtgtggggcgggtacgttgaggcgcgggtggttgtttacgcgtggcgttgtcgggagggagtgtgagtgtgttacggtgaatgggtatttttttttgttttgggcgattttattaggagttgataaaaacgggcgtatagttacggaaggttcgtgatagtatacggcgggaggtttttacgtagtttatatacgagggaggtgtgagatttagatgtgtggtttttatttagtagttacgttcggcggcggnttgtgtgggtgcgtggcgggttgggggtgtggtataggtgtgaaagggatgtgtttgtttgagagagaaagagacgggttttttgatg

SEQ ID NO: 36682 - DNA, 1187 bp, Artificial Sequence
  chemically treated genomic DNA (Homo sapiens) CpG-island No: 36682
  misc_feature (89)..(89): n is either a, c, g or t
  misc_feature (621)..(621): n is either a, c, g or t
  misc_feature (748)..(748): n is either a, c, g or t
  misc_feature (925)..(925): n is either a, c, g or t
catcaaaaaacccgtctctttctctctcaaacaaacacatccctttcacacctataccacacccccaacccgccacgcacccacacaanccgccgccgaacgtaactactaaataaaaaccacacatctaaatctcacacctccctcgtatataaactacgtaaaaacctcccgccgtatactatcacgaaccttccgtaactatacgcccgtttttatcaactcctaataaaatcgcccaaaacaaaaaaaaatacccattcaccgtaacacactcacactccctcccgacaacgccacgcgtaaacaaccacccgcgcctcaacgtacccgccccacactccgcaaacgacccctaaaaccttcacaatacgacctcctccccgcgtaactatcacacacgcctcttcccccgaatacgcaaacacacaatacactcgcacacacacaaacacacgcacacacatacacacccacacgtacgcgcccccccgacccgcgaaacaacaacctacgcacctacccctaaaaaccgcgacgtaaaaaccacgatactatatcccaacttcaccgccgcgcctttatcgaaaatcgcccgacacgccaaacgcccgccgcganccccacgcacccactcctcgtacgcgtatatcgaaacgacgccgcgacccgaccgaaacacgcgcgctcccgacgacgccgcactctaacccctttattaacgacccgaaaaactattcaacaccgnacccacgccgccgcccgccctcccgcgctcgaacccgaaacgcactcacccccaaccaacaaaaacaacaacgacgaaaacaacgacgacaaccgaacgacccgcaacaaccgacccataatataaccgtcgccgcctacaaccgcaacgacgcgacgcccgaacccgcgtcaaaanccgcgcgaacgacgacgacgaacccgacccgccccattaatccgcataaccgtcactcacgcccgaccccgcccgaccgcgtaccgcgaacgcgcccccgcgaaaacgaaacgaacgcgcgaacgaccgtccctccgcccgtcccccccgccaaaccgaccaatcaacaccgccgaaactcgaaaacttaacccgaccgcccgcaaacctaaacctcgcacctcgcgcccgaataccgctctctccccgcgcgatcacccgt

SEQ ID NO: 36683 - DNA, 1187 bp, Artificial Sequence
  chemically treated genomic DNA (Homo sapiens) CpG-island No: 36683
  misc_feature (89)..(89): n is either a, c, g or t
  misc_feature (621)..(621): n is either a, c, g or t
  misc_feature (748)..(748): n is either a, c, g or t
  misc_feature (925)..(925): n is either a, c, g or t
tattaggaggttcgttttttttttttttaggtagatatattttttttatatttgtgttatatttttagttcgttacgtatttatatagntcgtcgtcgggcgtggttgttgaatggaaattatatatttgagttttatatttttttcgtgtgtgagttgcgtgggagtttttcgtcgtgtgttgttacgggtttttcgtggttgtacgttcgtttttgttagtttttaatagagtcgtttagaataggagagaatatttatttatcgtgatatatttatattttttttcggtaacgttacgcgtaaatagttattcgcgttttagcgtattcgttttatatttcgtaggcggtttttgggatttttataatgcggtttttttttcgcgtggttgttatatacgttttttttttcgagtgcgtaggtatataatgtattcgtatatatataagtatacgtatatatatgtatatttatacgtgcgcgttttttcggttcgcgaggtagtagtttgcgtatttgtttttgagagtcgcggcgtgggggttacggtgttgtgttttagttttatcgtcgcgtttttgtcgggggtcgttcggtacgttaggcgttcgtcgcggnttttacgtatttatttttcgtgcgcgtgtgtcggggcggcgtcgcggttcggtcgggatacgcgcgttttcggcggcgtcgtattttggtttttttgttggcggttcggagagttgtttagtatcgngtttacgtcgtcgttcgttttttcgcgttcgggttcggagcgtatttatttttaattagtagaagtagtagcggcgaaagtagcggcggtagtcgggcggttcgtagtagtcggtttatggtgtagtcgtcgtcgtttgtagtcgtagcggcgcggcgttcgggttcgcgttagggntcgcgcgggcggcggcggcgggttcggttcgttttattggttcgtatggtcgttatttacgttcggtttcgttcggtcgcgtgtcgcgggcgcgttttcgcggagacgaagcggacgcgcgggcggtcgttttttcgttcgtttttttcgttaggtcggttaattagtatcgtcgaggttcgggggtttggttcggtcgttcgtagatttgggtttcgtatttcgcgttcggatgtcgtttttttttcgcgcggttattcgt

SEQ ID NO: 36684 - DNA, 1187 bp, Artificial Sequence
  chemically treated genomic DNA (Homo sapiens) CpG-island No: 36684
  misc_feature (263)..(263): n is either a, c, g or t
  misc_feature (440)..(440): n is either a, c, g or t
  misc_feature (567)..(567): n is either a, c, g or t
  misc_feature (1099)..(1099): n is either a, c, g or t
acgaataaccgcgcgaaaaaaaaacgacatccgaacgcgaaatacgaaacccaaatctacgaacgaccgaaccaaacccccgaacctcgacgatactaattaaccgacctaacgaaaaaaacgaacgaaaaaacgaccgcccgcgcgtccgcttcgtctccgcgaaaacgcgcccgcgacacgcgaccgaacgaaaccgaacgtaaataacgaccatacgaaccaataaaacgaaccgaacccgccgccgccgcccgcgcganccctaacgcgaacccgaacgccgcgccgctacgactacaaacgacgacgactacaccataaaccgactactacgaaccgcccgactaccgccgctactttcgccgctactacttctactaattaaaaataaatacgctccgaacccgaacgcgaaaaaacgaacgacgacgtaaacncgatactaaacaactctccgaaccgccaacaaaaaaaccaaaatacgacgccgccgaaaacgcgcgtatcccgaccgaaccgcgacgccgccccgacacacgcgcacgaaaaataaatacgtaaaanccgcgacgaacgcctaacgtaccgaacgacccccgacaaaaacgcgacgataaaactaaaacacaacaccgtaacccccacgccgcgactctcaaaaacaaatacgcaaactactacctcgcgaaccgaaaaaacgcgcacgtataaatatacatatatatacgtatacttatatatatacgaatacattatatacctacgcactcgaaaaaaaaaacgtatataacaaccacgcgaaaaaaaaaccgcattataaaaatcccaaaaaccgcctacgaaatataaaacgaatacgctaaaacgcgaataactatttacgcgtaacgttaccgaaaaaaaatataaatatatcacgataaataaatattctctcctattctaaacgactctattaaaaactaacaaaaacgaacgtacaaccacgaaaaacccgtaacaacacacgacgaaaaactcccacgcaactcacacacgaaaaaaatataaaactcaaatatataatttccattcaacaaccacgcccgacgacganctatataaatacgtaacgaactaaaaatataacacaaatataaaaaaaatatatctacctaaaaaaaaaaaaaacgaacctcctaata

SEQ ID NO: 36685 - DNA, 987 bp, Artificial Sequence
  chemically treated genomic DNA (Homo sapiens) CpG-island No: 36685
tatacggcggtttcgtattaattttttttttttcgttcgaggggtaggttttaaagttcgttttggtttcgttttttcgtttttgaatttcggtttcgcgggcggcgggcggcgttttttgcgtttcgggatttaattaaattcgttcggagattacgtcgggtttagcgcgtttgtttttttgatttatttttattttcggggttggggcggggcggggcgggcggggtatttcggggtaggggcggggtcgcggggcggggaggtcggggcgggcgggtttttcggacgtcgttgtagagcggggcggggcggggttgagcgtgtttatattcgtcgggtgcgcggtttcgtcgttcgaggtcgttcggttcgggtattatttttcgcgttatggatattagcgatttgttcgttagttgtaggaagggggatgtgggtcgagtgcggtgaggatttcgtagtttcggggagggtgcgggaggtggtcgttttcggaacgtttcgggttttgggacgggcggttgggcggtcgcggagaggcgggcgtttttgtcgggttatagttttcggagcgttttcgcggggtagattattcggattttcgtcgtagttttttagcggaagcgcgttggggcggggatattgatggttattgattttcggagggttttttgtaagaagggattgtttagcggaggttcgaaggcgtagaagtgggcggagagaaggcgggttattgttcgttttggtagggttcggacgttagatttttcgggcgtagggcgcgggtataggtttgggattttagacgtggtttttttttttcgtgttttttggatttggcgcggggaatatttagagtttataatcggttttcggtttttgaggattcggaaatttttgacgtagttaaagtgaatttggcgttgagatgttttttttatgggtcggacgcggagggaaggggtgtttagttgggttttg

SEQ ID NO: 36686 - DNA, 987 bp, Artificial Sequence
  chemically treated genomic DNA (Homo sapiens) CpG-island No: 36686
caaaacccaactaaacaccccttccctccgcgtccgacccataaaaaaaacatctcaacgccaaattcactttaactacgtcaaaaatttccgaatcctcaaaaaccgaaaaccgattataaactctaaatattccccgcgccaaatccaaaaaacacgaaaaaaaaaaaccacgtctaaaatcccaaacctatacccgcgccctacgcccgaaaaatctaacgtccgaaccctaccaaaacgaacaataacccgccttctctccgcccacttctacgccttcgaacctccgctaaacaatcccttcttacaaaaaaccctccgaaaatcaataaccatcaatatccccgccccaacgcgcttccgctaaaaaactacgacgaaaatccgaataatctaccccgcgaaaacgctccgaaaactataacccgacaaaaacgcccgcctctccgcgaccgcccaaccgcccgtcccaaaacccgaaacgttccgaaaacgaccacctcccgcaccctccccgaaactacgaaatcctcaccgcactcgacccacatcccccttcctacaactaacgaacaaatcgctaatatccataacgcgaaaaataatacccgaaccgaacgacctcgaacgacgaaaccgcgcacccgacgaatataaacacgctcaaccccgccccgccccgctctacaacgacgtccgaaaaacccgcccgccccgacctccccgccccgcgaccccgcccctaccccgaaataccccgcccgccccgccccgccccaaccccgaaaataaaaataaatcaaaaaaacaaacgcgctaaacccgacgtaatctccgaacgaatttaattaaatcccgaaacgcaaaaaacgccgcccgccgcccgcgaaaccgaaattcaaaaacgaaaaaacgaaaccaaaacgaactttaaaacctacccctcgaacgaaaaaaaaaaaattaatacgaaaccgccgtata

SEQ ID NO: 36687 - DNA, 987 bp, Artificial Sequence
  chemically treated genomic DNA (Homo sapiens) CpG-island No: 36687
tagaatttaattgggtatttttttttttcgcgttcggtttatggagggggtattttagcgttagatttattttagttgcgttaggagttttcgaatttttagggatcggaggtcgattatgggttttaggtgtttttcgcgttaggtttagagagtacgagagaaaggggttacgtttggagttttaggtttatattcgcgttttgcgttcggggggtttgacgttcgggttttattagggcgaatagtggttcgtttttttttcgtttatttttgcgttttcgggttttcgttgagtagtttttttttataggaagtttttcgggggttaatggttattagtgttttcgttttagcgcgttttcgttggggggttgcggcgggggttcgggtggtttgtttcgcgggggcgtttcgagggttgtgattcggtagaggcgttcgttttttcgcggtcgtttagtcgttcgttttagggttcgaggcgtttcgagggcggttatttttcgtatttttttcgggattgcgaggtttttatcgtattcggtttatatttttttttttgtagttggcgaataggtcgttggtgtttatggcgcggaggatggtattcgagtcgaacgatttcgggcggcgaagtcgcgtattcggcggatgtaaatacgtttagtttcgtttcgtttcgttttgtagcggcgttcggaggattcgttcgtttcggttttttcgtttcgcggtttcgtttttgtttcggggtgtttcgttcgtttcgtttcgttttaatttcggaaataagaatgagttaagaaggtagacgcgttgggttcggcgtggttttcgggcgggtttaattgagtttcggggcgtaggaagcgtcgttcgtcgttcgcggggtcggggtttaggggcgggaaagcggggttaaggcgggttttgaggtttgtttttcgggcgggagaaagggagttggtacgaagtcgtcgtgtg

SEQ ID NO: 36688 - DNA, 987 bp, Artificial Sequence
  chemically treated genomic DNA (Homo sapiens) CpG-island No: 36688
cacacgacgacttcgtaccaactccctttctcccgcccgaaaaacaaacctcaaaacccgccttaaccccgctttcccgcccctaaaccccgaccccgcgaacgacgaacgacgcttcctacgccccgaaactcaattaaacccgcccgaaaaccacgccgaacccaacgcgtctaccttcttaactcattcttatttccgaaattaaaacgaaacgaaacgaacgaaacaccccgaaacaaaaacgaaaccgcgaaacgaaaaaaccgaaacgaacgaatcctccgaacgccgctacaaaacgaaacgaaacgaaactaaacgtatttacatccgccgaatacgcgacttcgccgcccgaaatcgttcgactcgaataccatcctccgcgccataaacaccaacgacctattcgccaactacaaaaaaaaaaatataaaccgaatacgataaaaacctcgcaatcccgaaaaaaatacgaaaaataaccgccctcgaaacgcctcgaaccctaaaacgaacgactaaacgaccgcgaaaaaacgaacgcctctaccgaatcacaaccctcgaaacgcccccgcgaaacaaaccacccgaacccccgccgcaaccccccaacgaaaacgcgctaaaacgaaaacactaataaccattaacccccgaaaaacttcctataaaaaaaaactactcaacgaaaacccgaaaacgcaaaaataaacgaaaaaaaaacgaaccactattcgccctaataaaacccgaacgtcaaaccccccgaacgcaaaacgcgaatataaacctaaaactccaaacgtaacccctttctctcgtactctctaaacctaacgcgaaaaacacctaaaacccataatcgacctccgatccctaaaaattcgaaaactcctaacgcaactaaaataaatctaacgctaaaataccccctccataaaccgaacgcgaaaaaaaaaaatacccaattaaattcta

SEQ ID NO: 36689 - DNA, 523 bp, Artificial Sequence
  chemically treated genomic DNA (Homo sapiens) CpG-island No: 36689
  misc_feature (488)..(488): n is either a, c, g or t
aggcgtacgaggaaagcgcggaggagttagtgatcgggcgtattaggaagtttggtttttcgtttcggtattgtttcggtcggttgtgcgattttagtatagtatttaggtttttttttttttcgttttggaggattttcggaagagcgagattttttttcgttgtaaaatattaaattcggaaagggtcgcgtttttttcgtttagggtttttattttttttggttttacgcgttcgtcgttatttcggtaacgtcggtcgtggggcggatatcgttgtcgttaagtagtgcggtcgtaaagttagtcgagtgcgtagtcgtagagttttcgtcgggatttggcggagtgcgtttgcgtacggtcggttggcgggtgttttgtgcgttagttttgttattgcggagtatgaggcggaggttgcgtgcgcgttttgttgttttttgtaggattgtacggaagttagaacgattttgttagacgtattntatagatgagatgtagttattcgttaaatgttata

SEQ ID NO: 36690 - DNA, 523 bp, Artificial Sequence
  chemically treated genomic DNA (Homo sapiens) CpG-island No: 36690
  misc_feature (36)..(36): n is either a, c, g or t
tataacatttaacgaataactacatctcatctatanaatacgtctaacaaaatcgttctaacttccgtacaatcctacaaaaaacaacaaaacgcgcacgcaacctccgcctcatactccgcaataacaaaactaacgcacaaaacacccgccaaccgaccgtacgcaaacgcactccgccaaatcccgacgaaaactctacgactacgcactcgactaactttacgaccgcactacttaacgacaacgatatccgccccacgaccgacgttaccgaaataacgacgaacgcgtaaaaccaaaaaaaataaaaaccctaaacgaaaaaaacgcgaccctttccgaatttaatattttacaacgaaaaaaaatctcgctcttccgaaaatcctccaaaacgaaaaaaaaaaaaacctaaatactatactaaaatcgcacaaccgaccgaaacaataccgaaacgaaaaaccaaacttcctaatacgcccgatcactaactcctccgcgctttcctcgtacgcct

SEQ ID NO: 36691 - DNA, 523 bp, Artificial Sequence
  chemically treated genomic DNA (Homo sapiens) CpG-island No: 36691
  misc_feature (36)..(36): n is either a, c, g or t
tgtgatatttgacgggtaattgtattttatttgtanaatgcgtttggtaggatcgttttggttttcgtataattttgtagagagtagtaaagcgcgtacgtagttttcgttttatatttcgtagtggtagagttggcgtatagaatattcgttagtcggtcgtgcgtaggcgtatttcgttaagtttcgacgggagttttgcggttgcgtattcggttggttttgcggtcgtattgtttgacggtagcggtgttcgttttacggtcggcgttgtcggggtaacggcgagcgcgtggggttaagaaaggtaagggttttgggcgaggaaagcgcggtttttttcgagtttggtgttttgtagcgaaaggaaatttcgttttttcgaaagttttttagggcgagagaggaaagggtttaggtattgtgttggggtcgtatagtcggtcgagatagtgtcgggacggggagttaggttttttagtgcgttcggttattgattttttcgcgtttttttcgtgcgttt

SEQ ID NO: 36692 - DNA, 523 bp, Artificial Sequence
  chemically treated genomic DNA (Homo sapiens) CpG-island No: 36692
  misc_feature (488)..(488): n is either a, c, g or t
aaacgcacgaaaaaaacgcgaaaaaatcaataaccgaacgcactaaaaaacctaactccccgtcccgacactatctcgaccgactatacgaccccaacacaatacctaaaccctttcctctctcgccctaaaaaactttcgaaaaaacgaaatttcctttcgctacaaaacaccaaactcgaaaaaaaccgcgctttcctcgcccaaaacccttacctttcttaaccccacgcgctcgccgttaccccgacaacgccgaccgtaaaacgaacaccgctaccgtcaaacaatacgaccgcaaaaccaaccgaatacgcaaccgcaaaactcccgtcgaaacttaacgaaatacgcctacgcacgaccgactaacgaatattctatacgccaactctaccactacgaaatataaaacgaaaactacgtacgcgctttactactctctacaaaattatacgaaaaccaaaacgatcctaccaaacgcattntacaaataaaatacaattacccgtcaaatatcaca

SEQ ID NO: 36693 - DNA, 555 bp, Artificial Sequence
  chemically treated genomic DNA (Homo sapiens) CpG-island No: 36693
  misc_feature (472)..(473): n is either a, c, g or t
  misc_feature (545)..(545): n is either a, c, g or t
  misc_feature (553)..(553): n is either a, c, g or t
tcgttagcgttttagacgtattgttggtcgtattgttgagttgtattattttttttttcgtcgtatttgtatttttaagcgttacggcggatgtaatattttttgttcgtttagttgttgtttcggcgcgcgttgtcgcggatttcgtcgtatttttgttttgagttgtcgtcgtcgtattgttagtagtttttgtcgttttcgtggatgtcgtcgtggcgttgtttttcgttgttgacgtttgtttggtcgttttattttttgaagtagacgtcgatgatgtcgatgacgtcgtcgaattggttgacgatgcggtagtcgtttttgaggattttgcgtttgttttcgacgttttcgcgttcgtttcggatgttttcgttgcggaagtagatttcgttgttgcgttggtttgtttagtggtttcgttagttttcgttgtggttgttgaagtagacgatgcggcgttttttgnncgatttcggcggcggtggtattggttgaggtttgttcggtatttgttgacgttgtattggtagacgacgtanttcgttgntt

SEQ ID NO: 36694 - DNA, 555 bp, Artificial Sequence
  chemically treated genomic DNA (Homo sapiens) CpG-island No: 36694
  misc_feature (3)..(3): n is either a, c, g or t
  misc_feature (11)..(11): n is either a, c, g or t
  misc_feature (83)..(84): n is either a, c, g or t
aancaacgaantacgtcgtctaccaatacaacgtcaacaaataccgaacaaacctcaaccaataccaccgccgccgaaatcgnncaaaaaacgccgcatcgtctacttcaacaaccacaacgaaaactaacgaaaccactaaacaaaccaacgcaacaacgaaatctacttccgcaacgaaaacatccgaaacgaacgcgaaaacgtcgaaaacaaacgcaaaatcctcaaaaacgactaccgcatcgtcaaccaattcgacgacgtcatcgacatcatcgacgtctacttcaaaaaataaaacgaccaaacaaacgtcaacaacgaaaaacaacgccacgacgacatccacgaaaacgacaaaaactactaacaatacgacgacgacaactcaaaacaaaaatacgacgaaatccgcgacaacgcgcgccgaaacaacaactaaacgaacaaaaaatattacatccgccgtaacgcttaaaaatacaaatacgacgaaaaaaaaaataatacaactcaacaatacgaccaacaatacgtctaaaacgctaacga

SEQ ID NO: 36695 - DNA, 555 bp, Artificial Sequence
  chemically treated genomic DNA (Homo sapiens) CpG-island No: 36695
  misc_feature (3)..(3): n is either a, c, g or t
  misc_feature (11)..(11): n is either a, c, g or t
  misc_feature (83)..(84): n is either a, c, g or t
aantagcgggntgcgtcgtttgttagtgtagcgttaataagtgtcgggtaggttttagttagtgttatcgtcgtcgaaatcgnntagaaagcgtcgtatcgtttgttttaatagttataacgaaggttggcgaagttattgaataggttagcgtagtagcgaggtttgttttcgtagcgaagatattcgaaacgaacgcgaaagcgtcggaaataagcgtagaatttttaaaaacggttgtcgtatcgttagttagttcggcggcgttatcggtattatcggcgtttgttttaaaagatgaggcgattagataagcgttagtagcgaagagtagcgttacgacggtatttacgaaggcgatagaggttgttggtagtgcgacggcggtagtttagagtaaaagtacggcggaattcgcggtaacgcgcgtcgagatagtagttaaacgggtagaggatattgtattcgtcgtggcgtttgaggatgtaagtacgacgaaaaaggggatagtatagtttagtagtgcgattaatagtacgtttgaaacgttggcgg

SEQ ID NO: 36696 - DNA, 555 bp, Artificial Sequence
  chemically treated genomic DNA (Homo sapiens) CpG-island No: 36696
  misc_feature (472)..(473): n is either a, c, g or t
  misc_feature (545)..(545): n is either a, c, g or t
  misc_feature (553)..(553): n is either a, c, g or t
ccgccaacgtttcaaacgtactattaatcgcactactaaactatactatcccctttttcgtcgtacttacatcctcaaacgccacgacgaatacaatatcctctacccgtttaactactatctcgacgcgcgttaccgcgaattccgccgtacttttactctaaactaccgccgtcgcactaccaacaacctctatcgccttcgtaaataccgtcgtaacgctactcttcgctactaacgcttatctaatcgcctcatcttttaaaacaaacgccgataataccgataacgccgccgaactaactaacgatacgacaaccgtttttaaaaattctacgcttatttccgacgctttcgcgttcgtttcgaatatcttcgctacgaaaacaaacctcgctactacgctaacctattcaataacttcgccaaccttcgttataactattaaaacaaacgatacgacgctttctanncgatttcgacgacgataacactaactaaaacctacccgacacttattaacgctacactaacaaacgacgcancccgctantt

SEQ ID NO: 36697 - DNA, 593 bp, Artificial Sequence
  chemically treated genomic DNA (Homo sapiens) CpG-island No: 36697
aatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcggtcgacgtttttttttatgcgatttttgtattaggaagtagtttagtagtaggttgaggtcgttgagtatcgtcgtcgtaaggaatggtgtatgtaaggagatggcgtttaatagtttttcggttacggggtttgttattatatttacgtcgaaataagcgtttatgagttcgaagtggcgagttcgattttttttatcggtgatgtcggcgatataggcgttagtaatcgtatttgtggcgtcggtgatgtcggttacgatgcgttcggcgtagaggatttgaaaaagaagttaatagaaatgattttatataaagaagggaa

SEQ ID NO: 36698 - DNA, 593 bp, Artificial Sequence
  chemically treated genomic DNA (Homo sapiens) CpG-island No: 36698
ttcccttctttatataaaatcatttctattaacttctttttcaaatcctctacgccgaacgcatcgtaaccgacatcaccgacgccacaaatacgattactaacgcctatatcgccgacatcaccgataaaaaaaatcgaactcgccacttcgaactcataaacgcttatttcgacgtaaatataataacaaaccccgtaaccgaaaaactattaaacgccatctccttacatacaccattccttacgacgacgatactcaacgacctcaacctactactaaactacttcctaatacaaaaatcgcataaaaaaaaacgtcgaccgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccatt

SEQ ID NO: 36699 - DNA, 593 bp, Artificial Sequence
  chemically treated genomic DNA (Homo sapiens) CpG-island No: 36699
tttttttttttatatgaggttatttttattgattttttttttagattttttacgtcggacgtatcgtggtcggtattatcggcgttataggtgcggttgttggcgtttatatcgtcgatattatcgatggggaagatcgggttcgttatttcgggtttatgagcgtttgtttcggcgtgggtatggtggtaggtttcgtggtcgggggattgttgggcgttatttttttgtatgtattattttttgcggcggcggtgtttaacggttttaatttattattgggttgttttttaatgtaggagtcgtataagggagagcgtcgatcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttatt

SEQ ID NO: 36700 - DNA, 593 bp, Artificial Sequence
  chemically treated genomic DNA (Homo sapiens) CpG-island No: 36700
aataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgatcgacgctctcccttatacgactcctacattaaaaaacaacccaataataaattaaaaccgttaaacaccgccgccgcaaaaaataatacatacaaaaaaataacgcccaacaatcccccgaccacgaaacctaccaccatacccacgccgaaacaaacgctcataaacccgaaataacgaacccgatcttccccatcgataatatcgacgatataaacgccaacaaccgcacctataacgccgataataccgaccacgatacgtccgacgtaaaaaatctaaaaaaaaaatcaataaaaataacctcatataaaaaaaaaaa

SEQ ID NO: 36701 - DNA, 1194 bp, Artificial Sequence
  chemically treated genomic DNA (Homo sapiens) CpG-island No: 36701
  misc_feature (334)..(334): n is either a, c, g or t
  misc_feature (478)..(478): n is either a, c, g or t
gaatagttgacgtacgttaggatttagtttattatcgtttcgttaatcgttaggttaatttttaggttgaataggtaggtggagaatattagttcgtcgaggcggcgattttgcggtttttttcgtagtttattacgttagaagttattagttattgtagcggcgtggtggtattaaagacgaataggaataggatgttgagggtaaaaatgagcgcgatgtgtttcgtcggggtgacgaaaattagtaggttgattagcgagtaggcgacgatgatttatttgaaggcggtgacgcggtcgaagcggtttagtaggcgtgaggagtaaagcgngtcgaatatggtggcgaggttgtcgtaaagtaaaaattgggtcgttaatttcgggtgatttattacgtattttacgaagtagagcgtcgtttcgtcgcgtattacgttggagtaggtcgttattattttgaacgcgtatatgantgtcgtattggttgttgtttagtagtagtttaaggtttttcgttatcgacgagtttcgttgtattttaaaggtgtagcgttttttggtcgtgaagatgtagacgtagagtagtattacgttgtttagttttagtacgtatatggcgtcgaagtagtttatttgttcgttttttttgtcgatgatgtttagttagcggtagcgcgatgtcgttgatagcgagcgagttcgtcgtcgttaggaagaagcgttaggattgtagggcgtgacgttttttcgggtcggcggtgatgacgttcggtatggcgtagtacggtacgttaacgaaggtgtagattagggttaggagaatgtaggttacgtaggcgtagatgattttgttttgtgcggagaagttcggcgtgtagaaggttagtacgtagacgatgtcgaacgggatggttttttatagtaggaacgggcggaattggtcgtgtcgcgtgcgggtgcggtttattagtagttttattagcgggtcggtgacggcgtcgagtacgcgggagattaaaaatagcgtgtttataattttcgtcgataggtcgaagacgtcggtgtagaaataggttagtaggaatatcgtggtttgttagacgtaagcgtaggcggtgttttttagttcgtagttaattttgttttttatggttaattgcgttattagaattatatttttatgtagtgt

SEQ ID NO: 36702 - DNA, 1194 bp, Artificial Sequence
  chemically treated genomic DNA (Homo sapiens) CpG-island No: 36702
  misc_feature (717)..(717): n is either a, c, g or t
  misc_feature (861)..(861): n is either a, c, g or t
acactacataaaaatataattctaataacgcaattaaccataaaaaacaaaattaactacgaactaaaaaacaccgcctacgcttacgtctaacaaaccacgatattcctactaacctatttctacaccgacgtcttcgacctatcgacgaaaattataaacacgctatttttaatctcccgcgtactcgacgccgtcaccgacccgctaataaaactactaataaaccgcacccgcacgcgacacgaccaattccgcccgttcctactataaaaaaccatcccgttcgacatcgtctacgtactaaccttctacacgccgaacttctccgcacaaaacaaaatcatctacgcctacgtaacctacattctcctaaccctaatctacaccttcgttaacgtaccgtactacgccataccgaacgtcatcaccgccgacccgaaaaaacgtcacgccctacaatcctaacgcttcttcctaacgacgacgaactcgctcgctatcaacgacatcgcgctaccgctaactaaacatcatcgacaaaaaaaacgaacaaataaactacttcgacgccatatacgtactaaaactaaacaacgtaatactactctacgtctacatcttcacgaccaaaaaacgctacacctttaaaatacaacgaaactcgtcgataacgaaaaaccttaaactactactaaacaacaaccaatacgacantcatatacgcgttcaaaataataacgacctactccaacgtaatacgcgacgaaacgacgctctacttcgtaaaatacgtaataaatcacccgaaattaacgacccaatttttactttacgacaacctcgccaccatattcgacncgctttactcctcacgcctactaaaccgcttcgaccgcgtcaccgccttcaaataaatcatcgtcgcctactcgctaatcaacctactaattttcgtcaccccgacgaaacacatcgcgctcatttttaccctcaacatcctattcctattcgtctttaataccaccacgccgctacaataactaataacttctaacgtaataaactacgaaaaaaaccgcaaaatcgccgcctcgacgaactaatattctccacctacctattcaacctaaaaattaacctaacgattaacgaaacgataataaactaaatcctaacgtacgtcaactattc

SEQ ID NO: 36703 - DNA, 1194 bp, Artificial Sequence
  chemically treated genomic DNA (Homo sapiens) CpG-island No: 36703
  misc_feature (717)..(717): n is either a, c, g or t
  misc_feature (861)..(861): n is either a, c, g or t
atattatataagggtgtaattttgatgacgtaattaattatgaaagataaaattggttacgggttgggagatatcgtttgcgtttacgtttggtaggttacgatgtttttgttggtttatttttatatcgacgttttcggtttgtcggcggggattatgggtacgttgtttttggtttttcgcgtgttcgacgtcgttatcgattcgttgatggggttgttggtagatcgtattcgtacgcggtacggttagtttcgttcgtttttgttgtggggggttatttcgttcggtatcgtttgcgtgttgattttttatacgtcggattttttcgtatagggtaagattatttacgtttgcgtgatttatatttttttgattttggtttatattttcgttaacgtgtcgtattgcgttatgtcgggcgttattatcgtcgattcgagagagcgttacgttttgtagttttggcgtttttttttggcggcggcgggttcgttcgttattagcggtatcgcgttgtcgttggttgagtattatcggtaaaggggacgagtaggtgggttatttcggcgttatgtgcgtgttggggttgagtagcgtggtgttgttttacgtttgtatttttacgattaaagagcgttatatttttgaggtgtagcggggttcgtcggtggcgaaagattttaagttgttgttgggtaatagttagtgcggtanttatgtgcgcgtttaagatgatggcgatttgttttaacgtggtgcgcggcggggcgacgttttatttcgtgaaatacgtgatggattattcggagttggcgatttagtttttattttacggtagtttcgttattatgttcggtncgttttgttttttacgtttgttgggtcgtttcgatcgcgttatcgtttttaagtggattatcgtcgtttattcgttgattagtttgttgattttcgttatttcggcggagtatatcgcgtttatttttgtttttaatattttgtttttgttcgtttttaatattattacgtcgttgtagtggttgatggtttttgacgtggtggattacgaggagagtcgtagggtcgtcgtttcgacgggttggtgttttttatttatttgtttagtttgaagattggtttggcgattggcggggcggtggtgggttggattttggcgtacgttaattattt

SEQ ID NO: 36704 - DNA, 1194 bp, Artificial Sequence
  chemically treated genomic DNA (Homo sapiens) CpG-island No: 36704
  misc_feature (334)..(334): n is either a, c, g or t
  misc_feature (478)..(478): n is either a, c, g or t
aaataattaacgtacgccaaaatccaacccaccaccgccccgccaatcgccaaaccaatcttcaaactaaacaaataaataaaaaacaccaacccgtcgaaacgacgaccctacgactctcctcgtaatccaccacgtcaaaaaccatcaaccactacaacgacgtaataatattaaaaacgaacaaaaacaaaatattaaaaacaaaaataaacgcgatatactccgccgaaataacgaaaatcaacaaactaatcaacgaataaacgacgataatccacttaaaaacgataacgcgatcgaaacgacccaacaaacgtaaaaaacaaaacgnaccgaacataataacgaaactaccgtaaaataaaaactaaatcgccaactccgaataatccatcacgtatttcacgaaataaaacgtcgccccgccgcgcaccacgttaaaacaaatcgccatcatcttaaacgcgcacataantaccgcactaactattacccaacaacaacttaaaatctttcgccaccgacgaaccccgctacacctcaaaaatataacgctctttaatcgtaaaaatacaaacgtaaaacaacaccacgctactcaaccccaacacgcacataacgccgaaataacccacctactcgtcccctttaccgataatactcaaccaacgacaacgcgataccgctaataacgaacgaacccgccgccgccaaaaaaaaacgccaaaactacaaaacgtaacgctctctcgaatcgacgataataacgcccgacataacgcaatacgacacgttaacgaaaatataaaccaaaatcaaaaaaatataaatcacgcaaacgtaaataatcttaccctatacgaaaaaatccgacgtataaaaaatcaacacgcaaacgataccgaacgaaataaccccccacaacaaaaacgaacgaaactaaccgtaccgcgtacgaatacgatctaccaacaaccccatcaacgaatcgataacgacgtcgaacacgcgaaaaaccaaaaacaacgtacccataatccccgccgacaaaccgaaaacgtcgatataaaaataaaccaacaaaaacatcgtaacctaccaaacgtaaacgcaaacgatatctcccaacccgtaaccaattttatctttcataattaattacgtcatcaaaattacacccttatataatat

SEQ ID NO: 36705 - DNA, 934 bp, Artificial Sequence
  chemically treated genomic DNA (Homo sapiens) CpG-island No: 36705
  misc_feature (827)..(827): n is either a, c, g or t
  misc_feature (878)..(878): n is either a, c, g or t
  misc_feature (881)..(881): n is either a, c, g or t
  misc_feature (888)..(888): n is either a, c, g or t
  misc_feature (904)..(904): n is either a, c, g or t
  misc_feature (914)..(914): n is either a, c, g or t
ttttacggttagaaaaagtgcgtagggggcgtttcgcgtcgggcgcgtatacggttagagtacggggttttttacgcgggttttgtttcggacgtagaggggtcgcgagcggagatatggacgcggtattttttacgttaggagtttttcgcgcgcgttttttttttatagttttcgtttcgtaggtcgagagaggatcgcggggatttgcgaggggttgggtcgtttaggaggttcgggtttgcgtttcgtttagttttcgcggacgtttttggcgagagacgcggttttgaaattagttgtggggtttcgtttaggttcgttttttggttgcgttatttaagtggatttcgcgtggtgaggcggggttagattcggtgattttcgaggggttagagatttgggcgggggcgggggttagtttttttttcgagagggcgtcgcggggatatagtttatcgtcgggagttagcgggataacggtttcgggtttgacgtcgtttattcgagggtgttcgaagttcgttgggattcgtttagagtttatgtatcgttttgggacgggatcgacgggagcggggggagcgaggagttcgttttgtcgtcggagtggagttcggagttagggggtttcgtcgttcgttcgttaagtcgtgcggtttcgttaatgaggaaatttggggggcggggttttcgtgttgtcgttttacgtatttgtggtcgatagatttttttacgagttattattttcgtttcgtatttggcggcgacgtttgaggtcgcggatatgcggtgggaagtagttcgttcggggcgtgtggaatganaggtgcgtcggcgtttttattttgtaacgtggggtcgtcgtaggtaagttngtngtttatnagaagggggatttttngtagaggttnagagtattgcgatggcgatt

SEQ ID NO: 36706 - DNA, 934 bp, Artificial Sequence
  chemically treated genomic DNA (Homo sapiens) CpG-island No: 36706
  misc_feature (21)..(21): n is either a, c, g or t
  misc_feature (31)..(31): n is either a, c, g or t
  misc_feature (47)..(47): n is either a, c, g or t
  misc_feature (54)..(54): n is either a, c, g or t
  misc_feature (57)..(57): n is either a, c, g or t
  misc_feature (108)..(108): n is either a, c, g or t
aatcgccatcgcaatactctnaacctctacnaaaaatcccccttctnataaacnacnaacttacctacgacgaccccacgttacaaaataaaaacgccgacgcacctntcattccacacgccccgaacgaactacttcccaccgcatatccgcgacctcaaacgtcgccgccaaatacgaaacgaaaataataactcgtaaaaaaatctatcgaccacaaatacgtaaaacgacaacacgaaaaccccgccccccaaatttcctcattaacgaaaccgcacgacttaacgaacgaacgacgaaaccccctaactccgaactccactccgacgacaaaacgaactcctcgctccccccgctcccgtcgatcccgtcccaaaacgatacataaactctaaacgaatcccaacgaacttcgaacaccctcgaataaacgacgtcaaacccgaaaccgttatcccgctaactcccgacgataaactatatccccgcgacgccctctcgaaaaaaaaactaacccccgcccccgcccaaatctctaacccctcgaaaatcaccgaatctaaccccgcctcaccacgcgaaatccacttaaataacgcaaccaaaaaacgaacctaaacgaaaccccacaactaatttcaaaaccgcgtctctcgccaaaaacgtccgcgaaaactaaacgaaacgcaaacccgaacctcctaaacgacccaacccctcgcaaatccccgcgatcctctctcgacctacgaaacgaaaactataaaaaaaaaacgcgcgcgaaaaactcctaacgtaaaaaataccgcgtccatatctccgctcgcgacccctctacgtccgaaacaaaacccgcgtaaaaaaccccgtactctaaccgtatacgcgcccgacgcgaaacgccccctacgcactttttctaaccgtaaaa

SEQ ID NO: 36707 - DNA, 934 bp, Artificial Sequence
  chemically treated genomic DNA (Homo sapiens) CpG-island No: 36707
  misc_feature (21)..(21): n is either a, c, g or t
  misc_feature (31)..(31): n is either a, c, g or t
  misc_feature (47)..(47): n is either a, c, g or t
  misc_feature (54)..(54): n is either a, c, g or t
  misc_feature (57)..(57): n is either a, c, g or t
  misc_feature (108)..(108): n is either a, c, g or t
agtcgttatcgtagtgttttngatttttatngaggattttttttttnataggtngtnggtttgtttgcggcgattttacgttgtagggtaggggcgtcggcgtatttnttattttatacgtttcgggcgggttgttttttatcgtatattcgcgattttagacgtcgtcgttaaatgcggggcggggatggtgattcgtggaaagatttgtcggttataggtacgtgggacggtagtacggggatttcgttttttaagtttttttattagcgaggtcgtacggtttggcgggcggacggcgggattttttggtttcgggttttatttcgacggtaggacgggtttttcgtttttttcgttttcgtcggtttcgttttagggcggtgtatgggttttgagcgggttttagcgggtttcgggtattttcgggtgggcggcgttaggttcgaggtcgttgtttcgttggttttcggcggtgggttgtgttttcgcggcgttttttcgggaggaggattggttttcgttttcgtttaggtttttaatttttcggaggttatcgggtttggtttcgttttattacgcggggtttatttggatggcgtagttagaggacgggtttgggcgaaattttatagttgattttagaatcgcgtttttcgttaaaggcgttcgcgggggttgagcggggcgtagattcgagttttttggacggtttagtttttcgtaggttttcgcggttttttttcggtttgcggggcggggattgtggaaggggagcgcgcgcggggagtttttggcgtgagaaatgtcgcgtttatgttttcgttcgcggtttttttgcgttcgagataaaattcgcgtggggagtttcgtgttttggtcgtgtgcgcgttcgacgcgggacgttttttgcgtattttttttggtcgtagag

SEQ ID NO: 36708 - DNA, 934 bp, Artificial Sequence
  chemically treated genomic DNA (Homo sapiens) CpG-island No: 36708
  misc_feature (827)..(827): n is either a, c, g or t
  misc_feature (878)..(878): n is either a, c, g or t
  misc_feature (881)..(881): n is either a, c, g or t
  misc_feature (888)..(888): n is either a, c, g or t
  misc_feature (904)..(904): n is either a, c, g or t
  misc_feature (914)..(914): n is either a, c, g or t
ctctacgaccaaaaaaaatacgcaaaaaacgtcccgcgtcgaacgcgcacacgaccaaaacacgaaactccccacgcgaattttatctcgaacgcaaaaaaaccgcgaacgaaaacataaacgcgacatttctcacgccaaaaactccccgcgcgcgctccccttccacaatccccgccccgcaaaccgaaaaaaaaccgcgaaaacctacgaaaaactaaaccgtccaaaaaactcgaatctacgccccgctcaacccccgcgaacgcctttaacgaaaaacgcgattctaaaatcaactataaaatttcgcccaaacccgtcctctaactacgccatccaaataaaccccgcgtaataaaacgaaaccaaacccgataacctccgaaaaattaaaaacctaaacgaaaacgaaaaccaatcctcctcccgaaaaaacgccgcgaaaacacaacccaccgccgaaaaccaacgaaacaacgacctcgaacctaacgccgcccacccgaaaatacccgaaacccgctaaaacccgctcaaaacccatacaccgccctaaaacgaaaccgacgaaaacgaaaaaaacgaaaaacccgtcctaccgtcgaaataaaacccgaaaccaaaaaatcccgccgtccgcccgccaaaccgtacgacctcgctaataaaaaaacttaaaaaacgaaatccccgtactaccgtcccacgtacctataaccgacaaatctttccacgaatcaccatccccgccccgcatttaacgacgacgtctaaaatcgcgaatatacgataaaaaacaacccgcccgaaacgtataaaataanaaatacgccgacgcccctaccctacaacgtaaaatcgccgcaaacaaaccnacnacctatnaaaaaaaaaatcctcnataaaaatcnaaaacactacgataacgact

SEQ ID NO: 36709 - DNA, 601 bp, Artificial Sequence
  chemically treated genomic DNA (Homo sapiens) CpG-island No: 36709
  misc_feature (39)..(40): n is either a, c, g or t
ttttcggcgtttaagttggttttgcgttttcgggaggtnnggcggagaggggcgtacgcgggtgggttcgtcggcgtggatggggtcgggttggtatggcgtatattaaaggtcgttcgtgtaatgtatgcgcgttttttttaattaacggtattttttgttttttcgtttttttttattcgtttcgtttttttcgcgttagttcgggttgtttgagcgcggggacgagttttttttcgcgcgttcgttcgtgcgagtgcgcgcgtgcgcgtgcgcgtgcgaagggttttaggggcgtttcggatttgtttaggggaggttgcgagggtcgtcgggtttcgaggtttcgtcgaggtcgagtttcgggcgcgttttggggagagcgaggtttaagggtgcggcgggtggaacgtagggaggattttagtttttgttttttcgaacgttttttgtgttcgtatttataggtttcgattttggttttaaggcgcggttgttgcgggattttacgtgtagggaggggcgttcgggtatttttattttatacgtcggcgcgggttgttttatcgtatatcggcgattttagacgtcgcgcgttaaa

SEQ ID NO: 36710 - DNA, 601 bp, Artificial Sequence
  chemically treated genomic DNA (Homo sapiens) CpG-island No: 36710
  misc_feature (562)..(563): n is either a, c, g or t
tttaacgcgcgacgtctaaaatcgccgatatacgataaaacaacccgcgccgacgtataaaataaaaatacccgaacgcccctccctacacgtaaaatcccgcaacaaccgcgccttaaaaccaaaatcgaaacctataaatacgaacacaaaaaacgttcgaaaaaacaaaaactaaaatcctccctacgttccacccgccgcacccttaaacctcgctctccccaaaacgcgcccgaaactcgacctcgacgaaacctcgaaacccgacgaccctcgcaacctcccctaaacaaatccgaaacgcccctaaaacccttcgcacgcgcacgcgcacgcgcgcactcgcacgaacgaacgcgcgaaaaaaaactcgtccccgcgctcaaacaacccgaactaacgcgaaaaaaacgaaacgaataaaaaaaaacgaaaaaacaaaaaataccgttaattaaaaaaaacgcgcatacattacacgaacgacctttaatatacgccataccaacccgaccccatccacgccgacgaacccacccgcgtacgcccctctccgccnnacctcccgaaaacgcaaaaccaacttaaacgccgaaaa

SEQ ID NO: 36711 - DNA, 601 bp, Artificial Sequence
  chemically treated genomic DNA (Homo sapiens) CpG-island No: 36711
  misc_feature (562)..(563): n is either a, c, g or t
tttggcgcgcgacgtttgaggtcgtcgatatgcggtgggatagttcgcgtcggcgtgtggaatgagggtgttcgggcgtttttttttgtacgtggggtttcgtagtagtcgcgttttaaggttagagtcgaagtttgtgggtgcggatatagggaacgttcgaggagatagaaattggggttttttttgcgttttattcgtcgtatttttaagtttcgttttttttaaaacgcgttcgaaattcggtttcgacggggtttcggggttcggcgattttcgtagttttttttgggtaaattcggagcgtttttgggatttttcgtacgcgtacgcgtacgcgcgtattcgtacggacgggcgcgcgggaaaaggttcgttttcgcgtttaagtagttcggattggcgcggggggggcggggcggatgaagggaagcgagggggtaggaaatgtcgttaattgagggaaacgcgtatgtattgtacgggcggtttttgatgtgcgttatgttagttcggttttatttacgtcggcgagtttattcgcgtgcgttttttttcgttnngtttttcgggagcgtagggttagtttgagcgtcgagga

SEQ ID NO: 36712 - DNA, 601 bp, Artificial Sequence
  chemically treated genomic DNA (Homo sapiens) CpG-island No: 36712
  misc_feature (39)..(40): n is either a, c, g or t
tcctcgacgctcaaactaaccctacgctcccgaaaaacnnaacgaaaaaaaacgcacgcgaataaactcgccgacgtaaataaaaccgaactaacataacgcacatcaaaaaccgcccgtacaatacatacgcgtttccctcaattaacgacatttcctaccccctcgcttcccttcatccgccccgccccccccgcgccaatccgaactacttaaacgcgaaaacgaaccttttcccgcgcgcccgtccgtacgaatacgcgcgtacgcgtacgcgtacgaaaaatcccaaaaacgctccgaatttacccaaaaaaaactacgaaaatcgccgaaccccgaaaccccgtcgaaaccgaatttcgaacgcgttttaaaaaaaacgaaacttaaaaatacgacgaataaaacgcaaaaaaaaccccaatttctatctcctcgaacgttccctatatccgcacccacaaacttcgactctaaccttaaaacgcgactactacgaaaccccacgtacaaaaaaaaacgcccgaacaccctcattccacacgccgacgcgaactatcccaccgcatatcgacgacctcaaacgtcgcgcgccaaa

SEQ ID NO: 36713 - DNA, 1405 bp, Artificial Sequence
  chemically treated genomic DNA (Homo sapiens) CpG-island No: 36713
  misc_feature (1350)..(1351): n is either a, c, g or t
  misc_feature (1366)..(1366): n is either a, c, g or t
  misc_feature (1381)..(1381): n is either a, c, g or t
  misc_feature (1388)..(1388): n is either a, c, g or t
ggggcggcggttgggttgttcggtttttcggttttgagcgggattttttggggttttttcggggcgtttaggttcggggatttggagcggaagtttttattattgttgggggtcggcgatagggtttgcgaggacgaggattcggatagggcggggttgtcgcgttgcggttttttaggtcgtttacggtcgacgaggagtcgttgtttaggcggttatttttttcggattcgttttttacggatttgaggtcggttagttgttggtagtttatgatcgagtcgattatttttatttggttttttagggcggtaatgttggagatgatcgagggcggggagggcgggtaggatttcgcgtaggataggagtggtttggtcgggtcggtggtcgcgttttttagtttagcgtcgttttttatggagttttcgtttatgtcgttatcgtagttgtttagggttttcgcgtttttgtcgtcgtaggttagttcggagtttatggtattttggaagtttttcggtagcggcgtgttggggatttggtcgtttatgtgtatgcggatgtgttgttgtaggattacggcgttggtgaattttttttggtagatggggtaggagtgttgtacgcgtaggggcggttttgtacggtgtacgtcgaagtgcgttttgaggttgtttttggtggtgaaggcgcggtcgtagattttgtatttgaacggtcgttttttcgtgtgcgttcggtagtgtatttttagcgcgttttggtagtttagtattcggtggtagatgacgtattggttcgggttcgttatttttttgtcgatgttttttattagttgttgtagtttcgaggttttcgacgtttgtatcgagtttagtagtttttcgaacggaaattgggttttgaattgttcggagacggcgggtagtcggggttgtcgaggttcgtgggtgcgtcgtttatcgatgtgggtgtacgttagtttgcgcgtttacgggagcgttttcggttttggcgttggtgtagggtaggttgacgggttcggttttagtgaggggcggtcgcgaggagcgagtgtggggattcggcggtggtagtacgtcggagtggaggtggttgagggcgggggagaaggaggcgtattcgcgtggaggcggcgaggtcgtttgcggggagcggttggttggggtggcgcggggagagtgggcgtattggcgcggcgagggatagtgggcggtagtgtgtagcgtacggacgtgcgagcggtggagtagtacggggtgggttgtgcgaggtaggtggtgacgggtttttcggggggggagggatatgtcgttagggagtgtcganngtaggtgggacgttngtgtaggtattcggnggacggngtgaaggggttatttgg

SEQ ID NO: 36714 - DNA, 1405 bp, Artificial Sequence
  chemically treated genomic DNA (Homo sapiens) CpG-island No: 36714
  misc_feature (18)..(18): n is either a, c, g or t
  misc_feature (25)..(25): n is either a, c, g or t
  misc_feature (40)..(40): n is either a, c, g or t
  misc_feature (55)..(56): n is either a, c, g or t
ccaaataaccccttcacnccgtccnccgaatacctacacnaacgtcccacctacnntcgacactccctaacgacatatccctccccccccgaaaaacccgtcaccacctacctcgcacaacccaccccgtactactccaccgctcgcacgtccgtacgctacacactaccgcccactatccctcgccgcgccaatacgcccactctccccgcgccaccccaaccaaccgctccccgcaaacgacctcgccgcctccacgcgaatacgcctccttctcccccgccctcaaccacctccactccgacgtactaccaccgccgaatccccacactcgctcctcgcgaccgcccctcactaaaaccgaacccgtcaacctaccctacaccaacgccaaaaccgaaaacgctcccgtaaacgcgcaaactaacgtacacccacatcgataaacgacgcacccacgaacctcgacaaccccgactacccgccgtctccgaacaattcaaaacccaatttccgttcgaaaaactactaaactcgatacaaacgtcgaaaacctcgaaactacaacaactaataaaaaacatcgacaaaaaaataacgaacccgaaccaatacgtcatctaccaccgaatactaaactaccaaaacgcgctaaaaatacactaccgaacgcacacgaaaaaacgaccgttcaaatacaaaatctacgaccgcgccttcaccaccaaaaacaacctcaaaacgcacttcgacgtacaccgtacaaaaccgcccctacgcgtacaacactcctaccccatctaccaaaaaaaattcaccaacgccgtaatcctacaacaacacatccgcatacacataaacgaccaaatccccaacacgccgctaccgaaaaacttccaaaataccataaactccgaactaacctacgacgacaaaaacgcgaaaaccctaaacaactacgataacgacataaacgaaaactccataaaaaacgacgctaaactaaaaaacgcgaccaccgacccgaccaaaccactcctatcctacgcgaaatcctacccgccctccccgccctcgatcatctccaacattaccgccctaaaaaaccaaataaaaataatcgactcgatcataaactaccaacaactaaccgacctcaaatccgtaaaaaacgaatccgaaaaaaataaccgcctaaacaacgactcctcgtcgaccgtaaacgacctaaaaaaccgcaacgcgacaaccccgccctatccgaatcctcgtcctcgcaaaccctatcgccgacccccaacaataataaaaacttccgctccaaatccccgaacctaaacgccccgaaaaaaccccaaaaaatcccgctcaaaaccgaaaaaccgaacaacccaaccgccgcccc

SEQ ID NO: 36715 - DNA, 1405 bp, Artificial Sequence
  chemically treated genomic DNA (Homo sapiens) CpG-island No: 36715
  misc_feature (18)..(18): n is either a, c, g or t
  misc_feature (25)..(25): n is either a, c, g or t
  misc_feature (40)..(40): n is either a, c, g or t
  misc_feature (55)..(56): n is either a, c, g or t
ttagatgatttttttatntcgtttntcgagtatttgtatnaacgttttatttgtnntcggtattttttagcggtatgttttttttttttcgagaagttcgttattatttgtttcgtatagtttatttcgtgttgttttatcgttcgtacgttcgtgcgttgtatattgtcgtttattgtttttcgtcgcgttagtacgtttatttttttcgcgttattttagttagtcgtttttcgtagacgatttcgtcgtttttacgcgagtgcgtttttttttttttcgtttttaattatttttatttcggcgtgttgttatcgtcgagtttttatattcgtttttcgcggtcgttttttattaaagtcgagttcgttagtttgttttgtattaacgttagggtcggggacgttttcgtgggcgcgtaggttagcgtgtatttatatcggtggacggcgtatttacgagtttcggtagtttcggttgttcgtcgttttcgagtagtttaaggtttagttttcgttcggggggttgttagattcgatgtaaacgtcggaaatttcgaagttgtagtagttggtggagaatatcgataagaagatgacggattcgaattagtgcgttatttgttatcgggtgttgagttgttagagcgcgttgaagatgtattatcggacgtatacgggggagcggtcgtttaagtgtaagatttgcggtcgcgtttttattattaagggtaattttaagacgtatttcggcgtgtatcgtgtaaagtcgtttttgcgcgtgtagtatttttgttttatttgttagaagaagtttattaacgtcgtggttttgtagtagtatattcgtatgtatatgggcggttagatttttaatacgtcgttgtcggagggtttttaggatgttatggatttcgagttggtttacgacgataagaacgcggagattttgagtagttacgatgacgatatggacgagaattttatggaggacgacgttgagttgaaggacgcggttatcgattcggttaagttatttttgttttacgcggggttttgttcgtttttttcgttttcggttatttttagtattgtcgttttggagaattagatgaagatgatcgattcggttatgagttgttagtagttgatcggttttaagttcgtggagaacgggttcggggagagtgatcgtttgagtaacgatttttcgtcggtcgtgggcgatttggagagtcgtagcgcggtagtttcgttttgttcgagttttcgttttcgtaggttttgtcgtcggtttttagtaatggtgagagttttcgttttaagttttcgggtttgggcgtttcggaggagttttaggaaatttcgtttaagatcgagaggtcggatagtttagtcgtcgtttt

SEQ ID NO: 36716 - DNA, 1405 bp, Artificial Sequence
  chemically treated genomic DNA (Homo sapiens) CpG-island No: 36716
  misc_feature (1350)..(1351): n is either a, c, g or t
  misc_feature (1366)..(1366): n is either a, c, g or t
  misc_feature (1381)..(1381): n is either a, c, g or t
  misc_feature (1388)..(1388): n is either a, c, g or t
aaaacgacgactaaactatccgacctctcgatcttaaacgaaatttcctaaaactcctccgaaacgcccaaacccgaaaacttaaaacgaaaactctcaccattactaaaaaccgacgacaaaacctacgaaaacgaaaactcgaacaaaacgaaactaccgcgctacgactctccaaatcgcccacgaccgacgaaaaatcgttactcaaacgatcactctccccgaacccgttctccacgaacttaaaaccgatcaactactaacaactcataaccgaatcgatcatcttcatctaattctccaaaacgacaatactaaaaataaccgaaaacgaaaaaaacgaacaaaaccccgcgtaaaacaaaaataacttaaccgaatcgataaccgcgtccttcaactcaacgtcgtcctccataaaattctcgtccatatcgtcatcgtaactactcaaaatctccgcgttcttatcgtcgtaaaccaactcgaaatccataacatcctaaaaaccctccgacaacgacgtattaaaaatctaaccgcccatatacatacgaatatactactacaaaaccacgacgttaataaacttcttctaacaaataaaacaaaaatactacacgcgcaaaaacgactttacacgatacacgccgaaatacgtcttaaaattacccttaataataaaaacgcgaccgcaaatcttacacttaaacgaccgctcccccgtatacgtccgataatacatcttcaacgcgctctaacaactcaacacccgataacaaataacgcactaattcgaatccgtcatcttcttatcgatattctccaccaactactacaacttcgaaatttccgacgtttacatcgaatctaacaaccccccgaacgaaaactaaaccttaaactactcgaaaacgacgaacaaccgaaactaccgaaactcgtaaatacgccgtccaccgatataaatacacgctaacctacgcgcccacgaaaacgtccccgaccctaacgttaatacaaaacaaactaacgaactcgactttaataaaaaacgaccgcgaaaaacgaatataaaaactcgacgataacaacacgccgaaataaaaataattaaaaacgaaaaaaaaaaaaacgcactcgcgtaaaaacgacgaaatcgtctacgaaaaacgactaactaaaataacgcgaaaaaaataaacgtactaacgcgacgaaaaacaataaacgacaatatacaacgcacgaacgtacgaacgataaaacaacacgaaataaactatacgaaacaaataataacgaacttctcgaaaaaaaaaaaacataccgctaaaaaataccgannacaaataaaacgttnatacaaatactcganaaacganataaaaaaatcatctaa

SEQ ID NO: 36717 - DNA, 538 bp, Artificial Sequence
  chemically treated genomic DNA (Homo sapiens) CpG-island No: 36717
ataaacggttcggtcgggggggggcgttgcgatatagggggaggggtcggattaatagcgttttttcgtgtggttgcgttagcgtttgattttcgcggggagtcgcgtttattcgttcggttagtaagtcggttatcgttttttttaattttttataattaataaatttatcgtcgttttttttatcgcgcgcgcgttttttttgatttttgcgtagtcgttatcgggaaaaggcggggggaggggggaataggttttgcgcgaggtttattaggtcgcgttagagttagggtttcgcgtgaatgatcggtttggtatagtgaggtggtaggcgtttacgcgggattacgcgagatcgcggttcgtgattaggattcgagtcggttaagaagaagataaaagtggaaattgtagttatagtcgggggcgtaagggaaatttttaggtttatttgtaggcgcgaggcgattgaggggaaaaggggagcgggcgggaaggggaagggcgggaggtcgggggcggaataataggggcgggt

SEQ ID NO: 36718 - DNA, 538 bp, Artificial Sequence
  chemically treated genomic DNA (Homo sapiens) CpG-island No: 36718
acccgcccctattattccgcccccgacctcccgcccttccccttcccgcccgctccccttttcccctcaatcgcctcgcgcctacaaataaacctaaaaatttcccttacgcccccgactataactacaatttccacttttatcttcttcttaaccgactcgaatcctaatcacgaaccgcgatctcgcgtaatcccgcgtaaacgcctaccacctcactataccaaaccgatcattcacgcgaaaccctaactctaacgcgacctaataaacctcgcgcaaaacctattcccccctccccccgccttttcccgataacgactacgcaaaaatcaaaaaaaacgcgcgcgcgataaaaaaaacgacgataaatttattaattataaaaaattaaaaaaaacgataaccgacttactaaccgaacgaataaacgcgactccccgcgaaaatcaaacgctaacgcaaccacacgaaaaaacgctattaatccgacccctccccctatatcgcaacgcccccccccgaccgaaccgtttat

SEQ ID NO: 36719 - DNA, 538 bp, Artificial Sequence
  chemically treated genomic DNA (Homo sapiens) CpG-island No: 36719
gttcgtttttattgtttcgttttcggtttttcgtttttttttttttcgttcgttttttttttttttttagtcgtttcgcgtttgtaggtaagtttaaaaattttttttgcgttttcggttatggttataatttttatttttgttttttttttagtcggttcgggttttagttacgagtcgcggtttcgcgtagtttcgcgtgagcgtttattattttattgtgttaggtcggttatttacgcgaggttttggttttggcgcggtttagtaggtttcgcgtaaggtttattttttttttttttcgttttttttcggtggcggttgcgtaggagttagggagggcgcgcgcgcggtagggggggcggcggtggatttgttggttgtggggggttgggggaggcgatggtcggtttgttggtcgggcgggtgagcgcggtttttcgcgggggttaggcgttggcgtagttatacggggaggcgttattagttcggtttttttttttgtatcgtagcgttttttttcgatcgaatcgtttat

SEQ ID NO: 36720 - DNA, 538 bp, Artificial Sequence
  chemically treated genomic DNA (Homo sapiens) CpG-island No: 36720
ataaacgattcgatcgaaaaaaaacgctacgatacaaaaaaaaaaaccgaactaataacgcctccccgtataactacgccaacgcctaacccccgcgaaaaaccgcgctcacccgcccgaccaacaaaccgaccatcgcctcccccaaccccccacaaccaacaaatccaccgccgccccccctaccgcgcgcgcgccctccctaactcctacgcaaccgccaccgaaaaaaaacgaaaaaaaaaaaaaataaaccttacgcgaaacctactaaaccgcgccaaaaccaaaacctcgcgtaaataaccgacctaacacaataaaataataaacgctcacgcgaaactacgcgaaaccgcgactcgtaactaaaacccgaaccgactaaaaaaaaaacaaaaataaaaattataaccataaccgaaaacgcaaaaaaaatttttaaacttacctacaaacgcgaaacgactaaaaaaaaaaaaaaaacgaacgaaaaaaaaaaaaacgaaaaaccgaaaacgaaacaataaaaacgaac

SEQ ID NO: 36721 - DNA, 705 bp, Artificial Sequence
  chemically treated genomic DNA (Homo sapiens) CpG-island No: 36721
ttttcgtacggttttacgtttttcgttttgaaggaatcggtacgagacggtttatttaggtagttcgtagttcgtggtagtgtcggagttttgtttttttttatttattttttttttcgttttcgcgggcgttatcgtgattgtagtttttacgcgttttaatatatagtcgacgagttagggtcggggttaagttcggagtcgcggtcggtagggttcgtcgcggggtacgttgggatatggagtttttcgtttattttatttcgtgagtttttatttggaggggagttattcgttttataattttttgcgtgcgtggttcgttcgggtaggttgtatcgttttttgggaggagcgggtttttcgtcgtcgtttttcgagaaggtcgtatttttttgtttgtaatatcgtttcgttttttttttttcgcgttttttttttttcggttcgtgaagttgtggatatgcgtattagcggaggggaagtcgttgggtagggaggcggtaaggatttatttgggtacggagttttttggatcgcgagaaaattatagaatttaagagttcgcgcgttatttgtgtcgtagttggagaggtagggttaagtacgtacgagaagttttatggcgttattggttatttttattgcgattattttttttaggtgtattgagattggttatttcgattaaaggggcggagataa

SEQ ID NO: 36722 - DNA, 705 bp, Artificial Sequence
  chemically treated genomic DNA (Homo sapiens) CpG-island No: 36722
ttatctccgcccctttaatcgaaataaccaatctcaatacacctaaaaaaaataatcgcaataaaaataaccaataacgccataaaacttctcgtacgtacttaaccctacctctccaactacgacacaaataacgcgcgaactcttaaattctataattttctcgcgatccaaaaaactccgtacccaaataaatccttaccgcctccctacccaacgacttcccctccgctaatacgcatatccacaacttcacgaaccgaaaaaaaaaaaacgcgaaaaaaaaaaaacgaaacgatattacaaacaaaaaaatacgaccttctcgaaaaacgacgacgaaaaacccgctcctcccaaaaaacgatacaacctacccgaacgaaccacgcacgcaaaaaattataaaacgaataactcccctccaaataaaaactcacgaaataaaataaacgaaaaactccatatcccaacgtaccccgcgacgaaccctaccgaccgcgactccgaacttaaccccgaccctaactcgtcgactatatattaaaacgcgtaaaaactacaatcacgataacgcccgcgaaaacgaaaaaaaaaataaataaaaaaaaacaaaactccgacactaccacgaactacgaactacctaaataaaccgtctcgtaccgattccttcaaaacgaaaaacgtaaaaccgtacgaaaa

SEQ ID NO: 36723 - DNA, 705 bp, Artificial Sequence
  chemically treated genomic DNA (Homo sapiens) CpG-island No: 36723
ttgttttcgtttttttagtcgaagtaattaattttagtgtatttaggggaagtaatcgtaatgggagtaattaatgacgttatgaagtttttcgtgcgtgtttgattttgtttttttagttgcgatatagatggcgcgcgggtttttgggttttgtagttttttcgcgatttaaaaggtttcgtgtttaagtgagtttttatcgtttttttatttagcggtttttttttcgttagtacgtatgtttatagttttacggatcgggagagagggggcgcggaaggaaggaggcgggacggtattataaataaaaaaatacggttttttcgagaagcgacggcggagggttcgttttttttagaaggcggtgtagtttgttcgggcgagttacgtacgtagagggttgtggggcggatagtttttttttagatggaggtttacgaagtagggtgggcgggggattttatattttagcgtgtttcgcggcgggttttatcggtcgcgatttcgggtttggtttcggttttagttcgtcggttgtgtattggggcgcgtggaggttgtagttacggtggcgttcgcggggacggaggagggaatgagtgaagaggagtaaggtttcggtattattacgggttgcgggttgtttaggtgagtcgtttcgtatcgatttttttagggcgaaaagcgtggggtcgtgcggagg

SEQ ID NO: 36724 - DNA, 705 bp, Artificial Sequence
  chemically treated genomic DNA (Homo sapiens) CpG-island No: 36724
cctccgcacgaccccacgcttttcgccctaaaaaaatcgatacgaaacgactcacctaaacaacccgcaacccgtaataataccgaaaccttactcctcttcactcattccctcctccgtccccgcgaacgccaccgtaactacaacctccacgcgccccaatacacaaccgacgaactaaaaccgaaaccaaacccgaaatcgcgaccgataaaacccgccgcgaaacacgctaaaatataaaatcccccgcccaccctacttcgtaaacctccatctaaaaaaaaactatccgccccacaaccctctacgtacgtaactcgcccgaacaaactacaccgccttctaaaaaaaacgaaccctccgccgtcgcttctcgaaaaaaccgtatttttttatttataataccgtcccgcctccttccttccgcgccccctctctcccgatccgtaaaactataaacatacgtactaacgaaaaaaaaaccgctaaataaaaaaacgataaaaactcacttaaacacgaaaccttttaaatcgcgaaaaaactacaaaacccaaaaacccgcgcgccatctatatcgcaactaaaaaaacaaaatcaaacacgcacgaaaaacttcataacgtcattaattactcccattacgattacttcccctaaatacactaaaattaattacttcgactaaaaaaacgaaaacaa

SEQ ID NO: 36725 - DNA, 775 bp, Artificial Sequence
  chemically treated genomic DNA (Homo sapiens) CpG-island No: 36725
gtaattcgtcgtttgttagtagtcgttgtttcgttggtgtttacgttgttaaaggagtcgttttaggtttttgggaggtcgtttgtattgcgtggggaaggtttggacgacgtaatcgtttcgtcggttttcggggtggttagcgttttcggggtcgaagggtgcgcggggttgaaagtaggtcgtttcgtttcgttttttttttagattagtagaggtagtagtcggagtaatcgtagtttgggttttttttcgttcggtcgggtttcggatagatagatcggtatttcgagggtaaaaaatttcgttcgggaaagtttagcgtaaaacgcgttatattagtcgacggcgtagaagatttacgagaagatacgacgattaaaattttcgtcgatcgtaaagtacgtacgtcgcgatatattaattaatcgtatgtataggatcgaaacgaaattatcggtaggcgttaagagtttcgagatttacgttagcgatagtcgttcgtaaatatattttatagttttatatcgagataattatcgttttaacgaaagtacgagaagcgattatcgtagagatagtagcgacgttttatattcgatatatattacgcgaagacgttcgattgtgattatatatcgtaacgatagacgatcgatagcgtagatcgtattaaaagagttattttatcgattagttcgtcgttaagatttagtaacgcgatatattatacgaagcgtacgacgtacgtacgattatatatagatcgcgtcgt

SEQ ID NO: 36726 - DNA, 775 bp, Artificial Sequence
  chemically treated genomic DNA (Homo sapiens) CpG-island No: 36726
acgacgcgatctatatataatcgtacgtacgtcgtacgcttcgtataatatatcgcgttactaaatcttaacgacgaactaatcgataaaataactcttttaatacgatctacgctatcgatcgtctatcgttacgatatataatcacaatcgaacgtcttcgcgtaatatatatcgaatataaaacgtcgctactatctctacgataatcgcttctcgtactttcgttaaaacgataattatctcgatataaaactataaaatatatttacgaacgactatcgctaacgtaaatctcgaaactcttaacgcctaccgataatttcgtttcgatcctatacatacgattaattaatatatcgcgacgtacgtactttacgatcgacgaaaattttaatcgtcgtatcttctcgtaaatcttctacgccgtcgactaatataacgcgttttacgctaaactttcccgaacgaaattttttaccctcgaaataccgatctatctatccgaaacccgaccgaacgaaaaaaaacccaaactacgattactccgactactacctctactaatctaaaaaaaaaacgaaacgaaacgacctactttcaaccccgcgcacccttcgaccccgaaaacgctaaccaccccgaaaaccgacgaaacgattacgtcgtccaaaccttccccacgcaatacaaacgacctcccaaaaacctaaaacgactcctttaacaacgtaaacaccaacgaaacaacgactactaacaaacgacgaattac

SEQ ID NO: 36727 - DNA, 775 bp, Artificial Sequence
  chemically treated genomic DNA (Homo sapiens) CpG-island No: 36727
gcggcgcggtttgtgtgtggtcgtgcgtgcgtcgtgcgtttcgtgtggtgtgtcgcgttgttgggttttggcggcgggttggtcggtggagtggtttttttggtgcggtttacgttgtcgatcgtttgtcgttgcggtgtgtggttatagtcgggcgttttcgcgtagtgtgtgtcgggtgtagggcgtcgttgttgtttttgcggtggtcgtttttcgtgttttcgttgaggcggtggttgtttcgatgtgaggttgtggggtgtgtttgcgggcggttgtcgttggcgtgggtttcggggtttttggcgtttgtcggtggtttcgtttcggttttgtgtatgcggttggttggtgtgtcgcggcgtgcgtgttttgcggtcggcgggggttttggtcgtcgtgttttttcgtgggttttttgcgtcgtcggttagtgtggcgcgttttgcgttaggttttttcgggcggggttttttgttttcggagtgtcggtttgtttgttcggagttcggtcgggcgggagagggtttaggttgcggttgtttcggttgttgtttttgttggtttgggagggggacggggcggagcggtttgtttttaatttcgcgtatttttcgatttcggaagcgttaattatttcgggggtcggcgaggcgattgcgtcgtttaagttttttttacgtaatgtagacggttttttaaaagtttagagcggtttttttgatagcgtaggtattagcgagataacggttgttagtaagcgacgaattgt

SEQ ID NO: 36728 - DNA, 775 bp, Artificial Sequence
  chemically treated genomic DNA (Homo sapiens) CpG-island No: 36728
acaattcgtcgcttactaacaaccgttatctcgctaatacctacgctatcaaaaaaaccgctctaaacttttaaaaaaccgtctacattacgtaaaaaaaacttaaacgacgcaatcgcctcgccgacccccgaaataattaacgcttccgaaatcgaaaaatacgcgaaattaaaaacaaaccgctccgccccgtccccctcccaaaccaacaaaaacaacaaccgaaacaaccgcaacctaaaccctctcccgcccgaccgaactccgaacaaacaaaccgacactccgaaaacaaaaaaccccgcccgaaaaaacctaacgcaaaacgcgccacactaaccgacgacgcaaaaaacccacgaaaaaacacgacgaccaaaacccccgccgaccgcaaaacacgcacgccgcgacacaccaaccaaccgcatacacaaaaccgaaacgaaaccaccgacaaacgccaaaaaccccgaaacccacgccaacgacaaccgcccgcaaacacaccccacaacctcacatcgaaacaaccaccgcctcaacgaaaacacgaaaaacgaccaccgcaaaaacaacaacgacgccctacacccgacacacactacgcgaaaacgcccgactataaccacacaccgcaacgacaaacgatcgacaacgtaaaccgcaccaaaaaaaccactccaccgaccaacccgccgccaaaacccaacaacgcgacacaccacacgaaacgcacgacgcacgcacgaccacacacaaaccgcgccgc

SEQ ID NO: 36729 - DNA, 556 bp, Artificial Sequence
  chemically treated genomic DNA (Homo sapiens) CpG-island No: 36729
gataagcggtcgtcgttagggggcgtcgttatttttttgttaggcgattattcgcggaggcgcgcgcgttaggttttttatcgcgtttgcgttgaggatggatattagttcgttttttttcgacgtttagtcgttcgggtcggggtgaaaaattgcgtgatacgtagtgagcgtggcggttattttcgttttttgggtacgttagttgagtcggttagggttgaagaggagcgttgcgtaagcgtatttaagacggttataggtaatttttatttgacgagcgaggcgtcgtcgtcgtcgtcggaagtttggtgtttgcgtcgcgggggaggcggcggtcgtagtagaagtagttgagtgttttttgatattcggatgtgaggcgattcgttggcgttagtttgatttttcgttaggtaaaaggaaggtacgcgagcgtttttgacggttttcgtcgtttgtgtttttattttttttttgttagtttttttagggagcggatagttttttttttttttgttttattttcggtggcgtgttgtttcgtacgtttttt

SEQ ID NO: 36730 - DNA, 556 bp, Artificial Sequence
  chemically treated genomic DNA (Homo sapiens) CpG-island No: 36730
aaaaaacgtacgaaacaacacgccaccgaaaataaaacaaaaaaaaaaaaaactatccgctccctaaaaaaactaacaaaaaaaaaataaaaacacaaacgacgaaaaccgtcaaaaacgctcgcgtaccttccttttacctaacgaaaaatcaaactaacgccaacgaatcgcctcacatccgaatatcaaaaaacactcaactacttctactacgaccgccgcctcccccgcgacgcaaacaccaaacttccgacgacgacgacgacgcctcgctcgtcaaataaaaattacctataaccgtcttaaatacgcttacgcaacgctcctcttcaaccctaaccgactcaactaacgtacccaaaaaacgaaaataaccgccacgctcactacgtatcacgcaatttttcaccccgacccgaacgactaaacgtcgaaaaaaaacgaactaatatccatcctcaacgcaaacgcgataaaaaacctaacgcgcgcgcctccgcgaataatcgcctaacaaaaaaataacgacgccccctaacgacgaccgcttatc

SEQ ID NO: 36731 - DNA, 556 bp, Artificial Sequence
  chemically treated genomic DNA (Homo sapiens) CpG-island No: 36731
aaggggcgtgcgaggtaatacgttatcgagggtggaataggaagagggagaattgttcgttttttgaaggggttggtaaaagagaggtgaagatataggcggcggggatcgttagggacgttcgcgtattttttttttgtttggcggagggttagattagcgttagcggatcgttttatattcgggtattaggagatatttagttgtttttgttgcggtcgtcgtttttttcgcggcgtaaatattaaattttcggcgacgacggcgacgtttcgttcgttagatgggagttatttgtgatcgttttgggtgcgtttgcgtaacgtttttttttagttttaatcggtttagttgacgtgtttagaagacgaagatggtcgttacgtttattgcgtgttacgtagttttttatttcggttcggacggttgggcgtcgaggaaaggcgagttagtgtttatttttagcgtaggcgcggtgggaggtttagcgcgcgcgttttcgcgggtggtcgtttggtagggaagtggcggcgttttttagcggcggtcgtttgtt

SEQ ID NO: 36732 - DNA, 556 bp, Artificial Sequence
  chemically treated genomic DNA (Homo sapiens) CpG-island No: 36732
aacaaacgaccgccgctaaaaaacgccgccacttccctaccaaacgaccacccgcgaaaacgcgcgcgctaaacctcccaccgcgcctacgctaaaaataaacactaactcgcctttcctcgacgcccaaccgtccgaaccgaaataaaaaactacgtaacacgcaataaacgtaacgaccatcttcgtcttctaaacacgtcaactaaaccgattaaaactaaaaaaaaacgttacgcaaacgcacccaaaacgatcacaaataactcccatctaacgaacgaaacgtcgccgtcgtcgccgaaaatttaatatttacgccgcgaaaaaaacgacgaccgcaacaaaaacaactaaatatctcctaatacccgaatataaaacgatccgctaacgctaatctaaccctccgccaaacaaaaaaaaaatacgcgaacgtccctaacgatccccgccgcctatatcttcacctctcttttaccaaccccttcaaaaaacgaacaattctccctcttcctattccaccctcgataacgtattacctcgcacgcccctt

SEQ ID NO: 36733 - DNA, 657 bp, Artificial Sequence
  chemically treated genomic DNA (Homo sapiens) CpG-island No: 36733
cgggatttcggggtcgcgggcgcgtttcggggttcgggcgagtggatatattttatcgttcgggttagtcgttcgtttttttcgtcggtcggggatcgcgtttttatttgttttcgttttcgttttcgtattttcggggtcgcgcgtttcgtttagcgattcgtttttcggggtttcgtcgcgcggtcgtcgtagtcgtattcgtacgttagttcgggtcgcggcgcgtttatggggttcgtacgttttattttttgtttttaaaaattcggttcgtagattatttttttgggtagagttcggcggtggcgacggcgaggggcgaggtttggaggtgggatcggtcggcgaggagcgtcgtataaagaagtttcgtgggggcggggggtggtaggaggacggatagatcgtcggatcgacgcgggacgcgcggtcggagtagcggggcggtcgggtttaggcgtttttttttttgagtcgggcgggcggattcggggaggcggcggcggttcgtgattttagagagttggaatgcgggtagtcgcgcgggggaggcgcggatagttgcgttcggtcgtcggggagggggcgcgtcgttgttttttttaatcgtatgattatttattttaagagtttttaaataaagtaaggttttta

SEQ ID NO: 36734 - DNA, 657 bp, Artificial Sequence
  chemically treated genomic DNA (Homo sapiens) CpG-island No: 36734
taaaaaccttactttatttaaaaactcttaaaataaataatcatacgattaaaaaaaacaacgacgcgccccctccccgacgaccgaacgcaactatccgcgcctcccccgcgcgactacccgcattccaactctctaaaatcacgaaccgccgccgcctccccgaatccgcccgcccgactcaaaaaaaaaaacgcctaaacccgaccgccccgctactccgaccgcgcgtcccgcgtcgatccgacgatctatccgtcctcctaccaccccccgcccccacgaaacttctttatacgacgctcctcgccgaccgatcccacctccaaacctcgcccctcgccgtcgccaccgccgaactctacccaaaaaaataatctacgaaccgaatttttaaaaacaaaaaataaaacgtacgaaccccataaacgcgccgcgacccgaactaacgtacgaatacgactacgacgaccgcgcgacgaaaccccgaaaaacgaatcgctaaacgaaacgcgcgaccccgaaaatacgaaaacgaaaacgaaaacaaataaaaacgcgatccccgaccgacgaaaaaaacgaacgactaacccgaacgataaaatatatccactcgcccgaaccccgaaacgcgcccgcgaccccgaaatcccg

SEQ ID NO: 36735 - DNA, 657 bp, Artificial Sequence
  chemically treated genomic DNA (Homo sapiens) CpG-island No: 36735
taaaagttttgttttatttggaaatttttaaaataagtggttatacgattaaaaaaagtagcggcgcgtttttttttcggcggtcgggcgtagttgttcgcgtttttttcgcgcggttgttcgtattttaattttttgaggttacgggtcgtcgtcgttttttcggattcgttcgttcggtttagggggagggacgtttgggttcggtcgtttcgttgtttcggtcgcgcgtttcgcgtcggttcgacggtttgttcgtttttttgttatttttcgtttttacggggtttttttgtgcggcgtttttcgtcggtcggttttatttttaggtttcgtttttcgtcgtcgttatcgtcggattttgtttaggggaatggtttgcgagtcgggtttttggagataggaagtgaggcgtgcgagttttatgagcgcgtcgcggttcgggttggcgtgcgggtgcggttgcggcggtcgcgcggcggggtttcgggaggcgggtcgttgagcggggcgcgcggtttcgaggatgcgggagcgggagcgggagtaggtgagggcgcggttttcggtcggcgggaggggcgggcggttggttcgagcggtggggtgtgtttattcgttcggatttcggagcgcgttcgcggtttcggaatttcg

SEQ ID NO: 36736 - DNA, 657 bp, Artificial Sequence
  chemically treated genomic DNA (Homo sapiens) CpG-island No: 36736
cgaaattccgaaaccgcgaacgcgctccgaaatccgaacgaataaacacaccccaccgctcgaaccaaccgcccgcccctcccgccgaccgaaaaccgcgccctcacctactcccgctcccgctcccgcatcctcgaaaccgcgcgccccgctcaacgacccgcctcccgaaaccccgccgcgcgaccgccgcaaccgcacccgcacgccaacccgaaccgcgacgcgctcataaaactcgcacgcctcacttcctatctccaaaaacccgactcgcaaaccattcccctaaacaaaatccgacgataacgacgacgaaaaacgaaacctaaaaataaaaccgaccgacgaaaaacgccgcacaaaaaaaccccgtaaaaacgaaaaataacaaaaaaacgaacaaaccgtcgaaccgacgcgaaacgcgcgaccgaaacaacgaaacgaccgaacccaaacgtccctccccctaaaccgaacgaacgaatccgaaaaaacgacgacgacccgtaacctcaaaaaattaaaatacgaacaaccgcgcgaaaaaaacgcgaacaactacgcccgaccgccgaaaaaaaaacgcgccgctactttttttaatcgtataaccacttattttaaaaatttccaaataaaacaaaactttta

SEQ ID NO: 36737 - DNA, 699 bp, Artificial Sequence
  chemically treated genomic DNA (Homo sapiens) CpG-island No: 36737
ggagttgtaagattattcgtacgcgtacgtcgtcgttttttttgtttgagtataggtttcgcgggtagaaggcgtgcgtaggcgcggatacgggcgtatgcgcgtttatttcggcgcgtagtgtcggtcggggcggggatacgtcgtgtgcgcggtcgggggcggaacggaggaggaggcggtggtgtttcggttgcggggtaggagttcgcggtagttttcgggtaagttaagcgtcgcgtagtgttgagttttcgtacgtcgtagagttatggagatcggtatcgagattagtcgtaagattcgggtgaggttcgtgtcggtcgggggtgggaagttaggtttcggcgagcgggcggttgttaggagtaacggggattgtgggttcgggtggacgtcgcggtttggttttcgttggacgtttttggcgggttgcggttttttttcgtttaggtcgtttcggttttggggatatttgcggtttcggagcgtggttgcggttgaagtagtcgtcgggaaatggaaggataggcgtaggttcggttggagttattatcgcggcgtacggcgtcgttttggattcgttgcgggaggtgggcgtcgcggggttggggttggagttggagtggggtgcggggtggggggcggtgtaggcgaggttttttttagttttcgttcgggggattcgaggtgcgcgta

SEQ ID NO: 36738 - DNA, 699 bp, Artificial Sequence
  chemically treated genomic DNA (Homo sapiens) CpG-island No: 36738
tacgcgcacctcgaatcccccgaacgaaaactaaaaaaaacctcgcctacaccgccccccaccccgcaccccactccaactccaaccccaaccccgcgacgcccacctcccgcaacgaatccaaaacgacgccgtacgccgcgataataactccaaccgaacctacgcctatccttccatttcccgacgactacttcaaccgcaaccacgctccgaaaccgcaaatatccccaaaaccgaaacgacctaaacgaaaaaaaaccgcaacccgccaaaaacgtccaacgaaaaccaaaccgcgacgtccacccgaacccacaatccccgttactcctaacaaccgcccgctcgccgaaacctaacttcccacccccgaccgacacgaacctcacccgaatcttacgactaatctcgataccgatctccataactctacgacgtacgaaaactcaacactacgcgacgcttaacttacccgaaaactaccgcgaactcctaccccgcaaccgaaacaccaccgcctcctcctccgttccgcccccgaccgcgcacacgacgtatccccgccccgaccgacactacgcgccgaaataaacgcgcatacgcccgtatccgcgcctacgcacgccttctacccgcgaaacctatactcaaacaaaaaaaacgacgacgtacgcgtacgaataatcttacaactcc

SEQ ID NO: 36739 - DNA, 699 bp, Artificial Sequence
  chemically treated genomic DNA (Homo sapiens) CpG-island No: 36739
tgcgcgtatttcggatttttcgggcgggggttgggaggagtttcgtttgtatcgttttttatttcgtattttattttagttttagttttagtttcgcggcgtttatttttcgtagcggatttaaagcggcgtcgtgcgtcgcggtggtggttttagtcgggtttgcgtttgtttttttatttttcggcggttattttagtcgtagttacgtttcgaggtcgtaaatgtttttagggtcgaggcggtttggacgaggaggagtcgtagttcgttaggagcgtttagcggaggttaggtcgcggcgtttattcgggtttatagttttcgttatttttgataatcgttcgttcgtcgagatttggttttttattttcgatcggtacgggttttattcggattttgcggttgatttcggtgtcgatttttatggttttgcggcgtgcgggaatttagtattgcgcggcgtttggtttattcggaggttgtcgcggatttttatttcgtagtcgggatattatcgttttttttttcgtttcgttttcggtcgcgtatacggcgtattttcgtttcggtcggtattgcgcgtcggagtgaacgcgtatgcgttcgtgttcgcgtttgcgtacgttttttattcgcgaaatttgtgtttaggtaaggagggcggcggcgtgcgcgtgcgggtggttttgtagtttt

SEQ ID NO: 36740 - DNA, 699 bp, Artificial Sequence
  chemically treated genomic DNA (Homo sapiens) CpG-island No: 36740
aaaactacaaaaccacccgcacgcgcacgccgccgccctccttacctaaacacaaatttcgcgaataaaaaacgtacgcaaacgcgaacacgaacgcatacgcgttcactccgacgcgcaataccgaccgaaacgaaaatacgccgtatacgcgaccgaaaacgaaacgaaaaaaaaaacgataatatcccgactacgaaataaaaatccgcgacaacctccgaataaaccaaacgccgcgcaatactaaattcccgcacgccgcaaaaccataaaaatcgacaccgaaatcaaccgcaaaatccgaataaaacccgtaccgatcgaaaataaaaaaccaaatctcgacgaacgaacgattatcaaaaataacgaaaactataaacccgaataaacgccgcgacctaacctccgctaaacgctcctaacgaactacgactcctcctcgtccaaaccgcctcgaccctaaaaacatttacgacctcgaaacgtaactacgactaaaataaccgccgaaaaataaaaaaacaaacgcaaacccgactaaaaccaccaccgcgacgcacgacgccgctttaaatccgctacgaaaaataaacgccgcgaaactaaaactaaaactaaaataaaatacgaaataaaaaacgatacaaacgaaactcctcccaacccccgcccgaaaaatccgaaatacgcgca

SEQ ID NO: 36741 - DNA, 563 bp, Artificial Sequence
  chemically treated genomic DNA (Homo sapiens) CpG-island No: 36741
cgttttttggtattttcgttagtttcgtttcgtcggtaacgagtttggtttagtttattgtcgtatcgaggacgttgttgttgtattggttgtttagtttagaaagacgggtcgtaatttcgtcgtaacgttgttgtttttttttcggtagatttatgttagagagtttaaagtcgcgtagtgcgttattaatcgtttttttttgcgtcgtgtttagcgtggcgtaatgatcgttatcgcgtaggtcgcgatacgttttatatagttttttatgttgttttatttaggtgttgtatttcgatagtagcggtagggtttgttcgtaggttttacgtagtttcgggttattttttatcgagtttaggtggttgatcggggagaagatacgttttaatatatcgtttattttcgttagcggttggtagagatttttttaggtgtacggtgttttttgcgttattacgcgttttacgttttcgcggtagtcgtttaatgttttagttacggttggaacgatatgtttcgggagaattttagaaaacggaggtaatttaaagggagtt

SEQ ID NO: 36742 - DNA, 563 bp, Artificial Sequence
  chemically treated genomic DNA (Homo sapiens) CpG-island No: 36742
aactccctttaaattacctccgttttctaaaattctcccgaaacatatcgttccaaccgtaactaaaacattaaacgactaccgcgaaaacgtaaaacgcgtaataacgcaaaaaacaccgtacacctaaaaaaatctctaccaaccgctaacgaaaataaacgatatattaaaacgtatcttctccccgatcaaccacctaaactcgataaaaaataacccgaaactacgtaaaacctacgaacaaaccctaccgctactatcgaaatacaacacctaaataaaacaacataaaaaactatataaaacgtatcgcgacctacgcgataacgatcattacgccacgctaaacacgacgcaaaaaaaaacgattaataacgcactacgcgactttaaactctctaacataaatctaccgaaaaaaaaacaacaacgttacgacgaaattacgacccgtctttctaaactaaacaaccaatacaacaacaacgtcctcgatacgacaataaactaaaccaaactcgttaccgacgaaacgaaactaacgaaaataccaaaaaacg

SEQ ID NO: 36743 - DNA, 563 bp, Artificial Sequence
  chemically treated genomic DNA (Homo sapiens) CpG-island No: 36743
gattttttttgaattgttttcgttttttaaaattttttcggaatatgtcgttttagtcgtgattaaggtattgaacgattgtcgcgaaaacgtggagcgcgtagtagcgtaaggggtatcgtatatttgggaaaatttttgttagtcgttggcggaagtggacgatgtgttggggcgtatttttttttcggttagttatttgaattcggtgaaaaatagttcggaattgcgtgaagtttacgaataaattttgtcgttgttgtcggaatatagtatttgggtagggtaatatgaagggttgtataaagcgtatcgcgatttgcgcgatggcgattattacgttacgttgaatacggcgtagaagaaagcggttgataacgtattgcgcgattttgaattttttggtataggtttgtcgaaagagaaatagtagcgttacggcgaaattgcgattcgtttttttgaattgggtaattagtatagtaataacgttttcgatgcgataatgggttggattaaattcgttatcgacgaagcggagttggcggggatgttagaaagcg

SEQ ID NO: 36744 - DNA, 563 bp, Artificial Sequence
  chemically treated genomic DNA (Homo sapiens) CpG-island No: 36744
cgctttctaacatccccgccaactccgcttcgtcgataacgaatttaatccaacccattatcgcatcgaaaacgttattactatactaattacccaattcaaaaaaacgaatcgcaatttcgccgtaacgctactatttctctttcgacaaacctataccaaaaaattcaaaatcgcgcaatacgttatcaaccgctttcttctacgccgtattcaacgtaacgtaataatcgccatcgcgcaaatcgcgatacgctttatacaacccttcatattaccctacccaaatactatattccgacaacaacgacaaaatttattcgtaaacttcacgcaattccgaactatttttcaccgaattcaaataactaaccgaaaaaaaaatacgccccaacacatcgtccacttccgccaacgactaacaaaaattttcccaaatatacgataccccttacgctactacgcgctccacgttttcgcgacaatcgttcaataccttaatcacgactaaaacgacatattccgaaaaaattttaaaaaacgaaaacaattcaaaaaaaatc

SEQ ID NO: 36745 - DNA, 829 bp, Artificial Sequence
  chemically treated genomic DNA (Homo sapiens) CpG-island No: 36745
tcgcgcgcggattttcggtagagttttttcggtcgtattttcgacgttttttcgcgtttagtttaggtgtcgatcgttttatttcggtttttgtttttggtttttttggttttgtttttcgtttttttggttcggggggcggtcggttcggcgttttcggttttcgtcgttttttttttgcgtcgtttgtttcgtagttagttgaaggcgcggcggaggtcggacgcgtcggagcgggatttttttttgcgcggggggtcgttcgggtttttcggtttttcggtcgtaggtgcggcggggggcgcgcgggtcgttatggtaggcgggggcggagcgggcggcgggttaggttttttgcggcgcggtgtttatgtcggggggcggtcgtcggggacgcgcgttcggagaaaagtttgggcggcggaggtcgagcgggcgcggagagcggacggcgggagcggcgcgggaggggtcggtcgagcggcgggcggggcgtaggtcggcggggagggaaggagcggggcgggagcggtcgtagggcgggagcgtcgttgtttgcggttttttttcgtttttttcggtttcggcggagggcgaggtttagtttcgagaggagggggtttcgggagttcggggtcgtgtttttcgttggggttcgagagggcgggtcgtggggtcgttcgggagggggcggtattgaggtttcgtttcgtagggggtatcgcgggagatttgttcggaagagggtggtatggggtggggacggaaaggggaagggcgtaggaaaggaggagcgagaggttggggttggattttaggagatttggta

SEQ ID NO: 36746 - DNA, 829 bp, Artificial Sequence
  chemically treated genomic DNA (Homo sapiens) CpG-island No: 36746
taccaaatctcctaaaatccaaccccaacctctcgctcctcctttcctacgcccttcccctttccgtccccaccccataccaccctcttccgaacaaatctcccgcgataccccctacgaaacgaaacctcaataccgccccctcccgaacgaccccacgacccgccctctcgaaccccaacgaaaaacacgaccccgaactcccgaaaccccctcctctcgaaactaaacctcgccctccgccgaaaccgaaaaaaacgaaaaaaaaccgcaaacaacgacgctcccgccctacgaccgctcccgccccgctccttccctccccgccgacctacgccccgcccgccgctcgaccgacccctcccgcgccgctcccgccgtccgctctccgcgcccgctcgacctccgccgcccaaacttttctccgaacgcgcgtccccgacgaccgccccccgacataaacaccgcgccgcaaaaaacctaacccgccgcccgctccgcccccgcctaccataacgacccgcgcgccccccgccgcacctacgaccgaaaaaccgaaaaacccgaacgaccccccgcgcaaaaaaaaatcccgctccgacgcgtccgacctccgccgcgccttcaactaactacgaaacaaacgacgcaaaaaaaaaacgacgaaaaccgaaaacgccgaaccgaccgccccccgaaccaaaaaaacgaaaaacaaaaccaaaaaaaccaaaaacaaaaaccgaaataaaacgatcgacacctaaactaaacgcgaaaaaacgtcgaaaatacgaccgaaaaaactctaccgaaaatccgcgcgcga

SEQ ID NO: 36747 - DNA, 829 bp, Artificial Sequence
  chemically treated genomic DNA (Homo sapiens) CpG-island No: 36747
tattaagttttttggggtttaattttagtttttcgtttttttttttttgcgtttttttttttttcgtttttattttatattattttttttcgaatagatttttcgcggtgttttttgcgggacggaattttagtgtcgttttttttcgggcggttttacgattcgttttttcgggttttagcggggggtacgatttcgggttttcgggatttttttttttcgggattggatttcgtttttcgtcgggatcgggggaggcggggaggggtcgtaggtagcggcgttttcgttttgcggtcgttttcgtttcgtttttttttttttcgtcggtttgcgtttcgttcgtcgttcggtcggtttttttcgcgtcgttttcgtcgttcgtttttcgcgttcgttcggttttcgtcgtttaaattttttttcgggcgcgcgttttcggcggtcgtttttcggtatgggtatcgcgtcgtagggggtttgattcgtcgttcgtttcgttttcgtttgttatggcggttcgcgcgtttttcgtcgtatttgcggtcgaggagtcggggaattcgggcggtttttcgcgtaggaagaagtttcgtttcggcgcgttcggttttcgtcgcgtttttagttggttgcggggtaagcggcgtaagaagaaggcggcgggggtcgagggcgtcgaatcggtcgtttttcgggttaagaaggcggaggataaggttaagagggttaagggtaaaggtcgaggtaaggcggtcggtatttgggttgagcgcgggggggcgtcgagggtgcggtcgagggggttttgtcgggggttcgcgcgcgg

SEQ ID NO: 36748 - DNA, 829 bp, Artificial Sequence
  chemically treated genomic DNA (Homo sapiens) CpG-island No: 36748
ccgcgcgcgaacccccgacaaaaccccctcgaccgcaccctcgacgcccccccgcgctcaacccaaataccgaccgccttacctcgacctttacccttaaccctcttaaccttatcctccgccttcttaacccgaaaaacgaccgattcgacgccctcgacccccgccgccttcttcttacgccgcttaccccgcaaccaactaaaaacgcgacgaaaaccgaacgcgccgaaacgaaacttcttcctacgcgaaaaaccgcccgaattccccgactcctcgaccgcaaatacgacgaaaaacgcgcgaaccgccataacaaacgaaaacgaaacgaacgacgaatcaaaccccctacgacgcgatacccataccgaaaaacgaccgccgaaaacgcgcgcccgaaaaaaaatttaaacgacgaaaaccgaacgaacgcgaaaaacgaacgacgaaaacgacgcgaaaaaaaccgaccgaacgacgaacgaaacgcaaaccgacgaaaaaaaaaaaaacgaaacgaaaacgaccgcaaaacgaaaacgccgctacctacgacccctccccgcctcccccgatcccgacgaaaaacgaaatccaatcccgaaaaaaaaaaatcccgaaaacccgaaatcgtaccccccgctaaaacccgaaaaaacgaatcgtaaaaccgcccgaaaaaaaacgacactaaaattccgtcccgcaaaaaacaccgcgaaaaatctattcgaaaaaaaataatataaaataaaaacgaaaaaaaaaaaaacgcaaaaaaaaaaaaacgaaaaactaaaattaaaccccaaaaaacttaata

SEQ ID NO: 36749 - DNA, 969 bp, Artificial Sequence
  chemically treated genomic DNA (Homo sapiens) CpG-island No: 36749
ttttttcgcggggtcgtttcgtagtatcgattggttcgcgtcgtatcgttcgtttcgttgttttcgttcgcggttgtcgcgaaaattcggcggttatattcgcgttttcgcgtcgttcggcgagtcgtattgggtatgttcggtttcggtcggtttaggtttttgtaggtgggaagtttcgcgttttcggtagtcggcggcgtagttcgtaacgttgtgaggcgtcggcggaggcggttcgttcgtagtaggcgttatcgggcgttcggcgtagagtgcggcgtatcgttcgttgtcgggttggttatggcgaggggtgttacggcggtttatttgagtggcgcggcggtgttaggttaggcgggggttttcggcgggtcggggcggaggggtacgggtgggagttagtttcgtatcgggtcggcggtcgagtcggcgtcggggtcgtcgaattttcgggtgtttgggttggttgagattgcggcggaggttgcgttgcgagacgtcgtagggttcgggtagcgggttttagggggtcgtaggatgtttcgagattcgtgcggggcgggggttggtcgtttggggattgtcgtatttcgggttcgaatcgtaatttttcgagggcgaggagcgcggaatttattgttagttgtcggcgagttttttaggtgtcgtgggggaaggggacgtcgaatagtcgtgggggttttcgttgggttttggattttttttatcgttgtgttttagtttattcggatagggaggagcgtgcgttggttagggtttcggagaacgtgaatgcgggtttcgcgtcgggagggcgtcgtgttttgatgtcgtaggagtgcgggcggttgtgggtgttgcgagtcgtcgtttcgttattgaagttttcggagtttgtcgtatttgattttataataagttgatatcgaattgttttatggcgtggaatggggaaacgtgttt

SEQ ID NO: 36750 - DNA, 969 bp, Artificial Sequence
  chemically treated genomic DNA (Homo sapiens) CpG-island No: 36750
aaacacgtttccccattccacgccataaaacaattcgatatcaacttattataaaatcaaatacgacaaactccgaaaacttcaataacgaaacgacgactcgcaacacccacaaccgcccgcactcctacgacatcaaaacacgacgccctcccgacgcgaaacccgcattcacgttctccgaaaccctaaccaacgcacgctcctccctatccgaataaactaaaacacaacgataaaaaaaatccaaaacccaacgaaaacccccacgactattcgacgtccccttcccccacgacacctaaaaaactcgccgacaactaacaataaattccgcgctcctcgccctcgaaaaattacgattcgaacccgaaatacgacaatccccaaacgaccaacccccgccccgcacgaatctcgaaacatcctacgaccccctaaaacccgctacccgaaccctacgacgtctcgcaacgcaacctccgccgcaatctcaaccaacccaaacacccgaaaattcgacgaccccgacgccgactcgaccgccgacccgatacgaaactaactcccacccgtacccctccgccccgacccgccgaaaacccccgcctaacctaacaccgccgcgccactcaaataaaccgccgtaacacccctcgccataaccaacccgacaacgaacgatacgccgcactctacgccgaacgcccgataacgcctactacgaacgaaccgcctccgccgacgcctcacaacgttacgaactacgccgccgactaccgaaaacgcgaaacttcccacctacaaaaacctaaaccgaccgaaaccgaacatacccaatacgactcgccgaacgacgcgaaaacgcgaatataaccgccgaattttcgcgacaaccgcgaacgaaaacaacgaaacgaacgatacgacgcgaaccaatcgatactacgaaacgaccccgcgaaaaaa

SEQ ID NO: 36751 - DNA, 969 bp, Artificial Sequence
  chemically treated genomic DNA (Homo sapiens) CpG-island No: 36751
aagtacgtttttttattttacgttatgaagtaattcgatgttaatttgttatggagttaaatgcgataaatttcgagagttttagtagcgaggcggcggttcgtagtatttatagtcgttcgtatttttgcggtattaggatacggcgttttttcgacgcggaattcgtatttacgtttttcggagttttggttagcgtacgtttttttttgttcgggtaaattgaggtatagcgatgagagagatttagagtttagcgaaagtttttacggttgttcggcgttttttttttttacgatatttaggaggttcgtcggtagttggtagtggatttcgcgtttttcgttttcggaaggttacggttcgagttcgggatgcggtagtttttaaacggttagttttcgtttcgtacggatttcgaagtattttgcgattttttggagttcgttgttcggattttgcggcgtttcgtagcgtagttttcgtcgtagttttagttagtttaaatattcgaaagttcggcggtttcggcgtcgattcggtcgtcgattcggtgcggggttggtttttattcgtgttttttcgtttcggttcgtcgggggttttcgtttaatttgatatcgtcgcgttatttaggtgggtcgtcgtggtatttttcgttatggttagttcgatagcgggcggtgcgtcgtattttgcgtcggacgttcggtagcgtttattgcgggcgagtcgttttcgtcggcgttttatagcgttgcgagttgcgtcgtcggttgtcgggagcgcggagttttttatttataggagtttgggtcggtcggggtcgagtatgtttagtgcggttcgtcgggcggcgcggaggcgcgggtgtagtcgtcgggttttcgcggtagtcgcgggcgggggtagcggggcgggcggtgcggcgcgagttagtcggtgttgcggagcggtttcgcggaggag

SEQ ID NO: 36752 - DNA, 969 bp, Artificial Sequence
  chemically treated genomic DNA (Homo sapiens) CpG-island No: 36752
ctcctccgcgaaaccgctccgcaacaccgactaactcgcgccgcaccgcccgccccgctacccccgcccgcgactaccgcgaaaacccgacgactacacccgcgcctccgcgccgcccgacgaaccgcactaaacatactcgaccccgaccgacccaaactcctataaataaaaaactccgcgctcccgacaaccgacgacgcaactcgcaacgctataaaacgccgacgaaaacgactcgcccgcaataaacgctaccgaacgtccgacgcaaaatacgacgcaccgcccgctatcgaactaaccataacgaaaaataccacgacgacccacctaaataacgcgacgatatcaaattaaacgaaaacccccgacgaaccgaaacgaaaaaacacgaataaaaaccaaccccgcaccgaatcgacgaccgaatcgacgccgaaaccgccgaactttcgaatatttaaactaactaaaactacgacgaaaactacgctacgaaacgccgcaaaatccgaacaacgaactccaaaaaatcgcaaaatacttcgaaatccgtacgaaacgaaaactaaccgtttaaaaactaccgcatcccgaactcgaaccgtaaccttccgaaaacgaaaaacgcgaaatccactaccaactaccgacgaacctcctaaatatcgtaaaaaaaaaaaacgccgaacaaccgtaaaaactttcgctaaactctaaatctctctcatcgctatacctcaatttacccgaacaaaaaaaaacgtacgctaaccaaaactccgaaaaacgtaaatacgaattccgcgtcgaaaaaacgccgtatcctaataccgcaaaaatacgaacgactataaatactacgaaccgccgcctcgctactaaaactctcgaaatttatcgcatttaactccataacaaattaacatcgaattacttcataacgtaaaataaaaaaacgtactt

SEQ ID NO: 36753 - DNA, 578 bp, Artificial Sequence
  chemically treated genomic DNA (Homo sapiens) CpG-island No: 36753
gcgttttacgttttcggaggcgggttcgagagtcggcgagaatcggaggtcgggcgaaagagtgttcggtgcggggggcgggttaggttagtggggcgggcgtcgtcgagcgttgggcgtggcggacgcggcggggtttagatgcggttatacgtaggggggcggggtcgcggcgggagaggcggggttttattgggcggtagtttcgggaggggcggaattgcggtgggaggggcggggttttattgggcgatcgtagtggacgagaatttagattggaatcggttcgaagaaaaaaaggtagtttttattgggttgtcgtttggaataggagattaggtcgggagaaagggaggggcgtgtttaacgtattgtattatttatcgaaattcggacggtagcgggagaggcgcggtcgagaaggtagaggtttggttgggttgttatttcgagtcggggcggtatgtggttgggttttttaatcgcgagcggtcggggtaggggaaaggaatacgtttttttatattttttttttttattttttaaagattagaatttaattttttggttatttttag

SEQ ID NO: 36754 - DNA, 578 bp, Artificial Sequence
  chemically treated genomic DNA (Homo sapiens) CpG-island No: 36754
ctaaaaataaccaaaaaattaaattctaatctttaaaaaataaaaaaaaaaaatataaaaaaacgtattcctttcccctaccccgaccgctcgcgattaaaaaacccaaccacataccgccccgactcgaaataacaacccaaccaaacctctaccttctcgaccgcgcctctcccgctaccgtccgaatttcgataaataatacaatacgttaaacacgcccctccctttctcccgacctaatctcctattccaaacgacaacccaataaaaactacctttttttcttcgaaccgattccaatctaaattctcgtccactacgatcgcccaataaaaccccgcccctcccaccgcaattccgcccctcccgaaactaccgcccaataaaaccccgcctctcccgccgcgaccccgcccccctacgtataaccgcatctaaaccccgccgcgtccgccacgcccaacgctcgacgacgcccgccccactaacctaacccgccccccgcaccgaacactctttcgcccgacctccgattctcgccgactctcgaacccgcctccgaaaacgtaaaacgc

SEQ ID NO: 36755 - DNA, 578 bp, Artificial Sequence
  chemically treated genomic DNA (Homo sapiens) CpG-island No: 36755
ttgaaagtgattagaaaattaggttttggtttttaagagatggaagagggaaatgtgaaggggcgtattttttttttttgtttcgatcgttcgcggttggagagtttagttatatgtcgtttcggttcggagtgatagtttaattaggtttttgttttttcggtcgcgtttttttcgttgtcgttcggatttcgatgggtggtatagtacgttaggtacgtttttttttttttttcggtttggttttttgttttaggcgatagtttaatgagggttgttttttttttttcggatcggttttagtttaggttttcgtttattacgatcgtttagtgaggtttcgttttttttatcgtagtttcgtttttttcggagttatcgtttagtgaggtttcgtttttttcgtcgcggtttcgtttttttgcgtgtgatcgtatttaggtttcgtcgcgttcgttacgtttagcgttcggcggcgttcgttttattggtttggttcgtttttcgtatcgagtattttttcgttcggttttcggttttcgtcggttttcggattcgttttcgaagacgtggagcgt

SEQ ID NO: 36756 - DNA, 578 bp, Artificial Sequence
  chemically treated genomic DNA (Homo sapiens) CpG-island No: 36756
acgctccacgtcttcgaaaacgaatccgaaaaccgacgaaaaccgaaaaccgaacgaaaaaatactcgatacgaaaaacgaaccaaaccaataaaacgaacgccgccgaacgctaaacgtaacgaacgcgacgaaacctaaatacgatcacacgcaaaaaaacgaaaccgcgacgaaaaaaacgaaacctcactaaacgataactccgaaaaaaacgaaactacgataaaaaaaacgaaacctcactaaacgatcgtaataaacgaaaacctaaactaaaaccgatccgaaaaaaaaaaaacaaccctcattaaactatcgcctaaaacaaaaaaccaaaccgaaaaaaaaaaaaaaacgtacctaacgtactataccacccatcgaaatccgaacgacaacgaaaaaaacgcgaccgaaaaaacaaaaacctaattaaactatcactccgaaccgaaacgacatataactaaactctccaaccgcgaacgatcgaaacaaaaaaaaaaaatacgccccttcacatttccctcttccatctcttaaaaaccaaaacctaattttctaatcactttcaa

SEQ ID NO: 36757 - DNA, 1015 bp, Artificial Sequence
  chemically treated genomic DNA (Homo sapiens) CpG-island No: 36757
tacggcgggttcggggattcggtcgcgtaggcgcgaggagttcgggttgtcgggggggtatcgttttagatattcggaagttttcgtttaacgggtttagttcgtattttttgttcgggaagggggcggggtcgaagtttttcggcgcggggcgttatagagtatggacggaggatttgcgttttagatattttcggaagtggtttttttaggcgttcgtcgggtattatagagttgggggcggtggtcgggatagcgggttcgtttttttagagcggcgaggatagggtggcggttcggggggtagggagtagggagaagggggggagcggcgcgggcggaagcggtcgggaaggttattttcggtttgggcgttcgtttttttgattttagggtttgagtcgtcgttgtcgtcgttgttattattcgcgaggtaggagagaggaggaggagtgcggcgcggcggtttcgggattaaggaggtgaggggtgggggcgggggtcgtgcgttgggggttaggtgggcgcgcgtttcgggaagttgggtttgggttgggggtgggtggggagattggagggcgagcgcgattgggcggcgggcgcgcgtgcgcgttgttggggggcgtgagtgggcgcgcggtcggggtgacgcgggcggggggagtgcgcgtgcgcgtcgaagagttgtgggaggggacgcgcgttcgggcggttcgcgggcggcgagcggggttggagggggggtgcgcgtgcgcgggttcgggtttaggggcgcgcgcgtgcgcgtggcgggggtaggagcgggggtttcggtgggggtttttttgttgcgggtcgtcgggggtggggtcgttgttcgttttttcgaagttttaatttcgtcggtcgtggtcggaagtggtggcgatttcggggggaagttgaggtttaggtgggggaaggggtcgcgcggttgggttggtttggtcggatatcgcggtttcgagggtacggttttagttttcggtttttttag

SEQ ID NO: 36758 - DNA, 1015 bp, Artificial Sequence
  chemically treated genomic DNA (Homo sapiens) CpG-island No: 36758
ctaaaaaaaccgaaaactaaaaccgtaccctcgaaaccgcgatatccgaccaaaccaacccaaccgcgcgaccccttcccccacctaaacctcaacttccccccgaaatcgccaccacttccgaccacgaccgacgaaattaaaacttcgaaaaaacgaacaacgaccccacccccgacgacccgcaacaaaaaaacccccaccgaaacccccgctcctacccccgccacgcgcacgcgcgcgcccctaaacccgaacccgcgcacgcgcaccccccctccaaccccgctcgccgcccgcgaaccgcccgaacgcgcgtcccctcccacaactcttcgacgcgcacgcgcactccccccgcccgcgtcaccccgaccgcgcgcccactcacgccccccaacaacgcgcacgcgcgcccgccgcccaatcgcgctcgccctccaatctccccacccacccccaacccaaacccaacttcccgaaacgcgcgcccacctaacccccaacgcacgacccccgcccccacccctcacctccttaatcccgaaaccgccgcgccgcactcctcctcctctctcctacctcgcgaataataacaacgacgacaacgacgactcaaaccctaaaatcaaaaaaacgaacgcccaaaccgaaaataaccttcccgaccgcttccgcccgcgccgctcccccccttctccctactccctaccccccgaaccgccaccctatcctcgccgctctaaaaaaacgaacccgctatcccgaccaccgcccccaactctataatacccgacgaacgcctaaaaaaaccacttccgaaaatatctaaaacgcaaatcctccgtccatactctataacgccccgcgccgaaaaacttcgaccccgcccccttcccgaacaaaaaatacgaactaaacccgttaaacgaaaacttccgaatatctaaaacgatacccccccgacaacccgaactcctcgcgcctacgcgaccgaatccccgaacccgccgta

SEQ ID NO: 36759 - DNA, 1015 bp, Artificial Sequence
  chemically treated genomic DNA (Homo sapiens) CpG-island No: 36759
ttgggggggtcgagggttgagatcgtgttttcggggtcgcggtattcggttaggttagtttaatcgcgcggtttttttttttatttgggttttaattttttttcgaagtcgttattattttcggttacgatcggcggagttggaatttcggggggacggatagcggttttattttcgacggttcgtagtagagggatttttatcgaggttttcgtttttgttttcgttacgcgtacgcgcgcgtttttggattcggattcgcgtacgcgtattttttttttagtttcgttcgtcgttcgcgggtcgttcgggcgcgcgtttttttttatagtttttcggcgcgtacgcgtatttttttcgttcgcgttatttcggtcgcgcgtttatttacgttttttagtagcgcgtacgcgcgttcgtcgtttagtcgcgttcgttttttagtttttttatttatttttagtttaagtttagtttttcgaagcgcgcgtttatttggtttttagcgtacggttttcgtttttattttttatttttttggtttcggggtcgtcgcgtcgtattttttttttttttttttgtttcgcggatggtggtagcggcggtagcggcgatttagattttggggttagggggacgggcgtttaggtcggaagtgattttttcggtcgttttcgttcgcgtcgtttttttttttttttttattttttgtttttcgggtcgttattttgttttcgtcgttttaggaaggcgagttcgttatttcggttatcgtttttagttttgtggtgttcggcgggcgtttgagggagttattttcggaagtgtttaggacgtaggtttttcgtttatgttttatggcgtttcgcgtcgaggggtttcggtttcgtttttttttcggataggaggtgcgggttgggttcgttaggcggagattttcgggtgtttagggcggtgttttttcgataattcgggtttttcgcgtttgcgcggtcgggttttcgggttcgtcgtg

SEQ ID NO: 36760 - DNA, 1015 bp, Artificial Sequence
  chemically treated genomic DNA (Homo sapiens) CpG-island No: 36760
cacgacgaacccgaaaacccgaccgcgcaaacgcgaaaaacccgaattatcgaaaaaacaccgccctaaacacccgaaaatctccgcctaacgaacccaacccgcacctcctatccgaaaaaaaaacgaaaccgaaacccctcgacgcgaaacgccataaaacataaacgaaaaacctacgtcctaaacacttccgaaaataactccctcaaacgcccgccgaacaccacaaaactaaaaacgataaccgaaataacgaactcgccttcctaaaacgacgaaaacaaaataacgacccgaaaaacaaaaaataaaaaaaaaaaaaaaaacgacgcgaacgaaaacgaccgaaaaaatcacttccgacctaaacgcccgtccccctaaccccaaaatctaaatcgccgctaccgccgctaccaccatccgcgaaacaaaaaaaaaaaaaaaaaatacgacgcgacgaccccgaaaccaaaaaaataaaaaataaaaacgaaaaccgtacgctaaaaaccaaataaacgcgcgcttcgaaaaactaaacttaaactaaaaataaataaaaaaactaaaaaacgaacgcgactaaacgacgaacgcgcgtacgcgctactaaaaaacgtaaataaacgcgcgaccgaaataacgcgaacgaaaaaaatacgcgtacgcgccgaaaaactataaaaaaaaacgcgcgcccgaacgacccgcgaacgacgaacgaaactaaaaaaaaaatacgcgtacgcgaatccgaatccaaaaacgcgcgcgtacgcgtaacgaaaacaaaaacgaaaacctcgataaaaatccctctactacgaaccgtcgaaaataaaaccgctatccgtccccccgaaattccaactccgccgatcgtaaccgaaaataataacgacttcgaaaaaaaattaaaacccaaataaaaaaaaaaaccgcgcgattaaactaacctaaccgaataccgcgaccccgaaaacacgatctcaaccctcgacccccccaa

SEQ ID NO: 36761 - DNA, 884 bp, Artificial Sequence
  chemically treated genomic DNA (Homo sapiens) CpG-island No: 36761
ttggtgcgtggtacggattagtggcgtgtgtagagatttttattgtgcgtggtacgggtcggcgtgcgtagggattttttcggtgcgtggtacgggtcggcggcgtgcgtagggattttttcggtgcgtggtacgggtcggcggcgtgcgtagggattttttcggtgcgtggtacgggtcggcggcgtgcgtagggattttttcggtgcgtggtacgggtcggcggcgtgcgtagggattttttcggtgcgtggtacgggtcggcggcgtgcgtagggattttttcggtgcgtggtacgggtcggcggtgtcgtgcgtagggattttttcggtgcgtggtacgggtcggcggtgtcgtgcgtagggattttttcggtgcgtggtacgggtcggcggcgtgcgtagggattttttcggtgcgtggtacgggtcggcggtgtcgtgcgtagggattttttcggtgcgtggtacgggtcggcggtgtcgtgcgtagggattttttcggtgcgtggtacgggtcggcggtgtcgtgcgtagggattttttcggtgcgtggtacgggtcggcggtgtcgtgcgtagggattttttcggtgcgtggtacgggtcggcggcgtgcgtagggattttttcggtgcgtggtacgggtcggcggcgtgcgtagggattttttcggtgcgtggtacgggtcggcggtgtcgtgcgtagagattttttcggtgcgtggtacgggtcggtggtgtcgtgcgtagagatttttttggtgcgtggtacgggtcggtggtgtcgtgcgtagagatttttacggtgtgtggtacgggttgggagtgtcgtgtgtagagatttttaggcgtttgttgttttgtttttgttgtgatgggtaag

SEQ ID NO: 36762 - DNA, 884 bp, Artificial Sequence
  chemically treated genomic DNA (Homo sapiens) CpG-island No: 36762
cttacccatcacaacaaaaacaaaacaacaaacgcctaaaaatctctacacacgacactcccaacccgtaccacacaccgtaaaaatctctacgcacgacaccaccgacccgtaccacgcaccaaaaaaatctctacgcacgacaccaccgacccgtaccacgcaccgaaaaaatctctacgcacgacaccgccgacccgtaccacgcaccgaaaaaatccctacgcacgccgccgacccgtaccacgcaccgaaaaaatccctacgcacgccgccgacccgtaccacgcaccgaaaaaatccctacgcacgacaccgccgacccgtaccacgcaccgaaaaaatccctacgcacgacaccgccgacccgtaccacgcaccgaaaaaatccctacgcacgacaccgccgacccgtaccacgcaccgaaaaaatccctacgcacgacaccgccgacccgtaccacgcaccgaaaaaatccctacgcacgccgccgacccgtaccacgcaccgaaaaaatccctacgcacgacaccgccgacccgtaccacgcaccgaaaaaatccctacgcacgacaccgccgacccgtaccacgcaccgaaaaaatccctacgcacgccgccgacccgtaccacgcaccgaaaaaatccctacgcacgccgccgacccgtaccacgcaccgaaaaaatccctacgcacgccgccgacccgtaccacgcaccgaaaaaatccctacgcacgccgccgacccgtaccacgcaccgaaaaaatccctacgcacgccgccgacccgtaccacgcaccgaaaaaatccctacgcacgccgacccgtaccacgcacaataaaaatctctacacacgccactaatccgtaccacgcaccaa

SEQ ID NO: 36763 - DNA, 884 bp, Artificial Sequence
  chemically treated genomic DNA (Homo sapiens) CpG-island No: 36763
tttatttattatagtagaaatagggtaataggcgtttaagggtttttgtatacgatatttttaattcgtgttatatatcgtgagggtttttgcgtacgatattatcgattcgtgttacgtattaggagggtttttacgtacgatattatcgattcgtgttacgtatcgggagggtttttacgtacgatatcgtcgattcgtgttacgtatcgggagggtttttacgtacgtcgtcgattcgtgttacgtatcgggagggtttttacgtacgtcgtcgattcgtgttacgtatcgggagggtttttacgtacgatatcgtcgattcgtgttacgtatcgggagggtttttacgtacgatatcgtcgattcgtgttacgtatcgggagggtttttacgtacgatatcgtcgattcgtgttacgtatcgggagggtttttacgtacgatatcgtcgattcgtgttacgtatcgggagggtttttacgtacgtcgtcgattcgtgttacgtatcgggagggtttttacgtacgatatcgtcgattcgtgttacgtatcgggagggtttttacgtacgatatcgtcgattcgtgttacgtatcgggagggtttttacgtacgtcgtcgattcgtgttacgtatcgggagggtttttacgtacgtcgtcgattcgtgttacgtatcgggagggtttttacgtacgtcgtcgattcgtgttacgtatcgggagggtttttacgtacgtcgtcgattcgtgttacgtatcgggagggtttttacgtacgtcgtcgattcgtgttacgtatcgggagggtttttacgtacgtcgattcgtgttacgtatagtgagggtttttatatacgttattgattcgtgttacgtattag

SEQ ID NO: 36764 - DNA, 884 bp, Artificial Sequence
  chemically treated genomic DNA (Homo sapiens) CpG-island No: 36764
ctaatacgtaacacgaatcaataacgtatataaaaaccctcactatacgtaacacgaatcgacgtacgtaaaaaccctcccgatacgtaacacgaatcgacgacgtacgtaaaaaccctcccgatacgtaacacgaatcgacgacgtacgtaaaaaccctcccgatacgtaacacgaatcgacgacgtacgtaaaaaccctcccgatacgtaacacgaatcgacgacgtacgtaaaaaccctcccgatacgtaacacgaatcgacgacgtacgtaaaaaccctcccgatacgtaacacgaatcgacgatatcgtacgtaaaaaccctcccgatacgtaacacgaatcgacgatatcgtacgtaaaaaccctcccgatacgtaacacgaatcgacgacgtacgtaaaaaccctcccgatacgtaacacgaatcgacgatatcgtacgtaaaaaccctcccgatacgtaacacgaatcgacgatatcgtacgtaaaaaccctcccgatacgtaacacgaatcgacgatatcgtacgtaaaaaccctcccgatacgtaacacgaatcgacgatatcgtacgtaaaaaccctcccgatacgtaacacgaatcgacgacgtacgtaaaaaccctcccgatacgtaacacgaatcgacgacgtacgtaaaaaccctcccgatacgtaacacgaatcgacgatatcgtacgtaaaaaccctcccgatacgtaacacgaatcgataatatcgtacgtaaaaaccctcctaatacgtaacacgaatcgataatatcgtacgcaaaaaccctcacgatatataacacgaattaaaaatatcgtatacaaaaacccttaaacgcctattaccctatttctactataataaataaa

SEQ ID NO: 36765 - DNA, 612 bp, Artificial Sequence
  chemically treated genomic DNA (Homo sapiens) CpG-island No: 36765
ggttaagtatcggcgttcgtatagcggttttaagtttttcgtgtgttcgcgttgcggtcgcggttttagttagtttaagagtttcgcgcgttatttgcggttgtattcggagttgtcggggtttggcgtggcggttaaggtgttggcggttagcgttcggcgggttaaggggttcgaagaggcggtggcggcggacggcgagatcgttattttcgtgggcgatggcgagggtattatcgtggtgggcgcgtcgggcgagggggtcgcggtcgcggtagttatggcgggcgcgggggtaaaggtcgcggggtttcggtcgcggcgcgtttcggtttttaagtcgtacgtgtgtttggagtgcgggaagggtttcgggtacggggtcgggtttttggcgtattagcgggtttagtacggggacgggttcggggcggcggggggcgaggagtcggtttatatttgcgtggagtgcggggagggtttcgtgtagggcgtcgcgtttcggagatataagaagatttacgcggtgggcgcgttttcggtttgtagtagttgcggatagagttattatcgcgcgggcggggaggaggaggacgacgacgacgataggtt

SEQ ID NO: 36766 - DNA, 612 bp, Artificial Sequence
  chemically treated genomic DNA (Homo sapiens) CpG-island No: 36766
aacctatcgtcgtcgtcgtcctcctcctccccgcccgcgcgataataactctatccgcaactactacaaaccgaaaacgcgcccaccgcgtaaatcttcttatatctccgaaacgcgacgccctacacgaaaccctccccgcactccacgcaaatataaaccgactcctcgccccccgccgccccgaacccgtccccgtactaaacccgctaatacgccaaaaacccgaccccgtacccgaaacccttcccgcactccaaacacacgtacgacttaaaaaccgaaacgcgccgcgaccgaaaccccgcgacctttacccccgcgcccgccataactaccgcgaccgcgaccccctcgcccgacgcgcccaccacgataataccctcgccatcgcccacgaaaataacgatctcgccgtccgccgccaccgcctcttcgaaccccttaacccgccgaacgctaaccgccaacaccttaaccgccacgccaaaccccgacaactccgaatacaaccgcaaataacgcgcgaaactcttaaactaactaaaaccgcgaccgcaacgcgaacacacgaaaaacttaaaaccgctatacgaacgccgatacttaacc

SEQ ID NO: 36767 - DNA, 612 bp, Artificial Sequence
  chemically treated genomic DNA (Homo sapiens) CpG-island No: 36767
ggtttgtcgtcgtcgtcgtttttttttttttcgttcgcgcggtagtagttttgttcgtagttgttgtagatcgagggcgcgtttatcgcgtggatttttttgtgttttcggagcgcggcgttttgtacgaagtttttttcgtattttacgtagatgtgggtcggtttttcgtttttcgtcgtttcgagttcgttttcgtgttgggttcgttggtgcgttaggagttcggtttcgtgttcgaagtttttttcgtattttagatatacgtacggtttgggggtcggggcgcgtcgcgatcggggtttcgcggtttttgttttcgcgttcgttatggttgtcgcggtcgcggttttttcgttcggcgcgtttattacgatgatgttttcgttatcgtttacggggatggcgatttcgtcgttcgtcgttatcgttttttcgggttttttggttcgtcggacgttagtcgttagtattttggtcgttacgttaggtttcgatagtttcgggtgtagtcgtaggtgacgcgcgaggtttttgggttggttgaagtcgcggtcgtagcgcgggtatacgaagggtttgaggtcgttgtgcgagcgtcggtgtttggtt

SEQ ID NO: 36768 - DNA, 612 bp, Artificial Sequence
  chemically treated genomic DNA (Homo sapiens) CpG-island No: 36768
aaccaaacaccgacgctcgcacaacgacctcaaacccttcgtatacccgcgctacgaccgcgacttcaaccaacccaaaaacctcgcgcgtcacctacgactacacccgaaactatcgaaacctaacgtaacgaccaaaatactaacgactaacgtccgacgaaccaaaaaacccgaaaaaacgataacgacgaacgacgaaatcgccatccccgtaaacgataacgaaaacatcatcgtaataaacgcgccgaacgaaaaaaccgcgaccgcgacaaccataacgaacgcgaaaacaaaaaccgcgaaaccccgatcgcgacgcgccccgacccccaaaccgtacgtatatctaaaatacgaaaaaaacttcgaacacgaaaccgaactcctaacgcaccaacgaacccaacacgaaaacgaactcgaaacgacgaaaaacgaaaaaccgacccacatctacgtaaaatacgaaaaaaacttcgtacaaaacgccgcgctccgaaaacacaaaaaaatccacgcgataaacgcgccctcgatctacaacaactacgaacaaaactactaccgcgcgaacgaaaaaaaaaaaaacgacgacgacgacaaacc

SEQ ID NO: 36769 - DNA, 553 bp, Artificial Sequence
  chemically treated genomic DNA (Homo sapiens) CpG-island No: 36769
gtaggttttgtaggtattcgtattatataggtattttcgtaagattgtcgttgggatacgttggacgacgatcgcgttaatggttgtattcgttcgttggaatacgtttatagtaaagacggcggtttggcggtgttttacggtaattttgcggaaaacggttgtatcgtgaaaacggtaggcgtcgatgatagtatttttaaattatcggttcggcgaaagtgtacgaaagttaggacgatgcggtagaagcgattttcggcggtaaagttgtcgtcggagatgtggtagtaattcgttatgaaggttcgaaaggcggttcggggatgtaggaaatgttttatttaattagttttttgaaattaatgggtttcggtaaagtttgtgcgttgattatcgacggtcgtttttttggtggtatttttggtttttttatcggttacgttttatcggaagcggtaagcggcggtagtattggtttgattgaagatggtgatttgatcgttatcgatatttcgaatcgtggtagttagttataggtaagcgatgcgcg

SEQ ID NO: 36770 - DNA, 553 bp, Artificial Sequence
  chemically treated genomic DNA (Homo sapiens) CpG-island No: 36770
cgcgcatcgcttacctataactaactaccacgattcgaaatatcgataacgatcaaatcaccatcttcaatcaaaccaatactaccgccgcttaccgcttccgataaaacgtaaccgataaaaaaaccaaaaataccaccaaaaaaacgaccgtcgataatcaacgcacaaactttaccgaaacccattaatttcaaaaaactaattaaataaaacatttcctacatccccgaaccgcctttcgaaccttcataacgaattactaccacatctccgacgacaactttaccgccgaaaatcgcttctaccgcatcgtcctaactttcgtacactttcgccgaaccgataatttaaaaatactatcatcgacgcctaccgttttcacgatacaaccgttttccgcaaaattaccgtaaaacaccgccaaaccgccgtctttactataaacgtattccaacgaacgaatacaaccattaacgcgatcgtcgtccaacgtatcccaacgacaatcttacgaaaatacctatataatacgaatacctacaaaacctac

SEQ ID NO: 36771 - DNA, 553 bp, Artificial Sequence
  chemically treated genomic DNA (Homo sapiens) CpG-island No: 36771
cgcgtatcgtttatttgtaattgattgttacggttcgggatgtcgatagcgattaggttattatttttaattaggttaatgttgtcgtcgtttgtcgttttcggtgagacgtggtcgatggaaagattagaggtgttattagagaaacgatcgtcggtgattagcgtataggttttgtcgagatttattgattttaggaagttggttgggtagagtattttttgtattttcggatcgtttttcgggtttttatagcgaattattattatattttcggcgataattttatcgtcgagaatcgtttttatcgtatcgttttggttttcgtatattttcgtcgggtcggtaatttgaggatgttgttatcgacgtttgtcgtttttacgatgtagtcgtttttcgtaaagttatcgtagagtatcgttaggtcgtcgtttttgttgtaggcgtgttttagcgagcggatatagttattggcgcgatcgtcgtttagcgtattttaacggtaattttgcgagaatgtttgtgtggtacgaatgtttgtaggatttgt

SEQ ID NO: 36772 - DNA, 553 bp, Artificial Sequence
  chemically treated genomic DNA (Homo sapiens) CpG-island No: 36772
acaaatcctacaaacattcgtaccacacaaacattctcgcaaaattaccgttaaaatacgctaaacgacgatcgcgccaataactatatccgctcgctaaaacacgcctacaacaaaaacgacgacctaacgatactctacgataactttacgaaaaacgactacatcgtaaaaacgacaaacgtcgataacaacatcctcaaattaccgacccgacgaaaatatacgaaaaccaaaacgatacgataaaaacgattctcgacgataaaattatcgccgaaaatataataataattcgctataaaaacccgaaaaacgatccgaaaatacaaaaaatactctacccaaccaacttcctaaaatcaataaatctcgacaaaacctatacgctaatcaccgacgatcgtttctctaataacacctctaatctttccatcgaccacgtctcaccgaaaacgacaaacgacgacaacattaacctaattaaaaataataacctaatcgctatcgacatcccgaaccgtaacaatcaattacaaataaacgatacgcg

SEQ ID NO: 36773 - DNA, 565 bp, Artificial Sequence
  chemically treated genomic DNA (Homo sapiens) CpG-island No: 36773
gtaaaagtattttcgttagtttattgatgggttattattcgttaacggaaggtgagattcgttttgatggtcgtttattaagttcgttaagttatagcgcgttgcgttagggcgtggtaatggtgtagtaagattcggtggtgttggcggatatttttttcgttaacgtgacgttgggcgggatattttcgaagaacgcgtttggtaggcgttggaaatcgtgtaattggcggagttggcgtttagtatgagcgacggtatttatacgtcgttgggcgagtaggggaataattttttagttgggtaaaagtaattgttggtattggcgcgcgtgttggtcgagacgtcgtaaattttgatttttgatgaggtaatcgttagtattgatttcggtattgaataggcgatttaatatgttttggcggcggtgcgtgaatatattacgttggtagtgattgtttatcgtttatcgattattgttgatgtcgatattattttggtgttttatcgtgggtaagtcgtggagtagggtatttattagtaattgttggcggtttagggacgt

SEQ ID NO: 36774 - DNA, 565 bp, Artificial Sequence
  chemically treated genomic DNA (Homo sapiens) CpG-island No: 36774
acgtccctaaaccgccaacaattactaataaataccctactccacgacttacccacgataaaacaccaaaataatatcgacatcaacaataatcgataaacgataaacaatcactaccaacgtaatatattcacgcaccgccgccaaaacatattaaatcgcctattcaataccgaaatcaatactaacgattacctcatcaaaaatcaaaatttacgacgtctcgaccaacacgcgcgccaataccaacaattacttttacccaactaaaaaattattcccctactcgcccaacgacgtataaataccgtcgctcatactaaacgccaactccgccaattacacgatttccaacgcctaccaaacgcgttcttcgaaaatatcccgcccaacgtcacgttaacgaaaaaaatatccgccaacaccaccgaatcttactacaccattaccacgccctaacgcaacgcgctataacttaacgaacttaataaacgaccatcaaaacgaatctcaccttccgttaacgaataataacccatcaataaactaacgaaaatacttttac

SEQ ID NO: 36775 - DNA, 565 bp, Artificial Sequence
  chemically treated genomic DNA (Homo sapiens) CpG-island No: 36775
gcgtttttgggtcgttagtagttgttggtgagtgttttgttttacggtttgtttacgatgaagtattagaatggtgtcggtattaataatggtcgataagcggtgagtaattattattagcgtggtatgtttacgtatcgtcgttagagtatgttgaatcgtttgtttagtatcggagttaatgttggcggttgttttattaaggattaggatttgcggcgtttcgattagtacgcgcgttagtgttagtagttgtttttgtttaattgagagattatttttttgttcgtttagcggcgtgtaaatatcgtcgtttatgttaagcgttagtttcgttagttgtacggtttttagcgtttgttagacgcgtttttcggagatatttcgtttagcgttacgttggcgaggaaggtattcgttagtattatcggattttgttgtattattgttacgttttggcgtagcgcgttgtgatttagcgaatttaatggacgattattaaggcgaattttatttttcgttagcgggtaatagtttattaataaattggcgagggtgtttttgt

SEQ ID NO: 36776 - DNA, 565 bp, Artificial Sequence
  chemically treated genomic DNA (Homo sapiens) CpG-island No: 36776
acaaaaacaccctcgccaatttattaataaactattacccgctaacgaaaaataaaattcgccttaataatcgtccattaaattcgctaaatcacaacgcgctacgccaaaacgtaacaataatacaacaaaatccgataatactaacgaataccttcctcgccaacgtaacgctaaacgaaatatctccgaaaaacgcgtctaacaaacgctaaaaaccgtacaactaacgaaactaacgcttaacataaacgacgatatttacacgccgctaaacgaacaaaaaaataatctctcaattaaacaaaaacaactactaacactaacgcgcgtactaatcgaaacgccgcaaatcctaatccttaataaaacaaccgccaacattaactccgatactaaacaaacgattcaacatactctaacgacgatacgtaaacataccacgctaataataattactcaccgcttatcgaccattattaataccgacaccattctaatacttcatcgtaaacaaaccgtaaaacaaaacactcaccaacaactactaacgacccaaaaacgc

SEQ ID NO: 36777 - DNA, 952 bp, Artificial Sequence
  chemically treated genomic DNA (Homo sapiens) CpG-island No: 36777
gtaggtcggggcgattattatgttgatcgtgcgtttggggtcggtgatttcgtttatgattggcggtttattgttggcgatcggtggcgtagtttggaattacgggttggcggcggcgggtacgtttattattttgttatcgttgttaagtttttcggcgttgttatcgttatcgtagtcgcgtgagtattcgttgaaattattattggtaggatttcgttttttgtttgttagttcgttggtgggcgggattgcgttgttgggtggtttattgacgatggcgagcgcggtgcgggtattgtattcggcgttggttgataattggtagatgttagcggtatagattggttttttttacgcggcgatttcgttcggcgcggttattggtgcgttaattagcgggaagttggtatatagtgcgcgattagggttattgatgttgttttttacgttgggatcgtttttcgttattggtttgtttggtttgatgtcgatgtggattttaggcgtggtttgtttggcgttgttcggttggttgagtgcggttagttcgttgttgtaatatataatgttgtaaacgtaaatttcggaagcgatgttagggcggattaacggtttgtggacggcgtagaacgtgacgggcgatgttataggcgcggcgttgttgggtggtttgggcgcgatgatgatatcggttgttttcgttaagcgcgagcggttttggtttgttgattatcggcgtgtttgttattgttggtgttggtggagttgcgatattttcgttagacgtcgtcgtaggtgatagcgttcgatagttaatgtttaaaatagcgttttaagtttatttagtattgtgtagtggcgttgtagtaatttagacggaacgtttcggtttttagcgtataaatttgtttgttttgtattgtaggtaggtgtagcgagtagcggatta

SEQ ID NO: 36778 - DNA, 952 bp, Artificial Sequence
  chemically treated genomic DNA (Homo sapiens) CpG-island No: 36778
taatccgctactcgctacacctacctacaatacaaaacaaacaaatttatacgctaaaaaccgaaacgttccgtctaaattactacaacgccactacacaatactaaataaacttaaaacgctattttaaacattaactatcgaacgctatcacctacgacgacgtctaacgaaaatatcgcaactccaccaacaccaacaataacaaacacgccgataatcaacaaaccaaaaccgctcgcgcttaacgaaaacaaccgatatcatcatcgcgcccaaaccacccaacaacgccgcgcctataacatcgcccgtcacgttctacgccgtccacaaaccgttaatccgccctaacatcgcttccgaaatttacgtttacaacattatatattacaacaacgaactaaccgcactcaaccaaccgaacaacgccaaacaaaccacgcctaaaatccacatcgacatcaaaccaaacaaaccaataacgaaaaacgatcccaacgtaaaaaacaacatcaataaccctaatcgcgcactatataccaacttcccgctaattaacgcaccaataaccgcgccgaacgaaatcgccgcgtaaaaaaaaccaatctataccgctaacatctaccaattatcaaccaacgccgaatacaatacccgcaccgcgctcgccatcgtcaataaaccacccaacaacgcaatcccgcccaccaacgaactaacaaacaaaaaacgaaatcctaccaataataatttcaacgaatactcacgcgactacgataacgataacaacgccgaaaaacttaacaacgataacaaaataataaacgtacccgccgccgccaacccgtaattccaaactacgccaccgatcgccaacaataaaccgccaatcataaacgaaatcaccgaccccaaacgcacgatcaacataataatcgccccgacctac

SEQ ID NO: 36779 - DNA, 952 bp, Artificial Sequence
  chemically treated genomic DNA (Homo sapiens) CpG-island No: 36779
taattcgttgttcgttgtatttgtttgtagtataaaataagtaggtttatgcgttgggaatcgagacgtttcgtttggattattatagcgttattgtatagtgttggataggtttaaggcgttgttttaagtattaattgtcggacgttgttatttgcggcggcgtttggcgaaaatgtcgtaattttattagtattagtaataataagtacgtcgataattaataaattaaaatcgttcgcgtttagcggaagtaatcggtgttattatcgcgtttaaattatttagtagcgtcgcgtttatggtatcgttcgttacgttttgcgtcgtttataaatcgttaattcgttttaatatcgttttcggggtttgcgtttgtagtattgtgtattgtagtaacgagttgatcgtatttaattagtcgaatagcgttagataaattacgtttaaaatttatatcggtattaggttaaatagattaatggcgaggaacgattttagcgtggagagtagtattaataattttggtcgcgtattatgtgttagtttttcgttggttaacgtattaatagtcgcgtcgagcgggatcgtcgcgtagagaaaattaatttgtgtcgttgatatttgttagttgttagttagcgtcggatatagtattcgtatcgcgttcgttatcgttaataaattatttagtagcgtaatttcgtttattagcgggttggtaagtagaaaacgaaattttgttagtaatgattttaacggatgtttacgcggttgcggtggcggtggtaacgtcggaaggtttaataacggtagtaaggtaataaacgtgttcgtcgtcgttagttcgtagttttaggttacgttatcggtcgttagtaataaatcgttaattatgggcgaaattatcgattttagacgtacggttaatatggtgatcgtttcggtttgt

SEQ ID NO: 36780 - DNA, 952 bp, Artificial Sequence
  chemically treated genomic DNA (Homo sapiens) CpG-island No: 36780
acaaaccgaaacgatcaccatattaaccgtacgtctaaaatcgataatttcgcccataattaacgatttattactaacgaccgataacgtaacctaaaactacgaactaacgacgacgaacacgtttattaccttactaccgttattaaaccttccgacgttaccaccgccaccgcaaccgcgtaaacatccgttaaaatcattactaacaaaatttcgttttctacttaccaacccgctaataaacgaaattacgctactaaataatttattaacgataacgaacgcgatacgaatactatatccgacgctaactaacaactaacaaatatcaacgacacaaattaattttctctacgcgacgatcccgctcgacgcgactattaatacgttaaccaacgaaaaactaacacataatacgcgaccaaaattattaatactactctccacgctaaaatcgttcctcgccattaatctatttaacctaataccgatataaattttaaacgtaatttatctaacgctattcgactaattaaatacgatcaactcgttactacaatacacaatactacaaacgcaaaccccgaaaacgatattaaaacgaattaacgatttataaacgacgcaaaacgtaacgaacgataccataaacgcgacgctactaaataatttaaacgcgataataacaccgattacttccgctaaacgcgaacgattttaatttattaattatcgacgtacttattattactaatactaataaaattacgacattttcgccaaacgccgccgcaaataacaacgtccgacaattaatacttaaaacaacgccttaaacctatccaacactatacaataacgctataataatccaaacgaaacgtctcgattcccaacgcataaacctacttattttatactacaaacaaatacaacgaacaacgaatta

SEQ ID NO: 36781 - DNA, 701 bp, Artificial Sequence
  chemically treated genomic DNA (Homo sapiens) CpG-island No: 36781
gaagacgcgcggttttagcggcgtaggttttacgcggaacgtcggtatcgagtagcggttgtattattatttttagtgttgagatacgcgggatgacgcgtagaaattggtttatttagtcgacggtggttttgcggatttttattattttgcgcgttggcgcggtgattaggtttatttattcgttatcgtgtttgatttggatttgattttcgtcgggtagatagttggcgtatagcgagcgtagtagagttgatttgtcgttgtcggaatggtcgtggagtattacgtattcgttcgcgttgacggtgagcgaggcgcgattgaggacgggtaggcgtacgtcgttttgttggtgtaggatgaaggttttattgacgttttgtacgttaattatttttcgtttcgtggttcgggtgtcggatgcgacgttggcgcgttttattcgatttacggggagcgtatgtgtaggtcggataaggcgtttacgtcgtattcggtaatggtgtttaaatgtaatacgttttattcgttttggattttattcgttaattaacgcgtcgtagtaataattttttgttttagagataaatcgttattattcgtcggtaaattttgtggaaagagtaatgtgaaattagcgagataatgcgttagacgtgtacgtagtaaacggttatgaataatttcgtcgttaaata

SEQ ID NO: 36782 - DNA, 701 bp, Artificial Sequence
  chemically treated genomic DNA (Homo sapiens) CpG-island No: 36782
tatttaacgacgaaattattcataaccgtttactacgtacacgtctaacgcattatctcgctaatttcacattactctttccacaaaatttaccgacgaataataacgatttatctctaaaacaaaaaattattactacgacgcgttaattaacgaataaaatccaaaacgaataaaacgtattacatttaaacaccattaccgaatacgacgtaaacgccttatccgacctacacatacgctccccgtaaatcgaataaaacgcgccaacgtcgcatccgacacccgaaccacgaaacgaaaaataattaacgtacaaaacgtcaataaaaccttcatcctacaccaacaaaacgacgtacgcctacccgtcctcaatcgcgcctcgctcaccgtcaacgcgaacgaatacgtaatactccacgaccattccgacaacgacaaatcaactctactacgctcgctatacgccaactatctacccgacgaaaatcaaatccaaatcaaacacgataacgaataaataaacctaatcaccgcgccaacgcgcaaaataataaaaatccgcaaaaccaccgtcgactaaataaaccaatttctacgcgtcatcccgcgtatctcaacactaaaaataataatacaaccgctactcgataccgacgttccgcgtaaaacctacgccgctaaaaccgcgcgtcttc

SEQ ID NO: 36783 - DNA, 701 bp, Artificial Sequence
  chemically treated genomic DNA (Homo sapiens) CpG-island No: 36783
tatttagcggcggggttatttataatcgtttgttgcgtgtacgtttggcgtattatttcgttgattttatattgttttttttatagagtttatcggcgggtgatggcggtttgtttttggggtagggggttattgttgcggcgcgttggttagcgggtgaagtttagaacggataaaacgtgttgtatttggatattattgtcggatgcggcgtaaacgttttattcggtttatatatgcgtttttcgtaggtcggataagacgcgttagcgtcgtattcgatattcgaattacgaggcgaaaaatgattaacgtataaaacgttagtaaaatttttattttgtattagtaaaacggcgtgcgtttgttcgtttttaatcgcgtttcgtttatcgttaacgcgggcgaatgcgtggtgttttacggttatttcggtagcggtaaattaattttgttacgttcgttgtacgttaattatttgttcgacgaaggttaaatttagattaaatacggtgacgagtgggtagatttggttatcgcgttagcgcgtaaagtggtggaaattcgtaaaattatcgtcggttgggtgagttagtttttgcgcgttatttcgcgtattttagtattggaagtggtgatgtagtcgttgttcgatatcggcgtttcgcgtgaagtttgcgtcgttaaagtcgcgcgttttt

SEQ ID NO: 36784 - DNA, 701 bp, Artificial Sequence
  chemically treated genomic DNA (Homo sapiens) CpG-island No: 36784
aaaaacgcgcgactttaacgacgcaaacttcacgcgaaacgccgatatcgaacaacgactacatcaccacttccaatactaaaatacgcgaaataacgcgcaaaaactaactcacccaaccgacgataattttacgaatttccaccactttacgcgctaacgcgataaccaaatctacccactcgtcaccgtatttaatctaaatttaaccttcgtcgaacaaataattaacgtacaacgaacgtaacaaaattaatttaccgctaccgaaataaccgtaaaacaccacgcattcgcccgcgttaacgataaacgaaacgcgattaaaaacgaacaaacgcacgccgttttactaatacaaaataaaaattttactaacgttttatacgttaatcatttttcgcctcgtaattcgaatatcgaatacgacgctaacgcgtcttatccgacctacgaaaaacgcatatataaaccgaataaaacgtttacgccgcatccgacaataatatccaaatacaacacgttttatccgttctaaacttcacccgctaaccaacgcgccgcaacaataaccccctaccccaaaaacaaaccgccatcacccgccgataaactctataaaaaaaacaatataaaatcaacgaaataatacgccaaacgtacacgcaacaaacgattataaataaccccgccgctaaata

SEQ ID NO: 36785 - DNA, 546 bp, Artificial Sequence
  chemically treated genomic DNA (Homo sapiens) CpG-island No: 36785
gagtaagttatcgatttttggatggcgatcgtatatcgttatttttacgttattgcgggttagaatattcgtataggttagttttgtcggatttgtatcgataatcgttattcgtttgtttattttggtgatatggtttaagttaggacgttaatttttcgttaacgtttgatttgaaatgtagcgtttaatgttgtcgatagttatcgcgtcgtgtttatcgcgaatagtataggtatttttatataaacggttttgcggataaacgcgttcggtaattttcggtagggtgttggtttggtgagaaagttcgacggcggcgtcgatgttttcggtttttattagtttaatttattgcggtatatggttatgtagcgggtaggtttatttataaacgttgtgttcgtcgtatttaaggtagcgcgaggtttttcgttgtgtttggtcggcgcgaaatggtagataaattttattaaaatcggttttgcgcgttttaatcgttcgtttattttcgttcgttacgcgcgggcgtttgttgggtttgtg

SEQ ID NO: 36786 - DNA, 546 bp, Artificial Sequence
  chemically treated genomic DNA (Homo sapiens) CpG-island No: 36786
cacaaacccaacaaacgcccgcgcgtaacgaacgaaaataaacgaacgattaaaacgcgcaaaaccgattttaataaaatttatctaccatttcgcgccgaccaaacacaacgaaaaacctcgcgctaccttaaatacgacgaacacaacgtttataaataaacctacccgctacataaccatataccgcaataaattaaactaataaaaaccgaaaacatcgacgccgccgtcgaactttctcaccaaaccaacaccctaccgaaaattaccgaacgcgtttatccgcaaaaccgtttatataaaaatacctatactattcgcgataaacacgacgcgataactatcgacaacattaaacgctacatttcaaatcaaacgttaacgaaaaattaacgtcctaacttaaaccatatcaccaaaataaacaaacgaataacgattatcgatacaaatccgacaaaactaacctatacgaatattctaacccgcaataacgtaaaaataacgatatacgatcgccatccaaaaatcgataacttactc

SEQ ID NO: 36787 - DNA, 546 bp, Artificial Sequence
  chemically treated genomic DNA (Homo sapiens) CpG-island No: 36787
tataaatttagtaaacgttcgcgcgtggcgagcgggaataaacgggcgattgaagcgcgtaaaatcggttttgatgaaatttatttgttatttcgcgtcgattaggtataacgggaagtttcgcgttgttttaagtgcggcgagtatagcgtttgtgaatggatttgttcgttgtataattatatatcgtagtggattgaattggtgaaagtcggaaatatcgacgtcgtcgtcgagtttttttattagattaatattttgtcggaaattatcggacgcgtttgttcgtaagatcgtttgtgtgaaggtgtttgtattattcgcgatgagtacggcgcggtaattatcggtaatattgaacgttatattttagattaggcgttggcgaaaggttggcgttttgatttaagttatgttattaaagtggataagcgggtggcgattatcggtgtaggttcggtagggttggtttgtgcggatgttttgattcgtaatggcgtgggggtgacggtgtacgatcgttatttagaaatcggtggtttgttt

SEQ ID NO: 36788 - DNA, 546 bp, Artificial Sequence
  chemically treated genomic DNA (Homo sapiens) CpG-island No: 36788
aaacaaaccaccgatttctaaataacgatcgtacaccgtcacccccacgccattacgaatcaaaacatccgcacaaaccaaccctaccgaacctacaccgataatcgccacccgcttatccactttaataacataacttaaatcaaaacgccaacctttcgccaacgcctaatctaaaatataacgttcaatattaccgataattaccgcgccgtactcatcgcgaataatacaaacaccttcacacaaacgatcttacgaacaaacgcgtccgataatttccgacaaaatattaatctaataaaaaaactcgacgacgacgtcgatatttccgactttcaccaattcaatccactacgatatataattatacaacgaacaaatccattcacaaacgctatactcgccgcacttaaaacaacgcgaaacttcccgttatacctaatcgacgcgaaataacaaataaatttcatcaaaaccgattttacgcgcttcaatcgcccgtttattcccgctcgccacgcgcgaacgtttactaaatttata

SEQ ID NO: 36789 - DNA, 864 bp, Artificial Sequence
  chemically treated genomic DNA (Homo sapiens) CpG-island No: 36789
ttgggtaatcggcgtaggtaaaggtatcggttacgttacggcgttggcgtttgttgaggcgggagcgaaagttataggttttgattaagcgtttatttaggagtaatatttttttgcgatcgaagtgatggatgttgtcgacgttgcgtaggtcgcgtaagtgtgttagcgattgttagttgaaacggagcgattggacgcgttggttaatgcggcgggaattttacgtatgggcgcgatcgattagtttagtaaagaggattggtagtagatttttgcggttaacgtcggcggtgcgtttaatttgttttagtaaattatgaattagtttcgtcgttagcggggcggggcgattgttattgtggcgttcgacgtcgcgtatacgtcgcgtattggtatgagtgtttatggcgtatcgaaagcggcgttgaaaagtttggcgttgagcgtcgggttggaattggcgggtagcggcgtgcgttgtaatgtgggtttcgttttggttttatcgatatcgatatgtaacgtacgttgtgggtgagcgatgacgtcgaagaatagcgtattcgcggttttggcgagtagtttaaattcggtatttcgttggggaaaatcgttcgtttataagagatcgttaatacgattttgtttttcgtttttgatttcgttagttatattattttataggatattgtggtcgatggcggtttaacgttgggggtataagtatgatttggaaacgttatttaacgttcgacgaattgaacgttattagcgataatataatggtggcgtatttgggaattgtgtatattcgtttgggcgatgatgtgttggaagtcgaaatgtcggttgatattcgta

SEQ ID NO: 36790 - DNA, 864 bp, Artificial Sequence
  chemically treated genomic DNA (Homo sapiens) CpG-island No: 36790
tacgaatatcaaccgacatttcgacttccaacacatcatcgcccaaacgaatatacacaattcccaaatacgccaccattatattatcgctaataacgttcaattcgtcgaacgttaaataacgtttccaaatcatacttatacccccaacgttaaaccgccatcgaccacaatatcctataaaataatataactaacgaaatcaaaaacgaaaaacaaaatcgtattaacgatctcttataaacgaacgattttccccaacgaaataccgaatttaaactactcgccaaaaccgcgaatacgctattcttcgacgtcatcgctcacccacaacgtacgttacatatcgatatcgataaaaccaaaacgaaacccacattacaacgcacgccgctacccgccaattccaacccgacgctcaacgccaaacttttcaacgccgctttcgatacgccataaacactcataccaatacgcgacgtatacgcgacgtcgaacgccacaataacaatcgccccgccccgctaacgacgaaactaattcataatttactaaaacaaattaaacgcaccgccgacgttaaccgcaaaaatctactaccaatcctctttactaaactaatcgatcgcgcccatacgtaaaattcccgccgcattaaccaacgcgtccaatcgctccgtttcaactaacaatcgctaacacacttacgcgacctacgcaacgtcgacaacatccatcacttcgatcgcaaaaaaatattactcctaaataaacgcttaatcaaaacctataactttcgctcccgcctcaacaaacgccaacgccgtaacgtaaccgatacctttacctacgccgattacccaa

SEQ ID NO: 36791 - DNA, 864 bp, Artificial Sequence
  chemically treated genomic DNA (Homo sapiens) CpG-island No: 36791
tacgggtattaatcggtatttcggtttttagtatattatcgtttagacgggtatatataatttttagatgcgttattattgtgttatcgttggtggcgtttagttcgtcgagcgttaaatggcgtttttagattatgtttatgtttttagcgttgagtcgttatcgattataatattttgtagggtaatatggttggcgaggttagaggcgaggaataaaatcgtgttggcgattttttgtggacgggcgattttttttagcggaatgtcgagtttaaattgttcgttaaagtcgcgaatacgttgtttttcggcgttatcgtttatttatagcgtgcgttgtatatcggtgtcggtggagttagggcgaaatttatattatagcgtacgtcgttattcgttagttttagttcgacgtttaacgttaggttttttagcgtcgttttcgatgcgttataagtatttatgttaatacgcggcgtgtgcgcggcgtcggacgttatagtgataatcgtttcgtttcgttgacggcgaaattggtttatggtttgttggaataggttaaacgtatcgtcgacgttaatcgtaaaagtttgttgttagttttttttattgagttgatcggtcgcgtttatgcgtaaaattttcgtcgtattgattagcgcgtttagtcgtttcgttttagttaatagtcgttgatatatttgcgcgatttgcgtagcgtcggtaatatttattatttcggtcgtaaagggatattgtttttgagtgaacgtttgattaaaatttgtaattttcgttttcgttttaataaacgttagcgtcgtggcgtagtcgatatttttatttgcgtcggttatttag

SEQ ID NO: 36792 - DNA, 864 bp, Artificial Sequence
  chemically treated genomic DNA (Homo sapiens) CpG-island No: 36792
ctaaataaccgacgcaaataaaaatatcgactacgccacgacgctaacgtttattaaaacgaaaacgaaaattacaaattttaatcaaacgttcactcaaaaacaatatccctttacgaccgaaataataaatattaccgacgctacgcaaatcgcgcaaatatatcaacgactattaactaaaacgaaacgactaaacgcgctaatcaatacgacgaaaattttacgcataaacgcgaccgatcaactcaataaaaaaaactaacaacaaacttttacgattaacgtcgacgatacgtttaacctattccaacaaaccataaaccaatttcgccgtcaacgaaacgaaacgattatcactataacgtccgacgccgcgcacacgccgcgtattaacataaatacttataacgcatcgaaaacgacgctaaaaaacctaacgttaaacgtcgaactaaaactaacgaataacgacgtacgctataatataaatttcgccctaactccaccgacaccgatatacaacgcacgctataaataaacgataacgccgaaaaacaacgtattcgcgactttaacgaacaatttaaactcgacattccgctaaaaaaaatcgcccgtccacaaaaaatcgccaacacgattttattcctcgcctctaacctcgccaaccatattaccctacaaaatattataatcgataacgactcaacgctaaaaacataaacataatctaaaaacgccatttaacgctcgacgaactaaacgccaccaacgataacacaataataacgcatctaaaaattatatatacccgtctaaacgataatatactaaaaaccgaaataccgattaatacccgta

SEQ ID NO: 36793 - DNA, 615 bp, Artificial Sequence
  chemically treated genomic DNA (Homo sapiens) CpG-island No: 36793
tgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgaacgagcggtggtgttggggttcgatcgtgaaacgttgttgtgcggtgtgaagcgttgtttgtcggttatgaggtttttgggttggtgatcggattttggggggtttgggggtcgattgggttttggttttttcgttaggg

SEQ ID NO: 36794 - DNA, 615 bp, Artificial Sequence
  chemically treated genomic DNA (Homo sapiens) CpG-island No: 36794
ccctaacgaaaaaaccaaaacccaatcgacccccaaaccccccaaaatccgatcaccaacccaaaaacctcataaccgacaaacaacgcttcacaccgcacaacaacgtttcacgatcgaaccccaacaccaccgctcgttcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccaca

SEQ ID NO: 36795 - DNA, 615 bp, Artificial Sequence
  chemically treated genomic DNA (Homo sapiens) CpG-island No: 36795
ttttggcgggaaaattaaaatttaatcggtttttaggttttttagaattcggttattaatttagaagttttatgatcggtagatagcgttttatatcgtataataacgttttacggtcgaattttagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattata

SEQ ID NO: 36796 - DNA, 615 bp, Artificial Sequence
  chemically treated genomic DNA (Homo sapiens) CpG-island No: 36796
tataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatactaaaattcgaccgtaaaacgttattatacgatataaaacgctatctaccgatcataaaacttctaaattaataaccgaattctaaaaaacctaaaaaccgattaaattttaattttcccgccaaaa

SEQ ID NO: 36797 - DNA, 520 bp, Artificial Sequence
  chemically treated genomic DNA (Homo sapiens) CpG-island No: 36797
tcgttatcgttttttttttttttttttttggtcgttacgtagcgtcgttttatgtaggtcgtagcggttaaggcggggagttcggggcgggcgtttaggtaaggaattttcgagtcgggagagttggattaggagcgtttttcggtttcgttcgaataaggacgtcggtagagtcggtagtcgagtgtgtcgttttcgtttttagagtcgcgtcggtggtggtaaaaagcggcggcggtgggggtaaaaagttggggcggcggggataaaaagtttcggtggcgggggtaaaaagttacggcggtaaaaatcggcggcggcggggtaaaattcgtagggtaaaaagtcgtaaaaagcgcggcggcgggggtaagaagtcggtggcgggagtaaaaaattgcggcggtaaaaaggggcggcggcgggggtaaaaagtcgtaaaaagtttcgtttagggggtaaaagcgtggcgtcgggggtaagaatcgcggcggcgtgtaaaaaaaatatatatataatt

SEQ ID NO: 36798 - DNA, 520 bp, Artificial Sequence
  chemically treated genomic DNA (Homo sapiens) CpG-island No: 36798
aattatatatatattttttttacacgccgccgcgattcttacccccgacgccacgcttttaccccctaaacgaaactttttacgactttttacccccgccgccgcccctttttaccgccgcaattttttactcccgccaccgacttcttacccccgccgccgcgctttttacgactttttaccctacgaattttaccccgccgccgccgatttttaccgccgtaactttttacccccgccaccgaaactttttatccccgccgccccaactttttacccccaccgccgccgctttttaccaccaccgacgcgactctaaaaacgaaaacgacacactcgactaccgactctaccgacgtccttattcgaacgaaaccgaaaaacgctcctaatccaactctcccgactcgaaaattccttacctaaacgcccgccccgaactccccgccttaaccgctacgacctacataaaacgacgctacgtaacgaccaaaaaaaaaaaaaaaaaaaacgataacga

SEQ ID NO: 36799 - DNA, 520 bp, Artificial Sequence
  chemically treated genomic DNA (Homo sapiens) CpG-island No: 36799
aattatatatatattttttttgtacgtcgtcgcgatttttgttttcgacgttacgtttttgttttttgagcgaggttttttgcggttttttgttttcgtcgtcgtttttttttgtcgtcgtagttttttgttttcgttatcggttttttgttttcgtcgtcgcgttttttgcggttttttgttttgcggattttgtttcgtcgtcgtcggtttttgtcgtcgtggttttttattttcgttatcgaggttttttgttttcgtcgttttagttttttgtttttatcgtcgtcgttttttgttattatcgacgcggttttgagggcgggagcggtatattcggttgtcggttttatcggcgtttttgttcgggcggagtcgaggggcgtttttggtttagttttttcggttcgggggttttttgtttaggcgttcgtttcgagtttttcgttttggtcgttgcggtttgtatagagcggcgttgcgtagcggttaggggagagaagaaggagggcggtggcgg

SEQ ID NO: 36800 - DNA, 520 bp, Artificial Sequence
  chemically treated genomic DNA (Homo sapiens) CpG-island No: 36800
ccgccaccgccctccttcttctctcccctaaccgctacgcaacgccgctctatacaaaccgcaacgaccaaaacgaaaaactcgaaacgaacgcctaaacaaaaaacccccgaaccgaaaaaactaaaccaaaaacgcccctcgactccgcccgaacaaaaacgccgataaaaccgacaaccgaatataccgctcccgccctcaaaaccgcgtcgataataacaaaaaacgacgacgataaaaacaaaaaactaaaacgacgaaaacaaaaaacctcgataacgaaaataaaaaaccacgacgacaaaaaccgacgacgacgaaacaaaatccgcaaaacaaaaaaccgcaaaaaacgcgacgacgaaaacaaaaaaccgataacgaaaacaaaaaactacgacgacaaaaaaaaacgacgacgaaaacaaaaaaccgcaaaaaacctcgctcaaaaaacaaaaacgtaacgtcgaaaacaaaaatcgcgacgacgtacaaaaaaaatatatatataatt

SEQ ID NO: 36801 - DNA, 988 bp, Artificial Sequence
  chemically treated genomic DNA (Homo sapiens) CpG-island No: 36801
  misc_feature (230)..(230): n is either a, c, g or t
  misc_feature (276)..(276): n is either a, c, g or t
  misc_feature (400)..(400): n is either a, c, g or t
  misc_feature (503)..(503): n is either a, c, g or t
  misc_feature (513)..(513): n is either a, c, g or t
  misc_feature (618)..(618): n is either a, c, g or t
  misc_feature (638)..(638): n is either a, c, g or t
  misc_feature (642)..(642): n is either a, c, g or t
  misc_feature (656)..(656): n is either a, c, g or t
  misc_feature (674)..(674): n is either a, c, g or t
  misc_feature (757)..(757): n is either a, c, g or t
  misc_feature (767)..(767): n is either a, c, g or t
  misc_feature (882)..(882): n is either a, c, g or t
  misc_feature (940)..(940): n is either a, c, g or t
  misc_feature (965)..(965): n is either a, c, g or t
  misc_feature (983)..(983): n is either a, c, g or t
gttcgttcgtataattttcgtttttattttttcgtttttttaattatatttttttttatttatttatttttattttattcgtacgttttcgtcgtatacgttatttatatacgttcgtttaatacgtttttcgcgcgcgttcgtttattatatttcgtacgttcgtacgttattatagtattttagttagtttttatattttgcgttcgtatttcgtcgtatttttattnatcgttttttcgttattttatttttacgttttcgcgcgtatatatngttcgtatcgcgttcgtttttacgttatcgtttatttttatattcgcgattttcgcgttttatatcgtcgtcgcgcgcgtacgtatcgtcgcgttttttcgtcgtttattttcgcgcgttcgtnttatcgcgttcgcgtttttttttttttttttttttagtttacgttcgtacgtatcgcgcgttatatttattatcgtatttatcgttttttttttatttcgttnttcgcgtttnttcgtacgtattatttttcgttacgttatattcgcgttttttatcgttcgcgttttttcgtttttttacgttatcgtcgtatataagttttttcgttttttgtantcgcgttcgcgtttttcgtnatanttcgcgttaataanttttcgttttattataantttaatatacgtaattacgttttcgtatcgttatcggttttcgagttcgtttcgttttttagttttttcgcgttaataattangttttttatntcgttttaatacgtaatcgttgcgtagtttttatatcgttttaatatcgcgtcgtaaataattcgtttttcgtttagcgcgtcgtatcgcgttatttttatcgttgtatatttantttagttttaatattttaacgttttttttcgcgcgtcgtcgtacgttcgttcgttaanatttatttatatattcgcgtaaatnttttaaagcggtacgttntttcg

SEQ ID NO: 36802 - DNA, 988 bp, Artificial Sequence
  chemically treated genomic DNA (Homo sapiens) CpG-island No: 36802
  misc_feature (6)..(6): n is either a, c, g or t
  misc_feature (24)..(24): n is either a, c, g or t
  misc_feature (49)..(49): n is either a, c, g or t
  misc_feature (107)..(107): n is either a, c, g or t
  misc_feature (222)..(222): n is either a, c, g or t
  misc_feature (232)..(232): n is either a, c, g or t
  misc_feature (315)..(315): n is either a, c, g or t
  misc_feature (333)..(333): n is either a, c, g or t
  misc_feature (347)..(347): n is either a, c, g or t
  misc_feature (351)..(351): n is either a, c, g or t
  misc_feature (371)..(371): n is either a, c, g or t
  misc_feature (476)..(476): n is either a, c, g or t
  misc_feature (486)..(486): n is either a, c, g or t
  misc_feature (589)..(589): n is either a, c, g or t
  misc_feature (713)..(713): n is either a, c, g or t
  misc_feature (759)..(759): n is either a, c, g or t
cgaaanaacgtaccgctttaaaanatttacgcgaatatataaataaatnttaacgaacgaacgtacgacgacgcgcgaaaaaaaacgttaaaatattaaaactaaantaaatatacaacgataaaaataacgcgatacgacgcgctaaacgaaaaacgaattatttacgacgcgatattaaaacgatataaaaactacgcaacgattacgtattaaaacganataaaaaacntaattattaacgcgaaaaaactaaaaaacgaaacgaactcgaaaaccgataacgatacgaaaacgtaattacgtatattaaanttataataaaacgaaaanttattaacgcgaantatnacgaaaaacgcgaacgcgantacaaaaaacgaaaaaacttatatacgacgataacgtaaaaaaacgaaaaaacgcgaacgataaaaaacgcgaatataacgtaacgaaaaataatacgtacgaanaaacgcgaanaacgaaataaaaaaaaaacgataaatacgataataaatataacgcgcgatacgtacgaacgtaaactaaaaaaaaaaaaaaaaaaaaacgcgaacgcgataanacgaacgcgcgaaaataaacgacgaaaaaacgcgacgatacgtacgcgcgcgacgacgatataaaacgcgaaaatcgcgaatataaaaataaacgataacgtaaaaacgaacgcgatacgaacnatatatacgcgcgaaaacgtaaaaataaaataacgaaaaaacgatnaataaaaatacgacgaaatacgaacgcaaaatataaaaactaactaaaatactataataacgtacgaacgtacgaaatataataaacgaacgcgcgcgaaaaacgtattaaacgaacgtatataaataacgtatacgacgaaaacgtacgaataaaataaaaataaataaataaaaaaaaatataattaaaaaaacgaaaaaataaaaacgaaaattatacgaacgaac

SEQ ID NO: 36803 - DNA, 988 bp, Artificial Sequence
  chemically treated genomic DNA (Homo sapiens) CpG-island No: 36803
  misc_feature (6)..(6): n is either a, c, g or t
  misc_feature (24)..(24): n is either a, c, g or t
  misc_feature (49)..(49): n is either a, c, g or t
  misc_feature (107)..(107): n is either a, c, g or t
  misc_feature (222)..(222): n is either a, c, g or t
  misc_feature (232)..(232): n is either a, c, g or t
  misc_feature (315)..(315): n is either a, c, g or t
  misc_feature (333)..(333): n is either a, c, g or t
  misc_feature (347)..(347): n is either a, c, g or t
  misc_feature (351)..(351): n is either a, c, g or t
  misc_feature (371)..(371): n is either a, c, g or t
  misc_feature (476)..(476): n is either a, c, g or t
  misc_feature (486)..(486): n is either a, c, g or t
  misc_feature (589)..(589): n is either a, c, g or t
  misc_feature (713)..(713): n is either a, c, g or t
  misc_feature (759)..(759): n is either a, c, g or t
cggggnggcgtgtcgttttgaggngtttgcgcggatgtgtgagtgggtnttgacgggcgagcgtgcgacggcgcgcgaagaaaagcgttgggatgttggggttggantgggtgtgtagcggtgagggtggcgcgatgcggcgcgttggacgaggagcgggttgtttgcggcgcggtgttggagcggtgtgggagttgcgtagcggttgcgtgttgagacgangtggggagtntggttgttggcgcgagaaggttgggaagcgaagcgagttcgagagtcggtgacggtgcgggggcgtgattgcgtgtgttgganttgtgatgagacgggganttgttggcgcggantgtngcgggaagcgcgagcgcgantgtagagagcgaggggatttgtgtgcggcggtggcgtgggggggcgagagagcgcgagcggtggggagcgcgggtgtggcgtggcgagaagtggtgcgtgcgagngggcgcgagnggcggggtgggagagggacgatgagtgcgatggtgggtgtggcgcgcggtgcgtgcgagcgtgggttggagagagaggagagagagagcgcgagcgcggtggngcgggcgcgcgagagtgagcggcgagagagcgcggcggtgcgtgcgcgcgcggcggcggtgtgggacgcgggagtcgcgagtgtgagagtgggcgatggcgtggggacgagcgcgatgcgagtngtgtgtgcgcgcgggagcgtggggatgagatggcgggaggacgatnggtggggatgcggcgagatgcgggcgtagagtgtgagagttggttgggatgttgtgatggcgtgcgagcgtgcggagtgtgatgggcgagcgcgcgcgaggggcgtgttgagcgagcgtgtgtgagtggcgtgtgcggcgggggcgtgcgggtggagtaaaaatgggtgagtgggggagagtgtggttgggagggcgggggagtgagagcgagagttgtgcgagcgagt

SEQ ID NO: 36804 - DNA, 988 bp, Artificial Sequence
  chemically treated genomic DNA (Homo sapiens) CpG-island No: 36804
  misc_feature (230)..(230): n is either a, c, g or t
  misc_feature (276)..(276): n is either a, c, g or t
  misc_feature (400)..(400): n is either a, c, g or t
  misc_feature (503)..(503): n is either a, c, g or t
  misc_feature (513)..(513): n is either a, c, g or t
  misc_feature (618)..(618): n is either a, c, g or t
  misc_feature (638)..(638): n is either a, c, g or t
  misc_feature (642)..(642): n is either a, c, g or t
  misc_feature (656)..(656): n is either a, c, g or t
  misc_feature (674)..(674): n is either a, c, g or t
  misc_feature (757)..(757): n is either a, c, g or t
  misc_feature (767)..(767): n is either a, c, g or t
  misc_feature (882)..(882): n is either a, c, g or t
  misc_feature (940)..(940): n is either a, c, g or t
  misc_feature (965)..(965): n is either a, c, g or t
  misc_feature (983)..(983): n is either a, c, g or t
actcgctcgcacaactctcgctctcactcccccgccctcccaaccacactctcccccactcacccatttttactccacccgcacgcccccgccgcacacgccactcacacacgctcgctcaacacgcccctcgcgcgcgctcgcccatcacactccgcacgctcgcacgccatcacaacatcccaaccaactctcacactctacgcccgcatctcgccgcatccccaccnatcgtcctcccgccatctcatccccacgctcccgcgcgcacacacnactcgcatcgcgctcgtccccacgccatcgcccactctcacactcgcgactcccgcgtcccacaccgccgccgcgcgcgcacgcaccgccgcgctctctcgccgctcactctcgcgcgcccgcnccaccgcgctcgcgctctctctctcctctctctccaacccacgctcgcacgcaccgcgcgccacacccaccatcgcactcatcgtccctctcccaccccgccnctcgcgcccnctcgcacgcaccacttctcgccacgccacacccgcgctccccaccgctcgcgctctctcgcccccccacgccaccgccgcacacaaatcccctcgctctctacantcgcgctcgcgcttcccgcnacantccgcgccaacaantccccgtctcatcacaantccaacacacgcaatcacgcccccgcaccgtcaccgactctcgaactcgcttcgcttcccaaccttctcgcgccaacaaccanactccccacntcgtctcaacacgcaaccgctacgcaactcccacaccgctccaacaccgcgccgcaaacaacccgctcctcgtccaacgcgccgcatcgcgccaccctcaccgctacacacccantccaaccccaacatcccaacgcttttcttcgcgcgccgtcgcacgctcgcccgtcaanacccactcacacatccgcgcaaacncctcaaaacgacacgccnccccg

SEQ ID NO: 36805 - DNA, 502 bp, Artificial Sequence
  chemically treated genomic DNA (Homo sapiens) CpG-island No: 36805
tttaggggcggcggtcgtttttcggtggcgacggtagaagtagcgataggcgtttggagtcggagtcgtttagttggggttcgcgatttatttcgagtttcggaggcgaggttcggagggggcgggtcggcgagagggcggagtcgcgttttttcgcgtatttgttatttttcgcgttagtttaggtgaagtttagggtttttttatcggttacgattcgggtcgatttatcggttaggaaggtcgcgttgtttatatattttttttggatttcgggtagtcgtttttgatttagttcgagtggcgtaagtagtacgcgttcgtatttttcgtttgatttgttttttttcggtttcggtgttcgttatttttatagtttttcgttatttattacgcgtttttagatttttgcggtcgaaatatcgcgagatttcgttcggggtagttgttattgtggtaaagaatttatttttttattatagcgtgcgtattagtaagtgaa

SEQ ID NO: 36806 - DNA, 502 bp, Artificial Sequence
  chemically treated genomic DNA (Homo sapiens) CpG-island No: 36806
ttcacttactaatacgcacgctataataaaaaaataaattctttaccacaataacaactaccccgaacgaaatctcgcgatatttcgaccgcaaaaatctaaaaacgcgtaataaataacgaaaaactataaaaataacgaacaccgaaaccgaaaaaaaacaaatcaaacgaaaaatacgaacgcgtactacttacgccactcgaactaaatcaaaaacgactacccgaaatccaaaaaaaatatataaacaacgcgaccttcctaaccgataaatcgacccgaatcgtaaccgataaaaaaaccctaaacttcacctaaactaacgcgaaaaataacaaatacgcgaaaaaacgcgactccgccctctcgccgacccgccccctccgaacctcgcctccgaaactcgaaataaatcgcgaaccccaactaaacgactccgactccaaacgcctatcgctacttctaccgtcgccaccgaaaaacgaccgccgcccctaaa

SEQ ID NO: 36807 - DNA, 502 bp, Artificial Sequence
  chemically treated genomic DNA (Homo sapiens) CpG-island No: 36807
tttatttgttgatacgtacgttgtggtaaaaaagtgaattttttattatagtagtagttgtttcgagcgaagtttcgcgatatttcggtcgtagggatttagaggcgcgtagtgagtggcggaggattgtgggggtggcgggtatcggagtcgggaagggataggttaggcggggagtgcgagcgcgtattgtttgcgttattcgggttgggttaggagcggttgttcgaggtttagaggaagtgtgtggatagcgcggtttttttggtcggtgagtcggttcgggtcgtggtcggtgaggggattttgagttttatttgggttagcgcggggagtgataggtgcgcgaaggagcgcggtttcgttttttcgtcgattcgtttttttcgggtttcgttttcggggttcgggatgagtcgcgggttttagttgagcggtttcggttttaggcgtttgtcgttgtttttgtcgtcgttatcgaagagcggtcgtcgtttttgag

SEQ ID NO: 36808 - DNA, 502 bp, Artificial Sequence
  chemically treated genomic DNA (Homo sapiens) CpG-island No: 36808
ctcaaaaacgacgaccgctcttcgataacgacgacaaaaacaacgacaaacgcctaaaaccgaaaccgctcaactaaaacccgcgactcatcccgaaccccgaaaacgaaacccgaaaaaaacgaatcgacgaaaaaacgaaaccgcgctccttcgcgcacctatcactccccgcgctaacccaaataaaactcaaaatcccctcaccgaccacgacccgaaccgactcaccgaccaaaaaaaccgcgctatccacacacttcctctaaacctcgaacaaccgctcctaacccaacccgaataacgcaaacaatacgcgctcgcactccccgcctaacctatcccttcccgactccgatacccgccacccccacaatcctccgccactcactacgcgcctctaaatccctacgaccgaaatatcgcgaaacttcgctcgaaacaactactactataataaaaaattcacttttttaccacaacgtacgtatcaacaaataaa

SEQ ID NO: 36809 - DNA, 529 bp, Artificial Sequence
  chemically treated genomic DNA (Homo sapiens) CpG-island No: 36809
gtcgattgttatttagggtgtagtcggggtggtggggggcggggggcgtggggagggggggcgggggggggcggcgaggtaaggagcgacgggacggatacggacggcgggggaattaaagggtaaaatataggaaaagagataaaggatagataagagaagagaggaaagagtaaaaaagggaatcgggacgcgcgagagaggatagggcgcggcggaacgcgtagtacgtagacgttagtcggggggagaaagtttgagggagaggtagagcggtggaggagaagggcgtagatgacgttcgaattaaaattgggcgaggtaagaggaagaagaaatagtataataggtgtggagagacgaatagacgggacggagagcgggaatagtacgttgaatagtaggatagtcgttcgttagttttagatataaagtttatagatgaggtagaaagtaaattaaatatacgttttaagtaatttattcgatttacggttaaaatattttgaaacgaggcgtgaaataagga

SEQ ID NO: 36810 - DNA, 529 bp, Artificial Sequence
  chemically treated genomic DNA (Homo sapiens) CpG-island No: 36810
tccttatttcacgcctcgtttcaaaatattttaaccgtaaatcgaataaattacttaaaacgtatatttaatttactttctacctcatctataaactttatatctaaaactaacgaacgactatcctactattcaacgtactattcccgctctccgtcccgtctattcgtctctccacacctattatactatttcttcttcctcttacctcgcccaattttaattcgaacgtcatctacgcccttctcctccaccgctctacctctccctcaaactttctccccccgactaacgtctacgtactacgcgttccgccgcgccctatcctctctcgcgcgtcccgattcccttttttactctttcctctcttctcttatctatcctttatctcttttcctatattttaccctttaattcccccgccgtccgtatccgtcccgtcgctccttacctcgccgcccccccccgccccccctccccacgccccccgccccccaccaccccgactacaccctaaataacaatcgac

SEQ ID NO: 36811 - DNA, 529 bp, Artificial Sequence
  chemically treated genomic DNA (Homo sapiens) CpG-island No: 36811
tttttgttttacgtttcgttttagggtgttttggtcgtaggtcgggtggattatttggggcgtgtgtttggtttgttttttgttttatttataagttttgtgtttggggttggcgggcggttgttttgttgtttaacgtgttgttttcgtttttcgtttcgtttgttcgtttttttatatttgttatattgtttttttttttttttgtttcgtttagttttaattcgggcgttatttgcgttttttttttttatcgttttgttttttttttaaatttttttttttcgattggcgtttgcgtattgcgcgtttcgtcgcgttttgttttttttcgcgcgtttcggtttttttttttgtttttttttttttttttttgtttgttttttgtttttttttttgtgttttgttttttagttttttcgtcgttcgtgttcgtttcgtcgttttttgtttcgtcgttttttttcgttttttttttttacgtttttcgttttttattatttcggttatattttggatgataatcgat

SEQ ID NO: 36812 - DNA, 529 bp, Artificial Sequence
  chemically treated genomic DNA (Homo sapiens) CpG-island No: 36812
atcgattatcatccaaaatataaccgaaataataaaaaacgaaaaacgtaaaaaaaaaaaacgaaaaaaaacgacgaaacaaaaaacgacgaaacgaacacgaacgacgaaaaaactaaaaaacaaaacacaaaaaaaaaaacaaaaaacaaacaaaaaaaaaaaaaaaaaaacaaaaaaaaaaaccgaaacgcgcgaaaaaaaacaaaacgcgacgaaacgcgcaatacgcaaacgccaatcgaaaaaaaaaaatttaaaaaaaaaacaaaacgataaaaaaaaaaaacgcaaataacgcccgaattaaaactaaacgaaacaaaaaaaaaaaaaaacaatataacaaatataaaaaaacgaacaaacgaaacgaaaaacgaaaacaacacgttaaacaacaaaacaaccgcccgccaaccccaaacacaaaacttataaataaaacaaaaaacaaaccaaacacacgccccaaataatccacccgacctacgaccaaaacaccctaaaacgaaacgtaaaacaaaaa

SEQ ID NO: 36813 - DNA, 700 bp, Artificial Sequence
  chemically treated genomic DNA (Homo sapiens) CpG-island No: 36813
agtaacgaggttatggtcgggtcgggtcgtgttcgattttttggatatcggaggcgttgtggattttagggagggggtcggagggatttgagaaatttcggttgatttcgggattcgatcgtttttgttggtttatttattgttcgttcgttttttttttttgtgtcgttcgttcgttcgtcggtagtttgttgtttgtttgttttttcgttcgttttttcggttttcgtcgtttacgtcggaaattgcgttatagttaatcgtcgagatttttgcgaggttgtgtacgtgcgttgcgtagtcgcgatgaggtatggttttggacgtttttagcggggtttatattgtcggggttaagtgtcgggtaggggtaaagtaaaaaggagagttgtggggaatggtgcgttgagaattgagttttcgagagattcggaaacggtgcggttttttttgttgtttcggaattcgtttttatcgaagggatttttttagtcgttgtattttcggggataacgtcgtcgcgttttagtgacgtaggttcggggaagtcggggattcgggtattgggttcgggggtgtagtttttgattttcgttgtttttgttcgtttgtcgaggtttaagtgtttaggttagagcgaaaaagataagcgtcgttgtattaagtttttttggtatatttttttgttaattgattttcg

SEQ ID NO: 36814 - DNA, 700 bp, Artificial Sequence
  chemically treated genomic DNA (Homo sapiens) CpG-island No: 36814
cgaaaatcaattaacaaaaaaatataccaaaaaaacttaatacaacgacgcttatctttttcgctctaacctaaacacttaaacctcgacaaacgaacaaaaacaacgaaaatcaaaaactacacccccgaacccaatacccgaatccccgacttccccgaacctacgtcactaaaacgcgacgacgttatccccgaaaatacaacgactaaaaaaatcccttcgataaaaacgaattccgaaacaacaaaaaaaaccgcaccgtttccgaatctctcgaaaactcaattctcaacgcaccattccccacaactctcctttttactttacccctacccgacacttaaccccgacaatataaaccccgctaaaaacgtccaaaaccatacctcatcgcgactacgcaacgcacgtacacaacctcgcaaaaatctcgacgattaactataacgcaatttccgacgtaaacgacgaaaaccgaaaaaacgaacgaaaaaacaaacaaacaacaaactaccgacgaacgaacgaacgacacaaaaaaaaaaaacgaacgaacaataaataaaccaacaaaaacgatcgaatcccgaaatcaaccgaaatttctcaaatccctccgaccccctccctaaaatccacaacgcctccgatatccaaaaaatcgaacacgacccgacccgaccataacctcgttact

SEQ ID NO: 36815 - DNA, 700 bp, Artificial Sequence
  chemically treated genomic DNA (Homo sapiens) CpG-island No: 36815
cgagaattagttggtagggaaatgtattaggaaagtttggtataacggcgtttgtttttttcgttttagtttaaatatttgagtttcggtaaacgggtagaggtagcgggaattagggattatattttcgaatttagtattcgggttttcgattttttcgagtttacgttattggggcgcgacggcgttgttttcgggagtgtagcggttgagaaggttttttcggtgaaggcgagtttcgggataatagagagggtcgtatcgttttcgagtttttcggaggtttagtttttagcgtattattttttatagtttttttttttattttatttttattcgatatttgatttcggtagtgtgaatttcgttgggagcgtttaaagttatgttttatcgcggttgcgtagcgtacgtgtatagtttcgtaggagtttcggcgattggttgtgacgtagttttcggcgtgagcggcgaaagtcgggagggcgagcgagagagtaagtaggtagtaggttgtcggcgggcgggcggacggtatagagggagggagcgagcgagtagtgagtaagttagtaagggcggtcgggtttcgaggttagtcgagattttttaggttttttcggttttttttttggagtttatagcgttttcggtgtttagaggatcggatacggttcggttcggttatggtttcgttgtt

SEQ ID NO: 36816 - DNA, 700 bp, Artificial Sequence
  chemically treated genomic DNA (Homo sapiens) CpG-island No: 36816
aacaacgaaaccataaccgaaccgaaccgtatccgatcctctaaacaccgaaaacgctataaactccaaaaaaaaaaccgaaaaaacctaaaaaatctcgactaacctcgaaacccgaccgcccttactaacttactcactactcgctcgctccctccctctataccgtccgcccgcccgccgacaacctactacctacttactctctcgctcgccctcccgactttcgccgctcacgccgaaaactacgtcacaaccaatcgccgaaactcctacgaaactatacacgtacgctacgcaaccgcgataaaacataactttaaacgctcccaacgaaattcacactaccgaaatcaaatatcgaataaaaataaaataaaaaaaaaaactataaaaaataatacgctaaaaactaaacctccgaaaaactcgaaaacgatacgaccctctctattatcccgaaactcgccttcaccgaaaaaaccttctcaaccgctacactcccgaaaacaacgccgtcgcgccccaataacgtaaactcgaaaaaatcgaaaacccgaatactaaattcgaaaatataatccctaattcccgctacctctacccgtttaccgaaactcaaatatttaaactaaaacgaaaaaaacaaacgccgttataccaaactttcctaatacatttccctaccaactaattctcg

SEQ ID NO: 36817 - DNA, 623 bp, Artificial Sequence
  chemically treated genomic DNA (Homo sapiens) CpG-island No: 36817
tttcgcgttaggcgggtgcgaggggtgcgtgggtttggggacgcgggagggtttgtggtaggcgagtcgaaggacgtggtcgtgcgcgtcgtcgagggtcgggcgattcggcggcgggtagcgggagtcgtcgcggaagtgggggagaggggggcgaggggtgcggggttcggtcgaggcgggcggcggggggcgcggggggggcggcgtgttcgagtttcggtcgtggcggcgggtcgcgacggtggtcgaggcgcggggcggcgcggtcgcgggagtcggcgtgggcggggtgcgttaggcgggggtgggcgtcgggggagggggcggtagagggggtggggcgggggcgggggcgttattcgtcgtcgcgtcggggtcgagggggtcggcgtgtttcggcggcggggggggggggcggggcggggtgggcgaggaggcgaaggcggtagggcggagtgtcggcggaggggcggggggcgtcgggcgtcggcggggtcgcgtgcgtgtcgggggtgtggggggtttattcgcgaatggcgtgtttatcgttgtggtagtggtgtcgtagtttttgcggttaattttattaattcggtattttaggttttagtatggtattt

SEQ ID NO: 36818 - DNA, 623 bp, Artificial Sequence
  chemically treated genomic DNA (Homo sapiens) CpG-island No: 36818
aaataccatactaaaacctaaaataccgaattaataaaattaaccgcaaaaactacgacaccactaccacaacgataaacacgccattcgcgaataaaccccccacacccccgacacgcacgcgaccccgccgacgcccgacgccccccgcccctccgccgacactccgccctaccgccttcgcctcctcgcccaccccgccccgccccccccccccgccgccgaaacacgccgaccccctcgaccccgacgcgacgacgaataacgcccccgcccccgccccaccccctctaccgccccctcccccgacgcccacccccgcctaacgcaccccgcccacgccgactcccgcgaccgcgccgccccgcgcctcgaccaccgtcgcgacccgccgccacgaccgaaactcgaacacgccgccccccccgcgccccccgccgcccgcctcgaccgaaccccgcacccctcgcccccctctcccccacttccgcgacgactcccgctacccgccgccgaatcgcccgaccctcgacgacgcgcacgaccacgtccttcgactcgcctaccacaaaccctcccgcgtccccaaacccacgcacccctcgcacccgcctaacgcgaaa

SEQ ID NO: 36819 - DNA, 623 bp, Artificial Sequence
  chemically treated genomic DNA (Homo sapiens) CpG-island No: 36819
ggatattatattaaaatttgaagtgtcgaattaatggaattgatcgtaggagttacgatattattattataacgatgggtacgttattcgcggataggttttttatattttcgatacgtacgcggtttcgtcgacgttcgacgtttttcgttttttcgtcggtatttcgttttgtcgttttcgttttttcgtttatttcgtttcgtttttttttttcgtcgtcggggtacgtcggttttttcggtttcggcgcggcggcgggtggcgttttcgttttcgttttattttttttgtcgttttttttttcggcgtttattttcgtttggcgtatttcgtttacgtcggttttcgcggtcgcgtcgtttcgcgtttcggttatcgtcgcgattcgtcgttacggtcggggttcgggtacgtcgtttttttcgcgtttttcgtcgttcgtttcggtcgggtttcgtatttttcgttttttttttttttattttcgcggcgattttcgttgttcgtcgtcgaatcgttcgattttcgacggcgcgtacggttacgtttttcggttcgtttgttatagattttttcgcgtttttaggtttacgtatttttcgtattcgtttagcgcgaga

SEQ ID NO: 36820 - DNA, 623 bp, Artificial Sequence
  chemically treated genomic DNA (Homo sapiens) CpG-island No: 36820
tctcgcgctaaacgaatacgaaaaatacgtaaacctaaaaacgcgaaaaaatctataacaaacgaaccgaaaaacgtaaccgtacgcgccgtcgaaaatcgaacgattcgacgacgaacaacgaaaatcgccgcgaaaataaaaaaaaaaaaaacgaaaaatacgaaacccgaccgaaacgaacgacgaaaaacgcgaaaaaaacgacgtacccgaaccccgaccgtaacgacgaatcgcgacgataaccgaaacgcgaaacgacgcgaccgcgaaaaccgacgtaaacgaaatacgccaaacgaaaataaacgccgaaaaaaaaaacgacaaaaaaaataaaacgaaaacgaaaacgccacccgccgccgcgccgaaaccgaaaaaaccgacgtaccccgacgacgaaaaaaaaaaacgaaacgaaataaacgaaaaaacgaaaacgacaaaacgaaataccgacgaaaaaacgaaaaacgtcgaacgtcgacgaaaccgcgtacgtatcgaaaatataaaaaacctatccgcgaataacgtacccatcgttataataataatatcgtaactcctacgatcaattccattaattcgacacttcaaattttaatataatatcc

SEQ ID NO: 36821 - DNA, 1049 bp, Artificial Sequence
  chemically treated genomic DNA (Homo sapiens) CpG-island No: 36821
  misc_feature (847)..(847): n is either a, c, g or t
  misc_feature (910)..(910): n is either a, c, g or t
  misc_feature (932)..(933): n is either a, c, g or t
  misc_feature (1000)..(1000): n is either a, c, g or t
gttcgcgttagagcgtagaatttcgggatttggttagttttcgagttttagggcgtagggtgtttaagtcgattattttattcggcgtggttgtttttcgcgtttatttttttagttcggtttttattttcgcgaagtcgtagtagatttgagacgttggcggatatttcgttgtcgtttcggttcgcggtttttttttttaggtttttggaagcggttagtttatagatcggttggtcgatggtttaaggattttttcgtaatgtcggtttcgttggtttttcgcgcgttcgttggcgtcgtttgttttcgtttttttcgttgagcgcggagttcgagttttagtttttcgggtttttcgtagttcgtttcgtagttgttttggtatcggtagatgacgttagtagagagttttcggcgttttttaacgcgttcgcgtttttttttttaaagagtcgttaatagtagatagcgggagcgcggttatcgatgtcgttgtgttttcgggcgtcgagttttttatggcgcgggcgagttcgtcgtttacgttttttttgttgaggatcgtttggatggagaaggacgttaaggtgttggcgtcgcgtatagttatttgcgtcgcgggtaggagcggtcggcgcggcgggtagttggggcgtcgagtagtttcgagcgggaaaaaaagcgtcggcgtcgtaacgtagtttatttgggtgttcgatgtcgcgtcgtttattgttgtcggtttagtagttttcgttttatttcgttttaggattagcgtcgattttttttagtattttataggcgtatttcgttcggagatatttttttttcgaatttagangtagacgtttttttttcgtagtttagttggattattttatcgtttttcgtttttaggggaggnttggggtttagtttttcgcganncgtgaaggaggaattgcgggggttttttcgtggtagtagttttttttcgagcgtcgtcgggtaatangttcgagttatttttttttttcgggtttgtttttttttcgttgtaggat

SEQ ID NO: 36822 - DNA, 1049 bp, Artificial Sequence
  chemically treated genomic DNA (Homo sapiens) CpG-island No: 36822
  misc_feature (50)..(50): n is either a, c, g or t
  misc_feature (117)..(118): n is either a, c, g or t
  misc_feature (140)..(140): n is either a, c, g or t
  misc_feature (203)..(203): n is either a, c, g or t
atcctacaacgaaaaaaaaacaaacccgaaaaaaaaaaataactcgaacntattacccgacgacgctcgaaaaaaaactactaccacgaaaaaacccccgcaattcctccttcacgnntcgcgaaaaactaaaccccaancctcccctaaaaacgaaaaacgataaaataatccaactaaactacgaaaaaaaaacgtctacntctaaattcgaaaaaaaaatatctccgaacgaaatacgcctataaaatactaaaaaaaatcgacgctaatcctaaaacgaaataaaacgaaaactactaaaccgacaacaataaacgacgcgacatcgaacacccaaataaactacgttacgacgccgacgctttttttcccgctcgaaactactcgacgccccaactacccgccgcgccgaccgctcctacccgcgacgcaaataactatacgcgacgccaacaccttaacgtccttctccatccaaacgatcctcaacaaaaaaaacgtaaacgacgaactcgcccgcgccataaaaaactcgacgcccgaaaacacaacgacatcgataaccgcgctcccgctatctactattaacgactctttaaaaaaaaaaacgcgaacgcgttaaaaaacgccgaaaactctctactaacgtcatctaccgataccaaaacaactacgaaacgaactacgaaaaacccgaaaaactaaaactcgaactccgcgctcaacgaaaaaaacgaaaacaaacgacgccaacgaacgcgcgaaaaaccaacgaaaccgacattacgaaaaaatccttaaaccatcgaccaaccgatctataaactaaccgcttccaaaaacctaaaaaaaaaaaccgcgaaccgaaacgacaacgaaatatccgccaacgtctcaaatctactacgacttcgcgaaaataaaaaccgaactaaaaaaataaacgcgaaaaacaaccacgccgaataaaataatcgacttaaacaccctacgccctaaaactcgaaaactaaccaaatcccgaaattctacgctctaacgcgaac

SEQ ID NO: 36823 - DNA, 1049 bp, Artificial Sequence
  chemically treated genomic DNA (Homo sapiens) CpG-island No: 36823
  misc_feature (50)..(50): n is either a, c, g or t
  misc_feature (117)..(118): n is either a, c, g or t
  misc_feature (140)..(140): n is either a, c, g or t
  misc_feature (203)..(203): n is either a, c, g or t
attttgtagcgaggaaggaatagattcgaaaagaaaaagtgattcgggtntgttgttcggcggcgttcgggagggaattgttgttacggaagggttttcgtaattttttttttacgnntcgcgagggattagattttagnttttttttaagggcgagaagcgatgagataatttagttgagttgcgaaaggagagcgtttgtntttggattcggggggagggtgttttcgggcggggtgcgtttataaggtgttagagagggtcggcgttgattttgagacggagtggggcgggagttgttgggtcggtagtagtgggcggcgcggtatcgaatatttagataaattgcgttgcggcgtcggcgttttttttttcgttcggagttgttcggcgttttagttgttcgtcgcgtcggtcgtttttgttcgcggcgtagatggttgtgcgcggcgttaatattttgacgtttttttttatttaggcgatttttaataagaaagacgtgagcggcgggttcgttcgcgttatggagggttcggcgttcgggggtatagcggtatcggtggtcgcgttttcgttgtttgttgttggcggttttttggggagagggacgcgggcgcgttggggggcgtcgaggattttttgttggcgttatttgtcggtattagaatagttgcggggcggattgcggagagttcggaaggttgggattcggatttcgcgtttagcgaggagaacgagagtaggcggcgttagcggacgcgcggggagttagcggggtcggtattgcggggggatttttgagttatcggttagtcggtttgtgagttggtcgtttttaaagatttagaggaggaagtcgcgggtcggagcgatagcgagatgttcgttagcgttttaggtttgttgcggtttcgcggggatgggggtcgggttgaggggatggacgcggagggtaattacgtcgagtggggtggtcggtttgagtattttgcgttttggggttcggaggttggttaaatttcgaagttttgcgttttggcgcgagt

SEQ ID NO: 36824 - DNA, 1049 bp, Artificial Sequence
  chemically treated genomic DNA (Homo sapiens) CpG-island No: 36824
  misc_feature (847)..(847): n is either a, c, g or t
  misc_feature (910)..(910): n is either a, c, g or t
  misc_feature (932)..(933): n is either a, c, g or t
  misc_feature (1000)..(1000): n is either a, c, g or t
actcgcgccaaaacgcaaaacttcgaaatttaaccaacctccgaaccccaaaacgcaaaatactcaaaccgaccaccccactcgacgtaattaccctccgcgtccatcccctcaacccgacccccatccccgcgaaaccgcaacaaacctaaaacgctaacgaacatctcgctatcgctccgacccgcgacttcctcctctaaatctttaaaaacgaccaactcacaaaccgactaaccgataactcaaaaatccccccgcaataccgaccccgctaactccccgcgcgtccgctaacgccgcctactctcgttctcctcgctaaacgcgaaatccgaatcccaaccttccgaactctccgcaatccgccccgcaactattctaataccgacaaataacgccaacaaaaaatcctcgacgccccccaacgcgcccgcgtccctctccccaaaaaaccgccaacaacaaacaacgaaaacgcgaccaccgataccgctatacccccgaacgccgaaccctccataacgcgaacgaacccgccgctcacgtctttcttattaaaaatcgcctaaataaaaaaaaacgtcaaaatattaacgccgcgcacaaccatctacgccgcgaacaaaaacgaccgacgcgacgaacaactaaaacgccgaacaactccgaacgaaaaaaaaaacgccgacgccgcaacgcaatttatctaaatattcgataccgcgccgcccactactaccgacccaacaactcccgccccactccgtctcaaaatcaacgccgaccctctctaacaccttataaacgcaccccgcccgaaaacaccctccccccgaatccaaanacaaacgctctcctttcgcaactcaactaaattatctcatcgcttctcgcccttaaaaaaaanctaaaatctaatccctcgcganncgtaaaaaaaaaattacgaaaacccttccgtaacaacaattccctcccgaacgccgccgaacaacanacccgaatcactttttcttttcgaatctattccttcctcgctacaaaat

SEQ ID NO: 36825 - DNA, 514 bp, Artificial Sequence
  chemically treated genomic DNA (Homo sapiens) CpG-island No: 36825
cgtttttcgcggtttagcgttcgtattatcgtttttttttttttgtcgtagtcgcgtcgtcgcgtagcgttttagttatacgtcggcgggtagaagtcgttcgtttttcgggtaaggcgcggcgttttttttttttttatttttcgttttcggttttttcggagacgttaaggtggcggcgcgaagttgcggggttcgtgttgttcggtcgtggcgtcgtcgttagggtttggcgcgttttcgttcgcgtttagttggtcgaggcgttattgtggtaacggttcggtcggttaggtttttttcggggttggtaggggtcgcgaggttttgttcgagtcgtggttgagtcgcggttcgaacgtgtttggtcgggttaaagtcgattttcgtcgtcgcgggattttttttttttcggggcgcggagtttgtttttagcgtcggtgtcggatttttagcgttttggggacggtgggttttcgttgtttggattgggtttcgggttcgggttggtatg

SEQ ID NO: 36826 - DNA, 514 bp, Artificial Sequence
  chemically treated genomic DNA (Homo sapiens) CpG-island No: 36826
cataccaacccgaacccgaaacccaatccaaacaacgaaaacccaccgtccccaaaacgctaaaaatccgacaccgacgctaaaaacaaactccgcgccccgaaaaaaaaaaaatcccgcgacgacgaaaatcgactttaacccgaccaaacacgttcgaaccgcgactcaaccacgactcgaacaaaacctcgcgacccctaccaaccccgaaaaaaacctaaccgaccgaaccgttaccacaataacgcctcgaccaactaaacgcgaacgaaaacgcgccaaaccctaacgacgacgccacgaccgaacaacacgaaccccgcaacttcgcgccgccaccttaacgtctccgaaaaaaccgaaaacgaaaaataaaaaaaaaaaaaacgccgcgccttacccgaaaaacgaacgacttctacccgccgacgtataactaaaacgctacgcgacgacgcgactacgacaaaaaaaaaaaaacgataatacgaacgctaaaccgcgaaaaacg

SEQ ID NO: 36827 - DNA, 514 bp, Artificial Sequence
  chemically treated genomic DNA (Homo sapiens) CpG-island No: 36827
tatgttagttcgggttcggggtttagtttaggtagcgggagtttatcgtttttagggcgttgggggttcgatatcggcgttgaaggtagatttcgcgtttcgaggaaaggagaatttcgcggcggcgaaggtcgattttggttcggttaggtacgttcgggtcgcggtttagttacgattcgggtagggtttcgcggtttttattagtttcgggaggagtttggtcggtcgggtcgttattatagtggcgtttcggttagttgggcgcgagcggaggcgcgttaagttttggcggcggcgttacggtcgggtagtacgggtttcgtaatttcgcgtcgttattttagcgttttcggaggaatcgggagcggggagtgggggaagggagggcgtcgcgttttattcggagagcgggcggtttttgttcgtcggcgtgtggttggggcgttgcgcggcggcgcggttgcgatagggagggagaagcggtggtgcgagcgttgggtcgcgggagacg

SEQ ID NO: 36828 - DNA, 514 bp, Artificial Sequence
  chemically treated genomic DNA (Homo sapiens) CpG-island No: 36828
cgtctcccgcgacccaacgctcgcaccaccgcttctccctccctatcgcaaccgcgccgccgcgcaacgccccaaccacacgccgacgaacaaaaaccgcccgctctccgaataaaacgcgacgccctcccttcccccactccccgctcccgattcctccgaaaacgctaaaataacgacgcgaaattacgaaacccgtactacccgaccgtaacgccgccgccaaaacttaacgcgcctccgctcgcgcccaactaaccgaaacgccactataataacgacccgaccgaccaaactcctcccgaaactaataaaaaccgcgaaaccctacccgaatcgtaactaaaccgcgacccgaacgtacctaaccgaaccaaaatcgaccttcgccgccgcgaaattctcctttcctcgaaacgcgaaatctaccttcaacgccgatatcgaacccccaacgccctaaaaacgataaactcccgctacctaaactaaaccccgaacccgaactaacata

SEQ ID NO: 36829 - DNA, 1162 bp, Artificial Sequence
  chemically treated genomic DNA (Homo sapiens) CpG-island No: 36829
tttttcgttggtttttcgtttcggcgcgtttacggttaatttcgcgtagtgaatgagcgggtttggttatttcgtttattgtataaaaagcgcgggtcgggaaggcgtattagtgttttggacgtcgtttgcgggtttttttgttcgggacggttggttaggggcgtttttttcgtcgcgtttttttttattagttcgtttggttgttaggggtttcgaggaattcgttttttttcggtcgtcgcgatttagtttgcgtagtcggataatgagggcgattcgggagagttttttttttatttatttttcgcgttcggttaatagtttcgttattttcgttcgcgtagtcggggtattaaaagtaattttcggcgtttcgtttcgggcgtcgttttcgttatttttagtattgttcgcgtagatggcgtttttgggtcgcgaagtttcgtaaaagttagaggcgaggttgggttttaattttaaagttcgaggaggttaaagtttaagtttgtaaagagcgggtagcgttcggtaggagcggcgtttttatttagtttttttcggtaagcgcgggagatttacgtggtcgagatatttatttcgaggtggattaggatgcgcgttcggattttagtagttttaacgcgacgggttttgttcgcggtcgttttcgttcgttcgtttgcgggggatagggattttaggattcgggtcgggtttatttttttgtcggtattgcgcggcgatatatagtagtaagattaggagtacgttttcgcgtatttcgttttcgtcgttattcggtgggtttggggagaaagtcgcgcgttcgtttggaacgttttacgggacgcgagttcgcgttgttttggtttcgtcgtttttggagttttgtcgtttttttttttagtcgttttcggatatatttttcggttgcgtttcgtttcgtttcgtttcgtttcggtttggtttcgttatttagatttttttttcgggggcgtttagtttggtttttgggtttcggcgtacgcggattttaagtcggggaggtcgggttgatcgcggtcgttttttcggtttcgggtaggaggtgggtagagaaggtgggttgaggggaggagaaattgggttgcgggggttcgggagggtggatttcgagaaa

SEQ ID NO: 36830 - DNA, 1162 bp, Artificial Sequence
  chemically treated genomic DNA (Homo sapiens) CpG-island No: 36830
tttctcgaaatccaccctcccgaacccccgcaacccaatttctcctcccctcaacccaccttctctacccacctcctacccgaaaccgaaaaaacgaccgcgatcaacccgacctccccgacttaaaatccgcgtacgccgaaacccaaaaaccaaactaaacgcccccgaaaaaaaaatctaaataacgaaaccaaaccgaaacgaaacgaaacgaaacgaaacgcaaccgaaaaatatatccgaaaacgactaaaaaaaaaaacgacaaaactccaaaaacgacgaaaccaaaacaacgcgaactcgcgtcccgtaaaacgttccaaacgaacgcgcgactttctccccaaacccaccgaataacgacgaaaacgaaatacgcgaaaacgtactcctaatcttactactatatatcgccgcgcaataccgacaaaaaaataaacccgacccgaatcctaaaatccctatcccccgcaaacgaacgaacgaaaacgaccgcgaacaaaacccgtcgcgttaaaactactaaaatccgaacgcgcatcctaatccacctcgaaataaatatctcgaccacgtaaatctcccgcgcttaccgaaaaaaactaaataaaaacgccgctcctaccgaacgctacccgctctttacaaacttaaactttaacctcctcgaactttaaaattaaaacccaacctcgcctctaacttttacgaaacttcgcgacccaaaaacgccatctacgcgaacaatactaaaaataacgaaaacgacgcccgaaacgaaacgccgaaaattacttttaataccccgactacgcgaacgaaaataacgaaactattaaccgaacgcgaaaaataaataaaaaaaaaactctcccgaatcgccctcattatccgactacgcaaactaaatcgcgacgaccgaaaaaaaacgaattcctcgaaacccctaacaaccaaacgaactaataaaaaaaaacgcgacgaaaaaaacgcccctaaccaaccgtcccgaacaaaaaaacccgcaaacgacgtccaaaacactaatacgccttcccgacccgcgctttttatacaataaacgaaataaccaaacccgctcattcactacgcgaaattaaccgtaaacgcgccgaaacgaaaaaccaacgaaaaa

SEQ ID NO: 36831 - DNA, 1162 bp, Artificial Sequence
  chemically treated genomic DNA (Homo sapiens) CpG-island No: 36831
tttttcggaatttattttttcggattttcgtagtttagttttttttttttttagtttattttttttgtttattttttattcggagtcggggaggcggtcgcggttagttcggttttttcgatttggggttcgcgtgcgtcgggatttagaggttaagttgggcgttttcgggggaggggtttgggtggcggggttaagtcggggcgggacggggcggggcggggcgtagtcgaggggtgtgttcgagggcggttggagggaggggcggtaggattttaggagcggcggggttagggtagcgcggattcgcgtttcgtggagcgttttaggcgggcgcgcggttttttttttagatttatcgagtggcggcggaggcgagatgcgcgggggcgtgtttttggttttgttgttgtgtgtcgtcgcgtagtgtcggtagagaggtgagttcggttcgggttttagggtttttgtttttcgtaggcgggcgggcgggggcggtcgcggataaagttcgtcgcgttggggttgttggagttcgggcgcgtattttgatttatttcggagtgggtgtttcggttacgtgggtttttcgcgtttgtcggggagggttggatggggacgtcgtttttgtcggacgttgttcgttttttgtaggtttaggttttaattttttcgggttttggggttaaagtttagtttcgtttttggtttttgcgggatttcgcgatttaggagcgttatttacgcgagtagtgttgggggtggcgggagcggcgttcggagcggggcgtcgggggttgtttttagtgtttcggttgcgcgggcgggggtggcggggttgttggtcgggcgcgggggatgaatggagaaagagttttttcgagtcgtttttattgttcggttgcgtaagttgggtcgcggcggtcgggaaagggcggatttttcggggtttttggtagttaagcgggttagtggggagagacgcggcgagaagggcgtttttagttagtcgtttcgggtagggggattcgtaggcggcgtttagggtattgatgcgttttttcgattcgcgttttttgtgtaataggcgaagtggttaaattcgtttatttattgcgcgggattgatcgtgggcgcgtcggggcgagggattagcggagaa

SEQ ID NO: 36832 - DNA, 1162 bp, Artificial Sequence
  chemically treated genomic DNA (Homo sapiens) CpG-island No: 36832
ttctccgctaatccctcgccccgacgcgcccacgatcaatcccgcgcaataaataaacgaatttaaccacttcgcctattacacaaaaaacgcgaatcgaaaaaacgcatcaataccctaaacgccgcctacgaatccccctacccgaaacgactaactaaaaacgcccttctcgccgcgtctctccccactaacccgcttaactaccaaaaaccccgaaaaatccgccctttcccgaccgccgcgacccaacttacgcaaccgaacaataaaaacgactcgaaaaaactctttctccattcatcccccgcgcccgaccaacaaccccgccacccccgcccgcgcaaccgaaacactaaaaacaacccccgacgccccgctccgaacgccgctcccgccacccccaacactactcgcgtaaataacgctcctaaatcgcgaaatcccgcaaaaaccaaaaacgaaactaaactttaaccccaaaacccgaaaaaattaaaacctaaacctacaaaaaacgaacaacgtccgacaaaaacgacgtccccatccaaccctccccgacaaacgcgaaaaacccacgtaaccgaaacacccactccgaaataaatcaaaatacgcgcccgaactccaacaaccccaacgcgacgaactttatccgcgaccgcccccgcccgcccgcctacgaaaaacaaaaaccctaaaacccgaaccgaactcacctctctaccgacactacgcgacgacacacaacaacaaaaccaaaaacacgcccccgcgcatctcgcctccgccgccactcgataaatctaaaaaaaaaaccgcgcgcccgcctaaaacgctccacgaaacgcgaatccgcgctaccctaaccccgccgctcctaaaatcctaccgcccctccctccaaccgccctcgaacacacccctcgactacgccccgccccgccccgtcccgccccgacttaaccccgccacccaaacccctcccccgaaaacgcccaacttaacctctaaatcccgacgcacgcgaaccccaaatcgaaaaaaccgaactaaccgcgaccgcctccccgactccgaataaaaaataaacaaaaaaaataaactaaaaaaaaaaaaaactaaactacgaaaatccgaaaaaataaattccgaaaaa

SEQ ID NO: 36833 - DNA, 534 bp, Artificial Sequence
  chemically treated genomic DNA (Homo sapiens) CpG-island No: 36833
cgttgacgattatttttatgtcgtcgttggtagcggagttttggttgttcggtttcgggaggttgcgtttttcggattcgtttatttttttcgcgcgcgttttcgtagttttcgtttcgcgttttttgtagtcgtcgtcgtcgttgtcgttgggggttcggcgggtgttattcgtgcgttgatttcggggagagtttggtcggcgttcgtttgcggggaagggcggttatagcgggtagtagtttgcgggggcgcgtcgcgggggaggtatgtattcggcggcggggttcggggttggtattcgggcgttcgggcgagtcgcgggggttttggcggtcgtcggtttcgttcggggtatttatttcggttggttggcggcgcgtttcgtcgttttagttcggttttttgcgggagcggggttttttcgtgggcggttggtatcgtttttcgtttcggggcgcgtaggtagcggcggtaggtttcggagttggcggatttacgtcgttcgcgaggtgttcgaggtgtgtagagagt

SEQ ID NO: 36834 - DNA, 534 bp, Artificial Sequence
  chemically treated genomic DNA (Homo sapiens) CpG-island No: 36834
actctctacacacctcgaacacctcgcgaacgacgtaaatccgccaactccgaaacctaccgccgctacctacgcgccccgaaacgaaaaacgataccaaccgcccacgaaaaaaccccgctcccgcaaaaaaccgaactaaaacgacgaaacgcgccgccaaccaaccgaaataaataccccgaacgaaaccgacgaccgccaaaacccccgcgactcgcccgaacgcccgaataccaaccccgaaccccgccgccgaatacatacctcccccgcgacgcgcccccgcaaactactacccgctataaccgcccttccccgcaaacgaacgccgaccaaactctccccgaaatcaacgcacgaataacacccgccgaacccccaacgacaacgacgacgacgactacaaaaaacgcgaaacgaaaactacgaaaacgcgcgcgaaaaaaataaacgaatccgaaaaacgcaacctcccgaaaccgaacaaccaaaactccgctaccaacgacgacataaaaataatcgtcaacg

SEQ ID NO: 36835 - DNA, 534 bp, Artificial Sequence
  chemically treated genomic DNA (Homo sapiens) CpG-island No: 36835
gttttttgtatatttcgagtatttcgcggacggcgtgggttcgttagtttcgggatttgtcgtcgttgtttgcgcgtttcggggcggaggacggtgttagtcgtttacgaggagatttcgttttcgtaggaggtcgagttgaagcggcggagcgcgtcgttagttagtcggggtgagtgtttcgggcgaggtcggcggtcgttaaagttttcgcggttcgttcgggcgttcggatgttagtttcgagtttcgtcgtcgggtgtatgtttttttcgcggcgcgttttcgtaggttgttgttcgttgtgatcgttttttttcgtaggcgggcgtcggttaggtttttttcgagattagcgtacgggtggtattcgtcggatttttagcggtagcggcggcggcggttgtagggggcgcggggcggaggttgcgagggcgcgcgcggggaggatggacgggttcggggagcgtagtttttcggagtcgggtagttagagtttcgttgttagcgacgatatagagatagtcgttaacg

SEQ ID NO: 36836 - DNA, 534 bp, Artificial Sequence
  chemically treated genomic DNA (Homo sapiens) CpG-island No: 36836
cgttaacgactatctctatatcgtcgctaacaacgaaactctaactacccgactccgaaaaactacgctccccgaacccgtccatcctccccgcgcgcgccctcgcaacctccgccccgcgccccctacaaccgccgccgccgctaccgctaaaaatccgacgaataccacccgtacgctaatctcgaaaaaaacctaaccgacgcccgcctacgaaaaaaaacgatcacaacgaacaacaacctacgaaaacgcgccgcgaaaaaaacatacacccgacgacgaaactcgaaactaacatccgaacgcccgaacgaaccgcgaaaactttaacgaccgccgacctcgcccgaaacactcaccccgactaactaacgacgcgctccgccgcttcaactcgacctcctacgaaaacgaaatctcctcgtaaacgactaacaccgtcctccgccccgaaacgcgcaaacaacgacgacaaatcccgaaactaacgaacccacgccgtccgcgaaatactcgaaatatacaaaaaac

SEQ ID NO: 36837 - DNA, 572 bp, Artificial Sequence
  chemically treated genomic DNA (Homo sapiens) CpG-island No: 36837
  misc_feature (265)..(265): n is either a, c, g or t
  misc_feature (483)..(483): n is either a, c, g or t
  misc_feature (540)..(540): n is either a, c, g or t
tttcgtcgtcggtttcgttattttcgtttcgtcgtggtcgaaattgatataaagtagcgggtcgaggtttcgggggagcggggtcgtagttgggggggcgggagttcgtggggagtcgagtcgagcgtttttcgttttagttttcggtatgggtagtacggggtcgtcggggcgggcgtcgagcgttgagcgttgaggtgaggcgaggcgaggcgaagcgggggcgttcgggagcgcggggttaggagggtagagggagatgcgntcgtagtcgcggggttggaggggtcggggagcgggtgtagattggggagtatcgggggttaagatttgggagttgcggttagacggggcggggatggcggtcgattggagacgaggggttgtcgggttttcggggacggggtagagcgggggtttgcggataggatgggaggatggggcgtcgaaggggcgcgtggagagtaggagagcggcgcgagngttaaggagaagttcgtgtagttaaggttaggggagattcgtttagagagatgtggngtaaaaagagtattcgggattcgagggtttgg

SEQ ID NO: 36838 - DNA, 572 bp, Artificial Sequence
  chemically treated genomic DNA (Homo sapiens) CpG-island No: 36838
  misc_feature (33)..(33): n is either a, c, g or t
  misc_feature (90)..(90): n is either a, c, g or t
  misc_feature (308)..(308): n is either a, c, g or t
ccaaaccctcgaatcccgaatactctttttacnccacatctctctaaacgaatctcccctaaccttaactacacgaacttctccttaacnctcgcgccgctctcctactctccacgcgccccttcgacgccccatcctcccatcctatccgcaaacccccgctctaccccgtccccgaaaacccgacaacccctcgtctccaatcgaccgccatccccgccccgtctaaccgcaactcccaaatcttaacccccgatactccccaatctacacccgctccccgacccctccaaccccgcgactacgancgcatctccctctaccctcctaaccccgcgctcccgaacgcccccgcttcgcctcgcctcgcctcacctcaacgctcaacgctcgacgcccgccccgacgaccccgtactacccataccgaaaactaaaacgaaaaacgctcgactcgactccccacgaactcccgcccccccaactacgaccccgctcccccgaaacctcgacccgctactttatatcaatttcgaccacgacgaaacgaaaataacgaaaccgacgacgaaa

SEQ ID NO: 36839 - DNA, 572 bp, Artificial Sequence
  chemically treated genomic DNA (Homo sapiens) CpG-island No: 36839
  misc_feature (33)..(33): n is either a, c, g or t
  misc_feature (90)..(90): n is either a, c, g or t
  misc_feature (308)..(308): n is either a, c, g or t
ttaaattttcgggtttcggatattttttttgtnttatatttttttgggcgggttttttttggttttggttgtacgagtttttttttggtnttcgcgtcgtttttttgttttttacgcgttttttcggcgttttatttttttattttgttcgtagattttcgttttgtttcgttttcgggaattcgatagtttttcgtttttagtcggtcgttattttcgtttcgtttggtcgtagtttttaaattttggttttcggtgttttttagtttatattcgtttttcggtttttttagtttcgcggttgcggncgtatttttttttgtttttttggtttcgcgttttcgggcgttttcgtttcgtttcgtttcgttttattttagcgtttagcgttcggcgttcgtttcggcggtttcgtattgtttatgtcgggggttggggcggggggcgttcggttcggttttttacgggttttcgtttttttagttgcggtttcgttttttcggggtttcggttcgttattttgtgttagtttcggttacggcggggcggaagtgacggagtcggcggcgggg

SEQ ID NO: 36840 - DNA, 572 bp, Artificial Sequence
  chemically treated genomic DNA (Homo sapiens) CpG-island No: 36840
  misc_feature (265)..(265): n is either a, c, g or t
  misc_feature (483)..(483): n is either a, c, g or t
  misc_feature (540)..(540): n is either a, c, g or t
ccccgccgccgactccgtcacttccgccccgccgtaaccgaaactaacacaaaataacgaaccgaaaccccgaaaaaacgaaaccgcaactaaaaaaacgaaaacccgtaaaaaaccgaaccgaacgccccccgccccaacccccgacataaacaatacgaaaccgccgaaacgaacgccgaacgctaaacgctaaaataaaacgaaacgaaacgaaacgaaaacgcccgaaaacgcgaaaccaaaaaaacaaaaaaaaatacgnccgcaaccgcgaaactaaaaaaaccgaaaaacgaatataaactaaaaaacaccgaaaaccaaaatttaaaaactacgaccaaacgaaacgaaaataacgaccgactaaaaacgaaaaactatcgaattcccgaaaacgaaacaaaacgaaaatctacgaacaaaataaaaaaataaaacgccgaaaaaacgcgtaaaaaacaaaaaaacgacgcgaanaccaaaaaaaaactcgtacaaccaaaaccaaaaaaaacccgcccaaaaaaatataanacaaaaaaaatatccgaaacccgaaaatttaa

SEQ ID NO: 36841 - DNA, 725 bp, Artificial Sequence
  chemically treated genomic DNA (Homo sapiens) CpG-island No: 36841
ggttaaggcgagaattttgtcggtagttgtttattcgtattcggttttttttagcggttcgttttttttatcgtttgttcgtaaggtttcgtttattttatcgtttcgttttattttattttgcggaggcgatagagtgcgcgcgcgcgcgcggggtttcggttggtttttttttcgagcgttcgcgtttcgtatgcgtagtttgtttcggcggttttcgtttgtttgaataggaaggcggatatattagttttttttagtttttttcgttttattttttaggtattcgtcgtcgcgattcgtttttttttcggttgggatcgtagttttttttagaagtttttttattagtagtcgtcgggatttaattatcgttttttttttcgttcgttttttagttttttttttgttaagtttttatcgggtatcgatttcgttttgttttatcggatatcgtagtagtagttttagtagcgacgggataaaatgggagagtgaggttgttttgcgtggattagttcgtggtcgagattgatcggtgcgtcgggtcgggtcgagtagagtcggggacgcggggttagatcgtttatagcgtttttgagcggagcgggttcggttcgtggttcgagcggcggtcgtagttggtatagttttttattcgttttttgttttcgttttttttttttttttttttttgttgttcggagggagtttttattttgttt

SEQ ID NO: 36842 - DNA, 725 bp, Artificial Sequence
  chemically treated genomic DNA (Homo sapiens) CpG-island No: 36842
aaacaaaataaaaactccctccgaacaacaaaaaaaaaaaaaaaaaaaaaacgaaaacaaaaaacgaataaaaaactataccaactacgaccgccgctcgaaccacgaaccgaacccgctccgctcaaaaacgctataaacgatctaaccccgcgtccccgactctactcgacccgacccgacgcaccgatcaatctcgaccacgaactaatccacgcaaaacaacctcactctcccattttatcccgtcgctactaaaactactactacgatatccgataaaacaaaacgaaatcgatacccgataaaaacttaacaaaaaaaaaactaaaaaacgaacgaaaaaaaaaacgataattaaatcccgacgactactaataaaaaaacttctaaaaaaaactacgatcccaaccgaaaaaaaaacgaatcgcgacgacgaatacctaaaaaataaaacgaaaaaaactaaaaaaaactaatatatccgccttcctattcaaacaaacgaaaaccgccgaaacaaactacgcatacgaaacgcgaacgctcgaaaaaaaaaccaaccgaaaccccgcgcgcgcgcgcgcactctatcgcctccgcaaaataaaataaaacgaaacgataaaataaacgaaaccttacgaacaaacgataaaaaaaacgaaccgctaaaaaaaaccgaatacgaataaacaactaccgacaaaattctcgccttaacc

SEQ ID NO: 36843 - DNA, 725 bp, Artificial Sequence
  chemically treated genomic DNA (Homo sapiens) CpG-island No: 36843
aagtagggtggagatttttttcgggtaataagggagggagaagaggaaaggcgaaagtaaagggcgggtgaggagttgtgttagttgcggtcgtcgttcgggttacgggtcgggttcgtttcgtttagaggcgttgtagacggtttagtttcgcgttttcggttttattcggttcggttcgacgtatcgattagtttcggttacgagttggtttacgtaggatagttttatttttttattttgtttcgtcgttgttggggttgttgttacggtgttcggtggggtagggcgaggtcgatgttcgatggagatttagtagaggaaaggttggagagcgggcgaagaggaagacgatagttgggtttcggcggttgttgatgggggagtttttgggaggggttgcggttttagtcggggaaagggcgagtcgcggcggcgaatgtttggggggtggggcgaggggggttgagagggattaatatgttcgtttttttgtttaaataaacggagatcgtcggggtagattgcgtatgcggggcgcggacgttcggaaggggaattagtcgggatttcgcgcgcgcgcgcgtattttgtcgttttcgtagggtggggtggggcggggcggtgaggtgggcggggttttgcgggtaggcggtggagaaggcggatcgttgggaggagtcgagtgcgggtaagtagttgtcggtaaggttttcgttttggtt

SEQ ID NO: 36844 - DNA, 725 bp, Artificial Sequence
  chemically treated genomic DNA (Homo sapiens) CpG-island No: 36844
aaccaaaacgaaaaccttaccgacaactacttacccgcactcgactcctcccaacgatccgccttctccaccgcctacccgcaaaaccccgcccacctcaccgccccgccccaccccaccctacgaaaacgacaaaatacgcgcgcgcgcgcgaaatcccgactaattccccttccgaacgtccgcgccccgcatacgcaatctaccccgacgatctccgtttatttaaacaaaaaaacgaacatattaatccctctcaacccccctcgccccaccccccaaacattcgccgccgcgactcgccctttccccgactaaaaccgcaacccctcccaaaaactcccccatcaacaaccgccgaaacccaactatcgtcttcctcttcgcccgctctccaacctttcctctactaaatctccatcgaacatcgacctcgccctaccccaccgaacaccgtaacaacaaccccaacaacgacgaaacaaaataaaaaaataaaactatcctacgtaaaccaactcgtaaccgaaactaatcgatacgtcgaaccgaaccgaataaaaccgaaaacgcgaaactaaaccgtctacaacgcctctaaacgaaacgaacccgacccgtaacccgaacgacgaccgcaactaacacaactcctcacccgccctttactttcgcctttcctcttctccctcccttattacccgaaaaaaatctccaccctactt

SEQ ID NO: 36845 - DNA, 1065 bp, Artificial Sequence
  chemically treated genomic DNA (Homo sapiens) CpG-island No: 36845
ttcgcggacgtcgaggtagcgggaaggcgcgaggcggggcggggggagggggcgcgggggttttcgttgcggaggttagggcgggcgggaggggtagtatttgaggaattcgttttcggttgcggcggtcgtcgtttcgtttcgtttcggggaattgagcgcgcggatcgcgcgtttgttagagagacgttagtcgtcggcggcgttagtatttcggagtcgggcggtcggagtagcggagcgtagcgcggcgtagggaacggtattgggggtggggagattagttcggtcgagtcgagggttattttttggttttttgttttcgcgtttcgttagggttaggtgagcggtcgcggggatttcggggcgcgggtaggaggtgagaggtcgcgaatcgggcgcgggagttcgtttgtgatcggtaggagttgttttttggcgggttggacgttttggtcgcgcggggaagcgtcgtagcggattttttcggagggatgggaagtttagcgggggtgtgagcggagcgcgtgcgggtggcgagggagcgttagtgttaatttgggagtcgtgtttgttttttttgtcgtttcgcgtcgtttatcgaagggattcggtcgtgttgttcgcgtttagaggtcgaaggtttgttatcgggttttattcgttgtttttgtggcgggagcgagacggttcgggggtgggacgagggagttgcggcgcgtcgagtagcgcggggtttttcggcggaggcggcgagggggtatttggttcgttttttcgagtttaggggtagtgagggggtgtcgggtaggcgggcgggcgataggtagggcgtcgcggaggtggcggggagaggatggatggagtttagtttgggaaagttgagaacgtttagaggtggttgggcgttcgttcggcgtttgtgggtttttttttttaatattaaatgttatttcgttacgagcgggcgcgcgtgtttttcggttagtatgtttatttttttgtgtatggttgaggattatttttatttcgaatgagatataaagagttgtgttgatagttgat

SEQ ID NO: 36846 - DNA, 1065 bp, Artificial Sequence
  chemically treated genomic DNA (Homo sapiens) CpG-island No: 36846
atcaactatcaacacaactctttatatctcattcgaaataaaaataatcctcaaccatacacaaaaaaataaacatactaaccgaaaaacacgcgcgcccgctcgtaacgaaataacatttaatattaaaaaaaaaaacccacaaacgccgaacgaacgcccaaccacctctaaacgttctcaactttcccaaactaaactccatccatcctctccccgccacctccgcgacgccctacctatcgcccgcccgcctacccgacaccccctcactacccctaaactcgaaaaaacgaaccaaataccccctcgccgcctccgccgaaaaaccccgcgctactcgacgcgccgcaactccctcgtcccacccccgaaccgtctcgctcccgccacaaaaacaacgaataaaacccgataacaaaccttcgacctctaaacgcgaacaacacgaccgaatcccttcgataaacgacgcgaaacgacaaaaaaaacaaacacgactcccaaattaacactaacgctccctcgccacccgcacgcgctccgctcacacccccgctaaacttcccatccctccgaaaaaatccgctacgacgcttccccgcgcgaccaaaacgtccaacccgccaaaaaacaactcctaccgatcacaaacgaactcccgcgcccgattcgcgacctctcacctcctacccgcgccccgaaatccccgcgaccgctcacctaaccctaacgaaacgcgaaaacaaaaaaccaaaaaataaccctcgactcgaccgaactaatctccccacccccaataccgttccctacgccgcgctacgctccgctactccgaccgcccgactccgaaatactaacgccgccgacgactaacgtctctctaacaaacgcgcgatccgcgcgctcaattccccgaaacgaaacgaaacgacgaccgccgcaaccgaaaacgaattcctcaaatactacccctcccgcccgccctaacctccgcaacgaaaacccccgcgccccctccccccgccccgcctcgcgccttcccgctacctcgacgtccgcgaa

SEQ ID NO: 36847 - DNA, 1065 bp, Artificial Sequence
  chemically treated genomic DNA (Homo sapiens) CpG-island No: 36847
gttagttgttaatataattttttgtgttttattcggaataagagtggtttttagttatgtatagaaaaatggatatgttggtcggaagatacgcgcgttcgttcgtgacgaagtgatatttggtgttgaggaaaaaaatttatagacgtcgagcgagcgtttagttatttttggacgtttttaatttttttaggttgaattttatttatttttttttcgttattttcgcggcgttttatttgtcgttcgttcgtttgttcggtatttttttattgtttttgggttcggggagacgaattaggtgttttttcgtcgttttcgtcgggggatttcgcgttattcggcgcgtcgtagttttttcgttttattttcgggtcgtttcgttttcgttataaaggtagcgagtagagttcggtgataggttttcggtttttgggcgcggatagtacggtcgggttttttcggtgggcgacgcgaggcggtagggaaggtaggtacggtttttaggttggtattggcgttttttcgttattcgtacgcgtttcgtttatattttcgttgagttttttattttttcggaaaagttcgttgcggcgttttttcgcgcggttagggcgtttagttcgttaaagggtagtttttgtcggttataggcgagttttcgcgttcggttcgcgattttttattttttgttcgcgtttcggagttttcgcggtcgtttatttggttttagcggggcgcgagggtagaggattagggggtggttttcggttcggtcgggttggtttttttatttttagtgtcgttttttgcgtcgcgttgcgtttcgttgtttcggtcgttcgatttcgaggtgttagcgtcgtcggcggttggcgtttttttggtaggcgcgcggttcgcgcgtttagtttttcggggcggagcgaggcggcggtcgtcgtagtcggaggcggattttttaggtgttgtttttttcgttcgttttggttttcgtagcggggattttcgcgtttttttttttcgtttcgtttcgcgttttttcgttgtttcggcgttcgcgag

SEQ ID NO: 36848 - DNA, 1065 bp, Artificial Sequence
  chemically treated genomic DNA (Homo sapiens) CpG-island No: 36848
ctcgcgaacgccgaaacaacgaaaaaacgcgaaacgaaacgaaaaaaaaaaacgcgaaaatccccgctacgaaaaccaaaacgaacgaaaaaaacaacacctaaaaaatccgcctccgactacgacgaccgccgcctcgctccgccccgaaaaactaaacgcgcgaaccgcgcgcctaccaaaaaaacgccaaccgccgacgacgctaacacctcgaaatcgaacgaccgaaacaacgaaacgcaacgcgacgcaaaaaacgacactaaaaataaaaaaaccaacccgaccgaaccgaaaaccaccccctaatcctctaccctcgcgccccgctaaaaccaaataaacgaccgcgaaaactccgaaacgcgaacaaaaaataaaaaatcgcgaaccgaacgcgaaaactcgcctataaccgacaaaaactaccctttaacgaactaaacgccctaaccgcgcgaaaaaacgccgcaacgaacttttccgaaaaaataaaaaactcaacgaaaatataaacgaaacgcgtacgaataacgaaaaaacgccaataccaacctaaaaaccgtacctaccttccctaccgcctcgcgtcgcccaccgaaaaaacccgaccgtactatccgcgcccaaaaaccgaaaacctatcaccgaactctactcgctacctttataacgaaaacgaaacgacccgaaaataaaacgaaaaaactacgacgcgccgaataacgcgaaatcccccgacgaaaacgacgaaaaaacacctaattcgtctccccgaacccaaaaacaataaaaaaataccgaacaaacgaacgaacgacaaataaaacgccgcgaaaataacgaaaaaaaaataaataaaattcaacctaaaaaaattaaaaacgtccaaaaataactaaacgctcgctcgacgtctataaatttttttcctcaacaccaaatatcacttcgtcacgaacgaacgcgcgtatcttccgaccaacatatccatttttctatacataactaaaaaccactcttattccgaataaaacacaaaaaattatattaacaactaac

SEQ ID NO: 36849 - DNA, 821 bp, Artificial Sequence
  chemically treated genomic DNA (Homo sapiens) CpG-island No: 36849
cggcgtgaaaggtcgcgcgcggggtacggcgggaaaagacgttgcgcgtagaaatattcgtttcgcgtcgcgttttagtgggcggttttgtcgcgggcggttttgattggattgtcgaatttcgcgcgttgattggtcgcgtgggcgaggcggaggagagtcgtgcgtagcggcgtatgtggggtcgtgtgtagattcgcgtgtggcgtaggtaaggatttttaaaataaatagtttttattttgcgagtcgttttttttaggtttgcgttcgagttttcgtcgttgcgggttcgtttcgacgcggaaggtgagggttgggggaggggttcggcgttgacggagtcgtagtgcgggtcgggtttgtggcggatagagagggtagggagcggcgaggtggcgatggcggtcgtattttggtttgcgtttttgttgcgttaggcgggaagttcggttgttgtcgtcgtttcggattcgggtttttggcgtatcgttgtcggacgatatttttgtttttttttcgttttggaaagttgggtcgtcgagtatgcgggtttttcggcgttacggtcgtattttaggtcgtaggtttagggtagaggaggttcgttcgtgcgtttttggggtcgaggttttgacgtttcgagggtcgcggaatgagggatcgagggtggatttggcgggaatttattggaaggagttcgtgtggtggggaaaggttttcggttgcggatgaaggggggatggggtgggtatagtcgtgtaggttatgtgttggggtcgtgcgtttggcgggttatgtgttaagggttttgggggttt

SEQ ID NO: 36850 - DNA, 821 bp, Artificial Sequence
  chemically treated genomic DNA (Homo sapiens) CpG-island No: 36850
aaacccccaaaacccttaacacataacccgccaaacgcacgaccccaacacataacctacacgactatacccaccccatccccccttcatccgcaaccgaaaacctttccccaccacacgaactccttccaataaattcccgccaaatccaccctcgatccctcattccgcgaccctcgaaacgtcaaaacctcgaccccaaaaacgcacgaacgaacctcctctaccctaaacctacgacctaaaatacgaccgtaacgccgaaaaacccgcatactcgacgacccaactttccaaaacgaaaaaaaaacaaaaatatcgtccgacaacgatacgccaaaaacccgaatccgaaacgacgacaacaaccgaacttcccgcctaacgcaacaaaaacgcaaaccaaaatacgaccgccatcgccacctcgccgctccctaccctctctatccgccacaaacccgacccgcactacgactccgtcaacgccgaacccctcccccaaccctcaccttccgcgtcgaaacgaacccgcaacgacgaaaactcgaacgcaaacctaaaaaaaacgactcgcaaaataaaaactatttattttaaaaatccttacctacgccacacgcgaatctacacacgaccccacatacgccgctacgcacgactctcctccgcctcgcccacgcgaccaatcaacgcgcgaaattcgacaatccaatcaaaaccgcccgcgacaaaaccgcccactaaaacgcgacgcgaaacgaatatttctacgcgcaacgtcttttcccgccgtaccccgcgcgcgacctttcacgccg

SEQ ID NO: 36851 - DNA, 821 bp, Artificial Sequence
  chemically treated genomic DNA (Homo sapiens) CpG-island No: 36851
aggtttttaaaatttttggtatatggttcgttaggcgtacgattttagtatatggtttgtacgattatatttattttattttttttttattcgtagtcgggagtttttttttattatacggattttttttagtgagttttcgttaaatttattttcggttttttatttcgcgattttcgaagcgttagggtttcggttttaagggcgtacgggcgggttttttttgttttaagtttgcggtttggggtgcggtcgtggcgtcgaaagattcgtatgttcggcgatttagttttttaggacgaagaaaggatagaagtgtcgttcgatagcggtgcgttagaaattcgggttcgaggcggcggtagtagtcgagtttttcgtttgacgtagtagaggcgtaggttaaagtgcggtcgttatcgttatttcgtcgttttttattttttttgttcgttatagattcgattcgtattgcggtttcgttagcgtcgggttttttttttagtttttatttttcgcgtcggagcgggttcgtagcggcggagattcggacgtaggtttggggaagacggttcgtaaggtagaggttgtttattttgagggtttttgtttgcgttatacgcgggtttgtatacggttttatatacgtcgttgcgtacggttttttttcgtttcgtttacgcggttaattagcgcgcggggttcggtagtttaattagagtcgttcgcggtagggtcgtttattagagcgcggcgcggggcgggtgtttttgcgcgtagcgttttttttcgtcgtgtttcgcgcgcggttttttacgtcg

SEQ ID NO: 36852 - DNA, 821 bp, Artificial Sequence
  chemically treated genomic DNA (Homo sapiens) CpG-island No: 36852
cgacgtaaaaaaccgcgcgcgaaacacgacgaaaaaaaacgctacgcgcaaaaacacccgccccgcgccgcgctctaataaacgaccctaccgcgaacgactctaattaaactaccgaaccccgcgcgctaattaaccgcgtaaacgaaacgaaaaaaaaccgtacgcaacgacgtatataaaaccgtatacaaacccgcgtataacgcaaacaaaaaccctcaaaataaacaacctctaccttacgaaccgtcttccccaaacctacgtccgaatctccgccgctacgaacccgctccgacgcgaaaaataaaaactaaaaaaaaaacccgacgctaacgaaaccgcaatacgaatcgaatctataacgaacaaaaaaaataaaaaacgacgaaataacgataacgaccgcactttaacctacgcctctactacgtcaaacgaaaaactcgactactaccgccgcctcgaacccgaatttctaacgcaccgctatcgaacgacacttctatcctttcttcgtcctaaaaaactaaatcgccgaacatacgaatctttcgacgccacgaccgcaccccaaaccgcaaacttaaaacaaaaaaaacccgcccgtacgcccttaaaaccgaaaccctaacgcttcgaaaatcgcgaaataaaaaaccgaaaataaatttaacgaaaactcactaaaaaaaatccgtataataaaaaaaaactcccgactacgaataaaaaaaaaataaaataaatataatcgtacaaaccatatactaaaatcgtacgcctaacgaaccatataccaaaaattttaaaaacct

SEQ ID NO: 36853 - DNA, 885 bp, Artificial Sequence
  chemically treated genomic DNA (Homo sapiens) CpG-island No: 36853
cgcggtgtgggcgcgtcggggtgttgatggaggaggggtcgaggtgttgagggcggggtcgggttggggtcggggttgagggcggagtcgggtcgggcggagttagagttgaggtgagtttgagggcggagtcggggcgggttgaggtgggtttgtgggcggagtcggggcggtgtgttgaggtgggtttgagggcggagtcgaggtcgggttgaaggtcggagtcggggcgggttgaggtgggtttgaaggtagagtcgaggtcggagttggggacggagtcgagttcgggttgagggcggagtcggggcgggttgaggtggttttgtgggcggagtcgaggtcgggttgagggtagagtcgggtcggagtcggggcgcgttgaggtgggtttgggggcggagtcgaggtcggagttgagggcggagtcgggggcggggacgtaggcggaattcgggtcgggttgaggtgggttcgagggttgggttgggggcggagtgggtgttagtttgagggcggagtcgggggcgggcgggggcgggttggggcgggtttataggttagattggtgtggtacggagttgaggatcggtcggagttttgcggagggttcggtttggcgggttcgggggggagtcgaattcgcggggtatcgggttcgggcggggtcgagtcgggtcggggcgggagttagtcggggtggggcggggtcgaggtcgaggtaggcggtcggtagtgttgggggtttaggtgttgcggcggttttacgtagttaggcggttcgtgggttggagcgggcggagttcggttcgcggtttgcgtgagtttaggtcggttttagcgtttagagcgtcggtttttcggttttttataggttagggtagg

SEQ ID NO: 36854 - DNA, 885 bp, Artificial Sequence
  chemically treated genomic DNA (Homo sapiens) CpG-island No: 36854
cctaccctaacctataaaaaaccgaaaaaccgacgctctaaacgctaaaaccgacctaaactcacgcaaaccgcgaaccgaactccgcccgctccaacccacgaaccgcctaactacgtaaaaccgccgcaacacctaaacccccaacactaccgaccgcctacctcgacctcgaccccgccccaccccgactaactcccgccccgacccgactcgaccccgcccgaacccgataccccgcgaattcgactcccccccgaacccgccaaaccgaaccctccgcaaaactccgaccgatcctcaactccgtaccacaccaatctaacctataaacccgccccaacccgcccccgcccgcccccgactccgccctcaaactaacacccactccgcccccaacccaaccctcgaacccacctcaacccgacccgaattccgcctacgtccccgcccccgactccgccctcaactccgacctcgactccgcccccaaacccacctcaacgcgccccgactccgacccgactctaccctcaacccgacctcgactccgcccacaaaaccacctcaacccgccccgactccgccctcaacccgaactcgactccgtccccaactccgacctcgactctaccttcaaacccacctcaacccgccccgactccgaccttcaacccgacctcgactccgccctcaaacccacctcaacacaccgccccgactccgcccacaaacccacctcaacccgccccgactccgccctcaaactcacctcaactctaactccgcccgacccgactccgccctcaaccccgaccccaacccgaccccgccctcaacacctcgacccctcctccatcaacaccccgacgcgcccacaccgcg

SEQ ID NO: 36855 - DNA, 885 bp, Artificial Sequence
  chemically treated genomic DNA (Homo sapiens) CpG-island No: 36855
tttgttttggtttataagaagtcgaagggtcggcgttttggacgttgggatcggtttgagtttacgtaagtcgcgggtcgagtttcgttcgttttagtttacgggtcgtttggttacgtggagtcgtcgtaatatttgaatttttagtattgtcgatcgtttgtttcggtttcggtttcgttttatttcggttggttttcgtttcggttcggttcggtttcgttcggattcggtgtttcgcgggttcggttttttttcggattcgttaagtcgggtttttcgtaaagtttcggtcggtttttagtttcgtgttatattagtttggtttgtaggttcgttttagttcgttttcgttcgttttcggtttcgtttttaggttggtatttatttcgtttttagtttaattttcgggtttattttagttcgattcgggtttcgtttacgttttcgttttcgatttcgtttttagtttcgatttcgatttcgtttttaggtttattttagcgcgtttcgatttcgattcgattttgtttttagttcgatttcgatttcgtttataggattattttagttcgtttcgatttcgtttttagttcgaattcgatttcgtttttagtttcgatttcgattttgtttttaggtttattttagttcgtttcgatttcggtttttagttcgatttcgatttcgtttttaggtttattttagtatatcgtttcgatttcgtttataggtttattttagttcgtttcgatttcgtttttaggtttattttagttttgatttcgttcgattcgatttcgtttttagtttcgattttagttcgatttcgtttttagtatttcggttttttttttattaatatttcggcgcgtttatatcgcg

SEQ ID NO: 36856 - DNA, 885 bp, Artificial Sequence
  chemically treated genomic DNA (Homo sapiens) CpG-island No: 36856
cgcgatataaacgcgccgaaatattaataaaaaaaaaaccgaaatactaaaaacgaaatcgaactaaaatcgaaactaaaaacgaaatcgaatcgaacgaaatcaaaactaaaataaacctaaaaacgaaatcgaaacgaactaaaataaacctataaacgaaatcgaaacgatatactaaaataaacctaaaaacgaaatcgaaatcgaactaaaaaccgaaatcgaaacgaactaaaataaacctaaaaacaaaatcgaaatcgaaactaaaaacgaaatcgaattcgaactaaaaacgaaatcgaaacgaactaaaataatcctataaacgaaatcgaaatcgaactaaaaacaaaatcgaatcgaaatcgaaacgcgctaaaataaacctaaaaacgaaatcgaaatcgaaactaaaaacgaaatcgaaaacgaaaacgtaaacgaaacccgaatcgaactaaaataaacccgaaaattaaactaaaaacgaaataaataccaacctaaaaacgaaaccgaaaacgaacgaaaacgaactaaaacgaacctacaaaccaaactaatataacacgaaactaaaaaccgaccgaaactttacgaaaaacccgacttaacgaatccgaaaaaaaaccgaacccgcgaaacaccgaatccgaacgaaaccgaaccgaaccgaaacgaaaaccaaccgaaataaaacgaaaccgaaaccgaaacaaacgatcgacaatactaaaaattcaaatattacgacgactccacgtaaccaaacgacccgtaaactaaaacgaacgaaactcgacccgcgacttacgtaaactcaaaccgatcccaacgtccaaaacgccgacccttcgacttcttataaaccaaaacaaa

SEQ ID NO: 36857 - DNA, 589 bp, Artificial Sequence
  chemically treated genomic DNA (Homo sapiens) CpG-island No: 36857
tttcgttagtttttttttttttcgtcgtttgggttttaataagaggggtcggcggggtaggttgattaagtagttcgcgttttcgttgcggagttgcgtttcggtttcgcgtcgtcgtcgtttacgttcggatttatcggggtttttttcgtcgatacgcggtagtagtcggggtaggtgggtagtcgttacgtaggtggcgtttaagacgcggttgagttcgttttagggtgggtagtagtagtcggaggaagttatcgtcgtcggttcgtttcgcgtcggtattagcgtacgggttcggcggggcgcgggggtagttatttagttcggattatcgtagttcggattgttaatagagtggtgtatgatgattacgagagcgaggaggaggagtaagaggaggggggcggcgatgttcgaggagatttacgagtttgaggataattaggaggatgatatggaggaggacgacgatgatttcgattattcggagagttggaagatgacgacgaggacgttagttattttacggaaagtagttttagtagtattttaggtatttatttagcgtagttgttgtagatttatt

SEQ ID NO: 36858 - DNA, 589 bp, Artificial Sequence
  chemically treated genomic DNA (Homo sapiens) CpG-island No: 36858
aataaatctacaacaactacgctaaataaatacctaaaatactactaaaactactttccgtaaaataactaacgtcctcgtcgtcatcttccaactctccgaataatcgaaatcatcgtcgtcctcctccatatcatcctcctaattatcctcaaactcgtaaatctcctcgaacatcgccgcccccctcctcttactcctcctcctcgctctcgtaatcatcatacaccactctattaacaatccgaactacgataatccgaactaaataactacccccgcgccccgccgaacccgtacgctaataccgacgcgaaacgaaccgacgacgataacttcctccgactactactacccaccctaaaacgaactcaaccgcgtcttaaacgccacctacgtaacgactacccacctaccccgactactaccgcgtatcgacgaaaaaaaccccgataaatccgaacgtaaacgacgacgacgcgaaaccgaaacgcaactccgcaacgaaaacgcgaactacttaatcaacctaccccgccgacccctcttattaaaacccaaacgacgaaaaaaaaaaaaactaacgaaa

SEQ ID NO: 36859 - DNA, 589 bp, Artificial Sequence
  chemically treated genomic DNA (Homo sapiens) CpG-island No: 36859
aatgagtttgtagtaattgcgttgggtgggtatttggagtgttgttgaagttgtttttcgtggagtaattggcgttttcgtcgttattttttagtttttcggataatcggagttatcgtcgtttttttttatgttatttttttagttgtttttagattcgtgggttttttcgggtatcgtcgtttttttttttttatttttttttttcgttttcgtagttattatatattattttgttgatagttcgggttgcggtggttcgggttaggtggttgttttcgcgtttcgtcgggttcgtgcgttggtgtcggcgcggggcgggtcggcggcggtggtttttttcggttattgttgtttattttggggcgagtttagtcgcgttttgggcgttatttacgtggcggttgtttatttgtttcggttattatcgcgtatcggcgaggggagtttcgatgggttcggacgtgggcggcggcggcgcggggtcggggcgtagtttcgtagcgggagcgcgggttgtttggttagtttgtttcgtcggttttttttgttggagtttaggcggcgggagaagggaaagttgacgggg

SEQ ID NO: 36860 - DNA, 589 bp, Artificial Sequence
  chemically treated genomic DNA (Homo sapiens) CpG-island No: 36860
ccccgtcaactttcccttctcccgccgcctaaactccaacaaaaaaaaccgacgaaacaaactaaccaaacaacccgcgctcccgctacgaaactacgccccgaccccgcgccgccgccgcccacgtccgaacccatcgaaactcccctcgccgatacgcgataataaccgaaacaaataaacaaccgccacgtaaataacgcccaaaacgcgactaaactcgccccaaaataaacaacaataaccgaaaaaaaccaccgccgccgacccgccccgcgccgacaccaacgcacgaacccgacgaaacgcgaaaacaaccacctaacccgaaccaccgcaacccgaactatcaacaaaataatatataataactacgaaaacgaaaaaaaaaaataaaaaaaaaaaaacgacgatacccgaaaaaacccacgaatctaaaaacaactaaaaaaataacataaaaaaaaacgacgataactccgattatccgaaaaactaaaaaataacgacgaaaacgccaattactccacgaaaaacaacttcaacaacactccaaatacccacccaacgcaattactacaaactcatt

SEQ ID NO: 36861 - DNA, 569 bp, Artificial Sequence
  chemically treated genomic DNA (Homo sapiens) CpG-island No: 36861
cgtcggtgatgtacgggttgtttttgagggattcggggatttgttcgtaggtgtataggcggatgttacggggtattaggatcggttagtattggtagttgtttagttcgatgtaatgcgcgttttttagtagtttttgatgtatcgttttcggtcgtcgtcgtttttcggttcgggagtttttttaggtttcgttttttcggggagggggtttcgtcgttggcgttttcgtttcggagttcgcggacgttgcgcgaggttttatcgcgttgtcgttgttgtttagggttcggttttgcgtttatatcggttattgtcgttagcgtcgcggcggattcggtagcgtcgtagttttttttgacgttagcgcgtcgcggcggtttcgttttttagttttagttgggaggggtagggtgttggggcgcgttcgggtgtgttcgagcgtgcgttggcggcggttcgggttttcgggcgttttttacgttgtgttttggcggcgtttggggttttcgtttgtatatgagaagagtcgaaagtatagagttataggcgaatataagtggattttt

SEQ ID NO: 36862 - DNA, 569 bp, Artificial Sequence
  chemically treated genomic DNA (Homo sapiens) CpG-island No: 36862
aaaaatccacttatattcgcctataactctatactttcgactcttctcatatacaaacgaaaaccccaaacgccgccaaaacacaacgtaaaaaacgcccgaaaacccgaaccgccgccaacgcacgctcgaacacacccgaacgcgccccaacaccctacccctcccaactaaaactaaaaaacgaaaccgccgcgacgcgctaacgtcaaaaaaaactacgacgctaccgaatccgccgcgacgctaacgacaataaccgatataaacgcaaaaccgaaccctaaacaacaacgacaacgcgataaaacctcgcgcaacgtccgcgaactccgaaacgaaaacgccaacgacgaaaccccctccccgaaaaaacgaaacctaaaaaaactcccgaaccgaaaaacgacgacgaccgaaaacgatacatcaaaaactactaaaaaacgcgcattacatcgaactaaacaactaccaatactaaccgatcctaataccccgtaacatccgcctatacacctacgaacaaatccccgaatccctcaaaaacaacccgtacatcaccgacg

SEQ ID NO: 36863 - DNA, 569 bp, Artificial Sequence
  chemically treated genomic DNA (Homo sapiens) CpG-island No: 36863
aaaaatttatttgtattcgtttgtagttttgtgttttcggttttttttatatgtaaacgaagattttaggcgtcgttaaaatatagcgtgagagacgttcgggagttcgggtcgtcgttagcgtacgttcgagtatattcgggcgcgttttagtattttgttttttttagttagggttgaggggcggggtcgtcgcggcgcgttgacgttagaggaggttgcgacgttgtcgggttcgtcgcggcgttggcggtagtggtcggtgtgagcgtagagtcgggttttgggtagtagcggtagcgcggtaggatttcgcgtagcgttcgcgggtttcggggcgggggcgttagcggcgaagtttttttttcggggaggcgggatttgggggagttttcgagtcggggagcggcggcggtcgggaacgatgtattagaagttgttgaagagcgcgtattatatcgagttgggtagttattagtattggtcggttttggtgtttcgtggtattcgtttgtatatttacgagtagattttcgggttttttaaggataattcgtatattatcgacg

SEQ ID NO: 36864 - DNA, 569 bp, Artificial Sequence
  chemically treated genomic DNA (Homo sapiens) CpG-island No: 36864
cgtcgataatatacgaattatccttaaaaaacccgaaaatctactcgtaaatatacaaacgaataccacgaaacaccaaaaccgaccaatactaataactacccaactcgatataatacgcgctcttcaacaacttctaatacatcgttcccgaccgccgccgctccccgactcgaaaactcccccaaatcccgcctccccgaaaaaaaaacttcgccgctaacgcccccgccccgaaacccgcgaacgctacgcgaaatcctaccgcgctaccgctactacccaaaacccgactctacgctcacaccgaccactaccgccaacgccgcgacgaacccgacaacgtcgcaacctcctctaacgtcaacgcgccgcgacgaccccgcccctcaaccctaactaaaaaaaacaaaatactaaaacgcgcccgaatatactcgaacgtacgctaacgacgacccgaactcccgaacgtctctcacgctatattttaacgacgcctaaaatcttcgtttacatataaaaaaaaccgaaaacacaaaactacaaacgaatacaaataaattttt

SEQ ID NO: 36865 - DNA, 519 bp, Artificial Sequence
  chemically treated genomic DNA (Homo sapiens) CpG-island No: 36865
cggtggtaggagcggttgttggagtagtagtggcggcgggtattttgtgttcgcgttttcgaggtaatcgattgcgtcgtttttattttcgcgcggtcgggcgggacgtgtttttagattagggttttcggattttggtttcgcgtcgtcgtttttgttcgttgttgtcgttaggaggtcgttgggaggaggcgaagttggggtcgtattcggaagtttagcgtcgtaagggagaggcggcgtttgttttattaaaggtgcggagtttttgcgttttcggaggaggttttgcgtagggtcgttcggggtagcgtttttggggtttattttatcggggtgatcgcgggtttgatataatagacggttgggttttggtttacgattcgttttcggaggcgttttgtttcggtcgtgcggcgagtcgggcgaggggaattttaggttgtttttgagcgtcggggttacggggttaggttcgtggagaggacgtttttgttttagattcggtttcggtttagt

SEQ ID NO: 36866 - DNA, 519 bp, Artificial Sequence
  chemically treated genomic DNA (Homo sapiens) CpG-island No: 36866
actaaaccgaaaccgaatctaaaacaaaaacgtcctctccacgaacctaaccccgtaaccccgacgctcaaaaacaacctaaaattcccctcgcccgactcgccgcacgaccgaaacaaaacgcctccgaaaacgaatcgtaaaccaaaacccaaccgtctattatatcaaacccgcgatcaccccgataaaataaaccccaaaaacgctaccccgaacgaccctacgcaaaacctcctccgaaaacgcaaaaactccgcacctttaataaaacaaacgccgcctctcccttacgacgctaaacttccgaatacgaccccaacttcgcctcctcccaacgacctcctaacgacaacaacgaacaaaaacgacgacgcgaaaccaaaatccgaaaaccctaatctaaaaacacgtcccgcccgaccgcgcgaaaataaaaacgacgcaatcgattacctcgaaaacgcgaacacaaaatacccgccgccactactactccaacaaccgctcctaccaccg

SEQ ID NO: 36867 - DNA, 519 bp, Artificial Sequence
  chemically treated genomic DNA (Homo sapiens) CpG-island No: 36867
gttgggtcggggtcgggtttggggtaggggcgttttttttacgagtttagtttcgtggtttcggcgtttaggggtagtttggagtttttttcgttcggttcgtcgtacggtcggggtagggcgttttcgggagcggatcgtgggttagggtttagtcgtttgttgtgttaggttcgcggttatttcgatgaggtggattttagggacgttgtttcgggcggttttgcgtagagtttttttcggaggcgtaggaatttcgtatttttggtagggtaggcgtcgttttttttttacggcgttgggttttcgaatgcggttttagtttcgtttttttttagcggttttttggcggtagtagcgggtaagagcggcgacgcggggttagggttcggaggttttgatttggaggtacgtttcgttcggtcgcgcgagggtgggggcggcgtagtcggttgtttcggggacgcgggtatagggtattcgtcgttattgttgttttagtagtcgtttttgttatcg

SEQ ID NO: 36868 - DNA, 519 bp, Artificial Sequence
  chemically treated genomic DNA (Homo sapiens) CpG-island No: 36868
cgataacaaaaacgactactaaaacaacaataacgacgaataccctatacccgcgtccccgaaacaaccgactacgccgcccccaccctcgcgcgaccgaacgaaacgtacctccaaatcaaaacctccgaaccctaaccccgcgtcgccgctcttacccgctactaccgccaaaaaaccgctaaaaaaaaacgaaactaaaaccgcattcgaaaacccaacgccgtaaaaaaaaaacgacgcctaccctaccaaaaatacgaaattcctacgcctccgaaaaaaactctacgcaaaaccgcccgaaacaacgtccctaaaatccacctcatcgaaataaccgcgaacctaacacaacaaacgactaaaccctaacccacgatccgctcccgaaaacgccctaccccgaccgtacgacgaaccgaacgaaaaaaactccaaactacccctaaacgccgaaaccacgaaactaaactcgtaaaaaaaacgcccctaccccaaacccgaccccgacccaac

SEQ ID NO: 36869 - DNA, 515 bp, Artificial Sequence
  chemically treated genomic DNA (Homo sapiens) CpG-island No: 36869
gatttcgtttgagttttggtcgtttttcgatttttcgggttcgttttgcgttttagtttttttttcgtcgtggggttcggggttaggggcgcgcggttgtagttaggtttatattttttttatttttcgttattgttttgggtttttgtggtcgcgtttttatattcgttttcggtcgttttacggttttagggagtgatgatttattttttttttttcgttgatattatcgtgtttttagcgtggttcggtcgggcggcggtttcgtttttttaggtttttttttagtttttttcggcgagcgggcgtaggcgcggtgcgtttttttcggtcggtagggggcgtcggagtcgtcggggtttttagggtttttttagttacggttcgggtcggcgaagagggaggggtagagagtcgtcgcggtttcgttttttcggggagagtttggttgggagttagagtttttacggtaacggatagggaagttgagtttcgagttttgattaaggtagtat

SEQ ID NO: 36870 - DNA, 515 bp, Artificial Sequence
  chemically treated genomic DNA (Homo sapiens) CpG-island No: 36870
atactaccttaatcaaaactcgaaactcaacttccctatccgttaccgtaaaaactctaactcccaaccaaactctccccgaaaaaacgaaaccgcgacgactctctacccctccctcttcgccgacccgaaccgtaactaaaaaaaccctaaaaaccccgacgactccgacgccccctaccgaccgaaaaaaacgcaccgcgcctacgcccgctcgccgaaaaaaactaaaaaaaaacctaaaaaaacgaaaccgccgcccgaccgaaccacgctaaaaacacgataatatcaacgaaaaaaaaaaaataaatcatcactccctaaaaccgtaaaacgaccgaaaacgaatataaaaacgcgaccacaaaaacccaaaacaataacgaaaaataaaaaaaatataaacctaactacaaccgcgcgcccctaaccccgaaccccacgacgaaaaaaaaactaaaacgcaaaacgaacccgaaaaatcgaaaaacgaccaaaactcaaacgaaatc

SEQ ID NO: 36871 - DNA, 515 bp, Artificial Sequence
  chemically treated genomic DNA (Homo sapiens) CpG-island No: 36871
gtgttgttttggttaaggttcggaatttagtttttttattcgttatcgtgagagttttgatttttagttaggtttttttcgggagagcgggatcgcggcggttttttgttttttttttttcgtcggttcgggtcgtggttggggaggttttagaggtttcggcggtttcggcgttttttgtcggtcgagaagggcgtatcgcgtttgcgttcgttcgtcgagaggggttgggaggagatttgggagggcggagtcgtcgttcggtcgggttacgttgggggtacgatgatgttagcggaggaaaggaaatgagttattattttttgggatcgtggggcggtcgggagcgagtgtggagacgcggttataggaatttaggataatggcgggaagtaagaggaatgtgggtttgattgtagtcgcgcgtttttgatttcggattttacggcggggaggaggttggggcgtagggcgggttcgaggggtcggaaggcggttagaatttaggcggggtt

SEQ ID NO: 36872 - DNA, 515 bp, Artificial Sequence
  chemically treated genomic DNA (Homo sapiens) CpG-island No: 36872
aaccccgcctaaattctaaccgccttccgacccctcgaacccgccctacgccccaacctcctccccgccgtaaaatccgaaatcaaaaacgcgcgactacaatcaaacccacattcctcttacttcccgccattatcctaaattcctataaccgcgtctccacactcgctcccgaccgccccacgatcccaaaaaataataactcatttcctttcctccgctaacatcatcgtacccccaacgtaacccgaccgaacgacgactccgccctcccaaatctcctcccaacccctctcgacgaacgaacgcaaacgcgatacgcccttctcgaccgacaaaaaacgccgaaaccgccgaaacctctaaaacctccccaaccacgacccgaaccgacgaaaaaaaaaaaacaaaaaaccgccgcgatcccgctctcccgaaaaaaacctaactaaaaatcaaaactctcacgataacgaataaaaaaactaaattccgaaccttaaccaaaacaacac

SEQ ID NO: 36873 - DNA, 1229 bp, Artificial Sequence
  chemically treated genomic DNA (Homo sapiens) CpG-island No: 36873
  misc_feature (948)..(948): n is either a, c, g or t
gaggagttcgcggttttttagaggggcgggtttgcgttcgggtaatcgtgcgcgacgtttacgagtttttaggacgattagttttttagtttttaggtttcgacgtttgcgttatttaagttatatattcgttcgttcggtcgcggttaaggtcggcggtagttacgtagtcgtcgtcgttcggggttttatagtttacgggtcggatggatcgagcgtcggttgcggcgtttcggtgcgcgcgcgcgttttagttaatcgcgttttcgttcgtttttcgtcgcggcggcgaggttggcgttgggaagaggaagaagaatattcgttttttttttattagcgcgcgggcggcggcggcggcggtatcggggttacgaattttgattttttattgataaaaataataataaattttttttttttcgcgatttcggcggcgttttcgggttcgttttcgttatttcgtttttatttcggcgtttcgtttttcgttcgttgtttcgcgagttcgcggttttcgggttttcgttattcgtcgatatcgggagttcgggtttttcgcgttttgtttttcgcgtcgggggtcgttcgtcgtagatacgggattcgtttcgaggtcgttttggcgttaaattttgaggtaaaattgaaagagggtcgggcgggttcgggtcggcggcggagggggcgggtttggcgcgcggatatggaggcgtcgcggcggcggttgaattcgatttttttatttttgttacggggtggcggcggcggcgttcggcgttttgtatagtgggtcgggtcgtttttttttttttttcgttcgcggtcgggcgaagcgagcgggttttttttgatcggttcggtcggcgtaagggtgggggtggagggggaatggtcgcggtttcgttttatagttggtttttcgttagcgtcgatatttttattttnggggtgatggtttcggttgggcggtttttttttttttttatttttttttttttttcgtttgtcgtttttttttgtttttttgtcgggatttttattttttcgttttttgttcgtttttgtcggtcggtgtagttttttcgtcgttttttttgtttgtgagggtttttttttcggtcgtcggtcggttgtttcgtttttttttttgcgcgttgttgggttgttttatttttttttttttttttagtttcgttttttgttgtttttgtttttttttgttttgt

SEQ ID NO: 36874 - DNA, 1229 bp, Artificial Sequence
  chemically treated genomic DNA (Homo sapiens) CpG-island No: 36874
  misc_feature (282)..(282): n is either a, c, g or t
acaaaacaaaaaaaaacaaaaacaacaaaaaacgaaactaaaaaaaaaaaaaaaaataaaacaacccaacaacgcgcaaaaaaaaaaacgaaacaaccgaccgacgaccgaaaaaaaaaccctcacaaacaaaaaaaacgacgaaaaaactacaccgaccgacaaaaacgaacaaaaaacgaaaaaataaaaatcccgacaaaaaaacaaaaaaaaacgacaaacgaaaaaaaaaaaaaaataaaaaaaaaaaaaaaccgcccaaccgaaaccatcaccccnaaaataaaaatatcgacgctaacgaaaaaccaactataaaacgaaaccgcgaccattccccctccacccccacccttacgccgaccgaaccgatcaaaaaaaacccgctcgcttcgcccgaccgcgaacgaaaaaaaaaaaaaaacgacccgacccactatacaaaacgccgaacgccgccgccgccaccccgtaacaaaaataaaaaaatcgaattcaaccgccgccgcgacgcctccatatccgcgcgccaaacccgccccctccgccgccgacccgaacccgcccgaccctctttcaattttacctcaaaatttaacgccaaaacgacctcgaaacgaatcccgtatctacgacgaacgacccccgacgcgaaaaacaaaacgcgaaaaacccgaactcccgatatcgacgaataacgaaaacccgaaaaccgcgaactcgcgaaacaacgaacgaaaaacgaaacgccgaaataaaaacgaaataacgaaaacgaacccgaaaacgccgccgaaatcgcgaaaaaaaaaaaatttattattatttttatcaataaaaaatcaaaattcgtaaccccgataccgccgccgccgccgcccgcgcgctaataaaaaaaaaacgaatattcttcttcctcttcccaacgccaacctcgccgccgcgacgaaaaacgaacgaaaacgcgattaactaaaacgcgcgcgcgcaccgaaacgccgcaaccgacgctcgatccatccgacccgtaaactataaaaccccgaacgacgacgactacgtaactaccgccgaccttaaccgcgaccgaacgaacgaatatataacttaaataacgcaaacgtcgaaacctaaaaactaaaaaactaatcgtcctaaaaactcgtaaacgtcgcgcacgattacccgaacgcaaacccgcccctctaaaaaaccgcgaactcctc

SEQ ID NO: 36875 - DNA, 1229 bp, Artificial Sequence
  chemically treated genomic DNA (Homo sapiens) CpG-island No: 36875
  misc_feature (282)..(282): n is either a, c, g or t
gtaaagtagagaggaataaaaataataagagacgaaattaaggaagaggaagaaaatgagatagtttaatagcgcgtaagagggagagcggggtagtcggtcggcggtcggaaaaagaatttttataaatagaaaaaacggcggagaggttgtatcgatcgataaaggcggataaaaagcggagaggtaaaaatttcggtagagaagtaagaagggacggtaggcgggagaaggaggaggataagaaaaaagggagatcgtttagtcggagttattattttngaagtagaaatgtcggcgttggcggagggttaattataaggcggggtcgcggttattttttttttatttttatttttgcgtcggtcgggtcggttagggggaattcgttcgtttcgttcggtcgcgggcggggaggggaggggagcggttcggtttattatgtaaagcgtcgggcgtcgtcgtcgttatttcgtggtaaaggtaaaagggtcgggtttagtcgtcgtcgcggcgtttttatgttcgcgcgttaggttcgtttttttcgtcgtcggttcgagttcgttcgatttttttttaattttattttaggatttggcgttaaagcggtttcgaagcgggtttcgtgtttgcggcgggcggttttcggcgcggagggtagggcgcggggagttcgggttttcggtgtcggcggatggcgggagttcgggggtcgcgggttcgcggggtagcgggcgagagacgagacgtcgaggtgggagcggggtggcggggacgggttcgggggcgtcgtcggggtcgcggagaagggggggtttgttattgtttttgttagtgaaaggttagagttcgtgatttcggtgtcgtcgtcgtcgtcgttcgcgcgttggtaggaggagggcgaatgtttttttttttttttttagcgttagtttcgtcgtcgcggcggggggcgggcgagaacgcgattggttgaggcgcgcgcgcgtatcggaacgtcgtagtcggcgttcggtttattcggttcgtgggttgtggggtttcgggcggcggcggttacgtagttgtcgtcggttttggtcgcggtcgggcgggcggatatgtggtttaaatggcgtaggcgtcggggtttagaggttgaagggttggtcgttttaaaaattcgtggacgtcgcgtacggttattcggacgtaggttcgtttttttggggaatcgcgagtttttt

SEQ ID NO: 36876 - DNA, 1229 bp, Artificial Sequence
  chemically treated genomic DNA (Homo sapiens) CpG-island No: 36876
  misc_feature (948)..(948): n is either a, c, g or t
aaaaaactcgcgattccccaaaaaaacgaacctacgtccgaataaccgtacgcgacgtccacgaatttttaaaacgaccaacccttcaacctctaaaccccgacgcctacgccatttaaaccacatatccgcccgcccgaccgcgaccaaaaccgacgacaactacgtaaccgccgccgcccgaaaccccacaacccacgaaccgaataaaccgaacgccgactacgacgttccgatacgcgcgcgcgcctcaaccaatcgcgttctcgcccgccccccgccgcgacgacgaaactaacgctaaaaaaaaaaaaaaaaacattcgccctcctcctaccaacgcgcgaacgacgacgacgacgacaccgaaatcacgaactctaacctttcactaacaaaaacaataacaaacccccccttctccgcgaccccgacgacgcccccgaacccgtccccgccaccccgctcccacctcgacgtctcgtctctcgcccgctaccccgcgaacccgcgacccccgaactcccgccatccgccgacaccgaaaacccgaactccccgcgccctaccctccgcgccgaaaaccgcccgccgcaaacacgaaacccgcttcgaaaccgctttaacgccaaatcctaaaataaaattaaaaaaaaatcgaacgaactcgaaccgacgacgaaaaaaacgaacctaacgcgcgaacataaaaacgccgcgacgacgactaaacccgacccttttacctttaccacgaaataacgacgacgacgcccgacgctttacataataaaccgaaccgctcccctcccctccccgcccgcgaccgaacgaaacgaacgaattccccctaaccgacccgaccgacgcaaaaataaaaataaaaaaaaaataaccgcgaccccgccttataattaaccctccgccaacgccgacatttctacttcnaaaataataactccgactaaacgatctcccttttttcttatcctcctccttctcccgcctaccgtcccttcttacttctctaccgaaatttttacctctccgctttttatccgcctttatcgatcgatacaacctctccgccgttttttctatttataaaaattctttttccgaccgccgaccgactaccccgctctccctcttacgcgctattaaactatctcattttcttcctcttccttaatttcgtctcttattatttttattcctctctactttac

SEQ ID NO: 36877 - DNA, 535 bp, Artificial Sequence
  chemically treated genomic DNA (Homo sapiens) CpG-island No: 36877
  misc_feature (126)..(127): n is either a, c, g or t
  misc_feature (137)..(139): n is either a, c, g or t
  misc_feature (150)..(153): n is either a, c, g or t
  misc_feature (286)..(289): n is either a, c, g or t
  misc_feature (295)..(297): n is either a, c, g or t
  misc_feature (372)..(373): n is either a, c, g or t
gtttcgttttcgtgttgcgtggttatttgtatgtagtttcgggattggttattcggttttcgcgaggggaaggggagggaagtagcgcgtattcgcgcgtgcgtgagttggcgcgcgagaaagggnncggtcgcgtnnnggttcgagcgnnnntcgttattttgtaaggttttttttgacgtgggagtcgtcgtcgttgtcgttattcggaggtgcgagggggtcgtgtgtgtgtgatgtggggagttcgggggcgggtcgggtcgggttttcggtagattgtatnnnncggatnnnggttttttattttgtagcgggaggtttgggaagataacgggaggaggcggggtcgggttttcggaaggaggcggnntaggggtcgggtcgagtttttgttggggcgaagaagttggagggtgggtcgttgggggcgaggtggttggttttcggtttgggggaaaggggatttttttttttttagagtattttgaaaggcgttagtgcgcgtaggagaggtatatagatttttttttaa

SEQ ID NO: 36878 - DNA, 535 bp, Artificial Sequence
  chemically treated genomic DNA (Homo sapiens) CpG-island No: 36878
  misc_feature (163)..(164): n is either a, c, g or t
  misc_feature (239)..(241): n is either a, c, g or t
  misc_feature (247)..(250): n is either a, c, g or t
  misc_feature (383)..(386): n is either a, c, g or t
  misc_feature (397)..(399): n is either a, c, g or t
  misc_feature (409)..(410): n is either a, c, g or t
ttaaaaaaaaatctatatacctctcctacgcgcactaacgcctttcaaaatactctaaaaaaaaaaaaatcccctttcccccaaaccgaaaaccaaccacctcgcccccaacgacccaccctccaacttcttcgccccaacaaaaactcgacccgacccctannccgcctccttccgaaaacccgaccccgcctcctcccgttatcttcccaaacctcccgctacaaaataaaaaaccnnnatccgnnnnatacaatctaccgaaaacccgacccgacccgcccccgaactccccacatcacacacacacgaccccctcgcacctccgaataacgacaacgacgacgactcccacgtcaaaaaaaaccttacaaaataacgannnncgctcgaaccnnnacgcgaccgnnccctttctcgcgcgccaactcacgcacgcgcgaatacgcgctacttccctccccttcccctcgcgaaaaccgaataaccaatcccgaaactacatacaaataaccacgcaacacgaaaacgaaac

SEQ ID NO: 36879 - DNA, 535 bp, Artificial Sequence
  chemically treated genomic DNA (Homo sapiens) CpG-island No: 36879
  misc_feature (163)..(164): n is either a, c, g or t
  misc_feature (239)..(241): n is either a, c, g or t
  misc_feature (247)..(250): n is either a, c, g or t
  misc_feature (383)..(386): n is either a, c, g or t
  misc_feature (397)..(399): n is either a, c, g or t
  misc_feature (409)..(410): n is either a, c, g or t
ttggagggaaatttgtgtattttttttgcgcgtattagcgttttttaagatattttaaaaagaaaaaagtttttttttttttaaatcggggattaattatttcgtttttagcggtttattttttagttttttcgttttaataaagattcgattcgatttttgnntcgttttttttcggagattcggtttcgttttttttcgttgtttttttagatttttcgttgtaaaatgagaaattnnnattcgnnnngtgtagtttgtcggaggttcggttcgattcgttttcgagttttttatattatatatatacgattttttcgtattttcgggtggcggtagcgacggcggtttttacgttagagagaattttataaaatggcgannnncgttcgagttnnnacgcgatcgnnttttttttcgcgcgttagtttacgtacgcgcgagtgcgcgttgttttttttttttttttttcgcgggagtcgagtgattaatttcgaggttgtatataaatgattacgtagtacgggggcggggt

SEQ ID NO: 36880 - DNA, 535 bp, Artificial Sequence
  chemically treated genomic DNA (Homo sapiens) CpG-island No: 36880
  misc_feature (126)..(127): n is either a, c, g or t
  misc_feature (137)..(139): n is either a, c, g or t
  misc_feature (150)..(153): n is either a, c, g or t
  misc_feature (286)..(289): n is either a, c, g or t
  misc_feature (295)..(297): n is either a, c, g or t
  misc_feature (372)..(373): n is either a, c, g or t
accccgcccccgtactacgtaatcatttatatacaacctcgaaattaatcactcgactcccgcgaaaaaaaaaaaaaaaaaacaacgcgcactcgcgcgtacgtaaactaacgcgcgaaaaaaaanncgatcgcgtnnnaactcgaacgnnnntcgccattttataaaattctctctaacgtaaaaaccgccgtcgctaccgccacccgaaaatacgaaaaaatcgtatatatataatataaaaaactcgaaaacgaatcgaaccgaacctccgacaaactacacnnnncgaatnnnaatttctcattttacaacgaaaaatctaaaaaaacaacgaaaaaaaacgaaaccgaatctccgaaaaaaaacganncaaaaatcgaatcgaatctttattaaaacgaaaaaactaaaaaataaaccgctaaaaacgaaataattaatccccgatttaaaaaaaaaaaaacttttttctttttaaaatatcttaaaaaacgctaatacgcgcaaaaaaaatacacaaatttccctccaa

SEQ ID NO: 36881 - DNA, 623 bp, Artificial Sequence
  chemically treated genomic DNA (Homo sapiens) CpG-island No: 36881
cgtttcgggcggggcgggtcgcggagtatgtcggggtttgtggttttttcggagttcgggttcgtgttttgcgaggtcgtttttcgtcggtggtttttttgtgggcgggagagggcggtcgggagtttaatgagggagtaataacgtggtaattatttacgagttcgcgtcggtgttcgtttcgtagggggatttattattcggcgtcgagtcggaggggggaaacggcgttcgtcgttcgttcggagttcgcgagtaattttagttttttttattcgcgcgtggcggcgtcggttttttagttatcgcggttttattttttttcggttttagttgttcgggttgttttcgttttcgtttgtggatgttgcgttttttcgaacgtaatatgaaggtgttttttgtcgtcgtttttatcgcggggttcgttttttttttgttgttgtcgggattttttgcggtcgatgagaagaagaaggggtttaaagttatcgttaaggttcggtggagttcgcggtatttacggtgtcggagttcgggttcgggcggttttggtttggttttggtttagttttttttttttcggtttttgtttgtggtttcgtggcgtttgggtcgttttg

SEQ ID NO: 36882 - DNA, 623 bp, Artificial Sequence
  chemically treated genomic DNA (Homo sapiens) CpG-island No: 36882
caaaacgacccaaacgccacgaaaccacaaacaaaaaccgaaaaaaaaaaaactaaaccaaaaccaaaccaaaaccgcccgaacccgaactccgacaccgtaaataccgcgaactccaccgaaccttaacgataactttaaaccccttcttcttctcatcgaccgcaaaaaatcccgacaacaacaaaaaaaaaacgaaccccgcgataaaaacgacgacaaaaaacaccttcatattacgttcgaaaaaacgcaacatccacaaacgaaaacgaaaacaacccgaacaactaaaaccgaaaaaaaataaaaccgcgataactaaaaaaccgacgccgccacgcgcgaataaaaaaaactaaaattactcgcgaactccgaacgaacgacgaacgccgtttcccccctccgactcgacgccgaataataaatccccctacgaaacgaacaccgacgcgaactcgtaaataattaccacgttattactccctcattaaactcccgaccgccctctcccgcccacaaaaaaaccaccgacgaaaaacgacctcgcaaaacacgaacccgaactccgaaaaaaccacaaaccccgacatactccgcgacccgccccgcccgaaacg

SEQ ID NO: 36883 - DNA, 623 bp, Artificial Sequence
  chemically treated genomic DNA (Homo sapiens) CpG-island No: 36883
taggacggtttagacgttacgaggttatagatagaagtcgagggaggaggggttgagttaaggttaagttaaggtcgttcgggttcgagtttcggtatcgtaaatgtcgcggattttatcggattttgacggtgattttgggtttttttttttttttatcggtcgtagaaggtttcggtagtagtaggaagaagacggatttcgcgatgagggcggcggtaaggagtatttttatgttgcgttcggagaggcgtagtatttataggcggaggcgaaagtagttcggatagttgaggtcggaagagggtggggtcgcggtggttagggagtcggcgtcgttacgcgcgggtgggggggattggggttgttcgcgggtttcgggcgggcggcgggcgtcgtttttttttttcggttcggcgtcggatagtaggtttttttgcggggcgggtatcgacgcgggttcgtgggtggttgttacgttattgtttttttattgggttttcggtcgttttttttcgtttataggaaggttatcggcggaaggcggtttcgtagagtacgggttcgggtttcgagaagattataagtttcggtatgtttcgcggttcgtttcgttcggagcg

SEQ ID NO: 36884 - DNA, 623 bp, Artificial Sequence
  chemically treated genomic DNA (Homo sapiens) CpG-island No: 36884
cgctccgaacgaaacgaaccgcgaaacataccgaaacttataatcttctcgaaacccgaacccgtactctacgaaaccgccttccgccgataaccttcctataaacgaaaaaaaacgaccgaaaacccaataaaaaaacaataacgtaacaaccacccacgaacccgcgtcgatacccgccccgcaaaaaaacctactatccgacgccgaaccgaaaaaaaaaaacgacgcccgccgcccgcccgaaacccgcgaacaaccccaatcccccccacccgcgcgtaacgacgccgactccctaaccaccgcgaccccaccctcttccgacctcaactatccgaactactttcgcctccgcctataaatactacgcctctccgaacgcaacataaaaatactccttaccgccgccctcatcgcgaaatccgtcttcttcctactactaccgaaaccttctacgaccgataaaaaaaaaaaaaaacccaaaatcaccgtcaaaatccgataaaatccgcgacatttacgataccgaaactcgaacccgaacgaccttaacttaaccttaactcaacccctcctccctcgacttctatctataacctcgtaacgtctaaaccgtccta

SEQ ID NO: 36885 - DNA, 519 bp, Artificial Sequence
  chemically treated genomic DNA (Homo sapiens) CpG-island No: 36885
tttttcgattttcgtttagttttttttttttttcggggtgttttttcgtttgttatttcgaggggtgtaaatttacgattatcgcggcgtcggtgaaaatgttttttttttcggtgtcgttgtttttagtttcgggttttgatttttcggtcgttttttcggatttcggttttaggtcggggaagggcggaggtagttttttcgaagcgttatagttattattattcgacgttatttttttttattcgcggcggaagtcgtaataataattttatcgagagatagcgtcgtgagtaaagcgatttaacggtgcgaggagtgggagggtcgtaagggatttcgtgggattcgaggggcggagatttaggggcggggtttaggcgttgggggcgggggggtattcggttagttgaggttgcgtagtaaattcgaggtttggttcgcgatgttgagatattaacgagtggggttaaaggggtagaaaagtaggagttaggggttgtttaggtttttagggtt

SEQ ID NO: 36886 - DNA, 519 bp, Artificial Sequence
  chemically treated genomic DNA (Homo sapiens) CpG-island No: 36886
aaccctaaaaacctaaacaacccctaactcctacttttctacccctttaaccccactcgttaatatctcaacatcgcgaaccaaacctcgaatttactacgcaacctcaactaaccgaatacccccccgcccccaacgcctaaaccccgcccctaaatctccgcccctcgaatcccacgaaatcccttacgaccctcccactcctcgcaccgttaaatcgctttactcacgacgctatctctcgataaaattattattacgacttccgccgcgaataaaaaaaaataacgtcgaataataataactataacgcttcgaaaaaactacctccgcccttccccgacctaaaaccgaaatccgaaaaaacgaccgaaaaatcaaaacccgaaactaaaaacaacgacaccgaaaaaaaaaacattttcaccgacgccgcgataatcgtaaatttacacccctcgaaataacaaacgaaaaaacaccccgaaaaaaaaaaaaaactaaacgaaaatcgaaaaa

SEQ ID NO: 36887 - DNA, 519 bp, Artificial Sequence
  chemically treated genomic DNA (Homo sapiens) CpG-island No: 36887
ggttttagaaatttgagtagtttttaatttttatttttttgtttttttggttttattcgttaatattttagtatcgcgaattaggtttcggatttgttgcgtagttttagttggtcgggtgttttttcgtttttagcgtttaagtttcgtttttaggttttcgtttttcggattttacggggttttttgcggtttttttatttttcgtatcgttggatcgttttgtttacggcgttatttttcgataaagttgttgttgcggttttcgtcgcgggtggaagaagatggcgtcgggtggtggtggttgtagcgtttcggagagattgttttcgttttttttcggtttggagtcggagttcgagggggcggtcgggggattagaattcgaggttggggatagcgatatcgagggggaggatatttttatcggcgtcgcggtggtcgtgagtttgtatttttcggggtagtaggcgggagggtatttcgaaagggaagagaggttaagcgagaatcggggag

SEQ ID NO: 36888 - DNA, 519 bp, Artificial Sequence
  chemically treated genomic DNA (Homo sapiens) CpG-island No: 36888
ctccccgattctcgcttaacctctcttccctttcgaaataccctcccgcctactaccccgaaaaatacaaactcacgaccaccgcgacgccgataaaaatatcctccccctcgatatcgctatccccaacctcgaattctaatcccccgaccgccccctcgaactccgactccaaaccgaaaaaaaacgaaaacaatctctccgaaacgctacaaccaccaccacccgacgccatcttcttccacccgcgacgaaaaccgcaacaacaactttatcgaaaaataacgccgtaaacaaaacgatccaacgatacgaaaaataaaaaaaccgcaaaaaaccccgtaaaatccgaaaaacgaaaacctaaaaacgaaacttaaacgctaaaaacgaaaaaacacccgaccaactaaaactacgcaacaaatccgaaacctaattcgcgatactaaaatattaacgaataaaaccaaaaaaacaaaaaaataaaaattaaaaactactcaaatttctaaaacc

SEQ ID NO: 36889 - DNA, 640 bp, Artificial Sequence
  chemically treated genomic DNA (Homo sapiens) CpG-island No: 36889
taaattttcgataaggtttttttcgacggtttagttcgtagcgttcgtttatttaggttcgggtttcgggtttttattgagcgtagcgcggggaaattttgcgggtttcggcgtttttttttatttaggggtcgcgtttattatgtggttttttttcgggttttgtttgggtttttcggtttcgggttttatcgacgggatgtgaatttttagtattcgcgtttcggttttagttgtttcgcgcgttcggttcggagttttaattttttcggagcggattgaggatttcggggcggtcggtttcgttttttcggttcgtaggttttattttaggtttcgtttttaggcgatttcgtttcgggcgtttttttgcgtcgcgggttttgagtttagaagattaggcgggatttggacgtcgttttcgaagtttagtgcgtttatagcgcggggtagtggagttaatcgtttgttaaatattgacggagtatttattgatgttaggaattggcgagcgaaaatgttatttaatttgagttaagcgtttattaaggacggtttgtggttttaggcgcggacggaggcggggttcgggttttagcgtcggttttggggttaattagggatttgttttgggtttttt

SEQ ID NO: 36890 - DNA, 640 bp, Artificial Sequence
  chemically treated genomic DNA (Homo sapiens) CpG-island No: 36890
aaaaaacccaaaacaaatccctaattaaccccaaaaccgacgctaaaacccgaaccccgcctccgtccgcgcctaaaaccacaaaccgtccttaataaacgcttaactcaaattaaataacattttcgctcgccaattcctaacatcaataaatactccgtcaatatttaacaaacgattaactccactaccccgcgctataaacgcactaaacttcgaaaacgacgtccaaatcccgcctaatcttctaaactcaaaacccgcgacgcaaaaaaacgcccgaaacgaaatcgcctaaaaacgaaacctaaaataaaacctacgaaccgaaaaaacgaaaccgaccgccccgaaatcctcaatccgctccgaaaaaattaaaactccgaaccgaacgcgcgaaacaactaaaaccgaaacgcgaatactaaaaattcacatcccgtcgataaaacccgaaaccgaaaaacccaaacaaaacccgaaaaaaaaccacataataaacgcgacccctaaataaaaaaaaacgccgaaacccgcaaaatttccccgcgctacgctcaataaaaacccgaaacccgaacctaaataaacgaacgctacgaactaaaccgtcgaaaaaaaccttatcgaaaattta

SEQ ID NO: 36891 - DNA, 640 bp, Artificial Sequence
  chemically treated genomic DNA (Homo sapiens) CpG-island No: 36891
gaggaatttaagataggtttttggttggttttaggatcggcgttgaggttcgggtttcgttttcgttcgcgtttggagttataggtcgtttttggtaggcgtttaatttaggttgggtgatattttcgttcgttagtttttggtattagtgagtgtttcgttaatgtttgataaacggttgattttattgtttcgcgttgtgggcgtattagatttcgggggcggcgtttaggtttcgtttaattttttaggtttaggattcgcggcgtaagggaacgttcggggcggggtcgtttgggggcggggtttggggtggggtttgcggatcgagggggcggagtcggtcgtttcggggtttttagttcgtttcgggagagttagggtttcgagtcgagcgcgcggagtagttggggtcggggcgcggatgttggaagtttatatttcgtcggtggggttcgaggtcgaggggtttaggtagagttcggagaaaagttatatggtgagcgcggtttttggatggggaggggcgtcgggattcgtaggattttttcgcgttgcgtttagtggggattcggggttcgggtttgggtgaacgagcgttgcgggttggatcgtcgggggaaattttgtcgagggtttg

SEQ ID NO: 36892 - DNA, 640 bp, Artificial Sequence
  chemically treated genomic DNA (Homo sapiens) CpG-island No: 36892
caaaccctcgacaaaatttcccccgacgatccaacccgcaacgctcgttcacccaaacccgaaccccgaatccccactaaacgcaacgcgaaaaaatcctacgaatcccgacgcccctccccatccaaaaaccgcgctcaccatataacttttctccgaactctacctaaacccctcgacctcgaaccccaccgacgaaatataaacttccaacatccgcgccccgaccccaactactccgcgcgctcgactcgaaaccctaactctcccgaaacgaactaaaaaccccgaaacgaccgactccgccccctcgatccgcaaaccccaccccaaaccccgcccccaaacgaccccgccccgaacgttcccttacgccgcgaatcctaaacctaaaaaattaaacgaaacctaaacgccgcccccgaaatctaatacgcccacaacgcgaaacaataaaatcaaccgtttatcaaacattaacgaaacactcactaataccaaaaactaacgaacgaaaatatcacccaacctaaattaaacgcctaccaaaaacgacctataactccaaacgcgaacgaaaacgaaacccgaacctcaacgccgatcctaaaaccaaccaaaaacctatcttaaattcctc

SEQ ID NO: 36893 - DNA, 523 bp, Artificial Sequence
  chemically treated genomic DNA (Homo sapiens) CpG-island No: 36893
  misc_feature (340)..(341): n is either a, c, g or t
tggaatttatcgttgagttgcgtaagttggaagcggcgggcgattatattgcgcgtttggtattgttggaagagtagaaatcgttgtcgtggtaggcggtttgggaaatgtattgttaacgttacgatacgttagtaggtagcgaatggttggagagcgtgcgggtttatgagaaagaaattttgagtcgtcgcgggtaaatattgtcggatgcggcgcgagcgttttattcggtttacgggtcggtaatagttgtaggtttgataagacgcgatagcgtcgtattaggtattgattgtcggatgcggtataagtgttttattcggtttatagggtcgtnnatagtgtaggtttgataagacgcgatagcgtcgtattaggtattgattgtcggatgcggtataagtgttttattcggtttataggtcgtaatagttgtaggttttgatagaattaatagcgtcgtattaagtattgattggcggatggcggataagtgttttatttagttttataggtcgcg

SEQ ID NO: 36894 - DNA, 523 bp, Artificial Sequence
  chemically treated genomic DNA (Homo sapiens) CpG-island No: 36894
  misc_feature (183)..(184): n is either a, c, g or t
cgcgacctataaaactaaataaaacacttatccgccatccgccaatcaatacttaatacgacgctattaattctatcaaaacctacaactattacgacctataaaccgaataaaacacttataccgcatccgacaatcaatacctaatacgacgctatcgcgtcttatcaaacctacactatnnacgaccctataaaccgaataaaacacttataccgcatccgacaatcaatacctaatacgacgctatcgcgtcttatcaaacctacaactattaccgacccgtaaaccgaataaaacgctcgcgccgcatccgacaatatttacccgcgacgactcaaaatttctttctcataaacccgcacgctctccaaccattcgctacctactaacgtatcgtaacgttaacaatacatttcccaaaccgcctaccacgacaacgatttctactcttccaacaataccaaacgcgcaatataatcgcccgccgcttccaacttacgcaactcaacgataaattcca

SEQ ID NO: 36895 - DNA, 523 bp, Artificial Sequence
  chemically treated genomic DNA (Homo sapiens) CpG-island No: 36895
  misc_feature (183)..(184): n is either a, c, g or t
cgcgatttgtaaggttgaataaggtatttgttcgttattcgttaattaatgtttaatgcgacgttgttggttttattaaggtttataattgttgcgatttgtaggtcggataaggtatttgtgtcgtattcggtaattaatgtttgatgcgacgttgtcgcgttttattaggtttatattatnngcgattttgtaggtcggataaggtatttgtgtcgtattcggtaattaatgtttgatgcgacgttgtcgcgttttattaggtttataattgttgtcgattcgtaggtcggataaggcgttcgcgtcgtattcggtagtgtttattcgcggcgatttaaaattttttttttataagttcgtacgttttttagttattcgttatttgttggcgtatcgtgacgttggtaatatattttttagatcgtttgttacggtaacgatttttgtttttttagtagtgttagacgcgtagtgtaatcgttcgtcgtttttagtttgcgtagtttagcggtaggtttta

SEQ ID NO: 36896 - DNA, 523 bp, Artificial Sequence
  chemically treated genomic DNA (Homo sapiens) CpG-island No: 36896
  misc_feature (340)..(341): n is either a, c, g or t
taaaacctaccgctaaactacgcaaactaaaaacgacgaacgattacactacgcgtctaacactactaaaaaaacaaaaatcgttaccgtaacaaacgatctaaaaaatatattaccaacgtcacgatacgccaacaaataacgaataactaaaaaacgtacgaacttataaaaaaaaaattttaaatcgccgcgaataaacactaccgaatacgacgcgaacgccttatccgacctacgaatcgacaacaattataaacctaataaaacgcgacaacgtcgcatcaaacattaattaccgaatacgacacaaataccttatccgacctacaaaatcgcnnataatataaacctaataaaacgcgacaacgtcgcatcaaacattaattaccgaatacgacacaaataccttatccgacctacaaatcgcaacaattataaaccttaataaaaccaacaacgtcgcattaaacattaattaacgaataacgaacaaataccttattcaaccttacaaatcgcg

SEQ ID NO: 36897 - DNA, 983 bp, Artificial Sequence
  chemically treated genomic DNA (Homo sapiens) CpG-island No: 36897
tttttttcgcgttcggtttttgggcgtcggtgttttgtgttttcggttttttgtttggagtttcgtcgtttcgagttttaggtgtttttagtttcgcgttcgtttcgtcgcggttggttttttttcgtttttcggtttttaacgtttttattacgcgtcgcgttcgtcgtttcgatttttcggttggggggcgcggatttttttcggtttcgttacgtttcgattgtcgtttggtttttgcgtcggtattttggttttggtgacgaggtgcgtggttcgtttgattatcgcgaagttgtttttgtcgatggtgcggtcgatttcgtagtagtcgatacgggcgggtatgggttcgcgggaggtcggggttgggggacgcggttggtcggtcgtaggggatacggtagcgggggcggttggggatttcggcgcgggcggaggtagtaggcggttcgcgggttcggtttttttagtttcggtttcggtagtttcgttagtttcgttcgtcgtcgtcgtcgttattttgttgtgtagtgaaattttcggggtcgcggggagtcggttcgggggagggggtaagggggggcgggaaagggggggtcgcggacgttattcggggaggcggggcgttttcgtcgatcggcgttcggttttatggtaatcgcgggttacgtgtcgacgcgcgttattgttcggagttatggtaatcgtgattttatcggcgggttcgattttttcgcgtgggtttcggtttttgaggcgttggttttcgggtgttttttttcgggagttggcggtgggaattttcgatgggtttttaatttcgaagttttcgttatttttttcgagtggggggcgtaggatgttcgatttaaagttaattttttatcgtcgttcgaatcgttaatgtgatttttgttgtgatttttgttttagtttaacgattatttaattttttttaataaaaaaaaagtgttttttta

SEQ ID NO: 36898 - DNA, 983 bp, Artificial Sequence
  chemically treated genomic DNA (Homo sapiens) CpG-island No: 36898
taaaaaaacactttttttttattaaaaaaaattaaataatcgttaaactaaaacaaaaatcacaacaaaaatcacattaacgattcgaacgacgataaaaaattaactttaaatcgaacatcctacgccccccactcgaaaaaaataacgaaaacttcgaaattaaaaacccatcgaaaattcccaccgccaactcccgaaaaaaaacacccgaaaaccaacgcctcaaaaaccgaaacccacgcgaaaaaatcgaacccgccgataaaatcacgattaccataactccgaacaataacgcgcgtcgacacgtaacccgcgattaccataaaaccgaacgccgatcgacgaaaacgccccgcctccccgaataacgtccgcgaccccccctttcccgcccccccttaccccctcccccgaaccgactccccgcgaccccgaaaatttcactacacaacaaaataacgacgacgacgacgaacgaaactaacgaaactaccgaaaccgaaactaaaaaaaccgaacccgcgaaccgcctactacctccgcccgcgccgaaatccccaaccgcccccgctaccgtatcccctacgaccgaccaaccgcgtcccccaaccccgacctcccgcgaacccatacccgcccgtatcgactactacgaaatcgaccgcaccatcgacaaaaacaacttcgcgataatcaaacgaaccacgcacctcgtcaccaaaaccaaaataccgacgcaaaaaccaaacgacaatcgaaacgtaacgaaaccgaaaaaaatccgcgccccccaaccgaaaaatcgaaacgacgaacgcgacgcgtaataaaaacgttaaaaaccgaaaaacgaaaaaaaaccaaccgcgacgaaacgaacgcgaaactaaaaacacctaaaactcgaaacgacgaaactccaaacaaaaaaccgaaaacacaaaacaccgacgcccaaaaaccgaacgcgaaaaaaa

SEQ ID NO: 36899 - DNA, 983 bp, Artificial Sequence
  chemically treated genomic DNA (Homo sapiens) CpG-island No: 36899
tgaggaaatattttttttttgttaagggaggttgggtgatcgttgaattgggatagaggttatagtagaggttatattggcgattcgagcggcggtggggggttggttttgggtcgggtattttgcgttttttattcgggaaaggtggcggagatttcgaggttgggggtttatcgaaggtttttatcgttagttttcggaggggggtattcgggagttagcgttttaggaatcggggtttacgcgggaaggtcgagttcgtcggtgaggttacggttgttatggtttcgggtagtgacgcgcgtcggtacgtgattcgcggttgttatggagtcgggcgtcggtcggcgaaagcgtttcgttttttcgagtgacgttcgcggttttttttttttcgtttttttttgttttttttttcgagtcggtttttcgcggtttcggaggttttattgtataataagatggcggcggcggcggcgagcggagttggcggggttgtcggggtcgggattgggggagtcgggttcgcgggtcgtttgttgttttcgttcgcgtcggggtttttagtcgttttcgttgtcgtgttttttgcggtcggttagtcgcgttttttagtttcggtttttcgcggatttatgttcgttcgtatcggttattacgagatcgatcgtattatcggtaagggtaatttcgcggtggttaagcgggttacgtatttcgttattaaggttaaggtatcggcgtaggggttaggcggtagtcggagcgtggcggggtcgggagaggttcgcgttttttagtcggggggtcggggcggcgagcgcggcgcgtggtgggagcgttgggggtcgggaggcgggagggagttagtcgcggcggggcgggcgcggagttagggatatttgggattcgagacggcggaattttaagtagggggtcgagggtatagagtatcggcgtttaggagtcgggcgcggggaggg

SEQ ID NO: 36900 - DNA, 983 bp, Artificial Sequence
  chemically treated genomic DNA (Homo sapiens) CpG-island No: 36900
ccctccccgcgcccgactcctaaacgccgatactctataccctcgaccccctacttaaaattccgccgtctcgaatcccaaatatccctaactccgcgcccgccccgccgcgactaactccctcccgcctcccgacccccaacgctcccaccacgcgccgcgctcgccgccccgaccccccgactaaaaaacgcgaacctctcccgaccccgccacgctccgactaccgcctaacccctacgccgataccttaaccttaataacgaaatacgtaacccgcttaaccaccgcgaaattacccttaccgataatacgatcgatctcgtaataaccgatacgaacgaacataaatccgcgaaaaaccgaaactaaaaaacgcgactaaccgaccgcaaaaaacacgacaacgaaaacgactaaaaaccccgacgcgaacgaaaacaacaaacgacccgcgaacccgactcccccaatcccgaccccgacaaccccgccaactccgctcgccgccgccgccgccatcttattatacaataaaacctccgaaaccgcgaaaaaccgactcgaaaaaaaaaacaaaaaaaaacgaaaaaaaaaaaaccgcgaacgtcactcgaaaaaacgaaacgctttcgccgaccgacgcccgactccataacaaccgcgaatcacgtaccgacgcgcgtcactacccgaaaccataacaaccgtaacctcaccgacgaactcgaccttcccgcgtaaaccccgattcctaaaacgctaactcccgaatacccccctccgaaaactaacgataaaaaccttcgataaacccccaacctcgaaatctccgccacctttcccgaataaaaaacgcaaaatacccgacccaaaaccaaccccccaccgccgctcgaatcgccaatataacctctactataacctctatcccaattcaacgatcacccaacctcccttaacaaaaaaaaaatatttcctca

SEQ ID NO: 36901 - DNA, 704 bp, Artificial Sequence
  chemically treated genomic DNA (Homo sapiens) CpG-island No: 36901
attttttcgaattgttcgttagaggttttggcgtcgcgagtttttagtagttttcggaattgttttagagtgatagatttttcgtcgcggtttagcgttttttagttagcgaaataacgcgtcgcgatgtttcgatattagcgattcgtaggggggtgtgggtagtaacgttgtagtagtttttcgtagtttggtcggttttagtagcgtcgcggcgggtggtagcgttggagtcgcgacgttcgggtcggggtcgtgttcgagatcgcggtttagttttggtgtgggttttagttttcgttatcggagttgtcgtttcgtttttattgttgtgattcggagcgttttttatggggttttcgttttgggcgtttggttttgtagtcgtcgtcgtcgttttttcgtttcgatttgttaattttcgatagtagttggcgggcggggacgcggaggagacgacggcggtttttgcggttttcggttttttggtcgttaagcgacgatcgttgtcgtaaaggcgtcgttacgtagataggcggtttttattaatttacgatagttaggcggggagcgtcgttttaaagggtgtaattttgattttttagaggacgagtttgttttagtatttacgttatttcgtagttttcgttgtcgttatttttgttggggttgataatttgtaagttaagaagtacgagaagggt

SEQ ID NO: 36902 - DNA, 704 bp, Artificial Sequence
  chemically treated genomic DNA (Homo sapiens) CpG-island No: 36902
acccttctcgtacttcttaacttacaaattatcaaccccaacaaaaataacgacaacgaaaactacgaaataacgtaaatactaaaacaaactcgtcctctaaaaaatcaaaattacaccctttaaaacgacgctccccgcctaactatcgtaaattaataaaaaccgcctatctacgtaacgacgcctttacgacaacgatcgtcgcttaacgaccaaaaaaccgaaaaccgcaaaaaccgccgtcgtctcctccgcgtccccgcccgccaactactatcgaaaattaacaaatcgaaacgaaaaaacgacgacgacgactacaaaaccaaacgcccaaaacgaaaaccccataaaaaacgctccgaatcacaacaataaaaacgaaacgacaactccgataacgaaaactaaaacccacaccaaaactaaaccgcgatctcgaacacgaccccgacccgaacgtcgcgactccaacgctaccacccgccgcgacgctactaaaaccgaccaaactacgaaaaactactacaacgttactacccacacccccctacgaatcgctaatatcgaaacatcgcgacgcgttatttcgctaactaaaaaacgctaaaccgcgacgaaaaatctatcactctaaaacaattccgaaaactactaaaaactcgcgacgccaaaacctctaacgaacaattcgaaaaaat

SEQ ID NO: 36903 - DNA, 704 bp, Artificial Sequence
  chemically treated genomic DNA (Homo sapiens) CpG-island No: 36903
gtttttttcgtattttttggtttgtaggttgttagttttaataaagatggcggtagcggaggttacggaatgacgtagatattgagatagattcgttttttgggaaattaaggttgtattttttgaggcggcgtttttcgtttagttgtcgtgagttggtagaggtcgtttatttacgtgacggcgtttttgcgatagcggtcgtcgtttgacggttaggaagtcggaagtcgtaggggtcgtcgtcgtttttttcgcgttttcgttcgttagttgttgtcggaggttgataggtcgaggcggggaggcggcggcggcggttgtagagttaggcgtttaagacggagattttatggggaacgtttcgagttatagtagtgaagacgaagcggtagtttcggtggcgagggttggggtttatattaggattgggtcgcggtttcgggtacgatttcggttcgggcgtcgcggttttagcgttattattcgtcgcggcgttgttggagtcggttaggttgcgagaggttgttgtagcgttgttgtttatatttttttgcgagtcgttggtgtcgaggtatcgcggcgcgttgtttcgttggttggaagacgttgggtcgcggcgaagagtttgttattttggagtagtttcgggagttgttggaggttcgcggcgttagggtttttagcgagtagttcgaggaggt

SEQ ID NO: 36904 - DNA, 704 bp, Artificial Sequence
  chemically treated genomic DNA (Homo sapiens) CpG-island No: 36904
acctcctcgaactactcgctaaaaaccctaacgccgcgaacctccaacaactcccgaaactactccaaaataacaaactcttcgccgcgacccaacgtcttccaaccaacgaaacaacgcgccgcgatacctcgacaccaacgactcgcaaaaaaatataaacaacaacgctacaacaacctctcgcaacctaaccgactccaacaacgccgcgacgaataataacgctaaaaccgcgacgcccgaaccgaaatcgtacccgaaaccgcgacccaatcctaatataaaccccaaccctcgccaccgaaactaccgcttcgtcttcactactataactcgaaacgttccccataaaatctccgtcttaaacgcctaactctacaaccgccgccgccgcctccccgcctcgacctatcaacctccgacaacaactaacgaacgaaaacgcgaaaaaaacgacgacgacccctacgacttccgacttcctaaccgtcaaacgacgaccgctatcgcaaaaacgccgtcacgtaaataaacgacctctaccaactcacgacaactaaacgaaaaacgccgcctcaaaaaatacaaccttaatttcccaaaaaacgaatctatctcaatatctacgtcattccgtaacctccgctaccgccatctttattaaaactaacaacctacaaaccaaaaaatacgaaaaaaac

SEQ ID NO: 36905 - DNA, 779 bp, Artificial Sequence
  chemically treated genomic DNA (Homo sapiens) CpG-island No: 36905
  misc_feature (601)..(601): n is either a, c, g or t
gaggtgagcggttttatgattgcggcggggcgggggacggggtttcgggatattttggggacgttttggttttatcgtttttagcggttacgtagacgcgcggggggaggggcgggatcggtcgtgtttattgtttttttttttaagttacgattatttgacggacgaggaggagcgtatagcgtcgagagtagtacgagcgaggataattcgttcgagtattcgtatttttcgttcgttatcgatgaggatagttggtatagtaagtggtataagatggagtagaagtttcgtatcgtttacgcgtagaaggtgcgcgacgtcggcgggtttcgggggcgggcgggtcgggcgggggattcgggtatttcggggcggggcggggatgggggtcgcgtcgggacgtttttttagtcgttcgggttgagtcggcgtttcgtagggttatttggaggagttggtgcgtttgcgcgagtcgtagttgaaggatttggaggcggagaatcggcggttttagttgtagttggaggaggcggcggcgtagaattagcgcgagaaacgggagttggaaggcgtgattttggagttgtaggagtagtgnttgagcgtacggtttgttttaatttttgattttcgtcgtttcgattatattatcgggtgaattttatttttatttttatcgattttaatattattcgatacgagtatttatttttttagtattaattttttgatttagttagttttatttcgagatgtttataatgattttttaatat

SEQ ID NO: 36906 - DNA, 779 bp, Artificial Sequence
  chemically treated genomic DNA (Homo sapiens) CpG-island No: 36906
  misc_feature (179)..(179): n is either a, c, g or t
atattaaaaaatcattataaacatctcgaaataaaactaactaaatcaaaaaattaatactaaaaaaataaatactcgtatcgaataatattaaaatcgataaaaataaaaataaaattcacccgataatataatcgaaacgacgaaaatcaaaaattaaaacaaaccgtacgctcaancactactcctacaactccaaaatcacgccttccaactcccgtttctcgcgctaattctacgccgccgcctcctccaactacaactaaaaccgccgattctccgcctccaaatccttcaactacgactcgcgcaaacgcaccaactcctccaaataaccctacgaaacgccgactcaacccgaacgactaaaaaaacgtcccgacgcgacccccatccccgccccgccccgaaatacccgaatcccccgcccgacccgcccgcccccgaaacccgccgacgtcgcgcaccttctacgcgtaaacgatacgaaacttctactccatcttataccacttactataccaactatcctcatcgataacgaacgaaaaatacgaatactcgaacgaattatcctcgctcgtactactctcgacgctatacgctcctcctcgtccgtcaaataatcgtaacttaaaaaaaaaaacaataaacacgaccgatcccgcccctccccccgcgcgtctacgtaaccgctaaaaacgataaaaccaaaacgtccccaaaatatcccgaaaccccgtcccccgccccgccgcaatcataaaaccgctcacctc

SEQ ID NO: 36907 - DNA, 779 bp, Artificial Sequence
  chemically treated genomic DNA (Homo sapiens) CpG-island No: 36907
  misc_feature (179)..(179): n is either a, c, g or t
atgttagaagattattgtgggtatttcggggtggggttggttggattagagggttgatgttggagaggtgggtgttcgtgtcgggtgatgttagagtcgatggaagtgaagatggggtttattcggtgatgtggtcggggcggcgggggttaggggttagggtaggtcgtgcgtttaantattgtttttgtagttttaggattacgttttttagttttcgtttttcgcgttggttttgcgtcgtcgttttttttagttgtagttgaagtcgtcggtttttcgtttttaggttttttagttgcgattcgcgtagacgtattagtttttttaggtagttttgcggggcgtcggtttagttcgggcggttgggaggacgtttcggcgcggtttttattttcgtttcgtttcgggatgttcggatttttcgttcggttcgttcgttttcggggttcgtcggcgtcgcgtattttttgcgcgtagacgatgcggaatttttgttttattttgtgttatttgttgtattagttgtttttatcggtgacgagcgggaggtacgggtgttcgggcgagttgttttcgttcgtgttgttttcggcgttgtgcgttttttttcgttcgttaggtagtcgtagtttgggagagggagtagtgggtacggtcggtttcgttttttttttcgcgcgtttgcgtggtcgttgagggcggtgggattaggacgtttttaggatgtttcgaggtttcgtttttcgtttcgtcgtagttatggagtcgtttatttt

SEQ ID NO: 36908 - DNA, 779 bp, Artificial Sequence
  chemically treated genomic DNA (Homo sapiens) CpG-island No: 36908
  misc_feature (601)..(601): n is either a, c, g or t
aaaataaacgactccataactacgacgaaacgaaaaacgaaacctcgaaacatcctaaaaacgtcctaatcccaccgccctcaacgaccacgcaaacgcgcgaaaaaaaaaacgaaaccgaccgtacccactactccctctcccaaactacgactacctaacgaacgaaaaaaaacgcacaacgccgaaaacaacacgaacgaaaacaactcgcccgaacacccgtacctcccgctcgtcaccgataaaaacaactaatacaacaaataacacaaaataaaacaaaaattccgcatcgtctacgcgcaaaaaatacgcgacgccgacgaaccccgaaaacgaacgaaccgaacgaaaaatccgaacatcccgaaacgaaacgaaaataaaaaccgcgccgaaacgtcctcccaaccgcccgaactaaaccgacgccccgcaaaactacctaaaaaaactaatacgtctacgcgaatcgcaactaaaaaacctaaaaacgaaaaaccgacgacttcaactacaactaaaaaaaacgacgacgcaaaaccaacgcgaaaaacgaaaactaaaaaacgtaatcctaaaactacaaaaacaatanttaaacgcacgacctaccctaacccctaacccccgccgccccgaccacatcaccgaataaaccccatcttcacttccatcgactctaacatcacccgacacgaacacccacctctccaacatcaaccctctaatccaaccaaccccaccccgaaatacccacaataatcttctaacat

SEQ ID NO: 36909 - DNA, 500 bp, Artificial Sequence
  chemically treated genomic DNA (Homo sapiens) CpG-island No: 36909
cggcgagggtgacgtattggttttttttttcggtgtttttaggtgcgtggcggcggtagtgagaatgagtttttcgagatcgtcgggagattatataataacgacgaagttatttgtcgggttattcgtcgagatttgaaaatttcgcggcgatttttttcgtcggttttagtatcgtttttattttttaggttataggataggtttgtaattgtaaaacgttttgtaaattatagggtttcgcgcgggtgtgcgttattgggttagttgagttgtagttcgggtcgggcgggttgggacgtgagtaagtcgggggagacgggagagttatggggagttagattttattttcgcgtgattttgggtaaattataatttcgtttaaggttcggaatgattttgcgcggagaggaagagtattgagtgcgggagggtatcgacgttttggtgttggttgttttcgtatcgtgattttttttgagttttaaaattttttgtag

SEQ ID NO: 36910 - DNA, 500 bp, Artificial Sequence
  chemically treated genomic DNA (Homo sapiens) CpG-island No: 36910
ctacaaaaaattttaaaactcaaaaaaaatcacgatacgaaaacaaccaacaccaaaacgtcgataccctcccgcactcaatactcttcctctccgcgcaaaatcattccgaaccttaaacgaaattataatttacccaaaatcacgcgaaaataaaatctaactccccataactctcccgtctcccccgacttactcacgtcccaacccgcccgacccgaactacaactcaactaacccaataacgcacacccgcgcgaaaccctataatttacaaaacgttttacaattacaaacctatcctataacctaaaaaataaaaacgatactaaaaccgacgaaaaaaatcgccgcgaaattttcaaatctcgacgaataacccgacaaataacttcgtcgttattatataatctcccgacgatctcgaaaaactcattctcactaccgccgccacgcacctaaaaacaccgaaaaaaaaaaccaatacgtcaccctcgccg

SEQ ID NO: 36911 - DNA, 500 bp, Artificial Sequence
  chemically treated genomic DNA (Homo sapiens) CpG-island No: 36911
ttgtaaagagttttgagatttagaagaaattacgatacgagagtaattaatattaaaacgtcgatgttttttcgtatttagtgtttttttttttcgcgtagagttatttcgggttttaggcgaggttgtgatttgtttaaggttacgcgaaggtgggatttggttttttatggttttttcgtttttttcggtttgtttacgttttagttcgttcggttcgggttgtagtttagttaatttagtggcgtatattcgcgcggggttttgtggtttataaagcgttttgtagttgtaggtttgttttgtaatttgaaaaatgggggcgatgttaaggtcggcgagagaagtcgtcgcgaagtttttaagtttcggcgggtagttcggtaagtaatttcgtcgttattgtgtggtttttcggcgatttcgaagaatttatttttattgtcgtcgttacgtatttgaggatatcgaggaagagggttagtgcgttattttcgtcg

SEQ ID NO: 36912 - DNA, 500 bp, Artificial Sequence
  chemically treated genomic DNA (Homo sapiens) CpG-island No: 36912
cgacgaaaataacgcactaaccctcttcctcgatatcctcaaatacgtaacgacgacaataaaaataaattcttcgaaatcgccgaaaaaccacacaataacgacgaaattacttaccgaactacccgccgaaacttaaaaacttcgcgacgacttctctcgccgaccttaacatcgcccccatttttcaaattacaaaacaaacctacaactacaaaacgctttataaaccacaaaaccccgcgcgaatatacgccactaaattaactaaactacaacccgaaccgaacgaactaaaacgtaaacaaaccgaaaaaaacgaaaaaaccataaaaaaccaaatcccaccttcgcgtaaccttaaacaaatcacaacctcgcctaaaacccgaaataactctacgcgaaaaaaaaaaacactaaatacgaaaaaacatcgacgttttaatattaattactctcgtatcgtaatttcttctaaatctcaaaactctttacaa

SEQ ID NO: 36913 - DNA, 725 bp, Artificial Sequence
  chemically treated genomic DNA (Homo sapiens) CpG-island No: 36913
ttatttattgtgtttttttaagattttcgtttcggacggttttttttttttcgtttttatttttttttagaagcgttaattttagatcgtttagttttttttattcgaatttagggaatagaatattatttaatttacgaacgtcgcgaagagggggttgacgggcgggattgattagggggcgtaggcgcgatcgcgtttttttcggttgagatttattttgcggttggggggtttcggcggcgatttgtcgggagttcgggaggcgttgtcgagtagtagttttagtagcggtaatagtcggcgaggacgttggggttattcgtcggcggtatcgcggggttaggcgggttttagcggtttatggttttcgtttggtttcgttcgttcggtttcgcgtagtttagttttgcgtcgcgtttcgtagtttcggttttcgttttcgttgcggcgttcgtttagcgcgattgttttcgatcggagtcgtcgtaagcgttttttgtaggcggcgcgttatatcgttggtttttcggtatcgttatttttcggtttcgtttcgttcgtcgtttttcggtattgtttatttttagtttatttcgtagttttcgcgttttgcgtttttagattttgcgttgtaaaggagtgtcgggattagggttttattattcgggtttttgggtttcgagagtttttaaaatttggtgtaaaatttgtgtgtgtgtagg

SEQ ID NO: 36914 - DNA, 725 bp, Artificial Sequence
  chemically treated genomic DNA (Homo sapiens) CpG-island No: 36914
cctacacacacacaaattttacaccaaattttaaaaactctcgaaacccaaaaacccgaataataaaaccctaatcccgacactcctttacaacgcaaaatctaaaaacgcaaaacgcgaaaactacgaaataaactaaaaataaacaataccgaaaaacgacgaacgaaacgaaaccgaaaaataacgataccgaaaaaccaacgatataacgcgccgcctacaaaaaacgcttacgacgactccgatcgaaaacaatcgcgctaaacgaacgccgcaacgaaaacgaaaaccgaaactacgaaacgcgacgcaaaactaaactacgcgaaaccgaacgaacgaaaccaaacgaaaaccataaaccgctaaaacccgcctaaccccgcgataccgccgacgaataaccccaacgtcctcgccgactattaccgctactaaaactactactcgacaacgcctcccgaactcccgacaaatcgccgccgaaaccccccaaccgcaaaataaatctcaaccgaaaaaaacgcgatcgcgcctacgccccctaatcaatcccgcccgtcaaccccctcttcgcgacgttcgtaaattaaataatattctattccctaaattcgaataaaaaaaactaaacgatctaaaattaacgcttctaaaaaaaaataaaaacgaaaaaaaaaaaaccgtccgaaacgaaaatcttaaaaaaacacaataaataa

SEQ ID NO: 36915 - DNA, 725 bp, Artificial Sequence
  chemically treated genomic DNA (Homo sapiens) CpG-island No: 36915
tttatatatatataaattttgtattaaattttggggattttcgaaatttaagaattcgggtgatgggattttaatttcgatatttttttgtagcgtagagtttgggagcgtagagcgcgggggttgcggggtgggttgaaggtgggtagtatcggggggcggcgggcggagcggggtcgggaggtggcggtgtcggagggttagcggtgtggcgcgtcgtttgtagggggcgtttgcggcggtttcggtcggagataatcgcgttgagcgggcgtcgtagcgggagcgggagtcggagttgcgaggcgcggcgtagagttgggttgcgcggggtcgggcgagcgggattaggcgggagttatggatcgttagggttcgtttagtttcgcgatgtcgtcggcgagtggttttagcgttttcgtcggttgttgtcgttgttggggttgttgttcggtagcgtttttcgggttttcggtaagtcgtcgtcggagttttttagtcgtagggtgagttttagtcgggaggggcgcgatcgcgtttgcgttttttgattagtttcgttcgttagtttttttttcgcggcgttcgtgaattgagtggtattttgttttttggattcgggtggggggagttaagcgatttggggttggcgtttttgggggaaagtggaggcggggagagggaggtcgttcggggcgggggttttggggagatataatgggtag

SEQ ID NO: 36916 - DNA, 725 bp, Artificial Sequence
  chemically treated genomic DNA (Homo sapiens) CpG-island No: 36916
ctacccattatatctccccaaaacccccgccccgaacgacctccctctccccgcctccactttcccccaaaaacgccaaccccaaatcgcttaactccccccacccgaatccaaaaaacaaaataccactcaattcacgaacgccgcgaaaaaaaaactaacgaacgaaactaatcaaaaaacgcaaacgcgatcgcgcccctcccgactaaaactcaccctacgactaaaaaactccgacgacgacttaccgaaaacccgaaaaacgctaccgaacaacaaccccaacaacgacaacaaccgacgaaaacgctaaaaccactcgccgacgacatcgcgaaactaaacgaaccctaacgatccataactcccgcctaatcccgctcgcccgaccccgcgcaacccaactctacgccgcgcctcgcaactccgactcccgctcccgctacgacgcccgctcaacgcgattatctccgaccgaaaccgccgcaaacgccccctacaaacgacgcgccacaccgctaaccctccgacaccgccacctcccgaccccgctccgcccgccgccccccgatactacccaccttcaacccaccccgcaacccccgcgctctacgctcccaaactctacgctacaaaaaaatatcgaaattaaaatcccatcacccgaattcttaaatttcgaaaatccccaaaatttaatacaaaatttatatatatataaa

SEQ ID NO: 36917 - DNA, 560 bp, Artificial Sequence
  chemically treated genomic DNA (Homo sapiens) CpG-island No: 36917
gtaaaatcgttagagtttgaatagtttgttgtcgtcgttacgtgaataattggacggttttcgtcgttaggtttaggatagtttcggtaaagaagtataagaacgttatattttgatttacgaaattcgtaatttttagtaatttaacgcgtaaatggtttaggaagcgattaatttgacgcgcgcgttgaaaggcgataataaaatttagggtaattggggcgaggtagtattgacgcgggtgttggaggttttcggtttgcgtgaagggtatgaatatgaaatttaggttagtatcgaaaatgacgttcgttcgcggatgtagtcggatgttatcgtgcgtttgtcgtagggaaaagatgtggtgatcgacgttaaatgacgttgtcgtttatgaacgttattttaacgttaagacgattatattcgcgaaagcgcgttaataggaatatatcgcgtcggtgcgtaattatattcgtttgttggacgtaaagattattaatagttgtcggggttgcgaattttggattacgtgttgatgtttattttcgttgaattcg

SEQ ID NO: 36918 - DNA, 560 bp, Artificial Sequence
  chemically treated genomic DNA (Homo sapiens) CpG-island No: 36918
cgaattcaacgaaaataaacatcaacacgtaatccaaaattcgcaaccccgacaactattaataatctttacgtccaacaaacgaatataattacgcaccgacgcgatatattcctattaacgcgctttcgcgaatataatcgtcttaacgttaaaataacgttcataaacgacaacgtcatttaacgtcgatcaccacatcttttccctacgacaaacgcacgataacatccgactacatccgcgaacgaacgtcattttcgatactaacctaaatttcatattcatacccttcacgcaaaccgaaaacctccaacacccgcgtcaatactacctcgccccaattaccctaaattttattatcgcctttcaacgcgcgcgtcaaattaatcgcttcctaaaccatttacgcgttaaattactaaaaattacgaatttcgtaaatcaaaatataacgttcttatacttctttaccgaaactatcctaaacctaacgacgaaaaccgtccaattattcacgtaacgacgacaacaaactattcaaactctaacgattttac

SEQ ID NO: 36919 - DNA, 560 bp, Artificial Sequence
  chemically treated genomic DNA (Homo sapiens) CpG-island No: 36919
cgggtttaacgggaataaatattagtacgtaatttagagttcgtagtttcggtagttgttgataatttttgcgtttagtaaacggatatggttacgtatcgacgcgatatgtttttgttagcgcgttttcgcgggtgtagtcgttttggcgttaaaatagcgtttataggcgatagcgttatttggcgtcgattattatattttttttttgcggtaggcgtacgatgatattcggttgtattcgcgagcgggcgttattttcgatgttgatttgggttttatatttatattttttacgtagatcggaagtttttagtattcgcgttaatattatttcgttttagttgttttgggttttattgtcgttttttagcgcgcgcgttaggttgatcgttttttgggttatttgcgcgttgagttgttggagattgcgaatttcgtgggttagggtatggcgtttttgtgtttttttatcgaagttgttttgaatttgacggcggaaatcgtttagttgtttacgtagcggcgataataggttgtttagattttgacggttttgt

SEQ ID NO: 36920 - DNA, 560 bp, Artificial Sequence
  chemically treated genomic DNA (Homo sapiens) CpG-island No: 36920
acaaaaccgtcaaaatctaaacaacctattatcgccgctacgtaaacaactaaacgatttccgccgtcaaattcaaaacaacttcgataaaaaaacacaaaaacgccataccctaacccacgaaattcgcaatctccaacaactcaacgcgcaaataacccaaaaaacgatcaacctaacgcgcgcgctaaaaaacgacaataaaacccaaaacaactaaaacgaaataatattaacgcgaatactaaaaacttccgatctacgtaaaaaatataaatataaaacccaaatcaacatcgaaaataacgcccgctcgcgaatacaaccgaatatcatcgtacgcctaccgcaaaaaaaaaatataataatcgacgccaaataacgctatcgcctataaacgctattttaacgccaaaacgactacacccgcgaaaacgcgctaacaaaaacatatcgcgtcgatacgtaaccatatccgtttactaaacgcaaaaattatcaacaactaccgaaactacgaactctaaattacgtactaatatttattcccgttaaacccg

SEQ ID NO: 36921 - DNA, 568 bp, Artificial Sequence
  chemically treated genomic DNA (Homo sapiens) CpG-island No: 36921
ttcgttcgttattttgcgggcggtatagtattaacgaggtatatcgtggtaaaagttttaaaacgcgtttttgtttgtaatgaatgcggggtcgattattcgcgttggtaggggtagtgtagtgtttgttatgtttggaatattattatcgaggtgcgttttgttgcgtcgttaatggtggcgcgtaacgagcgttttagcggttatgtcggtagcgtcggggtggtaaaagtttagaaatttttcgatattagttttgaagagttgtcgcgtttttttatcggatttaaagagttcgatcgcgtattaggcggcggcgtggtgttaggaagtgttattttgattggcggtaattttggtgcggggaaatttacgttgttattgtaaacgttgtgtaaattggtttagtagatgaaaacgttgtatgttatcggcgaagagtcgttgtaataggtggtaatgcgcgtttatcgttttggtttgtcgattgataattttaatatgttgtcggaaattagtatcgaatagatttgtttgattgtcgaagaagagtaatcgaagttgatgg

SEQ ID NO: 36922 - DNA, 568 bp, Artificial Sequence
  chemically treated genomic DNA (Homo sapiens) CpG-island No: 36922
ccatcaacttcgattactcttcttcgacaatcaaacaaatctattcgatactaatttccgacaacatattaaaattatcaatcgacaaaccaaaacgataaacgcgcattaccacctattacaacgactcttcgccgataacatacaacgttttcatctactaaaccaatttacacaacgtttacaataacaacgtaaatttccccgcaccaaaattaccgccaatcaaaataacacttcctaacaccacgccgccgcctaatacgcgatcgaactctttaaatccgataaaaaaacgcgacaactcttcaaaactaatatcgaaaaatttctaaacttttaccaccccgacgctaccgacataaccgctaaaacgctcgttacgcgccaccattaacgacgcaacaaaacgcacctcgataataatattccaaacataacaaacactacactacccctaccaacgcgaataatcgaccccgcattcattacaaacaaaaacgcgttttaaaacttttaccacgatatacctcgttaatactataccgcccgcaaaataacgaacgaa

SEQ ID NO: 36923 - DNA, 568 bp, Artificial Sequence
  chemically treated genomic DNA (Homo sapiens) CpG-island No: 36923
ttattagtttcggttgttttttttcggtaattaggtagatttgttcgatgttggttttcgataatatattgagattgttagtcggtaggttaaggcgatgagcgcgtattgttatttgttgtagcgatttttcgtcggtgatatatagcgtttttatttgttgggttagtttgtatagcgtttgtagtagtagcgtggattttttcgtattagggttatcgttaattagaatggtattttttggtattacgtcgtcgtttagtacgcggtcgaattttttaaattcggtggaaaaacgcggtagttttttaaggttgatatcggagagtttttggatttttgttatttcggcgttatcggtatagtcgttgagacgttcgttacgcgttattattggcgacgtagtaagacgtatttcggtgatggtgttttaggtatgataggtattgtattgtttttgttagcgcggataatcggtttcgtatttattataaataaaggcgcgttttggagtttttgttacggtgtatttcgttaatgttgtgtcgttcgtaggatggcgggcgag

SEQ ID NO: 36924 - DNA, 568 bp, Artificial Sequence
  chemically treated genomic DNA (Homo sapiens) CpG-island No: 36924
ctcgcccgccatcctacgaacgacacaacattaacgaaatacaccgtaacaaaaactccaaaacgcgcctttatttataataaatacgaaaccgattatccgcgctaacaaaaacaatacaatacctatcatacctaaaacaccatcaccgaaatacgtcttactacgtcgccaataataacgcgtaacgaacgtctcaacgactataccgataacgccgaaataacaaaaatccaaaaactctccgatatcaaccttaaaaaactaccgcgtttttccaccgaatttaaaaaattcgaccgcgtactaaacgacgacgtaataccaaaaaataccattctaattaacgataaccctaatacgaaaaaatccacgctactactacaaacgctatacaaactaacccaacaaataaaaacgctatatatcaccgacgaaaaatcgctacaacaaataacaatacgcgctcatcgccttaacctaccgactaacaatctcaatatattatcgaaaaccaacatcgaacaaatctacctaattaccgaaaaaaaacaaccgaaactaataa

SEQ ID NO: 36925 - DNA, 581 bp, Artificial Sequence
  chemically treated genomic DNA (Homo sapiens) CpG-island No: 36925
  misc_feature (543)..(543): n is either a, c, g or t
cgtgttgttgtttgaagcgggcggttcggattatcgttttgattttcgtatttagatgttcgttgttttggtattttcgttatagggtaaacgttataattgggtttatgaaacggaatttgaatcgtttatgaataatcgtcgtatggagtgcggacgcggtaaaggtttgggtggatcgtcgttgattaacggtatgtgttatattcgtggtaatgcgttggatttcgataattgggcgtaagaattcggtttggagaattggagttatttcgattgtttgttttattatcgtaaggtcgagattcgcgatatgggtgaaaacgattattacggcggtgatggttcggtgagcgttattatttttaaattcggcgttaattcgttgtttgaagcgatgattgaagcgggcgtgtaggcgggttattcgcgtacggacgattttaacggttattagtaggaaggttttggttcgatggatcgtatcgttacgtcgtagggtcgtcgcgttagtatcgcgcgtggttatttcgattaggttanatcgcgtttttaattgattattcgtatttacgttatga

SEQ ID NO: 36926 - DNA, 581 bp, Artificial Sequence
  chemically treated genomic DNA (Homo sapiens) CpG-island No: 36926
  misc_feature (39)..(39): n is either a, c, g or t
tcataacgtaaatacgaataatcaattaaaaacgcgatntaacctaatcgaaataaccacgcgcgatactaacgcgacgaccctacgacgtaacgatacgatccatcgaaccaaaaccttcctactaataaccgttaaaatcgtccgtacgcgaataacccgcctacacgcccgcttcaatcatcgcttcaaacaacgaattaacgccgaatttaaaaataataacgctcaccgaaccatcaccgccgtaataatcgttttcacccatatcgcgaatctcgaccttacgataataaaacaaacaatcgaaataactccaattctccaaaccgaattcttacgcccaattatcgaaatccaacgcattaccacgaatataacacataccgttaatcaacgacgatccacccaaacctttaccgcgtccgcactccatacgacgattattcataaacgattcaaattccgtttcataaacccaattataacgtttaccctataacgaaaataccaaaacaacgaacatctaaatacgaaaatcaaaacgataatccgaaccgcccgcttcaaacaacaacacg

SEQ ID NO: 36927 - DNA, 581 bp, Artificial Sequence
  chemically treated genomic DNA (Homo sapiens) CpG-island No: 36927
  misc_feature (39)..(39): n is either a, c, g or t
ttatagcgtgagtacgaatggttagttaggaacgcgatntggtttgatcgagatagttacgcgcggtgttggcgcgacggttttgcggcgtgacggtgcgatttatcggattaaaatttttttgttgataatcgttgagatcgttcgtgcgcgggtagttcgtttgtacgttcgttttaattatcgttttaaatagcggattgacgtcgggtttggaggtagtgacgtttatcgggttattatcgtcgtgatagtcgtttttatttatatcgcgagtttcggttttgcggtagtagggtaggtagtcgaggtagttttagttttttagatcgggtttttgcgtttagttatcgagatttagcgtattgttacggatgtagtatatgtcgttgattagcgacgatttatttagatttttatcgcgttcgtattttatgcggcggttatttataaacggtttaggtttcgttttataggtttagttgtagcgtttattttgtagcgggaatgttagggtagcgggtatttgggtgcggaagttaaagcgatagttcgggtcgttcgttttaagtagtagtacg

SEQ ID NO: 36928 - DNA, 581 bp, Artificial Sequence
  chemically treated genomic DNA (Homo sapiens) CpG-island No: 36928
  misc_feature (543)..(543): n is either a, c, g or t
cgtactactacttaaaacgaacgacccgaactatcgctttaacttccgcacccaaatacccgctaccctaacattcccgctacaaaataaacgctacaactaaacctataaaacgaaacctaaaccgtttataaataaccgccgcataaaatacgaacgcgataaaaatctaaataaatcgtcgctaatcaacgacatatactacatccgtaacaatacgctaaatctcgataactaaacgcaaaaacccgatctaaaaaactaaaactacctcgactacctaccctactaccgcaaaaccgaaactcgcgatataaataaaaacgactatcacgacgataataacccgataaacgtcactacctccaaacccgacgtcaatccgctatttaaaacgataattaaaacgaacgtacaaacgaactacccgcgcacgaacgatctcaacgattatcaacaaaaaaattttaatccgataaatcgcaccgtcacgccgcaaaaccgtcgcgccaacaccgcgcgtaactatctcgatcaaaccanatcgcgttcctaactaaccattcgtactcacgctataa

SEQ ID NO: 36929 - DNA, 503 bp, Artificial Sequence
  chemically treated genomic DNA (Homo sapiens) CpG-island No: 36929
  misc_feature (444)..(444): n is either a, c, g or t
  misc_feature (447)..(447): n is either a, c, g or t
gttcgtacggtatcgtttttgttattattttggtaagaaatggttacgaggttgttttttggggttatgattttgaatatatcgtaacgtttgaacgcgatcgttgtaacgtcgcgttttttttcgatgtgttttttttcgatacgttttattttgaaagcgatttcgttattgcgttggtagttagtcgtaatattttcgtcgtcgtatttagttatgtttttggtgaagtgttgcgttagattaaattattgatgcgttttgatgcgcgtttggtgtgggcgattaaagggttggaagcggaaatcggacgtttgttataggacgtggcgcgtgaggttttaggcgattaaattcgttggcggttatttttggtttaacgtttgcgagagaattggcggtaggtttatcgatagttatttcgttgggttcgaacgattaganttntgtcgatgatttttagtagttgttgtattgcggtaaaagtttcgagtttatagtaa

SEQ ID NO: 36930 - DNA, 503 bp, Artificial Sequence
  chemically treated genomic DNA (Homo sapiens) CpG-island No: 36930
  misc_feature (57)..(57): n is either a, c, g or t
  misc_feature (60)..(60): n is either a, c, g or t
ttactataaactcgaaacttttaccgcaatacaacaactactaaaaatcatcgacanaantctaatcgttcgaacccaacgaaataactatcgataaacctaccgccaattctctcgcaaacgttaaaccaaaaataaccgccaacgaatttaatcgcctaaaacctcacgcgccacgtcctataacaaacgtccgatttccgcttccaaccctttaatcgcccacaccaaacgcgcatcaaaacgcatcaataatttaatctaacgcaacacttcaccaaaaacataactaaatacgacgacgaaaatattacgactaactaccaacgcaataacgaaatcgctttcaaaataaaacgtatcgaaaaaaaacacatcgaaaaaaaacgcgacgttacaacgatcgcgttcaaacgttacgatatattcaaaatcataaccccaaaaaacaacctcgtaaccatttcttaccaaaataataacaaaaacgataccgtacgaac

SEQ ID NO: 36931 - DNA, 503 bp, Artificial Sequence
  chemically treated genomic DNA (Homo sapiens) CpG-island No: 36931
  misc_feature (57)..(57): n is either a, c, g or t
  misc_feature (60)..(60): n is either a, c, g or t
ttgttgtaaattcgaaatttttgtcgtagtgtagtagttgttgagaattatcggtanagntttgatcgttcgagtttagcgaaatagttgtcggtaaatttgtcgttagttttttcgtaaacgttgggttagagataatcgttagcgaatttgatcgtttaaggttttacgcgttacgttttgtaatagacgttcggttttcgtttttagttttttggtcgtttatattagacgcgtattaggacgtattagtggtttaatttggcgtagtattttattaaagatatggttgggtacgacgacgagaatattacggttggttgttagcgtagtggcgagatcgtttttaagatggagcgtatcgggaaaaggtatatcggggagaaacgcggcgttatagcggtcgcgtttaagcgttgcgatatgtttagggttatggttttagaggataatttcgtggttattttttgttagggtgatggtaagagcggtgtcgtacgagt

SEQ ID NO: 36932 - DNA, 503 bp, Artificial Sequence
  chemically treated genomic DNA (Homo sapiens) CpG-island No: 36932
  misc_feature (444)..(444): n is either a, c, g or t
  misc_feature (447)..(447): n is either a, c, g or t
actcgtacgacaccgctcttaccatcaccctaacaaaaaataaccacgaaattatcctctaaaaccataaccctaaacatatcgcaacgcttaaacgcgaccgctataacgccgcgtttctccccgatataccttttcccgatacgctccatcttaaaaacgatctcgccactacgctaacaaccaaccgtaatattctcgtcgtcgtacccaaccatatctttaataaaatactacgccaaattaaaccactaatacgtcctaatacgcgtctaatataaacgaccaaaaaactaaaaacgaaaaccgaacgtctattacaaaacgtaacgcgtaaaaccttaaacgatcaaattcgctaacgattatctctaacccaacgtttacgaaaaaactaacgacaaatttaccgacaactatttcgctaaactcgaacgatcaaanctntaccgataattctcaacaactactacactacgacaaaaatttcgaatttacaacaa

SEQ ID NO: 36933 - DNA, 629 bp, Artificial Sequence
  chemically treated genomic DNA (Homo sapiens) CpG-island No: 36933
ggttcggttcgtggcgtacgcggttcgcgggttggagttagttcgtggtgcgggcgagagggtaggggcggggagaagttatgtttttagttgtagaggttgtatatagttggtatgatcgcggttatttgcgcggcgtcggtgtttttgcgttcgcgttgttcggttcgcggtcgcggattttgcggcgggagcgcggcgcggtgaagtatcggcgcggagggcgttcggcgtaggcggcggcgggtgtgggtcgagtcggtatttatagtttcgtgatagtagtagcggtagcgacgtcgtcggttcgtttcgtcgcgttttttagcgaggtcgtcggcgcgtcgagggttgtgttcgatcgcgaatttcgtgtgtagtcgtttcgcgtttcgcgcgatttttcgggtgagtacgtggggttcgggcgttgggcgagtttttttagtcgttcggtttagtcgtagcggagttttttcggttttgtcgttcgtgtttcggttgttatttcgttattgttcgcgagtgcggaagtagtcgcggaatttcggttcggttttcgaatttttcggcgtttttgtttttgtttttttggggatggtagttaaagaggtagggtgaagtgttaa

SEQ ID NO: 36934 - DNA, 629 bp, Artificial Sequence
  chemically treated genomic DNA (Homo sapiens) CpG-island No: 36934
ttaacacttcaccctacctctttaactaccatccccaaaaaaacaaaaacaaaaacgccgaaaaattcgaaaaccgaaccgaaattccgcgactacttccgcactcgcgaacaataacgaaataacaaccgaaacacgaacgacaaaaccgaaaaaactccgctacgactaaaccgaacgactaaaaaaactcgcccaacgcccgaaccccacgtactcacccgaaaaatcgcgcgaaacgcgaaacgactacacacgaaattcgcgatcgaacacaaccctcgacgcgccgacgacctcgctaaaaaacgcgacgaaacgaaccgacgacgtcgctaccgctactactatcacgaaactataaataccgactcgacccacacccgccgccgcctacgccgaacgccctccgcgccgatacttcaccgcgccgcgctcccgccgcaaaatccgcgaccgcgaaccgaacaacgcgaacgcaaaaacaccgacgccgcgcaaataaccgcgatcataccaactatatacaacctctacaactaaaaacataacttctccccgcccctaccctctcgcccgcaccacgaactaactccaacccgcgaaccgcgtacgccacgaaccgaacc

SEQ ID NO: 36935 - DNA, 629 bp, Artificial Sequence
  chemically treated genomic DNA (Homo sapiens) CpG-island No: 36935
ttgatattttattttgtttttttggttgttatttttaggaaggtaggagtagaggcgtcggagaattcgggggtcgggtcggggtttcgcggttgttttcgtattcgcgggtagtgacgaggtggtagtcgggatacgggcggtagggtcgggagggtttcgttgcggttggatcgaacggttggggaggttcgtttaacgttcgggttttacgtatttattcgaagggtcgcgcggggcgcggggcgattgtatacgggattcgcggtcgagtatagttttcggcgcgtcggcggtttcgttgggaagcgcggcgagacgggtcggcggcgtcgttgtcgttgttgttgttacggagttataaatatcggttcggtttatattcgtcgtcgtttacgtcgggcgtttttcgcgtcggtgttttatcgcgtcgcgttttcgtcgtaaagttcgcggtcgcgggtcgggtaacgcgagcgtaagggtatcggcgtcgcgtaggtgatcgcgattatgttagttgtgtgtaatttttgtagttggaggtatggttttttttcgtttttgttttttcgttcgtattacgggttgattttagttcgcgggtcgcgtgcgttacgggtcgagtt

SEQ ID NO: 36936 - DNA, 629 bp, Artificial Sequence
  chemically treated genomic DNA (Homo sapiens) CpG-island No: 36936
aactcgacccgtaacgcacgcgacccgcgaactaaaatcaacccgtaatacgaacgaaaaaacaaaaacgaaaaaaaaccatacctccaactacaaaaattacacacaactaacataatcgcgatcacctacgcgacgccgatacccttacgctcgcgttacccgacccgcgaccgcgaactttacgacgaaaacgcgacgcgataaaacaccgacgcgaaaaacgcccgacgtaaacgacgacgaatataaaccgaaccgatatttataactccgtaacaacaacaacgacaacgacgccgccgacccgtctcgccgcgcttcccaacgaaaccgccgacgcgccgaaaactatactcgaccgcgaatcccgtatacaatcgccccgcgccccgcgcgacccttcgaataaatacgtaaaacccgaacgttaaacgaacctccccaaccgttcgatccaaccgcaacgaaaccctcccgaccctaccgcccgtatcccgactaccacctcgtcactacccgcgaatacgaaaacaaccgcgaaaccccgacccgacccccgaattctccgacgcctctactcctaccttcctaaaaataacaaccaaaaaaacaaaataaaatatcaa

SEQ ID NO: 36937 - DNA, 837 bp, Artificial Sequence
  chemically treated genomic DNA (Homo sapiens) CpG-island No: 36937
gggttcgaggcgtttgcgtaagcgcgtgtttcgttggttgaaagcggattcgggttggaggcggtgttacggtgtatgaatattgattacgcgtcgtagcgtttagggtttagcgtttagtttttagtgttcgtttttttcggtcgttcgacgttttttgttcgcgtttgggttcgcgatggggaagaagtttcgggcggtattcggtcgtaggtttattttgtaatttttttcgtcgggttttcggggtagtacgtcgggtcgggattcggagtcggaattcgatattgagtcggatttaatcgcggcggtttttagttagttcgtttcgtcggcggcgacgattattattatcgcggtgattgtcgtcgcggtttcggacgattcgtttttagaaggtaagggtgcgcggggggatttgaattcgagtttagggtttgcggtttaggttttttacggcgtttggttagattcggcgagggaggcgggcgaggtcggttttcgaggtttgtttgttgcgggtttgtaggcggggcggttttgggtttcgggtcgtagaagggttaggtcgagttttgcgttttcggttcgggttaagttcgaggcgttatttgtggtgtagggtttgtttcgggaacgtttgaaatatgatcgaagttcgggtattttgagttttttaaacgtttcgggtcggttttgggtaacgtagagggtggatgtgaggatgagttttcgcgtgcgcggtttgtgattgtgggttaggtttttttatacgttatttgttttttttcggttttgtcgaaacggggatagagacgtttagaaaaagtttttaat

SEQ ID NO: 36938 - DNA, 837 bp, Artificial Sequence
  chemically treated genomic DNA (Homo sapiens) CpG-island No: 36938
attaaaaactttttctaaacgtctctatccccgtttcgacaaaaccgaaaaaaaacaaataacgtataaaaaaacctaacccacaatcacaaaccgcgcacgcgaaaactcatcctcacatccaccctctacgttacccaaaaccgacccgaaacgtttaaaaaactcaaaatacccgaacttcgatcatatttcaaacgttcccgaaacaaaccctacaccacaaataacgcctcgaacttaacccgaaccgaaaacgcaaaactcgacctaacccttctacgacccgaaacccaaaaccgccccgcctacaaacccgcaacaaacaaacctcgaaaaccgacctcgcccgcctccctcgccgaatctaaccaaacgccgtaaaaaacctaaaccgcaaaccctaaactcgaattcaaatccccccgcgcacccttaccttctaaaaacgaatcgtccgaaaccgcgacgacaatcaccgcgataataataatcgtcgccgccgacgaaacgaactaactaaaaaccgccgcgattaaatccgactcaatatcgaattccgactccgaatcccgacccgacgtactaccccgaaaacccgacgaaaaaaattacaaaataaacctacgaccgaataccgcccgaaacttcttccccatcgcgaacccaaacgcgaacaaaaaacgtcgaacgaccgaaaaaaacgaacactaaaaactaaacgctaaaccctaaacgctacgacgcgtaatcaatattcatacaccgtaacaccgcctccaacccgaatccgctttcaaccaacgaaacacgcgcttacgcaaacgcctcgaaccc

SEQ ID NO: 36939 - DNA, 837 bp, Artificial Sequence
  chemically treated genomic DNA (Homo sapiens) CpG-island No: 36939
attaagagttttttttaaacgtttttattttcgtttcgataaaatcgaaaggaggtagatgacgtgtggaaaggtttggtttatagttataggtcgcgtacgcggaaatttatttttatatttattttttgcgttatttaaaatcgattcggggcgtttgggagatttaggatgttcgaatttcggttatattttaaacgttttcggggtaagttttgtattatagatggcgtttcgggtttggttcgggtcgagggcgtagaattcggtttggtttttttgcggttcggagtttagggtcgtttcgtttgtaggttcgtagtaggtaggtttcggaagtcgatttcgttcgtttttttcgtcgggtttggttaggcgtcgtgaggagtttaggtcgtaagttttgagttcgagtttaggttttttcgcgtatttttgttttttgaaggcgagtcgttcgaggtcgcggcggtagttatcgcggtggtggtggtcgtcgtcgtcgacggggcgggttggttggggatcgtcgcggttgagttcggtttagtgtcgggtttcggtttcgggtttcggttcggcgtgttgtttcgaggattcggcggagagagttgtaggatgggtttacggtcgggtatcgttcgggattttttttttatcgcgagtttaagcgcgagtagagagcgtcgggcggtcgagaggggcgggtattggaggttgggcgttgggttttgggcgttgcgacgcgtaattaatatttatatatcgtgatatcgtttttagttcggattcgtttttaattagcggagtacgcgtttgcgtaagcgtttcggattt

SEQ ID NO: 36940 - DNA, 837 bp, Artificial Sequence
  chemically treated genomic DNA (Homo sapiens) CpG-island No: 36940
aaatccgaaacgcttacgcaaacgcgtactccgctaattaaaaacgaatccgaactaaaaacgatatcacgatatataaatattaattacgcgtcgcaacgcccaaaacccaacgcccaacctccaatacccgcccctctcgaccgcccgacgctctctactcgcgcttaaactcgcgataaaaaaaaaatcccgaacgatacccgaccgtaaacccatcctacaactctctccgccgaatcctcgaaacaacacgccgaaccgaaacccgaaaccgaaacccgacactaaaccgaactcaaccgcgacgatccccaaccaacccgccccgtcgacgacgacgaccaccaccaccgcgataactaccgccgcgacctcgaacgactcgccttcaaaaaacaaaaatacgcgaaaaaacctaaactcgaactcaaaacttacgacctaaactcctcacgacgcctaaccaaacccgacgaaaaaaacgaacgaaatcgacttccgaaacctacctactacgaacctacaaacgaaacgaccctaaactccgaaccgcaaaaaaaccaaaccgaattctacgccctcgacccgaaccaaacccgaaacgccatctataatacaaaacttaccccgaaaacgtttaaaatataaccgaaattcgaacatcctaaatctcccaaacgccccgaatcgattttaaataacgcaaaaaataaatataaaaataaatttccgcgtacgcgacctataactataaaccaaacctttccacacgtcatctacctcctttcgattttatcgaaacgaaaataaaaacgtttaaaaaaaactcttaat

SEQ ID NO: 36941 - DNA, 596 bp, Artificial Sequence
  chemically treated genomic DNA (Homo sapiens) CpG-island No: 36941
tcgacgtttaaatcgagaagagacgacggcgtatcgcggcgacgttaagatagattcgacgaagagaaggacggacgagcggacggtttattaaaggcgattatagatttatcgtagtattcgaacggtagattaagagtagcggaaacgagagcggagagttaaagggaggataagtattattacgacgagagaaaacgcgacgaagacgaacgaaagagttatcgagagtaaggagaggacgtagatcgaagagaggagtatattatagggagtatagtaagcgataagtacggagaattgtcgagaataggttaagtaaggaacggaagcgttatatagagaataaagaagaggaggcgagagaaagaggagaaacgtaggcgcgaaagagataaattagaagagtagagagacgacgatagaagcgtcgggagtaggaaaagatagaaacgttagagaaaaggggagttattatatagcgaggcgtaagaagttcgatagcgtacgagtagaggtatattataagagagtataagaaaacgatagaggaaggtagaggcggtagtcgtagtaagtacggagcgagtataata

SEQ ID NO: 36942 - DNA, 596 bp, Artificial Sequence
  chemically treated genomic DNA (Homo sapiens) CpG-island No: 36942
tattatactcgctccgtacttactacgactaccgcctctaccttcctctatcgttttcttatactctcttataatatacctctactcgtacgctatcgaacttcttacgcctcgctatataataactccccttttctctaacgtttctatcttttcctactcccgacgcttctatcgtcgtctctctactcttctaatttatctctttcgcgcctacgtttctcctctttctctcgcctcctcttctttattctctatataacgcttccgttccttacttaacctattctcgacaattctccgtacttatcgcttactatactccctataatatactcctctcttcgatctacgtcctctccttactctcgataactctttcgttcgtcttcgtcgcgttttctctcgtcgtaataatacttatcctccctttaactctccgctctcgtttccgctactcttaatctaccgttcgaatactacgataaatctataatcgcctttaataaaccgtccgctcgtccgtccttctcttcgtcgaatctatcttaacgtcgccgcgatacgccgtcgtctcttctcgatttaaacgtcga

SEQ ID NO: 36943 - DNA, 596 bp, Artificial Sequence
  chemically treated genomic DNA (Homo sapiens) CpG-island No: 36943
tgttatgttcgtttcgtgtttgttgcggttgtcgtttttgtttttttttgtcgtttttttgtgtttttttgtggtgtgtttttgttcgtgcgttgtcgggttttttgcgtttcgttgtgtggtagttttttttttttttgacgtttttgtttttttttgttttcggcgtttttgtcgtcgtttttttgtttttttgatttgtttttttcgcgtttgcgttttttttttttttttcgtttttttttttttgttttttgtgtggcgttttcgttttttgtttagtttgttttcggtagtttttcgtgtttgtcgtttgttgtgttttttgtggtgtgttttttttttcggtttgcgttttttttttgttttcggtggttttttcgttcgttttcgtcgcgttttttttcgtcgtggtagtgtttgttttttttttggtttttcgttttcgttttcgttgtttttggtttgtcgttcgagtgttgcggtaggtttgtggtcgtttttggtgagtcgttcgttcgttcgttttttttttcgtcgggtttgttttggcgtcgtcgcgatgcgtcgtcgttttttttcggtttgggcgtcgg

SEQ ID NO: 36944 - DNA, 596 bp, Artificial Sequence
  chemically treated genomic DNA (Homo sapiens) CpG-island No: 36944
ccgacgcccaaaccgaaaaaaaacgacgacgcatcgcgacgacgccaaaacaaacccgacgaaaaaaaaaacgaacgaacgaacgactcaccaaaaacgaccacaaacctaccgcaacactcgaacgacaaaccaaaaacaacgaaaacgaaaacgaaaaaccaaaaaaaaaacaaacactaccacgacgaaaaaaaacgcgacgaaaacgaacgaaaaaaccaccgaaaacaaaaaaaaaacgcaaaccgaaaaaaaaaacacaccacaaaaaacacaacaaacgacaaacacgaaaaactaccgaaaacaaactaaacaaaaaacgaaaacgccacacaaaaaacaaaaaaaaaaaaacgaaaaaaaaaaaaaaaacgcaaacgcgaaaaaaacaaatcaaaaaaacaaaaaaacgacgacaaaaacgccgaaaacaaaaaaaaacaaaaacgtcaaaaaaaaaaaaaactaccacacaacgaaacgcaaaaaacccgacaacgcacgaacaaaaacacaccacaaaaaaacacaaaaaaacgacaaaaaaaaacaaaaacgacaaccgcaacaaacacgaaacgaacataaca

SEQ ID NO: 36945 - DNA, 893 bp, Artificial Sequence
  chemically treated genomic DNA (Homo sapiens) CpG-island No: 36945
atagttttttgttttcgtacgttgggcgttagtttcggtcgtgttgttcggttgtttgagagcgcgttcggttatggagttttcgtataaagacgtcgagacggcggcggcggcggcggcggtgtcggcggcggattttcggggggcgttttcgtttagcggggtggtggtgtaggttcgcgagaagaagggttttttgcgcgtcgtttattttttatatgttttttttcgtggtcgttatttgttttttttttaatattttcgtgtcgggattgggtaagatacggttgtcgcgatttttgcgatttttatttcgtcgcgggagggcgtggggggagagaagggcgcggtcggagattttttggcggggtcgcgcgttttaagtgttgcgattacgcgttatcgttcgtttttggcgttttcgggtaggtggtagaagcgcgtggagtgtgtattttagaggggagaggttgcgttggggttttcgattcgtaggcggggttttaaagagtcggaaattttgcggttaatgttggagttcgtagcggcggtcggaatggttttgtcggtttcggagtaggtttttcgtttcggcgtttcgatttttgtttttttttttcgtcgtgtgtattcgttcgcgagtttattttttcgagaggaatggggtcgggttagaatgagttttagggtttcggcggcgaggattaaattttcgggcgtcgaagttagttgagtcggggaaagaggacgagtcgggttagatatatttgtagttttttttggttcgcggagtgcggatcgcgtggggacgagaattttagttagagtttttttcgttttatttaggggtatttgtattttcgttagtatttcgtagggcgttagggggatgg

SEQ ID NO: 36946 - DNA, 893 bp, Artificial Sequence
  chemically treated genomic DNA (Homo sapiens) CpG-island No: 36946
ccatccccctaacgccctacgaaatactaacgaaaatacaaatacccctaaataaaacgaaaaaaactctaactaaaattctcgtccccacgcgatccgcactccgcgaaccaaaaaaaactacaaatatatctaacccgactcgtcctctttccccgactcaactaacttcgacgcccgaaaatttaatcctcgccgccgaaaccctaaaactcattctaacccgaccccattcctctcgaaaaaataaactcgcgaacgaatacacacgacgaaaaaaaaaaacaaaaatcgaaacgccgaaacgaaaaacctactccgaaaccgacaaaaccattccgaccgccgctacgaactccaacattaaccgcaaaatttccgactctttaaaaccccgcctacgaatcgaaaaccccaacgcaacctctcccctctaaaatacacactccacgcgcttctaccacctacccgaaaacgccaaaaacgaacgataacgcgtaatcgcaacacttaaaacgcgcgaccccgccaaaaaatctccgaccgcgcccttctctccccccacgccctcccgcgacgaaataaaaatcgcaaaaatcgcgacaaccgtatcttacccaatcccgacacgaaaatattaaaaaaaaaacaaataacgaccacgaaaaaaaacatataaaaaataaacgacgcgcaaaaaacccttcttctcgcgaacctacaccaccaccccgctaaacgaaaacgccccccgaaaatccgccgccgacaccgccgccgccgccgccgccgtctcgacgtctttatacgaaaactccataaccgaacgcgctctcaaacaaccgaacaacacgaccgaaactaacgcccaacgtacgaaaacaaaaaactat

SEQ ID NO: 36947 - DNA, 893 bp, Artificial Sequence
  chemically treated genomic DNA (Homo sapiens) CpG-island No: 36947
ttatttttttggcgttttgcggggtgttggcggaagtgtaggtatttttgaatgaggcggaggagattttggttagagttttcgtttttacgcggttcgtatttcgcgaattaaagggggttgtaggtatatttagttcggttcgtttttttttttcggtttagttgatttcgacgttcgggagtttgattttcgtcgtcgaggttttagagtttattttgattcgattttatttttttcggggaagtgggttcgcggacggatgtatacgacggagagaaggagtagaaatcggggcgtcgggacgggagatttatttcgaagtcggtagagttatttcggtcgtcgttgcgggttttaatattggtcgtaaagttttcggttttttggggtttcgtttgcgggtcggagattttagcgtagttttttttttttggggtgtatattttacgcgtttttgttatttgttcggggacgttaggagcgggcggtggcgcgtggtcgtagtatttggagcgcgcggtttcgttaggaggttttcggtcgcgtttttttttttttttacgttttttcgcggcggggtgggggtcgtaagggtcgcggtagtcgtgttttatttagtttcggtacgaaagtgttgaggaagaggtagatgacggttacggggaagggtatgtaggggatgggcggcgcgtagggggttttttttttcgcggatttgtattattatttcgttggacgaggacgtttttcgggggttcgtcgtcggtatcgtcgtcgtcgtcgtcgtcgtttcggcgtttttgtgcgagggttttatggtcgggcgcgtttttaggtagtcgggtagtacggtcggagttggcgtttagcgtacgggagtaggagattgt

SEQ ID NO: 36948 - DNA, 893 bp, Artificial Sequence
  chemically treated genomic DNA (Homo sapiens) CpG-island No: 36948
acaatctcctactcccgtacgctaaacgccaactccgaccgtactacccgactacctaaaaacgcgcccgaccataaaaccctcgcacaaaaacgccgaaacgacgacgacgacgacgacgataccgacgacgaacccccgaaaaacgtcctcgtccaacgaaataataatacaaatccgcgaaaaaaaaaaccccctacgcgccgcccatcccctacatacccttccccgtaaccgtcatctacctcttcctcaacactttcgtaccgaaactaaataaaacacgactaccgcgacccttacgacccccaccccgccgcgaaaaaacgtaaaaaaaaaaaaaaacgcgaccgaaaacctcctaacgaaaccgcgcgctccaaatactacgaccacgcgccaccgcccgctcctaacgtccccgaacaaataacaaaaacgcgtaaaatatacaccccaaaaaaaaaaaactacgctaaaatctccgacccgcaaacgaaaccccaaaaaaccgaaaactttacgaccaatattaaaacccgcaacgacgaccgaaataactctaccgacttcgaaataaatctcccgtcccgacgccccgatttctactccttctctccgtcgtatacatccgtccgcgaacccacttccccgaaaaaaataaaatcgaatcaaaataaactctaaaacctcgacgacgaaaatcaaactcccgaacgtcgaaatcaactaaaccgaaaaaaaaaaacgaaccgaactaaatatacctacaaccccctttaattcgcgaaatacgaaccgcgtaaaaacgaaaactctaaccaaaatctcctccgcctcattcaaaaatacctacacttccgccaacaccccgcaaaacgccaaaaaaataa

SEQ ID NO: 36949 - DNA, 636 bp, Artificial Sequence
  chemically treated genomic DNA (Homo sapiens) CpG-island No: 36949
gattttgttcgggttttttttttcgcgcggggtttcggggacgcgggtgggggcggtcggggatattcgttacgcggggcggggacgtcgttgttagttttttttttttttcgtcgttgcgtttcgggcgttttcggtatttgggataggtatttcgggcgtggagaggggcgtttggatcggatttgttaagttgttttttcgttcgtgtttattttttttttttttggattttttttagattcgggtcgggttattttcgagatttttttttgttttcgattttattcgggagtttcgtcgttcggagttcgtttttcgtttcgtcgcgcgtagtttttagtattttttaattttttattttttttgggttttttttttaattttttcgtagtttttttttttttcgtgtttaatttcgttttttattttcggcgttcgttattcgcgtcgattttttttttagtttttatcgggttttttcggttcggatagttttttgttaacgtatttcgtatttttagcgttttttaatttttttttggttattttagttaagttgcggatgtcggaaagaaatttagttttttgtaatacgtttatcgttagagtggtgattttagttgcgttttgaat

SEQ ID NO: 36950 - DNA, 636 bp, Artificial Sequence
  chemically treated genomic DNA (Homo sapiens) CpG-island No: 36950
attcaaaacgcaactaaaatcaccactctaacgataaacgtattacaaaaaactaaatttctttccgacatccgcaacttaactaaaataaccaaaaaaaaattaaaaaacgctaaaaatacgaaatacgttaacaaaaaactatccgaaccgaaaaaacccgataaaaactaaaaaaaaaatcgacgcgaataacgaacgccgaaaataaaaaacgaaattaaacacgaaaaaaaaaaaaactacgaaaaaattaaaaaaaaaacccaaaaaaaataaaaaattaaaaaatactaaaaactacgcgcgacgaaacgaaaaacgaactccgaacgacgaaactcccgaataaaatcgaaaacaaaaaaaaatctcgaaaataacccgacccgaatctaaaaaaaatccaaaaaaaaaaaaaataaacacgaacgaaaaaacaacttaacaaatccgatccaaacgcccctctccacgcccgaaatacctatcccaaataccgaaaacgcccgaaacgcaacgacgaaaaaaaaaaaaaactaacaacgacgtccccgccccgcgtaacgaatatccccgaccgcccccacccgcgtccccgaaaccccgcgcgaaaaaaaaaacccgaacaaaatc

SEQ ID NO: 36951 - DNA, 636 bp, Artificial Sequence
  chemically treated genomic DNA (Homo sapiens) CpG-island No: 36951
gtttaagacgtagttaaagttattattttggcggtaagcgtgttatagagaattagattttttttcggtattcgtaatttggttggagtgattaaggaggagttgaagagcgttggagatgcgaggtgcgttggtagaaaattgttcgggtcgggaggattcggtggaaattaaaaggagggtcgacgcgggtggcgggcgtcgagagtaagaggcgaagttgggtacgggaaggaaaggagttgcgagaagattgagagggaagtttaggaggggtggggggttggggggtgttggagattgcgcgcggcggggcggggagcgaatttcgggcggcgaggttttcgggtggagtcgaggataagaaggggtttcgagggtaattcgattcgggtttagagagagtttaggagggaaaggaatgagtacgagcgagagagtagtttggtaagttcggtttaagcgtttttttttacgttcggggtatttattttaggtgtcgggaacgttcggggcgtagcgacgaggaagagagaaaattagtagcggcgttttcgtttcgcgtggcgggtgttttcggtcgtttttattcgcgttttcggggtttcgcgcggaggggaagattcgggtagggtt

SEQ ID NO: 36952 - DNA, 636 bp, Artificial Sequence
  chemically treated genomic DNA (Homo sapiens) CpG-island No: 36952
aaccctacccgaatcttcccctccgcgcgaaaccccgaaaacgcgaataaaaacgaccgaaaacacccgccacgcgaaacgaaaacgccgctactaattttctctcttcctcgtcgctacgccccgaacgttcccgacacctaaaataaataccccgaacgtaaaaaaaaacgcttaaaccgaacttaccaaactactctctcgctcgtactcattcctttccctcctaaactctctctaaacccgaatcgaattaccctcgaaaccccttcttatcctcgactccacccgaaaacctcgccgcccgaaattcgctccccgccccgccgcgcgcaatctccaacaccccccaaccccccacccctcctaaacttccctctcaatcttctcgcaactcctttccttcccgtacccaacttcgcctcttactctcgacgcccgccacccgcgtcgaccctccttttaatttccaccgaatcctcccgacccgaacaattttctaccaacgcacctcgcatctccaacgctcttcaactcctccttaatcactccaaccaaattacgaataccgaaaaaaaatctaattctctataacacgcttaccgccaaaataataactttaactacgtcttaaac

SEQ ID NO: 36953 - DNA, 631 bp, Artificial Sequence
  chemically treated genomic DNA (Homo sapiens) CpG-island No: 36953
gtttagtatcggtaaatagatttaatattatttttttttatttttagtttcgcggcgtagtagttgcgttttacgcgatacgttttagcggtaatcggaaagtgtgttattattacggattattcgatgatagggtattatgatagttagtttgttggcggtataggcgttggtaacggttcgtatcgttttcggtttgtcgatggcgttagttagttgttgataattgacggttttatcgtaaggtatcgtgcgtagtgtttgttagatttgttgttgaaaagtagtgtcgcgaatgtttagcggtaacgttagcggcgtatcgcgttgattgaggttggcgattattttacgtatatgttgttgaaatattagatcggtaggcgcgttgtcggtagcgggaaatatttgttgtaattcgttgattagtgtcgcgttattatcgtttagtaatatcgcgtaaatttttcgttcgttttttgttattaggtaacgatttagtttataattagttagcgcgtaacgtatcgttagattttacgtatcgtgacgtaattgtttagtcgttatgtttagcgtttcgttagtttttcgatagtaattgttgttgtcggggaatttggcgttaata

SEQ ID NO: 36954 - DNA, 631 bp, Artificial Sequence
  chemically treated genomic DNA (Homo sapiens) CpG-island No: 36954
tattaacgccaaattccccgacaacaacaattactatcgaaaaactaacgaaacgctaaacataacgactaaacaattacgtcacgatacgtaaaatctaacgatacgttacgcgctaactaattataaactaaatcgttacctaataacaaaaaacgaacgaaaaatttacgcgatattactaaacgataataacgcgacactaatcaacgaattacaacaaatatttcccgctaccgacaacgcgcctaccgatctaatatttcaacaacatatacgtaaaataatcgccaacctcaatcaacgcgatacgccgctaacgttaccgctaaacattcgcgacactacttttcaacaacaaatctaacaaacactacgcacgataccttacgataaaaccgtcaattatcaacaactaactaacgccatcgacaaaccgaaaacgatacgaaccgttaccaacgcctataccgccaacaaactaactatcataataccctatcatcgaataatccgtaataataacacactttccgattaccgctaaaacgtatcgcgtaaaacgcaactactacgccgcgaaactaaaaataaaaaaaaataatattaaatctatttaccgatactaaac

SEQ ID NO: 36955 - DNA, 631 bp, Artificial Sequence
  chemically treated genomic DNA (Homo sapiens) CpG-island No: 36955
tgttaacgttagatttttcgatagtagtagttattatcggaaagttgacgaaacgttgggtatgacggttaaataattgcgttacggtgcgtaaaatttggcggtgcgttacgcgttggttgattgtgagttgggtcgttgtttggtggtagaaagcgagcgggggatttgcgcgatattgttgggcgatgatgacgcgatattaattagcgagttgtagtagatgtttttcgttgtcgataacgcgtttgtcgatttgatgttttagtaatatgtgcgtgaagtgatcgttagttttaattaacgcgatacgtcgttgacgttatcgttggatattcgcggtattgttttttagtaataagtttggtaggtattgcgtacgatattttgcggtgaaatcgttagttattagtaattggttaacgttatcggtaaatcgaaagcggtacgggtcgttgttagcgtttgtgtcgttaataagttggttattataatattttgttatcgggtggttcgtggtgatggtatatttttcggttatcgttggggcgtgtcgcgtaaagcgtaattgttgcgtcgcgaagttgaaaatgaggagaggtaatgttggatttgtttgtcgatgttgaat

SEQ ID NO: 36956 - DNA, 631 bp, Artificial Sequence
  chemically treated genomic DNA (Homo sapiens) CpG-island No: 36956
attcaacatcgacaaacaaatccaacattacctctcctcattttcaacttcgcgacgcaacaattacgctttacgcgacacgccccaacgataaccgaaaaatataccatcaccacgaaccacccgataacaaaatattataataaccaacttattaacgacacaaacgctaacaacgacccgtaccgctttcgatttaccgataacgttaaccaattactaataactaacgatttcaccgcaaaatatcgtacgcaatacctaccaaacttattactaaaaaacaataccgcgaatatccaacgataacgtcaacgacgtatcgcgttaattaaaactaacgatcacttcacgcacatattactaaaacatcaaatcgacaaacgcgttatcgacaacgaaaaacatctactacaactcgctaattaatatcgcgtcatcatcgcccaacaatatcgcgcaaatcccccgctcgctttctaccaccaaacaacgacccaactcacaatcaaccaacgcgtaacgcaccgccaaattttacgcaccgtaacgcaattatttaaccgtcatacccaacgtttcgtcaactttccgataataactactactatcgaaaaatctaacgttaaca

SEQ ID NO: 36957 - DNA, 557 bp, Artificial Sequence
  chemically treated genomic DNA (Homo sapiens) CpG-island No: 36957
tcgttgtttattcgtcggtgatatttttgattttgtcgtgttgtattatttttagcgtttgcgttagcgtttgtttttcgtttttaattaacgcgtttgattggtttcgcggtattagcgagtcgttagtttgataatcgcgatcggtaaatattttttcgcgcgttgttagattatattgtttgtttgtacgaattagttcgtttttcgttagttcgacgagaattaatgttggatcgtaagcgtatatcgttttggcgatggcgtttgttagttgtgtttttttcgtcgtttggttgtataatatgtcgtgcggtttgatatgacgtattacgtcgttttgcgtacgggtaatcgttgttagcgcgttaatttgatatagcgtttgggcgtaaacggtttttggcggtagttgtatggcgttgcgattaaaattttttttgtcgggaaaattcgggtgagcgttaatcgcgatattattttttattgttttacgtacgtaagtttgtatgatttgcgtatcgtttgtatgaaatttataggtaatattggtagag

SEQ ID NO: 36958 - DNA, 557 bp, Artificial Sequence
  chemically treated genomic DNA (Homo sapiens) CpG-island No: 36958
ctctaccaatattacctataaatttcatacaaacgatacgcaaatcatacaaacttacgtacgtaaaacaataaaaaataatatcgcgattaacgctcacccgaattttcccgacaaaaaaaattttaatcgcaacgccatacaactaccgccaaaaaccgtttacgcccaaacgctatatcaaattaacgcgctaacaacgattacccgtacgcaaaacgacgtaatacgtcatatcaaaccgcacgacatattatacaaccaaacgacgaaaaaaacacaactaacaaacgccatcgccaaaacgatatacgcttacgatccaacattaattctcgtcgaactaacgaaaaacgaactaattcgtacaaacaaacaatataatctaacaacgcgcgaaaaaatatttaccgatcgcgattatcaaactaacgactcgctaataccgcgaaaccaatcaaacgcgttaattaaaaacgaaaaacaaacgctaacgcaaacgctaaaaataatacaacacgacaaaatcaaaaatatcaccgacgaataaacaacga

SEQ ID NO: 36959 - DNA, 557 bp, Artificial Sequence
  chemically treated genomic DNA (Homo sapiens) CpG-island No: 36959
ttttgttaatattgtttgtggattttatgtaggcgatgcgtaaattatgtaggtttgcgtgcgtgaagtaataaaaaatggtgtcgcgattggcgtttattcgagttttttcgatagggaaaattttggtcgtagcgttatgtagttgtcgttagaaatcgtttacgtttagacgttgtattaaattggcgcgttggtaacgattgttcgtgcgtaaggcggcgtaatgcgttatgttaaatcgtacggtatgttgtataattaggcggcgaaagaagtataattggtagacgttatcgttagagcggtatacgtttgcgatttagtattgattttcgtcgggttggcgggaagcgagttgattcgtgtaggtaagtaatatggtttgataacgcgcgaggaagtgtttgtcgatcgcggttattaggttgacggttcgttggtgtcgcgaagttagttaggcgcgttgattgaaaacgaagaataggcgttggcgtaaacgttggagatggtgtaatacggtagagttaaaagtattatcggcgaatgggtaacgg

SEQ ID NO: 36960 - DNA, 557 bp, Artificial Sequence
  chemically treated genomic DNA (Homo sapiens) CpG-island No: 36960
ccgttacccattcgccgataatacttttaactctaccgtattacaccatctccaacgtttacgccaacgcctattcttcgttttcaatcaacgcgcctaactaacttcgcgacaccaacgaaccgtcaacctaataaccgcgatcgacaaacacttcctcgcgcgttatcaaaccatattacttacctacacgaatcaactcgcttcccgccaacccgacgaaaatcaatactaaatcgcaaacgtataccgctctaacgataacgtctaccaattatacttctttcgccgcctaattatacaacataccgtacgatttaacataacgcattacgccgccttacgcacgaacaatcgttaccaacgcgccaatttaatacaacgtctaaacgtaaacgatttctaacgacaactacataacgctacgaccaaaattttccctatcgaaaaaactcgaataaacgccaatcgcgacaccattttttattacttcacgcacgcaaacctacataatttacgcatcgcctacataaaatccacaaacaatattaacaaaa

SEQ ID NO: 36961 - DNA, 586 bp, Artificial Sequence
  chemically treated genomic DNA (Homo sapiens) CpG-island No: 36961
tatattcgcggatataagtatacgcgcgttggtaaagcgttcgcgtcgttagtcgtatcgagcgttcgtttttttgttcggatcgggggcgtttcgcgcgcgtggttaatttgtagcggaataggcgcgaggcgttcgcgacggcgacggcggtattacggaatagtcggcggtcgttaggacgtagatttttttcggagtgggtttaagggtgtcgggacgcgcggtacggagcgggaaggaagtgcgagtttatttagtttagtcgtttatcgagagtatacgttttcgcgtcgtagtagagagacgcgaatcggcggggcggggtcgcgcgtattttcgggattggagcggagtcgagtcgattttcgggggcgggtcgcgcgcgttttcgggattggggcggggtcgcgcgcgtttacgggattgggcggggtcgtaagtattttttggatgggcggagtcgagcggattttcgggattcggcggagtcgtaggaggaggcgggtggtttttgttaaagaagttagtttttttgaaaaaaagaaacgtgcggggaaacgtattcgatagtaaagaatttatt

SEQ ID NO: 36962 - DNA, 586 bp, Artificial Sequence
  chemically treated genomic DNA (Homo sapiens) CpG-island No: 36962
aataaattctttactatcgaatacgtttccccgcacgtttctttttttcaaaaaaactaacttctttaacaaaaaccacccgcctcctcctacgactccgccgaatcccgaaaatccgctcgactccgcccatccaaaaaatacttacgaccccgcccaatcccgtaaacgcgcgcgaccccgccccaatcccgaaaacgcgcgcgacccgcccccgaaaatcgactcgactccgctccaatcccgaaaatacgcgcgaccccgccccgccgattcgcgtctctctactacgacgcgaaaacgtatactctcgataaacgactaaactaaataaactcgcacttccttcccgctccgtaccgcgcgtcccgacacccttaaacccactccgaaaaaaatctacgtcctaacgaccgccgactattccgtaataccgccgtcgccgtcgcgaacgcctcgcgcctattccgctacaaattaaccacgcgcgcgaaacgcccccgatccgaacaaaaaaacgaacgctcgatacgactaacgacgcgaacgctttaccaacgcgcgtatacttatatccgcgaatata

SEQ ID NO: 36963 - DNA, 586 bp, Artificial Sequence
  chemically treated genomic DNA (Homo sapiens) CpG-island No: 36963
ggtaagttttttgttgtcggatacgttttttcgtacgttttttttttttaagaaaattggtttttttagtaggaattattcgtttttttttgcggtttcgtcggatttcggaaattcgttcggtttcgtttatttaggaaatgtttgcggtttcgtttaatttcgtaagcgcgcgcggtttcgttttaatttcggaagcgcgcgcggttcgttttcgaaagtcggttcggtttcgttttaatttcggaagtgcgcgcggtttcgtttcgtcggttcgcgtttttttgttgcggcgcggggacgtgtgttttcggtaggcggttgggttgggtgggttcgtatttttttttcgtttcgtgtcgcgcgtttcggtatttttaggtttatttcgggaggggtttgcgttttggcggtcgtcggttgtttcgtgatgtcgtcgtcgtcgtcgcgggcgtttcgcgtttgtttcgttgtaggttggttacgcgcgcggagcgttttcgattcggataaagaaacgagcgttcggtgcgattagcggcgcgggcgttttgttagcgcgcgtgtgtttgtgttcgcgagtgtg

SEQ ID NO: 36964 - DNA, 586 bp, Artificial Sequence
  chemically treated genomic DNA (Homo sapiens) CpG-island No: 36964
cacactcgcgaacacaaacacacgcgcgctaacaaaacgcccgcgccgctaatcgcaccgaacgctcgtttctttatccgaatcgaaaacgctccgcgcgcgtaaccaacctacaacgaaacaaacgcgaaacgcccgcgacgacgacgacgacatcacgaaacaaccgacgaccgccaaaacgcaaacccctcccgaaataaacctaaaaataccgaaacgcgcgacacgaaacgaaaaaaaaatacgaacccacccaacccaaccgcctaccgaaaacacacgtccccgcgccgcaacaaaaaaacgcgaaccgacgaaacgaaaccgcgcgcacttccgaaattaaaacgaaaccgaaccgactttcgaaaacgaaccgcgcgcgcttccgaaattaaaacgaaaccgcgcgcgcttacgaaattaaacgaaaccgcaaacatttcctaaataaacgaaaccgaacgaatttccgaaatccgacgaaaccgcaaaaaaaaacgaataattcctactaaaaaaaccaattttcttaaaaaaaaaaaacgtacgaaaaaacgtatccgacaacaaaaaacttacc

SEQ ID NO: 36965 - DNA, 682 bp, Artificial Sequence
  chemically treated genomic DNA (Homo sapiens) CpG-island No: 36965
agataatcgcggaaggcgtcggttagtagtcgttattcgttttcgtttttgtatcggttgttcggtgatttttagaggggtaggttcgaaaacgtttaaaattttttcgaaacgtttttgattattttcgttacgatcgttgtttattcggattgtggtgcgcggtagagaggttcggttttcgtgcgttttcggtttcgttagatagggaaagatggataagtttagggagaatcgcgaagatcgaattcgttttgtagaggtagaaatttcgcgtcggtcgtttttacgtcgagcgtgtttagggtgtcgaggtcgggggcgttttgaagagttttgaagcgagcgagacgcgggttcggatcgttaatttcggtcgtttagagttttataggataagtatcgtacggttttttcggttcgcgggtttattttgcgcgtgtagtgtttatattttatttggagcgcggcgggcgggaggtcgggcgttttagttttagggaagtatcgggagattggatatttatttgtatcgtcgcggttttttgttgtttttcgcgcggtagttttacgtttttagattcgcgttcggttaatgagagtatcgggagagataagtcgtatttttgggttaatagattttttatttttgacgtttttttaggttaatgatagtgtcggg

SEQ ID NO: 36966 - DNA, 682 bp, Artificial Sequence
  chemically treated genomic DNA (Homo sapiens) CpG-island No: 36966
cccgacactatcattaacctaaaaaaacgtcaaaaataaaaaatctattaacccaaaaatacgacttatctctcccgatactctcattaaccgaacgcgaatctaaaaacgtaaaactaccgcgcgaaaaacaacaaaaaaccgcgacgatacaaataaatatccaatctcccgatacttccctaaaactaaaacgcccgacctcccgcccgccgcgctccaaataaaatataaacactacacgcgcaaaataaacccgcgaaccgaaaaaaccgtacgatacttatcctataaaactctaaacgaccgaaattaacgatccgaacccgcgtctcgctcgcttcaaaactcttcaaaacgcccccgacctcgacaccctaaacacgctcgacgtaaaaacgaccgacgcgaaatttctacctctacaaaacgaattcgatcttcgcgattctccctaaacttatccatctttccctatctaacgaaaccgaaaacgcacgaaaaccgaacctctctaccgcgcaccacaatccgaataaacaacgatcgtaacgaaaataatcaaaaacgtttcgaaaaaattttaaacgttttcgaacctacccctctaaaaatcaccgaacaaccgatacaaaaacgaaaacgaataacgactactaaccgacgccttccgcgattatct

SEQ ID NO: 36967 - DNA, 682 bp, Artificial Sequence
  chemically treated genomic DNA (Homo sapiens) CpG-island No: 36967
ttcgatattgttattggtttaggaaagcgttaagggtggggaatttattggtttaggggtgcggtttgtttttttcggtgtttttattggtcgagcgcgggtttaggggcgtgaggttgtcgcgcggaggataataaagggtcgcggcggtgtaagtaggtgtttagtttttcggtgtttttttgaggttgaggcgttcggtttttcgttcgtcgcgttttagatgaagtgtgagtattgtacgcgtaaggtgagttcgcgggtcggggaggtcgtgcgatgtttgttttgtggggttttgggcggtcgaggttggcggttcgggttcgcgtttcgttcgttttagggttttttaaggcgttttcggtttcggtattttgggtacgttcggcgtggaggcggtcggcgcggggtttttgtttttgtagggcgggttcggttttcgcggttttttttgaatttgtttatttttttttatttggcgaagtcggaaacgtacggagatcgagtttttttgtcgcgtattatagttcgagtaaatagcggtcgtggcgggaatgattagaagcgtttcgagagggttttaggcgttttcgaatttgtttttttgagggttatcgagtagtcggtgtaggggcggaagcgggtgacggttgttgatcggcgtttttcgcggttgttt

SEQ ID NO: 36968 - DNA, 682 bp, Artificial Sequence
  chemically treated genomic DNA (Homo sapiens) CpG-island No: 36968
aaacaaccgcgaaaaacgccgatcaacaaccgtcacccgcttccgcccctacaccgactactcgataaccctcaaaaaaacaaattcgaaaacgcctaaaaccctctcgaaacgcttctaatcattcccgccacgaccgctatttactcgaactataatacgcgacaaaaaaactcgatctccgtacgtttccgacttcgccaaataaaaaaaaataaacaaattcaaaaaaaaccgcgaaaaccgaacccgccctacaaaaacaaaaaccccgcgccgaccgcctccacgccgaacgtacccaaaataccgaaaccgaaaacgccttaaaaaaccctaaaacgaacgaaacgcgaacccgaaccgccaacctcgaccgcccaaaaccccacaaaacaaacatcgcacgacctccccgacccgcgaactcaccttacgcgtacaatactcacacttcatctaaaacgcgacgaacgaaaaaccgaacgcctcaacctcaaaaaaacaccgaaaaactaaacacctacttacaccgccgcgaccctttattatcctccgcgcgacaacctcacgcccctaaacccgcgctcgaccaataaaaacaccgaaaaaaacaaaccgcacccctaaaccaataaattccccacccttaacgctttcctaaaccaataacaatatcgaa

SEQ ID NO: 36969 - DNA, 746 bp, Artificial Sequence
  chemically treated genomic DNA (Homo sapiens) CpG-island No: 36969
  misc_feature (328)..(328): n is either a, c, g or t
  misc_feature (330)..(330): n is either a, c, g or t
  misc_feature (701)..(702): n is either a, c, g or t
ttattcgggatgttcgagcgttagtcgcggtagcgttagcgcgcgcgtcggaagcgtttgttcgtgtagattttcggcgcggaacgtcgattacgaagttgcggtatcgagcgtcgtttttaggtttttatttcgttttttttcgggttttgcggacggagttggcgtttttgaaggcgaggcgagggttcgttttttgatcgtttttgttttttcgcgggagcgtcggtcgttacgtgggaggttacgtgggtggtttgttaattgttcggagacgttttcgtcgtagtcggtttttacgggagtcgtagttcgagtatgttaaggnanggcgcgagtttggattttatagcgcggcgtggcgggaggtttttttttatttagatttcgtcggttttttttttttttatttagatttcgtcggttttttttttatttatttagatttcgtcggttttttattttttatttagatatcgtcgttttttttcggcgttcgggataggttcgggacgttggggtcgcgttcgagtacgtgagggttgagtagttcgcgtttttttttaggaaatttagtgagacgttgggtattcgaatgtggtcgtcggggaacggggtttatatttttcgcgttcggagaattttttagtttcgtttgaaacgaacgcggtgttttaaagtgcgggttgtaggttttgttnnttgacgcggcgatgattgaaggtgttgtttttaggagagaatag

SEQ ID NO: 36970 - DNA, 746 bp, Artificial Sequence
  chemically treated genomic DNA (Homo sapiens) CpG-island No: 36970
  misc_feature (45)..(46): n is either a, c, g or t
  misc_feature (417)..(417): n is either a, c, g or t
  misc_feature (419)..(419): n is either a, c, g or t
ctattctctcctaaaaacaacaccttcaatcatcgccgcgtcaannaacaaaacctacaacccgcactttaaaacaccgcgttcgtttcaaacgaaactaaaaaattctccgaacgcgaaaaatataaaccccgttccccgacgaccacattcgaatacccaacgtctcactaaatttcctaaaaaaaaacgcgaactactcaaccctcacgtactcgaacgcgaccccaacgtcccgaacctatcccgaacgccgaaaaaaaacgacgatatctaaataaaaaataaaaaaccgacgaaatctaaataaataaaaaaaaaaccgacgaaatctaaataaaaaaaaaaaaaaccgacgaaatctaaataaaaaaaaacctcccgccacgccgcgctataaaatccaaactcgcgccntnccttaacatactcgaactacgactcccgtaaaaaccgactacgacgaaaacgtctccgaacaattaacaaaccacccacgtaacctcccacgtaacgaccgacgctcccgcgaaaaaacaaaaacgatcaaaaaacgaaccctcgcctcgccttcaaaaacgccaactccgtccgcaaaacccgaaaaaaaacgaaataaaaacctaaaaacgacgctcgataccgcaacttcgtaatcgacgttccgcgccgaaaatctacacgaacaaacgcttccgacgcgcgcgctaacgctaccgcgactaacgctcgaacatcccgaataa

SEQ ID NO: 36971 - DNA, 746 bp, Artificial Sequence
  chemically treated genomic DNA (Homo sapiens) CpG-island No: 36971
  misc_feature (45)..(46): n is either a, c, g or t
  misc_feature (417)..(417): n is either a, c, g or t
  misc_feature (419)..(419): n is either a, c, g or t
ttatttttttttaaaagtagtatttttaattatcgtcgcgttaannggtagagtttgtagttcgtattttagggtatcgcgttcgttttaggcgggattggggagtttttcgagcgcggggggtgtgggtttcgtttttcggcgattatattcgaatatttagcgttttattgggttttttaaggagaggcgcgggttgtttagtttttacgtgttcggacgcggttttagcgtttcgagtttgtttcgagcgtcgagggagggcggcggtgtttgggtgaaaagtgggaggtcggcggggtttgggtgggtgggagggagatcggcggggtttgggtaggagggagggaggtcggcggggtttgggtgggagggagtttttcgttacgtcgcgttgtggagtttaaattcgcgttntnttttggtatgttcggattgcgattttcgtgagggtcggttgcggcgaaggcgttttcgagtagttgatagattatttacgtgattttttacgtgacggtcggcgttttcgcggaggagtaagaacggttaaggaacgggttttcgtttcgtttttagaggcgttagtttcgttcgtaaaattcggggggaagcgaggtggggatttggaggcggcgttcgatgtcgtagtttcgtagtcggcgtttcgcgtcggggatttgtacgagtaaacgttttcggcgcgcgcgttggcgttgtcgcgattgacgttcgggtatttcgggtag

SEQ ID NO: 36972 - DNA, 746 bp, Artificial Sequence
  chemically treated genomic DNA (Homo sapiens) CpG-island No: 36972
  misc_feature (328)..(328): n is either a, c, g or t
  misc_feature (330)..(330): n is either a, c, g or t
  misc_feature (701)..(702): n is either a, c, g or t
ctacccgaaatacccgaacgtcaatcgcgacaacgccaacgcgcgcgccgaaaacgtttactcgtacaaatccccgacgcgaaacgccgactacgaaactacgacatcgaacgccgcctccaaatccccacctcgcttccccccgaattttacgaacgaaactaacgcctctaaaaacgaaacgaaaacccgttccttaaccgttcttactcctccgcgaaaacgccgaccgtcacgtaaaaaatcacgtaaataatctatcaactactcgaaaacgccttcgccgcaaccgaccctcacgaaaatcgcaatccgaacataccaaaananaacgcgaatttaaactccacaacgcgacgtaacgaaaaactccctcccacccaaaccccgccgacctccctccctcctacccaaaccccgccgatctccctcccacccacccaaaccccgccgacctcccacttttcacccaaacaccgccgccctccctcgacgctcgaaacaaactcgaaacgctaaaaccgcgtccgaacacgtaaaaactaaacaacccgcgcctctccttaaaaaacccaataaaacgctaaatattcgaatataatcgccgaaaaacgaaacccacaccccccgcgctcgaaaaactccccaatcccgcctaaaacgaacgcgataccctaaaatacgaactacaaactctaccnnttaacgcgacgataattaaaaatactacttttaaaaaaaaataa

SEQ ID NO: 36973 - DNA, 747 bp, Artificial Sequence
  chemically treated genomic DNA (Homo sapiens) CpG-island No: 36973
gggcgcggaacggggtggggagtttgcgggcgagttcggaggatattggcgtatttttttcgtcggtttacggtcgtattcgttatattcgaaggcgtcgcgatttttcggagatttcgaagcgtgcgtttttattcgggttttgcgggcgttggcggaaagaggcgaggcggtgtttcgggggcggggtttttttcggttggcggtttcgggtttcgggagttttttaagaggttaggtgaggcgtttcgtgatgttcgcgttcggtcgttttggttgtaacgtgtttttggggcggaggagcggtagtggagttcgttgcgcgttgttgggggttatttgttttttcgtttgtgtttttttttttagtgtcgcgttcgagtatcgacgggtcgttttaagtttcgatatgtcgtataattacgtggtaacggtttagaagtttatcgtcgtgaacggttgcgtgatcggtgaggttgtcggggtcggagatttcggcgagtgagggagttggggggagtcgcggtttagggaggttcgtcgtttcgggggcggtcgggtaggagtgggttcggcgaatggaaggcgttggcggatcgaggaattttttttagtatcgcgatttcgaaagagtcgtttttgtacgcgtttttgggggttggaagtcgttttcgaggggtttttttttcgttttggggaggttattcggtttcgagaatagggcgggttttagtgagatagaggagt

SEQ ID NO: 36974 - DNA, 747 bp, Artificial Sequence
  chemically treated genomic DNA (Homo sapiens) CpG-island No: 36974
actcctctatctcactaaaacccgccctattctcgaaaccgaataacctccccaaaacgaaaaaaaaacccctcgaaaacgacttccaacccccaaaaacgcgtacaaaaacgactctttcgaaatcgcgatactaaaaaaaattcctcgatccgccaacgccttccattcgccgaacccactcctacccgaccgcccccgaaacgacgaacctccctaaaccgcgactccccccaactccctcactcgccgaaatctccgaccccgacaacctcaccgatcacgcaaccgttcacgacgataaacttctaaaccgttaccacgtaattatacgacatatcgaaacttaaaacgacccgtcgatactcgaacgcgacactaaaaaaaaaaacacaaacgaaaaaacaaataacccccaacaacgcgcaacgaactccactaccgctcctccgccccaaaaacacgttacaaccaaaacgaccgaacgcgaacatcacgaaacgcctcacctaacctcttaaaaaactcccgaaacccgaaaccgccaaccgaaaaaaaccccgcccccgaaacaccgcctcgcctctttccgccaacgcccgcaaaacccgaataaaaacgcacgcttcgaaatctccgaaaaatcgcgacgccttcgaatataacgaatacgaccgtaaaccgacgaaaaaaatacgccaatatcctccgaactcgcccgcaaactccccaccccgttccgcgccc

SEQ ID NO: 36975 - DNA, 747 bp, Artificial Sequence
  chemically treated genomic DNA (Homo sapiens) CpG-island No: 36975
atttttttgttttattggggttcgttttgttttcgaggtcgaatgatttttttaggacgaaagggggatttttcgagagcggtttttaatttttaaaagcgcgtatagggacgattttttcgaggtcgcggtgttgggggaggtttttcgattcgttagcgttttttattcgtcgggtttatttttgttcggtcgttttcggggcggcgggtttttttaggtcgcggttttttttaatttttttattcgtcggggttttcggtttcggtagttttatcggttacgtagtcgtttacggcggtgggtttttgggtcgttattacgtagttgtacgatatgtcgaggtttggagcggttcgtcggtattcgagcgcgatattagaaagagggatataagcgaaaagataggtggtttttaatagcgcgtagcgaattttattgtcgttttttcgttttagagatacgttgtagttagagcggtcgggcgcgggtattacgggacgttttatttggttttttggaggattttcgaagttcgaggtcgttaatcgaaggaggtttcgttttcggagtatcgtttcgttttttttcgttagcgttcgtaggattcggatgagagcgtacgtttcggggttttcgggaagtcgcggcgttttcggatgtggcggatgcggtcgtgagtcggcgggggaggtgcgttagtgtttttcgagttcgttcgtagattttttatttcgtttcgcgttt

SEQ ID NO: 36976 - DNA, 747 bp, Artificial Sequence
  chemically treated genomic DNA (Homo sapiens) CpG-island No: 36976
aaacgcgaaacgaaataaaaaatctacgaacgaactcgaaaaacactaacgcacctcccccgccgactcacgaccgcatccgccacatccgaaaacgccgcgacttcccgaaaaccccgaaacgtacgctctcatccgaatcctacgaacgctaacgaaaaaaaacgaaacgatactccgaaaacgaaacctccttcgattaacgacctcgaacttcgaaaatcctccaaaaaaccaaataaaacgtcccgtaatacccgcgcccgaccgctctaactacaacgtatctctaaaacgaaaaaacgacaataaaattcgctacgcgctattaaaaaccacctatcttttcgcttatatccctctttctaatatcgcgctcgaataccgacgaaccgctccaaacctcgacatatcgtacaactacgtaataacgacccaaaaacccaccgccgtaaacgactacgtaaccgataaaactaccgaaaccgaaaaccccgacgaataaaaaaattaaaaaaaaccgcgacctaaaaaaacccgccgccccgaaaacgaccgaacaaaaataaacccgacgaataaaaaacgctaacgaatcgaaaaacctcccccaacaccgcgacctcgaaaaaatcgtccctatacgcgcttttaaaaattaaaaaccgctctcgaaaaatccccctttcgtcctaaaaaaatcattcgacctcgaaaacaaaacgaaccccaataaaacaaaaaaat

SEQ ID NO: 36977 - DNA, 769 bp, Artificial Sequence
  chemically treated genomic DNA (Homo sapiens) CpG-island No: 36977
agggagacggaggtggagagttttagaaaattgttttgtacggcgggttaggttttcgcggggtttcgtaagattttcgcgtcgtttttcgcgttacggtaggcgttgttttagttcggtttttttagtcgcgttcggttttcgcgattcgtacggttcggatacgttcgtttttaggaaacgtcggacgtttgtgggggtaattacggatcgtaggatagagattcgcgggcggcgggttttttcggtggcgtcgtatttagagtagcgttcgcgtttttaggcggtgatgtcgtcgcggtcgaggattttttgtgttagtttcggtcgcgtagttcggggagggtgagagacggcgacgcgggtcggtaagcgggggcggggcggaggtaggacggggcggggttgaaggcggggttgaaggcggggttttagggaaggcgagagatagcgacgttggttggcgggcgtggggcgggacggagataggatagggcggggttagaggcggggtttcggggaggacgggaggagtcgtgagtaggtcggcggcgggcggggcggggtcgaaagtaggtgaggcggggttaagcgtttcgggtttttaagcggaggaagttttaggcgtttgtgttttgggtttgtagcggtggtcgcgcgttttcggaggagtcgagttggaggaggggatagtttgggagtgcgagagtttaaagacgttgttaggttggcgttaaaattttttggttatgggaagacgataattata

SEQ ID NO: 36978 - DNA, 769 bp, Artificial Sequence
  chemically treated genomic DNA (Homo sapiens) CpG-island No: 36978
tataattatcgtcttcccataaccaaaaaattttaacgccaacctaacaacgtctttaaactctcgcactcccaaactatcccctcctccaactcgactcctccgaaaacgcgcgaccaccgctacaaacccaaaacacaaacgcctaaaacttcctccgcttaaaaacccgaaacgcttaaccccgcctcacctactttcgaccccgccccgcccgccgccgacctactcacgactcctcccgtcctccccgaaaccccgcctctaaccccgccctatcctatctccgtcccgccccacgcccgccaaccaacgtcgctatctctcgccttccctaaaaccccgccttcaaccccgccttcaaccccgccccgtcctacctccgccccgcccccgcttaccgacccgcgtcgccgtctctcaccctccccgaactacgcgaccgaaactaacacaaaaaatcctcgaccgcgacgacatcaccgcctaaaaacgcgaacgctactctaaatacgacgccaccgaaaaaacccgccgcccgcgaatctctatcctacgatccgtaattacccccacaaacgtccgacgtttcctaaaaacgaacgtatccgaaccgtacgaatcgcgaaaaccgaacgcgactaaaaaaaccgaactaaaacaacgcctaccgtaacgcgaaaaacgacgcgaaaatcttacgaaaccccgcgaaaacctaacccgccgtacaaaacaattttctaaaactctccacctccgtctccct

SEQ ID NO: 36979 - DNA, 769 bp, Artificial Sequence
  chemically treated genomic DNA (Homo sapiens) CpG-island No: 36979
tatagttgtcgtttttttataattaaaaggttttaacgttagtttggtagcgtttttagattttcgtatttttaaattgtttttttttttagttcgattttttcgggagcgcgcggttatcgttgtaagtttagaatataaacgtttagagtttttttcgtttagaaattcggggcgtttggtttcgttttatttgttttcggtttcgtttcgttcgtcgtcggtttgtttacggtttttttcgtttttttcgaagtttcgtttttgatttcgttttgttttgttttcgtttcgttttacgttcgttagttagcgtcgttgtttttcgttttttttgaggtttcgtttttagtttcgtttttaatttcgtttcgttttgttttcgtttcgttttcgtttgtcggttcgcgtcgtcgttttttatttttttcgggttgcgcggtcggagttggtatagaggattttcggtcgcggcgatattatcgtttggggacgcgggcgttgttttggatacggcgttatcgagagaattcgtcgttcgcgggtttttgttttgcggttcgtggttgtttttataagcgttcggcgttttttgagggcgggcgtgttcgggtcgtgcgggtcgcggggatcgagcgcggttgaggagatcgagttggggtagcgtttgtcgtagcgcgggagacgacgcgggggttttgcggagtttcgcgggagtttggttcgtcgtgtagagtagttttttggaattttttattttcgttttttt

SEQ ID NO: 36980 - DNA, 769 bp, Artificial Sequence
  chemically treated genomic DNA (Homo sapiens) CpG-island No: 36980
aaaaaaacgaaaataaaaaattccaaaaaactactctacacgacgaaccaaactcccgcgaaactccgcaaaacccccgcgtcgtctcccgcgctacgacaaacgctaccccaactcgatctcctcaaccgcgctcgatccccgcgacccgcacgacccgaacacgcccgccctcaaaaaacgccgaacgcttataaaaacaaccacgaaccgcaaaacaaaaacccgcgaacgacgaattctctcgataacgccgtatccaaaacaacgcccgcgtccccaaacgataatatcgccgcgaccgaaaatcctctataccaactccgaccgcgcaacccgaaaaaaataaaaaacgacgacgcgaaccgacaaacgaaaacgaaacgaaaacaaaacgaaacgaaattaaaaacgaaactaaaaacgaaacctcaaaaaaaacgaaaaacaacgacgctaactaacgaacgtaaaacgaaacgaaaacaaaacaaaacgaaatcaaaaacgaaacttcgaaaaaaacgaaaaaaaccgtaaacaaaccgacgacgaacgaaacgaaaccgaaaacaaataaaacgaaaccaaacgccccgaatttctaaacgaaaaaaactctaaacgtttatattctaaacttacaacgataaccgcgcgctcccgaaaaaatcgaactaaaaaaaaaaacaatttaaaaatacgaaaatctaaaaacgctaccaaactaacgttaaaaccttttaattataaaaaaacgacaactata

SEQ ID NO: 36981 - DNA, 994 bp, Artificial Sequence
  chemically treated genomic DNA (Homo sapiens) CpG-island No: 36981
tgtcgtcggtttttatttaggtcgaggtggttcggttttatgtatcgcgacgtaacgcggggaggtagataaggtatagggcggcgtttataatttatgttaattcgttttatgtgttcgtcgaggcggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcggtcgacgtttttttttatgcgatttttgtattaggaagtagtttagtagtaggttgaggtcgttgagtatcgtcgtcgtaaggaatggtgtatgtaaggagatggcgtttaatagtttttcggttacggggtttgttattatatttacgtcgaaataagcgtttatgagttcgaagtggcgagttcgattttttttatcggtgatgtcggcgatataggcgttagtaatcgtatttgtggcgtcggtgatgtcggttacgatgcgttcggcgtagaggattttattgattgtttttagttagtttcgttagaggagaattagtgaataattttgtttttattgttttatggagtggag

SEQ ID NO: 36982 - DNA, 994 bp, Artificial Sequence
  chemically treated genomic DNA (Homo sapiens) CpG-island No: 36982
ctccactccataaaacaataaaaacaaaattattcactaattctcctctaacgaaactaactaaaaacaatcaataaaatcctctacgccgaacgcatcgtaaccgacatcaccgacgccacaaatacgattactaacgcctatatcgccgacatcaccgataaaaaaaatcgaactcgccacttcgaactcataaacgcttatttcgacgtaaatataataacaaaccccgtaaccgaaaaactattaaacgccatctccttacatacaccattccttacgacgacgatactcaacgacctcaacctactactaaactacttcctaatacaaaaatcgcataaaaaaaaacgtcgaccgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgcctcgacgaacacataaaacgaattaacataaattataaacgccgccctataccttatctacctccccgcgttacgtcgcgatacataaaaccgaaccacctcgacctaaataaaaaccgacgaca

SEQ ID NO: 36983 - DNA, 994 bp, Artificial Sequence
  chemically treated genomic DNA (Homo sapiens) CpG-island No: 36983
ttttattttatgagatagtagagataggattatttattaatttttttttggcggagttggttgaggataattagtaagattttttacgtcggacgtatcgtggtcggtattatcggcgttataggtgcggttgttggcgtttatatcgtcgatattatcgatggggaagatcgggttcgttatttcgggtttatgagcgtttgtttcggcgtgggtatggtggtaggtttcgtggtcgggggattgttgggcgttatttttttgtatgtattattttttgcggcggcggtgtttaacggttttaatttattattgggttgttttttaatgtaggagtcgtataagggagagcgtcgatcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgtttcggcgagtatatggaacgggttggtatggattgtaggcgtcgttttatattttgtttgttttttcgcgttgcgtcgcggtgtatggagtcgggttatttcgatttgaatggaagtcggcggta

SEQ ID NO: 36984 - DNA, 994 bp, Artificial Sequence
  chemically treated genomic DNA (Homo sapiens) CpG-island No: 36984
taccgccgacttccattcaaatcgaaataacccgactccatacaccgcgacgcaacgcgaaaaaacaaacaaaatataaaacgacgcctacaatccataccaacccgttccatatactcgccgaaacgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgatcgacgctctcccttatacgactcctacattaaaaaacaacccaataataaattaaaaccgttaaacaccgccgccgcaaaaaataatacatacaaaaaaataacgcccaacaatcccccgaccacgaaacctaccaccatacccacgccgaaacaaacgctcataaacccgaaataacgaacccgatcttccccatcgataatatcgacgatataaacgccaacaaccgcacctataacgccgataataccgaccacgatacgtccgacgtaaaaaatcttactaattatcctcaaccaactccgccaaaaaaaaattaataaataatcctatctctactatctcataaaataaaa

SEQ ID NO: 36985 - DNA, 689 bp, Artificial Sequence
  chemically treated genomic DNA (Homo sapiens) CpG-island No: 36985
tttgtcgtcgggttttcgagtttcgtcgcgttttcgatgtttagttttttggtcgttaggttttcgtcgtcgtcggggtcgtcgttaatgaggtcgggggtttcgaagatgtttagcgttttttcggcgtcgcggtgttgtcggtaggttatttagtagtagggttttacgtcggtttcgtcgatgttttagaaggttagttttttttcgaagagcggttcgtatacgtttgcggggtagtgtagtttgtcggtgcggtagtaattgagtatataggcgaagacgttcgggtgtcggtcgaagaagaattcgcggtcgttatcgggatggtcgttggttttgtcgtcgcgggaattgtagttgttcgcgtcgttttcgaagtagtcgtttggttcgggggatagcgggggcgttttcggcggcggcgatagtggaggcggcgacggttgtagtttgtcgttcgtcgtggttaagtagtcgtttgggggttcggaggaggtaagaagggttaggcgtgttttaggtagggttttgagggtgttgcggtaggtttcgtgtcggtgttttcgatattgaggattattttttcgttgttttcgattttgtttatttttgtgatttagatatgattagggggaggtaaatatagcgtcgagttaaagattttagtcgttaaagatatattatga

SEQ ID NO: 36986 - DNA, 689 bp, Artificial Sequence
  chemically treated genomic DNA (Homo sapiens) CpG-island No: 36986
tcataatatatctttaacgactaaaatctttaactcgacgctatatttacctccccctaatcatatctaaatcacaaaaataaacaaaatcgaaaacaacgaaaaaataatcctcaatatcgaaaacaccgacacgaaacctaccgcaacaccctcaaaaccctacctaaaacacgcctaacccttcttacctcctccgaacccccaaacgactacttaaccacgacgaacgacaaactacaaccgtcgccgcctccactatcgccgccgccgaaaacgcccccgctatcccccgaaccaaacgactacttcgaaaacgacgcgaacaactacaattcccgcgacgacaaaaccaacgaccatcccgataacgaccgcgaattcttcttcgaccgacacccgaacgtcttcgcctatatactcaattactaccgcaccgacaaactacactaccccgcaaacgtatacgaaccgctcttcgaaaaaaaactaaccttctaaaacatcgacgaaaccgacgtaaaaccctactactaaataacctaccgacaacaccgcgacgccgaaaaaacgctaaacatcttcgaaacccccgacctcattaacgacgaccccgacgacgacgaaaacctaacgaccaaaaaactaaacatcgaaaacgcgacgaaactcgaaaacccgacgacaaa

SEQ ID NO: 36987 - DNA, 689 bp, Artificial Sequence
  chemically treated genomic DNA (Homo sapiens) CpG-island No: 36987
ttatggtgtgtttttgacggttaagatttttaattcggcgttgtgtttgtttttttttagttatgtttgagttatagagatgggtaagatcgagaataacgagagggtgatttttaatgtcgggggtatcggtacgaaatttatcgtagtatttttaagattttgtttggaatacgtttggttttttttgtttttttcgagtttttaggcgattgtttgattacggcgggcgataagttgtagtcgtcgtcgtttttattgtcgtcgtcgtcgagagcgttttcgttgtttttcgggttaggcggttgtttcgagggcggcgcgggtaattgtagttttcgcggcggtagggttagcgattatttcggtggcggtcgcgagttttttttcgatcggtattcgggcgttttcgtttatgtgtttaattattatcgtatcggtaagttgtattgtttcgtagacgtgtgcgggtcgtttttcgaggaggagttggttttttggggtatcgacgagatcgacgtggagttttgttgttggatgatttatcggtagtatcgcgacgtcgaggaggcgttggatattttcgagattttcgattttattggcggcgatttcggcgacgacgaggatttggcggttaagaggttgggtatcgaggacgcggcggggttcgggggttcgacggtaaa

SEQ ID NO: 36988 - DNA, 689 bp, Artificial Sequence
  chemically treated genomic DNA (Homo sapiens) CpG-island No: 36988
tttaccgtcgaacccccgaaccccgccgcgtcctcgatacccaacctcttaaccgccaaatcctcgtcgtcgccgaaatcgccgccaataaaatcgaaaatctcgaaaatatccaacgcctcctcgacgtcgcgatactaccgataaatcatccaacaacaaaactccacgtcgatctcgtcgataccccaaaaaaccaactcctcctcgaaaaacgacccgcacacgtctacgaaacaatacaacttaccgatacgataataattaaacacataaacgaaaacgcccgaataccgatcgaaaaaaaactcgcgaccgccaccgaaataatcgctaaccctaccgccgcgaaaactacaattacccgcgccgccctcgaaacaaccgcctaacccgaaaaacaacgaaaacgctctcgacgacgacgacaataaaaacgacgacgactacaacttatcgcccgccgtaatcaaacaatcgcctaaaaactcgaaaaaaacaaaaaaaaccaaacgtattccaaacaaaatcttaaaaatactacgataaatttcgtaccgatacccccgacattaaaaatcaccctctcgttattctcgatcttacccatctctataactcaaacataactaaaaaaaaacaaacacaacgccgaattaaaaatcttaaccgtcaaaaacacaccataa

SEQ ID NO: 36989 - DNA, 608 bp, Artificial Sequence
  chemically treated genomic DNA (Homo sapiens) CpG-island No: 36989
aacgcgcgtttgttttttagggcggtggagacgtttttagttttcgtcgttagttcgcggggtagaaggggtgcgagcgattttggttaggttttagggacggggatcgggtttcgcggttttgatcggggagagtttaggaacgtacgtggtcggagcgttaggggttttagtatcgagatttatttcgtttgtttttggattttcgcgattttcgcgggttttttcgttcgtttcgtcggttatttgttaggggaaggagcgtagtgagcgcgtcgttaggaagcggcgttcgaaattttgtagttagagttttgttttcgcgtttttttcgggcgttatgacgtgggcggagtcgtagcgttgtttggagatttggaggaagtcgggtttggattgaagagggggcgggtcgagggtagtgcgcgggggtagagagggggcggggtttggggatacggttaggaggtgcgttttgggggcggattttagggcggggttaagatgagcgttaggagggcggggtttggggtgtggttaggatgaacgttatgagggcgaagtttggggtagggttaggataagcgacgttggggtaggttttgggg

SEQ ID NO: 36990 - DNA, 608 bp, Artificial Sequence
  chemically treated genomic DNA (Homo sapiens) CpG-island No: 36990
ccccaaaacctaccccaacgtcgcttatcctaaccctaccccaaacttcgccctcataacgttcatcctaaccacaccccaaaccccgccctcctaacgctcatcttaaccccgccctaaaatccgcccccaaaacgcacctcctaaccgtatccccaaaccccgccccctctctacccccgcgcactaccctcgacccgccccctcttcaatccaaacccgacttcctccaaatctccaaacaacgctacgactccgcccacgtcataacgcccgaaaaaaacgcgaaaacaaaactctaactacaaaatttcgaacgccgcttcctaacgacgcgctcactacgctccttcccctaacaaataaccgacgaaacgaacgaaaaaacccgcgaaaatcgcgaaaatccaaaaacaaacgaaataaatctcgatactaaaacccctaacgctccgaccacgtacgttcctaaactctccccgatcaaaaccgcgaaacccgatccccgtccctaaaacctaaccaaaatcgctcgcaccccttctaccccgcgaactaacgacgaaaactaaaaacgtctccaccgccctaaaaaacaaacgcgcgtt

SEQ ID NO: 36991 - DNA, 608 bp, Artificial Sequence
  chemically treated genomic DNA (Homo sapiens) CpG-island No: 36991
ttttaggatttgttttaacgtcgtttattttggttttattttaggtttcgtttttatgacgtttattttggttatattttaggtttcgtttttttaacgtttattttggtttcgttttagagttcgtttttaggacgtattttttgatcgtatttttaggtttcgttttttttttgttttcgcgtattgttttcggttcgttttttttttagtttaggttcggttttttttaggtttttaggtaacgttgcggtttcgtttacgttatggcgttcgaggagaacgcggggatagaattttggttgtagggtttcgagcgtcgttttttggcggcgcgtttattgcgtttttttttttggtaggtggtcggcggggcgagcggagaggttcgcgggggtcgcgggagtttaggggtagacgggatgggtttcggtgttgaaatttttggcgtttcggttacgtgcgtttttgggtttttttcggttagggtcgcgagattcggttttcgtttttggggtttggttagagtcgttcgtattttttttgtttcgcgagttggcggcggaagttgggggcgtttttatcgttttggggggtagacgcgcgtt

SEQ ID NO: 36992 - DNA, 608 bp, Artificial Sequence
  chemically treated genomic DNA (Homo sapiens) CpG-island No: 36992
aacgcgcgtctaccccccaaaacgataaaaacgcccccaacttccgccgccaactcgcgaaacaaaaaaaatacgaacgactctaaccaaaccccaaaaacgaaaaccgaatctcgcgaccctaaccgaaaaaaacccaaaaacgcacgtaaccgaaacgccaaaaatttcaacaccgaaacccatcccgtctacccctaaactcccgcgacccccgcgaacctctccgctcgccccgccgaccacctaccaaaaaaaaaaacgcaataaacgcgccgccaaaaaacgacgctcgaaaccctacaaccaaaattctatccccgcgttctcctcgaacgccataacgtaaacgaaaccgcaacgttacctaaaaacctaaaaaaaaccgaacctaaactaaaaaaaaaacgaaccgaaaacaatacgcgaaaacaaaaaaaaaacgaaacctaaaaatacgatcaaaaaatacgtcctaaaaacgaactctaaaacgaaaccaaaataaacgttaaaaaaacgaaacctaaaatataaccaaaataaacgtcataaaaacgaaacctaaaataaaaccaaaataaacgacgttaaaacaaatcctaaaa

SEQ ID NO: 36993 - DNA, 546 bp, Artificial Sequence
  chemically treated genomic DNA (Homo sapiens) CpG-island No: 36993
acgtgtgtgtggatttttcgcggtgttcgtgtgtggatttttcgcggtgttcgtgtgtggatttttcgcggtgtttgtgtgtgtgtggattttatagtttttatgtgtgtgtggatttttcgcggtgttcgtgtgtggatttttcgcggtgttcgtgtgtgtgtggattttatagtttttatgtgtgtgtggatttttcgcggtgttcgtgtgtggatttcgcggtgttcgtgtgtgtgtggattttatagtttttatgtgtgtgtggattttttacggtgttcgtgtgtggatttcgcggtgttcgtgtgtgtgtggattttatagtttttatgtgtgtgtggatttttcgcggtgttcgtgtgtggatttcgcggtgttcgtgtgtgtgtggattttatagtttttatgtgtgtgtggatttttcgcggtgttcgtgtgtggattttgcggtgttcgtgtgtgtgtggattttatagtttttatgtgtgtgtggatttttcgcggtgtttgtgtgtgtgtggattttatagtttttatgtgtgt

SEQ ID NO: 36994 - DNA, 546 bp, Artificial Sequence
  chemically treated genomic DNA (Homo sapiens) CpG-island No: 36994
acacacataaaaactataaaatccacacacacacaaacaccgcgaaaaatccacacacacataaaaactataaaatccacacacacacgaacaccgcaaaatccacacacgaacaccgcgaaaaatccacacacacataaaaactataaaatccacacacacacgaacaccgcgaaatccacacacgaacaccgcgaaaaatccacacacacataaaaactataaaatccacacacacacgaacaccgcgaaatccacacacgaacaccgtaaaaaatccacacacacataaaaactataaaatccacacacacacgaacaccgcgaaatccacacacgaacaccgcgaaaaatccacacacacataaaaactataaaatccacacacacacgaacaccgcgaaaaatccacacacgaacaccgcgaaaaatccacacacacataaaaactataaaatccacacacacacaaacaccgcgaaaaatccacacacgaacaccgcgaaaaatccacacacgaacaccgcgaaaaatccacacacacgt

SEQ ID NO: 36995 - DNA, 546 bp, Artificial Sequence
  chemically treated genomic DNA (Homo sapiens) CpG-island No: 36995
atatatatagaaattgtgaagtttatatatatatagatatcgcggagagtttatatatatatagaaattgtgaagtttatatatatacggatatcgtagagtttatatacggatatcgcggagagtttatatatatatagaaattgtgaagtttatatatatacggatatcgcggagtttatatacggatatcgcggagagtttatatatatatagaaattgtgaagtttatatatatacggatatcgcggagtttatatacggatatcgtggagagtttatatatatatagaaattgtgaagtttatatatatacggatatcgcggagtttatatacggatatcgcggagagtttatatatatatagaaattgtgaagtttatatatatacggatatcgcggagagtttatatacggatatcgcggagagtttatatatatatagaaattgtgaagtttatatatatatagatatcgcggagagtttatatacggatatcgcggagagtttatatacggatatcgcggagagtttatatatacgt

SEQ ID NO: 36996 - DNA, 546 bp, Artificial Sequence
  chemically treated genomic DNA (Homo sapiens) CpG-island No: 36996
acgtatatataaactctccgcgatatccgtatataaactctccgcgatatccgtatataaactctccgcgatatctatatatatataaacttcacaatttctatatatatataaactctccgcgatatccgtatataaactctccgcgatatccgtatatatataaacttcacaatttctatatatatataaactctccgcgatatccgtatataaactccgcgatatccgtatatatataaacttcacaatttctatatatatataaactctccacgatatccgtatataaactccgcgatatccgtatatatataaacttcacaatttctatatatatataaactctccgcgatatccgtatataaactccgcgatatccgtatatatataaacttcacaatttctatatatatataaactctccgcgatatccgtatataaactctacgatatccgtatatatataaacttcacaatttctatatatatataaactctccgcgatatctatatatatataaacttcacaatttctatatatat

SEQ ID NO: 36997 - DNA, 546 bp, Artificial Sequence
  chemically treated genomic DNA (Homo sapiens) CpG-island No: 36997
tcgggcggtaggcgttttagaataggttcgggcggtaggcgttagtagtgtgtttagaataggggcgggtagcgggcgtttagtagtgtgtttagaataggggcgggcggcgggcgtttagtagtgtgtttagaagaggggcgggcggcgggcgtttagtagtgtgtttagaagaggggcgggcggcgggcgtttagtagtgtgtttagaagaggggcgggcggcgggcgtttagtagtgtgtttagaagaggggcgggcggcgggcgtttagtagtgtgtttagaataggggcgggcggcgggcgtttagtagtgtgtttagaataggggcgggcggcgggcgtttagtagtgtgtttagaagaggggcgggcggcgggcgtttagtagtgtgtttagaagaggggcgcgcgggcgtttagtagtgtgtttagaataggggcgggcggcgggcgtttagtagtgtgtttagaataggggcgggcggcgggcgtttagtagtgtgttaaataattaggggtataaataggtgtagagaggaaatgt

SEQ ID NO: 36998 - DNA, 546 bp, Artificial Sequence
  chemically treated genomic DNA (Homo sapiens) CpG-island No: 36998
acatttcctctctacacctatttatacccctaattatttaacacactactaaacgcccgccgcccgcccctattctaaacacactactaaacgcccgccgcccgcccctattctaaacacactactaaacgcccgcgcgcccctcttctaaacacactactaaacgcccgccgcccgcccctcttctaaacacactactaaacgcccgccgcccgcccctattctaaacacactactaaacgcccgccgcccgcccctattctaaacacactactaaacgcccgccgcccgcccctcttctaaacacactactaaacgcccgccgcccgcccctcttctaaacacactactaaacgcccgccgcccgcccctcttctaaacacactactaaacgcccgccgcccgcccctcttctaaacacactactaaacgcccgccgcccgcccctattctaaacacactactaaacgcccgctacccgcccctattctaaacacactactaacgcctaccgcccgaacctattctaaaacgcctaccgcccga

SEQ ID NO: 36999 - DNA, 546 bp, Artificial Sequence
  chemically treated genomic DNA (Homo sapiens) CpG-island No: 36999
gtattttttttttgtatttgtttatgtttttggttatttgatatattgttgagcgttcgtcgttcgtttttgttttagatatattgttgggcgttcgtcgttcgtttttgttttagatatattgttgggcgttcgcgcgttttttttttagatatattgttgggcgttcgtcgttcgttttttttttagatatattgttgggcgttcgtcgttcgtttttgttttagatatattgttgggcgttcgtcgttcgtttttgttttagatatattgttgggcgttcgtcgttcgttttttttttagatatattgttgggcgttcgtcgttcgttttttttttagatatattgttgggcgttcgtcgttcgttttttttttagatatattgttgggcgttcgtcgttcgttttttttttagatatattgttgggcgttcgtcgttcgtttttgttttagatatattgttgggcgttcgttgttcgtttttgttttagatatattgttggcgtttgtcgttcgaatttgttttagagcgtttgtcgttcga

SEQ ID NO: 37000 - DNA, 546 bp, Artificial Sequence
  chemically treated genomic DNA (Homo sapiens) CpG-island No: 37000
tcgaacgacaaacgctctaaaacaaattcgaacgacaaacgccaacaatatatctaaaacaaaaacgaacaacgaacgcccaacaatatatctaaaacaaaaacgaacgacgaacgcccaacaatatatctaaaaaaaaaacgaacgacgaacgcccaacaatatatctaaaaaaaaaacgaacgacgaacgcccaacaatatatctaaaaaaaaaacgaacgacgaacgcccaacaatatatctaaaaaaaaaacgaacgacgaacgcccaacaatatatctaaaacaaaaacgaacgacgaacgcccaacaatatatctaaaacaaaaacgaacgacgaacgcccaacaatatatctaaaaaaaaaacgaacgacgaacgcccaacaatatatctaaaaaaaaaacgcgcgaacgcccaacaatatatctaaaacaaaaacgaacgacgaacgcccaacaatatatctaaaacaaaaacgaacgacgaacgctcaacaatatatcaaataaccaaaaacataaacaaatacaaaaaaaaaatac

SEQ ID NO: 37001 - DNA, 1730 bp, Artificial Sequence
  chemically treated genomic DNA (Homo sapiens) CpG-island No: 37001
gagtagtacgttaggttcgtttcggtttttttttttttcgttatttaaatattcggttaattttcgttttggtttttatggttatcgcgtttcgaggcgttttcgcgggggttggcgaatcgggtagtttcgcgaaggaggggggcgcgcgatcggggcgtttggttttatttttagcgcgtttttcgagagtcggcggtttcggagggtgtatagtcgggaagcgatatacggtcgaggggtgtcgggatcgggtcgttttcgttttagagcgcgcgatgatttataaatgtagtagttgaagtttgagttagttcgagcggcgggtacgcgcgacgcgttttcgttatgtcggggagggggcgaggtcgggtcggggagcgcgcggggagggggcggtcggcgttcgggttcgcgttcgttcgtcgttcgtttaaattgcgttatacgtcgcggcggggttacgcggcggtcgtcgttattttgtgcggtcgttattttttggttcgtcgcgttcgcgatttatcgttttcgttaaataaagatataaatttaacgttgttcgttcgggattgggatgaagtgaggcgcgatataaattcgagttcgagttcgaggaggcggaggcgaagcgtagcgaggagcggtcgggttaggtgtcgtcgtcgagtagcggggaggggttgttttagcgacgttcgcggtttatattcgttagcgtcggagttgggcgatttggcgcggagagacggcgtcgtgagtcgtgggcggtcggggagtgtatttttttcgttagttagcggttcgaggggtcgagggggcgggaagtatcgggtagggggtcgtttttttatcgaatttatttttggaatgttttcgttttgattgaataacgtcgtcgtcgcgtttaagttattttcggttttagcgttcgtttttcgcgttaggttttattgtttattggttggaggtttgttatagttcgttcgttattggttcgtttgcgacgttaatcgtattttttcgcgttttttttgttttttgaggtttaattcgcggtttcggttcgtttttagtttcggtttcgttttttttttttttttttttttcgttttttttagaggttttcgcggcgtagtttttgggtttcgcgagattcggagtggttttggtggcggggtcggggtatcgggggtcgttttttgtcggtttgggttttgagggggagatggtggttggttttttttttcgtcgggtttgggataggtcgcggcgttatggcgattttcgggacgtaggagttatcgttttcgaaattgttttcgaggtcgtgtttttgcggttgttattttcggggagaggaattcgatcgcgtttttttcgtagcgggcgtttatttttttttttcgttttttcgggacgttcgatttcgggtttcgaggaatgagttgtttttttattttaagttttaggtttgggttttttattttagggacgttttttgtttcggattcggggtggattggtcgttggcggaacgagttcgtgattcgttagtgatcgtttagggcggtcgcgaggtcgcgtcgtttcggtgtcggttcgtaatttagtttgcgcgtttagtttagcgcgtcgtttttcgttttcggaagaggaggtttttaattggtttggaattttggggttttttgaaggcgtttcgtggtgggtttttattttttggtgaa

SEQ ID NO: 37002 - DNA, 1730 bp, Artificial Sequence
  chemically treated genomic DNA (Homo sapiens) CpG-island No: 37002
ttcaccaaaaaataaaaacccaccacgaaacgccttcaaaaaaccccaaaattccaaaccaattaaaaacctcctcttccgaaaacgaaaaacgacgcgctaaactaaacgcgcaaactaaattacgaaccgacaccgaaacgacgcgacctcgcgaccgccctaaacgatcactaacgaatcacgaactcgttccgccaacgaccaatccaccccgaatccgaaacaaaaaacgtccctaaaataaaaaacccaaacctaaaacttaaaataaaaaaacaactcattcctcgaaacccgaaatcgaacgtcccgaaaaaacgaaaaaaaaaaataaacgcccgctacgaaaaaaacgcgatcgaattcctctccccgaaaataacaaccgcaaaaacacgacctcgaaaacaatttcgaaaacgataactcctacgtcccgaaaatcgccataacgccgcgacctatcccaaacccgacgaaaaaaaaaaccaaccaccatctccccctcaaaacccaaaccgacaaaaaacgacccccgataccccgaccccgccaccaaaaccactccgaatctcgcgaaacccaaaaactacgccgcgaaaacctctaaaaaaaacgaaaaaaaaaaaaaaaaaaaaaacgaaaccgaaactaaaaacgaaccgaaaccgcgaattaaacctcaaaaaacaaaaaaaacgcgaaaaaatacgattaacgtcgcaaacgaaccaataacgaacgaactataacaaacctccaaccaataaacaataaaacctaacgcgaaaaacgaacgctaaaaccgaaaataacttaaacgcgacgacgacgttattcaatcaaaacgaaaacattccaaaaataaattcgataaaaaaacgaccccctacccgatacttcccgccccctcgacccctcgaaccgctaactaacgaaaaaaatacactccccgaccgcccacgactcacgacgccgtctctccgcgccaaatcgcccaactccgacgctaacgaatataaaccgcgaacgtcgctaaaacaacccctccccgctactcgacgacgacacctaacccgaccgctcctcgctacgcttcgcctccgcctcctcgaactcgaactcgaatttatatcgcgcctcacttcatcccaatcccgaacgaacaacgttaaatttatatctttatttaacgaaaacgataaatcgcgaacgcgacgaaccaaaaaataacgaccgcacaaaataacgacgaccgccgcgtaaccccgccgcgacgtataacgcaatttaaacgaacgacgaacgaacgcgaacccgaacgccgaccgccccctccccgcgcgctccccgacccgacctcgccccctccccgacataacgaaaacgcgtcgcgcgtacccgccgctcgaactaactcaaacttcaactactacatttataaatcatcgcgcgctctaaaacgaaaacgacccgatcccgacacccctcgaccgtatatcgcttcccgactatacaccctccgaaaccgccgactctcgaaaaacgcgctaaaaataaaaccaaacgccccgatcgcgcgcccccctccttcgcgaaactacccgattcgccaacccccgcgaaaacgcctcgaaacgcgataaccataaaaaccaaaacgaaaattaaccgaatatttaaataacgaaaaaaaaaaaaaccgaaacgaacctaacgtactactc

SEQ ID NO: 37003 - DNA, 1730 bp, Artificial Sequence
  chemically treated genomic DNA (Homo sapiens) CpG-island No: 37003
tttattagaaggtgggaatttattacgaagcgtttttaggaggttttaggattttaaattaattaagggttttttttttcgaaaacgggaggcgacgcgttgagttaagcgcgtaggttgggttgcgggtcgatatcgaggcggcgcggtttcgcgatcgttttgggcggttattggcgagttacggattcgtttcgttagcggttaatttatttcgagttcgaaatagaagacgtttttgggatgaaagatttaggtttggggtttaaggtggaaaaataatttatttttcgaggttcggagtcgggcgtttcgggagaacgggaaagggagatgagcgttcgttgcggggagaacgcggtcgggttttttttttcgaaggtggtagtcgtaaaaatacggtttcgaaagtagtttcgaggacgatggtttttgcgtttcgggagtcgttatgacgtcgcggtttgttttagattcggcgagggaggggattaattattattttttttttaaggtttaaatcgataaagaacggttttcggtatttcggtttcgttattagggttatttcgggtttcgcgagatttaagggttgcgtcgcgaagatttttgggaaaggcggggggaggggagaggaaggaagcgagatcggggttggaggcgggtcgaggtcgcgagttgagttttaggaagtagaaggggcgcggaaagatgcgattgacgtcgtaagcgaattaatgacgagcgagttgtggtaggtttttagttaatgggtagtgaggtttgacgcggggggcggacgttggggtcgagggtagtttgagcgcggcggcggcgttgtttagttagagcgagaatattttagaggtgagttcggtgaaggggcggttttttgttcggtgtttttcgttttttcgatttttcgggtcgttggttggcggggaaggtgtatttttcgatcgtttacggtttacggcgtcgttttttcgcgttaggtcgtttagtttcggcgttgacgggtgtggatcgcggacgtcgttgggatagttttttttcgttgttcggcggcggtatttggttcggtcgtttttcgttgcgtttcgttttcgttttttcggattcggattcgggtttatatcgcgttttattttattttagtttcgggcgagtagcgttgggtttatgtttttatttgacgaaaacggtgagtcgcgggcgcggcgggttaggagatggcggtcgtataagatggcggcggtcgtcgcgtgatttcgtcgcggcgtgtggcgtagtttgggcggacggcgggcgggcgcgggttcgggcgtcggtcgtttttttttcgcgcgtttttcggttcggtttcgtttttttttcggtatggcgggagcgcgtcgcgcgtgttcgtcgttcgggttgatttaggttttagttgttgtatttgtgagttatcgcgcgttttggggcgggggcggttcgatttcggtatttttcggtcgtgtgtcgtttttcggttgtgtatttttcggggtcgtcggttttcgggggacgcgttggggatggggttagacgtttcggtcgcgcgtttttttttttcgcggagttgttcggttcgttagttttcgcggaaacgtttcggagcgcggtagttatggggattagggcgaaggttaatcgagtatttgaatagcgaggaaaagggaggtcggggcgagtttggcgtattgttt

SEQ ID NO: 37004 - DNA, 1730 bp, Artificial Sequence
  chemically treated genomic DNA (Homo sapiens) CpG-island No: 37004
aaacaatacgccaaactcgccccgacctcccttttcctcgctattcaaatactcgattaaccttcgccctaatccccataactaccgcgctccgaaacgtttccgcgaaaactaacgaaccgaacaactccgcgaaaaaaaaaaacgcgcgaccgaaacgtctaaccccatccccaacgcgtcccccgaaaaccgacgaccccgaaaaatacacaaccgaaaaacgacacacgaccgaaaaataccgaaatcgaaccgcccccgccccaaaacgcgcgataactcacaaatacaacaactaaaacctaaatcaacccgaacgacgaacacgcgcgacgcgctcccgccataccgaaaaaaaaacgaaaccgaaccgaaaaacgcgcgaaaaaaaaacgaccgacgcccgaacccgcgcccgcccgccgtccgcccaaactacgccacacgccgcgacgaaatcacgcgacgaccgccgccatcttatacgaccgccatctcctaacccgccgcgcccgcgactcaccgttttcgtcaaataaaaacataaacccaacgctactcgcccgaaactaaaataaaataaaacgcgatataaacccgaatccgaatccgaaaaaacgaaaacgaaacgcaacgaaaaacgaccgaaccaaataccgccgccgaacaacgaaaaaaaactatcccaacgacgtccgcgatccacacccgtcaacgccgaaactaaacgacctaacgcgaaaaaacgacgccgtaaaccgtaaacgatcgaaaaatacaccttccccgccaaccaacgacccgaaaaatcgaaaaaacgaaaaacaccgaacaaaaaaccgccccttcaccgaactcacctctaaaatattctcgctctaactaaacaacgccgccgccgcgctcaaactaccctcgaccccaacgtccgccccccgcgtcaaacctcactacccattaactaaaaacctaccacaactcgctcgtcattaattcgcttacgacgtcaatcgcatctttccgcgccccttctacttcctaaaactcaactcgcgacctcgacccgcctccaaccccgatctcgcttccttcctctcccctccccccgcctttcccaaaaatcttcgcgacgcaacccttaaatctcgcgaaacccgaaataaccctaataacgaaaccgaaataccgaaaaccgttctttatcgatttaaaccttaaaaaaaaaataataattaatcccctccctcgccgaatctaaaacaaaccgcgacgtcataacgactcccgaaacgcaaaaaccatcgtcctcgaaactactttcgaaaccgtatttttacgactaccaccttcgaaaaaaaaaacccgaccgcgttctccccgcaacgaacgctcatctccctttcccgttctcccgaaacgcccgactccgaacctcgaaaaataaattatttttccaccttaaaccccaaacctaaatctttcatcccaaaaacgtcttctatttcgaactcgaaataaattaaccgctaacgaaacgaatccgtaactcgccaataaccgcccaaaacgatcgcgaaaccgcgccgcctcgatatcgacccgcaacccaacctacgcgcttaactcaacgcgtcgcctcccgttttcgaaaaaaaaaacccttaattaatttaaaatcctaaaacctcctaaaaacgcttcgtaataaattcccaccttctaataaa

SEQ ID NO: 37005 - DNA, 796 bp, Artificial Sequence
  chemically treated genomic DNA (Homo sapiens) CpG-island No: 37005
gagtcgcgttcgcgtaaagttgcgcgttcgcgcgcggatcgtttttcgttcggttcgtgggatgcggtcgtttttttagttttttttttcgtttttttcgttttcgtttttttttttttttttttcgattcgttttaggttagattttcgcgcgggttttcgtttttttaggatttttttttttttttttttttttttcgtcgcgtttcggattttgcgggttggtttcgcgtttcgttagggttgtcggggtgtgttgttggggagcgtggagtgggtaggattacgttggatacgtagttcgcgtgcggtcgtttttcgagtagtgcgcggcgtgggcggaggagcggtttcgcgaggagatcgaggcgaacgcggcgttcgcgttgttggaggtcgtggacgcggcgggcgtcgagtatttggttacgttttaggatttggatattcgttacggcgacggtttcgcggtgttttcgggcgtgtgtagcgaggtttcgtttcgggtcgtgaggtcgtcgagtaagcgtttgcgtcggtcgtgggaattcggggtcgtttcgcgggtgttggtgggtatttaggtcgattcggacgacgggcgttaggtgttgacggcgcggggtcgcgaggggcgtttttcgttttcggaggttatggttaagagttagcggatggtggatcgggtgtttatgtaggcggtgcgcgagacggaggttttggtttcgttcgaggaggaggtggagtgttgggaagttttttgttgttttttggattttatttagaaaaagatggt

SEQ ID NO: 37006 - DNA, 796 bp, Artificial Sequence
  chemically treated genomic DNA (Homo sapiens) CpG-island No: 37006
accatctttttctaaataaaatccaaaaaacaacaaaaaacttcccaacactccacctcctcctcgaacgaaaccaaaacctccgtctcgcgcaccgcctacataaacacccgatccaccatccgctaactcttaaccataacctccgaaaacgaaaaacgcccctcgcgaccccgcgccgtcaacacctaacgcccgtcgtccgaatcgacctaaatacccaccaacacccgcgaaacgaccccgaattcccacgaccgacgcaaacgcttactcgacgacctcacgacccgaaacgaaacctcgctacacacgcccgaaaacaccgcgaaaccgtcgccgtaacgaatatccaaatcctaaaacgtaaccaaatactcgacgcccgccgcgtccacgacctccaacaacgcgaacgccgcgttcgcctcgatctcctcgcgaaaccgctcctccgcccacgccgcgcactactcgaaaaacgaccgcacgcgaactacgtatccaacgtaatcctacccactccacgctccccaacaacacaccccgacaaccctaacgaaacgcgaaaccaacccgcaaaatccgaaacgcgacgaaaaaaaaaaaaaaaaaaaaaaaaatcctaaaaaaacgaaaacccgcgcgaaaatctaacctaaaacgaatcgaaaaaaaaaaaaaaaaaaacgaaaacgaaaaaaacgaaaaaaaaaactaaaaaaacgaccgcatcccacgaaccgaacgaaaaacgatccgcgcgcgaacgcgcaactttacgcgaacgcgactc

SEQ ID NO: 37007 - DNA, 796 bp, Artificial Sequence
  chemically treated genomic DNA (Homo sapiens) CpG-island No: 37007
gttatttttttttggatggagtttaggggataatagaaaattttttaatattttatttttttttcgggcgggattaaggttttcgtttcgcgtatcgtttgtatgaatattcggtttattattcgttggtttttggttatgattttcgggaacggggagcgtttttcgcggtttcgcgtcgttagtatttggcgttcgtcgttcgggtcggtttgggtgtttattagtattcgcgggacggtttcgggtttttacggtcggcgtaggcgtttgttcggcggttttacggttcggaacgaggtttcgttgtatacgttcgggagtatcgcggagtcgtcgtcgtggcggatgtttaggttttggagcgtgattaggtgttcggcgttcgtcgcgtttacgatttttagtaacgcgggcgtcgcgttcgtttcgattttttcgcggagtcgttttttcgtttacgtcgcgtattgttcggggagcggtcgtacgcgaattgcgtgtttagcgtggttttgtttattttacgttttttagtagtatatttcggtagttttggcggggcgcgggattagttcgtagggttcgggacgcggcggggaggggaggggagggaggaagggttttgggagggcgaggattcgcgcgggggtttggtttggggcgggtcgggaggggaggggaggaaaacgggggcggggagggcggaggaaggggttgggagggcgatcgtattttacgagtcgggcgaggagcggttcgcgcgcgagcgcgtagttttgcgcgagcgcggttt

SEQ ID NO: 37008 - DNA, 796 bp, Artificial Sequence
  chemically treated genomic DNA (Homo sapiens) CpG-island No: 37008
aaaccgcgctcgcgcaaaactacgcgctcgcgcgcgaaccgctcctcgcccgactcgtaaaatacgatcgccctcccaaccccttcctccgccctccccgcccccgttttcctcccctcccctcccgacccgccccaaaccaaacccccgcgcgaatcctcgccctcccaaaacccttcctccctcccctcccctccccgccgcgtcccgaaccctacgaactaatcccgcgccccgccaaaactaccgaaatatactactaaaaaacgtaaaataaacaaaaccacgctaaacacgcaattcgcgtacgaccgctccccgaacaatacgcgacgtaaacgaaaaaacgactccgcgaaaaaatcgaaacgaacgcgacgcccgcgttactaaaaatcgtaaacgcgacgaacgccgaacacctaatcacgctccaaaacctaaacatccgccacgacgacgactccgcgatactcccgaacgtatacaacgaaacctcgttccgaaccgtaaaaccgccgaacaaacgcctacgccgaccgtaaaaacccgaaaccgtcccgcgaatactaataaacacccaaaccgacccgaacgacgaacgccaaatactaacgacgcgaaaccgcgaaaaacgctccccgttcccgaaaatcataaccaaaaaccaacgaataataaaccgaatattcatacaaacgatacgcgaaacgaaaaccttaatcccgcccgaaaaaaaaataaaatattaaaaaattttctattatcccctaaactccatccaaaaaaaaataac

SEQ ID NO: 37009 - DNA, 743 bp, Artificial Sequence
  chemically treated genomic DNA (Homo sapiens) CpG-island No: 37009
tttttttttttttttgttttttatttttttttttttttttttttgtcgaagtttcgacgcgtttttggttttagttttttttttattttttttttttgtttttttttttttttcgcgcgttcggaattgcggttgtttcgcgttcgttaggttgtcgggtgtgttgttggggagcgtgacgtggtaggattacgttggatacgtagttcgcgtgcggtcgtttttcgagtagtgcgcggcgtgggcggaggagcggtttcgcgaggagatcgaggtaaacgcggcgttcgcgttgttggaaatcgtggacgcggcggacgtcgagtatttggttacgttttaggatttgggatattcgttacggcgacgcgttcgcggtgtttcggggcgtgtgtagcgaggtttcgttttcggtcgtgagggtttgcgcgagcgtttgcgcgggttgtgggaattcggggtcgttttgttggtgttggtgggtatttaggtcgatcgggatttcgagcgttaggtgttgatggcgcgggttcgcgaggggttttgttcgttttcgggggttacggttaagatttagcggaggatggattaggtgtttacgttggcggtgcgcgagacggaggttttgatttcgttcgaggtgttttttcgttaatgtttagtatacgaggttgtcggaaaggtttattggttaatttgttatagttggtttttaatacgtttatttttttttttgattttta

SEQ ID NO: 37010 - DNA, 743 bp, Artificial Sequence
  chemically treated genomic DNA (Homo sapiens) CpG-island No: 37010
taaaaatcaaaaaaaaaaataaacgtattaaaaaccaactataacaaattaaccaataaacctttccgacaacctcgtatactaaacattaacgaaaaaacacctcgaacgaaatcaaaacctccgtctcgcgcaccgccaacgtaaacacctaatccatcctccgctaaatcttaaccgtaacccccgaaaacgaacaaaacccctcgcgaacccgcgccatcaacacctaacgctcgaaatcccgatcgacctaaatacccaccaacaccaacaaaacgaccccgaattcccacaacccgcgcaaacgctcgcgcaaaccctcacgaccgaaaacgaaacctcgctacacacgccccgaaacaccgcgaacgcgtcgccgtaacgaatatcccaaatcctaaaacgtaaccaaatactcgacgtccgccgcgtccacgatttccaacaacgcgaacgccgcgtttacctcgatctcctcgcgaaaccgctcctccgcccacgccgcgcactactcgaaaaacgaccgcacgcgaactacgtatccaacgtaatcctaccacgtcacgctccccaacaacacacccgacaacctaacgaacgcgaaacaaccgcaattccgaacgcgcgaaaaaaaaaaaaaaacaaaaaaaaaaaataaaaaaaaaactaaaaccaaaaacgcgtcgaaacttcgacaaaaaaaaaaaaaaaaaaaaataaaaaacaaaaaaaaaaaaaaa

SEQ ID NO: 37011 - DNA, 743 bp, Artificial Sequence
  chemically treated genomic DNA (Homo sapiens) CpG-island No: 37011
tggaaattaggaaaagggatggacgtattgaaaattaattgtggtaaattagttaatgaattttttcgatagtttcgtgtgttgggtattggcggggaggtatttcgggcgggattagggttttcgtttcgcgtatcgttagcgtgaatatttggtttatttttcgttggattttggtcgtgattttcgggaacgggtagggtttttcgcgggttcgcgttattagtatttggcgttcggagtttcggtcggtttgggtgtttattagtattagtaggacggtttcgggtttttatagttcgcgtaggcgttcgcgtaggtttttacggtcgggaacgaggtttcgttgtatacgtttcggagtatcgcgaacgcgtcgtcgtggcggatgttttaggttttggagcgtgattaggtgttcggcgttcgtcgcgtttacgatttttagtagcgcgggcgtcgcgtttgtttcgattttttcgcggagtcgttttttcgtttacgtcgcgtattgttcggggagcggtcgtacgcgaattgcgtgtttagcgtggttttgttacgttacgttttttagtagtatattcggtagtttggcgggcgcgggatagtcgtagtttcggacgcgcgggagggagagaggagtagggagggaagatgagggaggggttgggattagggacgcgtcgggatttcggtagggaggagggaagaggagggtgggaggtaaagaaaaagagagg

SEQ ID NO: 37012 - DNA, 743 bp, Artificial Sequence
  chemically treated genomic DNA (Homo sapiens) CpG-island No: 37012
cctctctttttctttacctcccaccctcctcttccctcctccctaccgaaatcccgacgcgtccctaatcccaacccctccctcatcttccctccctactcctctctccctcccgcgcgtccgaaactacgactatcccgcgcccgccaaactaccgaatatactactaaaaaacgtaacgtaacaaaaccacgctaaacacgcaattcgcgtacgaccgctccccgaacaatacgcgacgtaaacgaaaaaacgactccgcgaaaaaatcgaaacaaacgcgacgcccgcgctactaaaaatcgtaaacgcgacgaacgccgaacacctaatcacgctccaaaacctaaaacatccgccacgacgacgcgttcgcgatactccgaaacgtatacaacgaaacctcgttcccgaccgtaaaaacctacgcgaacgcctacgcgaactataaaaacccgaaaccgtcctactaatactaataaacacccaaaccgaccgaaactccgaacgccaaatactaataacgcgaacccgcgaaaaaccctacccgttcccgaaaatcacgaccaaaatccaacgaaaaataaaccaaatattcacgctaacgatacgcgaaacgaaaaccctaatcccgcccgaaatacctccccgccaatacccaacacacgaaactatcgaaaaaattcattaactaatttaccacaattaattttcaatacgtccatcccttttcctaatttcca

SEQ ID NO: 37013 - DNA, 746 bp, Artificial Sequence
  chemically treated genomic DNA (Homo sapiens) CpG-island No: 37013
aatttcgcgttcggtatcgtttttttttttttcgcgtattgttgatttttcgttttgttttcgtagtgttggagattttgagtttgatttagtagcgcgaattagcgcgtgcggacgagtatattttggagttagaggtcgaggagttggcgtcgtcgaggggcggcgcgtttgggttttttaaggtcgagggcgttggcgggggtcgtcgggcgcgggacgtggcgttgttgtacgaggttttgtagcgcgagttgtgggcgttggtgcgcgagacgttggcgggtttcgggtcgggagcgtgcgtcggggcgggcgcggtggcgtagttgggttaggtgttggtataggaggaggcggtcgacgggcgtcggggtttcggggcggttcgtaaattacgcgtacgttgggtcgaagtcgtggcgcgcgcggttcgggagcgtttagaggtagcggttttcggggcgttcgggggtttggtcgggtagttggaggcgttgcgggcgcggttgttggaggatatggtcgtggtgcggggtcgtttggcgttcgtttatttcgtcggtttgggcgttttcggcgtttatttgcgcggttattacggggttttggtcgagtggttgggggttttcgttcgtcgtaggttgtcgttggtcgatcgttacgcgttgttgtattggtataattaggtttattttaggtaagttggatttagttgtttaaggttacgtgaaatttttagtttt

SEQ ID NO: 37014 - DNA, 746 bp, Artificial Sequence
  chemically treated genomic DNA (Homo sapiens) CpG-island No: 37014
aaaactaaaaatttcacgtaaccttaaacaactaaatccaacttacctaaaataaacctaattataccaatacaacaacgcgtaacgatcgaccaacgacaacctacgacgaacgaaaacccccaaccactcgaccaaaaccccgtaataaccgcgcaaataaacgccgaaaacgcccaaaccgacgaaataaacgaacgccaaacgaccccgcaccacgaccatatcctccaacaaccgcgcccgcaacgcctccaactacccgaccaaacccccgaacgccccgaaaaccgctacctctaaacgctcccgaaccgcgcgcgccacgacttcgacccaacgtacgcgtaatttacgaaccgccccgaaaccccgacgcccgtcgaccgcctcctcctataccaacacctaacccaactacgccaccgcgcccgccccgacgcacgctcccgacccgaaacccgccaacgtctcgcgcaccaacgcccacaactcgcgctacaaaacctcgtacaacaacgccacgtcccgcgcccgacgacccccgccaacgccctcgaccttaaaaaacccaaacgcgccgcccctcgacgacgccaactcctcgacctctaactccaaaatatactcgtccgcacgcgctaattcgcgctactaaatcaaactcaaaatctccaacactacgaaaacaaaacgaaaaatcaacaatacgcgaaaaaaaaaaaaacgataccgaacgcgaaatt

SEQ ID NO: 37015 - DNA, 746 bp, Artificial Sequence
  chemically treated genomic DNA (Homo sapiens) CpG-island No: 37015
agggttgagggttttacgtgattttggataattgagtttagtttatttggggtagatttgattgtgttagtgtagtagcgcgtagcggtcggttagcggtagtttgcgacgggcggaggtttttagttattcggttagggtttcgtggtagtcgcgtaggtagacgtcgaaggcgtttaggtcggcggggtaggcgggcgttaggcggtttcgtattacggttatattttttagtagtcgcgttcgtagcgtttttagttgttcggttaggttttcgggcgtttcgggagtcgttgtttttaggcgttttcgggtcgcgcgcgttacggtttcggtttagcgtgcgcgtagtttgcgggtcgtttcgggatttcgacgttcgtcggtcgtttttttttgtattagtatttggtttagttgcgttatcgcgttcgtttcggcgtacgttttcggttcggggttcgttagcgtttcgcgtattagcgtttatagttcgcgttgtagggtttcgtatagtagcgttacgtttcgcgttcggcggttttcgttagcgttttcggttttgggaggtttaggcgcgtcgtttttcgacggcgttagtttttcggtttttagttttaggatgtgttcgttcgtacgcgttagttcgcgttgttggattaggtttaggatttttagtattgcgggagtaaagcgggaggttagtagtgcgcgggggggaggagggcgatgtcggacgcggggtt

SEQ ID NO: 37016 - DNA, 746 bp, Artificial Sequence
  chemically treated genomic DNA (Homo sapiens) CpG-island No: 37016
aaccccgcgtccgacatcgccctcctcccccccgcgcactactaacctcccgctttactcccgcaatactaaaaatcctaaacctaatccaacaacgcgaactaacgcgtacgaacgaacacatcctaaaactaaaaaccgaaaaactaacgccgtcgaaaaacgacgcgcctaaacctcccaaaaccgaaaacgctaacgaaaaccgccgaacgcgaaacgtaacgctactatacgaaaccctacaacgcgaactataaacgctaatacgcgaaacgctaacgaaccccgaaccgaaaacgtacgccgaaacgaacgcgataacgcaactaaaccaaatactaatacaaaaaaaaacgaccgacgaacgtcgaaatcccgaaacgacccgcaaactacgcgcacgctaaaccgaaaccgtaacgcgcgcgacccgaaaacgcctaaaaacaacgactcccgaaacgcccgaaaacctaaccgaacaactaaaaacgctacgaacgcgactactaaaaaatataaccgtaatacgaaaccgcctaacgcccgcctaccccgccgacctaaacgccttcgacgtctacctacgcgactaccacgaaaccctaaccgaataactaaaaacctccgcccgtcgcaaactaccgctaaccgaccgctacgcgctactacactaacacaatcaaatctaccccaaataaactaaactcaattatccaaaatcacgtaaaaccctcaaccct

SEQ ID NO: 37017 - DNA, 532 bp, Artificial Sequence
  chemically treated genomic DNA (Homo sapiens) CpG-island No: 37017
agaacgttcgggttcgcgcggcgggagagggggtagggcgggggaggggaagggacgtcgagggttttagtggtttcgtgtagcggggatttcgggcgttatgggggcggcgggtaggcgggcgggcgggggtcgcggagggggcgcggagtcggtttaggcggcggcggagggaggcggtggaggggttggggagggaggaagggacgttagggggaggggcgggtagggcggggcgtcgggatttcgtttttcgtcgtcggtttttaaaggcgtaggttcgggttggtcggggcgtcgggggtttcgggggtttcgggggcggaggcgggtttgggtacgtcggcggggagcgtgttttcgttcgagacgagaggcgtattggagaggagagaaggggagagagaggtcggggtagagcgttagagacgtagagagagagatcgagagacgtagagatagagagatacgaagagagagagacgagttataaaagggtggagaggcgtaaggagatgaaggaagagttaga

SEQ ID NO: 37018 - DNA, 532 bp, Artificial Sequence
  chemically treated genomic DNA (Homo sapiens) CpG-island No: 37018
tctaactcttccttcatctccttacgcctctccacccttttataactcgtctctctctcttcgtatctctctatctctacgtctctcgatctctctctctacgtctctaacgctctaccccgacctctctctccccttctctcctctccaatacgcctctcgtctcgaacgaaaacacgctccccgccgacgtacccaaacccgcctccgcccccgaaacccccgaaacccccgacgccccgaccaacccgaacctacgcctttaaaaaccgacgacgaaaaacgaaatcccgacgccccgccctacccgcccctccccctaacgtcccttcctccctccccaacccctccaccgcctccctccgccgccgcctaaaccgactccgcgccccctccgcgacccccgcccgcccgcctacccgccgcccccataacgcccgaaatccccgctacacgaaaccactaaaaccctcgacgtcccttcccctcccccgccctaccccctctcccgccgcgcgaacccgaacgttct

SEQ ID NO: 37019 - DNA, 532 bp, Artificial Sequence
  chemically treated genomic DNA (Homo sapiens) CpG-island No: 37019
tttggttttttttttatttttttgcgtttttttatttttttgtaattcgttttttttttttcgtgtttttttatttttacgtttttcgatttttttttttgcgtttttggcgttttgtttcggttttttttttttttttttttttttttagtgcgtttttcgtttcgggcgagaatacgtttttcgtcggcgtgtttagattcgttttcgttttcggagttttcggagttttcggcgtttcgattagttcgggtttgcgtttttaagggtcggcggcggggggcggggtttcggcgtttcgttttgttcgtttttttttttgacgtttttttttttttttttagtttttttatcgttttttttcgtcgtcgtttgggtcggtttcgcgtttttttcgcggttttcgttcgttcgtttgttcgtcgtttttatggcgttcggggttttcgttgtacggggttattaggattttcggcgtttttttttttttttcgttttgttttttttttcgtcgcgcggattcgggcgtttt

SEQ ID NO: 37020 - DNA, 532 bp, Artificial Sequence
  chemically treated genomic DNA (Homo sapiens) CpG-island No: 37020
aaaacgcccgaatccgcgcgacgaaaaaaaaaacaaaacgaaaaaaaaaaaaaaacgccgaaaatcctaataaccccgtacaacgaaaaccccgaacgccataaaaacgacgaacaaacgaacgaacgaaaaccgcgaaaaaaacgcgaaaccgacccaaacgacgacgaaaaaaaacgataaaaaaactaaaaaaaaaaaaaaaaacgtcaaaaaaaaaaacgaacaaaacgaaacgccgaaaccccgccccccgccgccgacccttaaaaacgcaaacccgaactaatcgaaacgccgaaaactccgaaaactccgaaaacgaaaacgaatctaaacacgccgacgaaaaacgtattctcgcccgaaacgaaaaacgcactaaaaaaaaaaaaaaaaaaaaaaaaaaccgaaacaaaacgccaaaaacgcaaaaaaaaaaatcgaaaaacgtaaaaataaaaaaacacgaaaaaaaaaaaacgaattacaaaaaaataaaaaaacgcaaaaaaataaaaaaaaaaccaaa

SEQ ID NO: 37021 - DNA, 543 bp, Artificial Sequence
  chemically treated genomic DNA (Homo sapiens) CpG-island No: 37021
cggggtagagtttgagtcgtatcgtttttttagaagtttttgggaggcggttttacgttttaggcgattggttgttatcgaggaagatggcggcgttagattcgaggcgttagggaagatcgtatcgcggacgttcgttgagtttggcgtacgggtcgattaggtgagtgcggggttgcgggggttcggcgagggcggacggatttttgatcgtgtttacggattcgagggaacgcggcgtagtcgtggcggggtttgcggggtcgggggcgtggtcgggagtaaaggttgttgggtaggcggtttggggcgcggggcgcggggcgcggggcgcggggcgcggggcgcggggcgcggggttcggggtttagggtttgcggcggaaatttgggggaggtttgaggttcgcggggttgggttcggggcggggtttaaggagagtttggggcgaggttgaaggcgtttggtgggatttcgggggcggggtttggagtgggtttggggtcgtcggggtggagtttggggattggggggttgtagagg

SEQ ID NO: 37022 - DNA, 543 bp, Artificial Sequence
  chemically treated genomic DNA (Homo sapiens) CpG-island No: 37022
cctctacaaccccccaatccccaaactccaccccgacgaccccaaacccactccaaaccccgcccccgaaatcccaccaaacgccttcaacctcgccccaaactctccttaaaccccgccccgaacccaaccccgcgaacctcaaacctcccccaaatttccgccgcaaaccctaaaccccgaaccccgcgccccgcgccccgcgccccgcgccccgcgccccgcgccccgcgccccaaaccgcctacccaacaacctttactcccgaccacgcccccgaccccgcaaaccccgccacgactacgccgcgttccctcgaatccgtaaacacgatcaaaaatccgtccgccctcgccgaacccccgcaaccccgcactcacctaatcgacccgtacgccaaactcaacgaacgtccgcgatacgatcttccctaacgcctcgaatctaacgccgccatcttcctcgataacaaccaatcgcctaaaacgtaaaaccgcctcccaaaaacttctaaaaaaacgatacgactcaaactctaccccg

SEQ ID NO: 37023 - DNA, 543 bp, Artificial Sequence
  chemically treated genomic DNA (Homo sapiens) CpG-island No: 37023
tttttatagttttttagtttttaggttttatttcggcgattttaaatttattttaggtttcgttttcgaagttttattaagcgtttttagtttcgttttaaattttttttaggtttcgtttcgaatttagtttcgcgggttttaggttttttttaggttttcgtcgtaaattttgagtttcgagtttcgcgtttcgcgtttcgcgtttcgcgtttcgcgtttcgcgtttcgcgttttaggtcgtttatttagtagtttttgttttcggttacgttttcgatttcgtaggtttcgttacggttgcgtcgcgttttttcgggttcgtggatacggttaggggttcgttcgttttcgtcgggttttcgtagtttcgtatttatttggtcggttcgtgcgttaagtttagcgggcgttcgcggtgcgattttttttagcgtttcgggtttggcgtcgttatttttttcggtaataattagtcgtttgaggcgtggggtcgttttttaaagatttttgggagggcggtgcggtttaggttttgtttcg

SEQ ID NO: 37024 - DNA, 543 bp, Artificial Sequence
  chemically treated genomic DNA (Homo sapiens) CpG-island No: 37024
cgaaacaaaacctaaaccgcaccgccctcccaaaaatctttaaaaaacgaccccacgcctcaaacgactaattattaccgaaaaaaataacgacgccaaacccgaaacgctaaaaaaaatcgcaccgcgaacgcccgctaaacttaacgcacgaaccgaccaaataaatacgaaactacgaaaacccgacgaaaacgaacgaacccctaaccgtatccacgaacccgaaaaaacgcgacgcaaccgtaacgaaacctacgaaatcgaaaacgtaaccgaaaacaaaaactactaaataaacgacctaaaacgcgaaacgcgaaacgcgaaacgcgaaacgcgaaacgcgaaacgcgaaactcgaaactcaaaatttacgacgaaaacctaaaaaaaacctaaaacccgcgaaactaaattcgaaacgaaacctaaaaaaaatttaaaacgaaactaaaaacgcttaataaaacttcgaaaacgaaacctaaaataaatttaaaatcgccgaaataaaacctaaaaactaaaaaactataaaaa

SEQ ID NO: 37025 - DNA, 1370 bp, Artificial Sequence
  chemically treated genomic DNA (Homo sapiens) CpG-island No: 37025
ggttagcgcgttttcgttggacgatttcgcgcgtcgttatatgattatttacgtgtcgttggacgtttcgcgttttaagtagtttattagcgagtggaagtagaagagtttggagggtcgcggtttggggttgttcgacgacgttagtttcgggtatttgcgcgcgttcgtcgaatttatggcggaggaggaggaagaggaggaggacgaagaggaagaggaggaggaggaagaggaggaggacgagggttcggtttcgttttcgttttattttatcgtgtaggcgcggtcggggttggggtttcgggttatttttttatcgcgcgcggggtcgtcgtcgttggtgtatatttcggaggagggcgcgtaggcgggggtcggtttgttttttaaaagcggcgtcggggtgcgcgttaagtggtttatgatggtcgagaagagcggggcggtagtggttaatttttcgcggttgttgtaggttatcgttatgtttaaggtttcgggcgcgtcgggttttaaggcggtcgagacggcgtcgtcgtttagcgttagtttcgatttttcgtagtatcggtcgtcgtcggatcgcgatttcgttagtatcgtgattatcgacgcgtacgcgtcgtattatttcgtggtgtatttgtcggtcggcggcgcgttttgggagtggaaggcggcgggcggcggggttaaggcggaggtcgacggcggttacgagttgggggatttggcgcgcggttttcgcggcggggttaagttttcgggcgtgtttttcggttcgtcggttagcgacgtggattaggaggagtcgcggttcggggtcgtggttatcgttaatttggttacgggcgaggggttgttttcgttgggcgcggtcgatggggcgttgggttcgggtagtcgggagtttacgttgcggcgttacgcgggcggtttggggttggcggagcgcgaggcggaggcggaggtcgagggttattttcgtaagatgtaggcgcgtcgttttttcgattagcgcggcggggtcgggggcgggcggggggcgggtcgagggcgcgggcggtcgcgcggatgtttaataaagcggtagaaatcgaggttcggtttttggttattcgttttggttcgtacgttttacgtagggatttttatttttagggtcgggtttatttcgttcgtggttttatttggcgtttcggcggatattcgggcgggagtcggggtcgttcgcggtatagaaagaggaagttagtaacgaaggcggaacggagcgaggatatagaagatttattcgaagtttaggtatagattggttaatttgtttttatagcgtttatagcgaatatagggttagataagggagg

SEQ ID NO: 37026 - DNA, 1370 bp, Artificial Sequence
  chemically treated genomic DNA (Homo sapiens) CpG-island No: 37026
cctcccttatctaaccctatattcgctataaacgctataaaaacaaattaaccaatctatacctaaacttcgaataaatcttctatatcctcgctccgttccgccttcgttactaacttcctctttctataccgcgaacgaccccgactcccgcccgaatatccgccgaaacgccaaataaaaccacgaacgaaataaacccgaccctaaaaataaaaatccctacgtaaaacgtacgaaccaaaacgaataaccaaaaaccgaacctcgatttctaccgctttattaaacatccgcgcgaccgcccgcgccctcgacccgccccccgcccgcccccgaccccgccgcgctaatcgaaaaaacgacgcgcctacatcttacgaaaataaccctcgacctccgcctccgcctcgcgctccgccaaccccaaaccgcccgcgtaacgccgcaacgtaaactcccgactacccgaacccaacgccccatcgaccgcgcccaacgaaaacaacccctcgcccgtaaccaaattaacgataaccacgaccccgaaccgcgactcctcctaatccacgtcgctaaccgacgaaccgaaaaacacgcccgaaaacttaaccccgccgcgaaaaccgcgcgccaaatcccccaactcgtaaccgccgtcgacctccgccttaaccccgccgcccgccgccttccactcccaaaacgcgccgccgaccgacaaatacaccacgaaataatacgacgcgtacgcgtcgataatcacgatactaacgaaatcgcgatccgacgacgaccgatactacgaaaaatcgaaactaacgctaaacgacgacgccgtctcgaccgccttaaaacccgacgcgcccgaaaccttaaacataacgataacctacaacaaccgcgaaaaattaaccactaccgccccgctcttctcgaccatcataaaccacttaacgcgcaccccgacgccgcttttaaaaaacaaaccgacccccgcctacgcgccctcctccgaaatatacaccaacgacgacgaccccgcgcgcgataaaaaaataacccgaaaccccaaccccgaccgcgcctacacgataaaataaaacgaaaacgaaaccgaaccctcgtcctcctcctcttcctcctcctcctcttcctcttcgtcctcctcctcttcctcctcctccgccataaattcgacgaacgcgcgcaaatacccgaaactaacgtcgtcgaacaaccccaaaccgcgaccctccaaactcttctacttccactcgctaataaactacttaaaacgcgaaacgtccaacgacacgtaaataatcatataacgacgcgcgaaatcgtccaacgaaaacgcgctaacc

SEQ ID NO: 37027 - DNA, 1370 bp, Artificial Sequence
  chemically treated genomic DNA (Homo sapiens) CpG-island No: 37027
ttttttttgtttagttttgtgttcgttgtggacgttgtagaggtaggttggttagtttgtatttggatttcgaataaattttttgtattttcgtttcgtttcgttttcgttgttggttttttttttttgtgtcgcgggcggtttcgattttcgttcgggtgttcgtcgaagcgttaggtggggttacgggcggggtgggttcggttttgagagtgggggtttttgcgtggggcgtgcgggttagagcgaatgattaagagtcggatttcggtttttgtcgttttattgagtattcgcgcggtcgttcgcgttttcggttcgtttttcgttcgttttcggtttcgtcgcgttagtcggggaagcggcgcgtttgtattttgcggaagtagttttcggttttcgttttcgtttcgcgtttcgttagttttaggtcgttcgcgtggcgtcgtagcgtggattttcggttgttcgggtttagcgttttatcggtcgcgtttagcgggggtagtttttcgttcgtggttaggttgacggtggttacggtttcgaatcgcggttttttttggtttacgtcgttgatcgacgagtcgggggatacgttcgggggtttggtttcgtcgcggaagtcgcgcgttaggttttttagttcgtagtcgtcgtcggttttcgttttggtttcgtcgttcgtcgttttttatttttagggcgcgtcgtcggtcgataggtgtattacggggtggtgcggcgcgtgcgcgtcgatggttacgatgttggcggagtcgcggttcgacggcgatcggtattgcgaggagtcggagttggcgttggacgacgacgtcgtttcggtcgttttggggttcggcgcgttcggagttttggatatggcgatgatttgtagtagtcgcggagggttggttattgtcgtttcgtttttttcggttattatgagttatttggcgcgtatttcggcgtcgtttttgggggataggtcggttttcgtttgcgcgttttttttcgggatgtgtattagcggcggcggtttcgcgcgcggtgggaggatgattcgaggttttagtttcggtcgcgtttgtacggtggggtagagcgagggcggggtcgggttttcgttttttttttttttttttttttttttttttttttcgtttttttttttttttttttttttcgttatgggttcggcgggcgcgcgtaggtgttcggggttggcgtcgtcgggtagttttaggtcgcggttttttaggtttttttgtttttattcgttgatgagttgtttggagcgcgaggcgtttagcggtacgtggatggttatgtggcggcgcgcggggtcgtttagcgagggcgcgttggtt

SEQ ID NO: 37028 - DNA, 1370 bp, Artificial Sequence
  chemically treated genomic DNA (Homo sapiens) CpG-island No: 37028
aaccaacgcgccctcgctaaacgaccccgcgcgccgccacataaccatccacgtaccgctaaacgcctcgcgctccaaacaactcatcaacgaataaaaacaaaaaaacctaaaaaaccgcgacctaaaactacccgacgacgccaaccccgaacacctacgcgcgcccgccgaacccataacgaaaaaaaaaaaaaaaaaaaaaaacgaaaaaaaaaaaaaaaaaaaaaaaaaaaaaaaaaacgaaaacccgaccccgccctcgctctaccccaccgtacaaacgcgaccgaaactaaaacctcgaatcatcctcccaccgcgcgcgaaaccgccgccgctaatacacatcccgaaaaaaaacgcgcaaacgaaaaccgacctatcccccaaaaacgacgccgaaatacgcgccaaataactcataataaccgaaaaaaacgaaacgacaataaccaaccctccgcgactactacaaatcatcgccatatccaaaactccgaacgcgccgaaccccaaaacgaccgaaacgacgtcgtcgtccaacgccaactccgactcctcgcaataccgatcgccgtcgaaccgcgactccgccaacatcgtaaccatcgacgcgcacgcgccgcaccaccccgtaatacacctatcgaccgacgacgcgccctaaaaataaaaaacgacgaacgacgaaaccaaaacgaaaaccgacgacgactacgaactaaaaaacctaacgcgcgacttccgcgacgaaaccaaacccccgaacgtatcccccgactcgtcgatcaacgacgtaaaccaaaaaaaaccgcgattcgaaaccgtaaccaccgtcaacctaaccacgaacgaaaaactacccccgctaaacgcgaccgataaaacgctaaacccgaacaaccgaaaatccacgctacgacgccacgcgaacgacctaaaactaacgaaacgcgaaacgaaaacgaaaaccgaaaactacttccgcaaaatacaaacgcgccgcttccccgactaacgcgacgaaaccgaaaacgaacgaaaaacgaaccgaaaacgcgaacgaccgcgcgaatactcaataaaacgacaaaaaccgaaatccgactcttaatcattcgctctaacccgcacgccccacgcaaaaacccccactctcaaaaccgaacccaccccgcccgtaaccccacctaacgcttcgacgaacacccgaacgaaaatcgaaaccgcccgcgacacaaaaaaaaaaaaccaacaacgaaaacgaaacgaaacgaaaatacaaaaaatttattcgaaatccaaatacaaactaaccaacctacctctacaacgtccacaacgaacacaaaactaaacaaaaaaaa

SEQ ID NO: 37029 - DNA, 564 bp, Artificial Sequence
  chemically treated genomic DNA (Homo sapiens) CpG-island No: 37029
tcgcgtttcggattttagggatatagaacggggttttattcgtggatttattcgttatttcgtagtttcgtttaggtttcgacgcgtgtagtttttatttcgtagtttcgtttaggtttcgacgcgtgtagtttttatttcgtagtttcgtttaggtttcgacgcgtgtagtttttatttcgtagtttcgtttaggtttcgacgcgtgcggtttttatttcgtagtttcgtttaggtttcgacgcgtgtagtttttatttcgtagtttcgtttaggtttcgacgcgtgtagtttttatttcgtagtttcgtttaggtttcgacgcgtgcggtttttatttcgtagtttcgtttaggtttcgacgcgtgcggtttttatttcgtagtttcgtttaggtttcgacgcgtgcgtgtagtttttatttcgtagtttcgtttaggtttcgacgcgtgtagtttttatttcgtagtttcgtttaggtttcgacgcgtgtagttttttggtagagttagtttcgtttaggtttcgacgcgtgtagttttttggtagagttagttgtgttta

SEQ ID NO: 37030 - DNA, 564 bp, Artificial Sequence
  chemically treated genomic DNA (Homo sapiens) CpG-island No: 37030
taaacacaactaactctaccaaaaaactacacgcgtcgaaacctaaacgaaactaactctaccaaaaaactacacgcgtcgaaacctaaacgaaactacgaaataaaaactacacgcgtcgaaacctaaacgaaactacgaaataaaaactacacgcacgcgtcgaaacctaaacgaaactacgaaataaaaaccgcacgcgtcgaaacctaaacgaaactacgaaataaaaaccgcacgcgtcgaaacctaaacgaaactacgaaataaaaactacacgcgtcgaaacctaaacgaaactacgaaataaaaactacacgcgtcgaaacctaaacgaaactacgaaataaaaaccgcacgcgtcgaaacctaaacgaaactacgaaataaaaactacacgcgtcgaaacctaaacgaaactacgaaataaaaactacacgcgtcgaaacctaaacgaaactacgaaataaaaactacacgcgtcgaaacctaaacgaaactacgaaataacgaataaatccacgaataaaaccccgttctatatccctaaaatccgaaacgcga

SEQ ID NO: 37031 - DNA, 564 bp, Artificial Sequence
  chemically treated genomic DNA (Homo sapiens) CpG-island No: 37031
tgagtatagttggttttgttaggaggttgtacgcgtcggggtttggacggggttggttttgttagggggttgtacgcgtcggggtttggacggggttgcggggtgggggttgtacgcgtcggggtttggacggggttgcggggtgggggttgtacgtacgcgtcggggtttggacggggttgcggggtgggggtcgtacgcgtcggggtttggacggggttgcggggtgggggtcgtacgcgtcggggtttggacggggttgcggggtgggggttgtacgcgtcggggtttggacggggttgcggggtgggggttgtacgcgtcggggtttggacggggttgcggggtgggggtcgtacgcgtcggggtttggacggggttgcggggtgggggttgtacgcgtcggggtttggacggggttgcggggtgggggttgtacgcgtcggggtttggacggggttgcggggtgggggttgtacgcgtcggggtttggacggggttgcggggtggcgggtgggtttacggatgggatttcgttttatgtttttgaaattcgaggcgcgg

SEQ ID NO: 37032 - DNA, 564 bp, Artificial Sequence
  chemically treated genomic DNA (Homo sapiens) CpG-island No: 37032
ccgcgcctcgaatttcaaaaacataaaacgaaatcccatccgtaaacccacccgccaccccgcaaccccgtccaaaccccgacgcgtacaacccccaccccgcaaccccgtccaaaccccgacgcgtacaacccccaccccgcaaccccgtccaaaccccgacgcgtacaacccccaccccgcaaccccgtccaaaccccgacgcgtacgacccccaccccgcaaccccgtccaaaccccgacgcgtacaacccccaccccgcaaccccgtccaaaccccgacgcgtacaacccccaccccgcaaccccgtccaaaccccgacgcgtacgacccccaccccgcaaccccgtccaaaccccgacgcgtacgacccccaccccgcaaccccgtccaaaccccgacgcgtacgtacaacccccaccccgcaaccccgtccaaaccccgacgcgtacaacccccaccccgcaaccccgtccaaaccccgacgcgtacaaccccctaacaaaaccaaccccgtccaaaccccgacgcgtacaacctcctaacaaaaccaactatactca

SEQ ID NO: 37033 - DNA, 596 bp, Artificial Sequence
  chemically treated genomic DNA (Homo sapiens) CpG-island No: 37033
attagcgagcggcgggtttcgcggaggggcgggcggaggcgcggggcgggggtagtcggagtcggcgagagatcgtgagagatacggagatagttagagatttcgaaattttaattttcgttttcgttttcgttttcgtttcgatggcgtttttcgggtcgatcgtagttattcgggaggggaggacggggtcgttatcgtcgtaggttcgaagggaggaggacgcgattttcgagtttcgttagtcgttcgcgtagatttgagattttcgagattttcggcggtgggaggcggcgttagggaggcggggacggtgcgcggggtttgcggaggacgcgtttagataaagagttttcgtttttggttgcggcgtttgggttgcggcgtttgggcgcgcgcgggggttttcgggtcggatttttttttttttcgtttttttttttttttcggttttcggtttcgttttacggaggagacgcgttttgtgttgggcgtcggtcgcgttaggtgaggggttgtggggttgggggcgcggatttagtttttttcgtcgttcggatttttagttttttcggatgttttttattattacgcgg

SEQ ID NO: 37034 - DNA, 596 bp, Artificial Sequence
  chemically treated genomic DNA (Homo sapiens) CpG-island No: 37034
ccgcgtaataataaaaaacatccgaaaaaactaaaaatccgaacgacgaaaaaaactaaatccgcgcccccaaccccacaacccctcacctaacgcgaccgacgcccaacacaaaacgcgtctcctccgtaaaacgaaaccgaaaaccgaaaaaaaaaaaaaaacgaaaaaaaaaaaaatccgacccgaaaacccccgcgcgcgcccaaacgccgcaacccaaacgccgcaaccaaaaacgaaaactctttatctaaacgcgtcctccgcaaaccccgcgcaccgtccccgcctccctaacgccgcctcccaccgccgaaaatctcgaaaatctcaaatctacgcgaacgactaacgaaactcgaaaatcgcgtcctcctcccttcgaacctacgacgataacgaccccgtcctcccctcccgaataactacgatcgacccgaaaaacgccatcgaaacgaaaacgaaaacgaaaacgaaaattaaaatttcgaaatctctaactatctccgtatctctcacgatctctcgccgactccgactacccccgccccgcgcctccgcccgcccctccgcgaaacccgccgctcgctaat

SEQ ID NO: 37035 - DNA, 596 bp, Artificial Sequence
  chemically treated genomic DNA (Homo sapiens) CpG-island No: 37035
tcgcgtggtggtggggggtattcgggagaattgggggttcgggcggcggaggagattgggttcgcgtttttagttttatagttttttatttggcgcggtcggcgtttagtataaagcgcgtttttttcgtggggcggggtcgggagtcgggaaggggagggggacgggggaggggagggttcggttcggagattttcgcgcgcgtttagacgtcgtagtttagacgtcgtagttaggggcgggggttttttgtttgggcgcgtttttcgtaggtttcgcgtatcgttttcgtttttttggcgtcgttttttatcgtcgggggtttcgggggttttaggtttgcgcgagcggttggcggggttcgggggtcgcgttttttttttttcgggtttgcggcggtgacggtttcgtttttttttttcgggtggttgcggtcggttcggggggcgttatcgagacgggggcggaggcgggggcgggggttggggtttcggggtttttgattgttttcgtgttttttacggtttttcgtcggtttcgattgttttcgtttcgcgttttcgttcgttttttcgcggagttcgtcgttcgttggt

SEQ ID NO: 37036 - DNA, 596 bp, Artificial Sequence
  chemically treated genomic DNA (Homo sapiens) CpG-island No: 37036
accaacgaacgacgaactccgcgaaaaaacgaacgaaaacgcgaaacgaaaacaatcgaaaccgacgaaaaaccgtaaaaaacacgaaaacaatcaaaaaccccgaaaccccaacccccgcccccgcctccgcccccgtctcgataacgccccccgaaccgaccgcaaccacccgaaaaaaaaaaacgaaaccgtcaccgccgcaaacccgaaaaaaaaaaaacgcgacccccgaaccccgccaaccgctcgcgcaaacctaaaacccccgaaacccccgacgataaaaaacgacgccaaaaaaacgaaaacgatacgcgaaacctacgaaaaacgcgcccaaacaaaaaacccccgcccctaactacgacgtctaaactacgacgtctaaacgcgcgcgaaaatctccgaaccgaaccctcccctcccccgtccccctccccttcccgactcccgaccccgccccacgaaaaaaacgcgctttatactaaacgccgaccgcgccaaataaaaaactataaaactaaaaacgcgaacccaatctcctccgccgcccgaacccccaattctcccgaataccccccaccaccacgcga

SEQ ID NO: 37037 - DNA, 561 bp, Artificial Sequence
  chemically treated genomic DNA (Homo sapiens) CpG-island No: 37037
ttcgttcggagatttttcgtttttttcggcgatttcggtttcgatttttcgatttcgggtgtaggggcgttcggaagtcgcgtgttgggtcggggcgcggggaggttacgcggacgtcgttttttgtagttttagttttttcgatcgtttttttttcgtcggcgtcggttatcgtgtttttttcgggtttcgtttgcgcgtttttttttagcgtcgtttttttttttttagttacggtttgcggcgttcgcggtattatgatttttattaaggagaagaataagatttcgaaggatagtatgacgtttttgttttgtttttatttcgtggaggtgggtgggggtcgcgttggggttcgggggagacgtttcggtttcgttcgttcgtagagattttcgcgttgggggatcggagtcggcgtagttgtttcggtagtggtttcggggcggggtaggatcggggtgttcggcggatggggggtggggtagaggatttgggttgtgcgggtcgagtaggagttttagaggaatcgaggggggtttaggtcgtgggaattgtggg

SEQ ID NO: 37038 - DNA, 561 bp, Artificial Sequence
  chemically treated genomic DNA (Homo sapiens) CpG-island No: 37038
cccacaattcccacgacctaaacccccctcgattcctctaaaactcctactcgacccgcacaacccaaatcctctaccccaccccccatccgccgaacaccccgatcctaccccgccccgaaaccactaccgaaacaactacgccgactccgatcccccaacgcgaaaatctctacgaacgaacgaaaccgaaacgtctcccccgaaccccaacgcgacccccacccacctccacgaaataaaaacaaaacaaaaacgtcatactatccttcgaaatcttattcttctccttaataaaaatcataataccgcgaacgccgcaaaccgtaactaaaaaaaaaaaaacgacgctaaaaaaaaacgcgcaaacgaaacccgaaaaaaacacgataaccgacgccgacgaaaaaaaaacgatcgaaaaaactaaaactacaaaaaacgacgtccgcgtaacctccccgcgccccgacccaacacgcgacttccgaacgcccctacacccgaaatcgaaaaatcgaaaccgaaatcgccgaaaaaaacgaaaaatctccgaacgaa

SEQ ID NO: 37039 - DNA, 561 bp, Artificial Sequence
  chemically treated genomic DNA (Homo sapiens) CpG-island No: 37039
tttatagtttttacggtttggatttttttcggtttttttggagtttttattcgattcgtatagtttaagttttttgttttattttttattcgtcggatatttcggttttgtttcgtttcgaggttattgtcggggtagttgcgtcggtttcggttttttagcgcgggggtttttgcgggcgggcggaatcgaggcgtttttttcgggttttagcgcgatttttatttatttttacgaagtagaagtagggtagaagcgttatgttgtttttcgggattttgtttttttttttggtggagattatggtgtcgcgggcgtcgtaggtcgtggttggaggggagaaagcggcgttggaggggggcgcgtaggcggagttcgggggagatacggtggtcggcgtcggcgggggaggggcggtcggggaaattgaggttgtagagagcggcgttcgcgtggttttttcgcgtttcggtttagtacgcggttttcgggcgtttttatattcgggatcggggggtcggggtcgggatcgtcgaggagggcggggggttttcgggcggg

SEQ ID NO: 37040 - DNA, 561 bp, Artificial Sequence
  chemically treated genomic DNA (Homo sapiens) CpG-island No: 37040
cccgcccgaaaaccccccgccctcctcgacgatcccgaccccgaccccccgatcccgaatataaaaacgcccgaaaaccgcgtactaaaccgaaacgcgaaaaaaccacgcgaacgccgctctctacaacctcaatttccccgaccgcccctcccccgccgacgccgaccaccgtatctcccccgaactccgcctacgcgcccccctccaacgccgctttctcccctccaaccacgacctacgacgcccgcgacaccataatctccaccaaaaaaaaaaacaaaatcccgaaaaacaacataacgcttctaccctacttctacttcgtaaaaataaataaaaatcgcgctaaaacccgaaaaaaacgcctcgattccgcccgcccgcaaaaacccccgcgctaaaaaaccgaaaccgacgcaactaccccgacaataacctcgaaacgaaacaaaaccgaaatatccgacgaataaaaaataaaacaaaaaacttaaactatacgaatcgaataaaaactccaaaaaaaccgaaaaaaatccaaaccgtaaaaactataaa

SEQ ID NO: 37041 - DNA, 1007 bp, Artificial Sequence
  chemically treated genomic DNA (Homo sapiens) CpG-island No: 37041
ggggttgtacgcgtcggggtttggacggggttgcggggtgggggtcgtacgcgtcggggtttggacggggttgcggggtgggggtcgtacgcgtcggggtttggacggggttgcggggtgggggttgtacgcgtcggggtttggacggggttgcggggtgggggttgtacgcgtcggggtttggacggggttgcggggtgggggttgtacgcgtcggggtttggacggggttgcggggtgggggtcgtacgcgtcggggtttggacggggttgcggggtgggggttgtacgcgtcggggtttggacggggttgcggggtgggggttgtacgcgtcggggtttggacggggttgcggggtgggggttgtacgcgtcggggtttggacggggttgcggggtgggggtcgtacgcgtcggggtttggacggggttgcggggtgggggttgtacgcgtcggggtttggacggggttgcggggtgggggttgtacgcgtcggggtttggacggggttgcggggtgggggttgtacgcgtcggggtttggacggggttgcggggtgggggtcgtacgcgtcggggtttggacggggttgcggggtgggggttgtacgtacgcgtcggggtttggatagggttgcggggtgggggtcgtacgtacgcgtcggggtttggatagggttgcggggtgggggttgtacgtacgcgtcggggtttggatagggttgaggggtgggggtcgtacgcgtcggggtttggacggggttgcggggtgggggtcgtacgcgtcggggtttggacggggttgcggggtgggggttgtacgcgtcggggtttggacggggttgcggggtgggggttgtacgcgtcggggtttggacggggttgcggggtgggggtcgtatacgtcggggtttggacggtgttgcggggggggggttgtacgcgtcggggtttggacggagttgcggggtgggggttgtacgtattggggtttggacggggttgcg

SEQ ID NO: 37042 - DNA, 1007 bp, Artificial Sequence
  chemically treated genomic DNA (Homo sapiens) CpG-island No: 37042
cgcaaccccgtccaaaccccaatacgtacaacccccaccccgcaactccgtccaaaccccgacgcgtacaaccccccccccgcaacaccgtccaaaccccgacgtatacgacccccaccccgcaaccccgtccaaaccccgacgcgtacaacccccaccccgcaaccccgtccaaaccccgacgcgtacaacccccaccccgcaaccccgtccaaaccccgacgcgtacgacccccaccccgcaaccccgtccaaaccccgacgcgtacgacccccacccctcaaccctatccaaaccccgacgcgtacgtacaacccccaccccgcaaccctatccaaaccccgacgcgtacgtacgacccccaccccgcaaccctatccaaaccccgacgcgtacgtacaacccccaccccgcaaccccgtccaaaccccgacgcgtacgacccccaccccgcaaccccgtccaaaccccgacgcgtacaacccccaccccgcaaccccgtccaaaccccgacgcgtacaacccccaccccgcaaccccgtccaaaccccgacgcgtacaacccccaccccgcaaccccgtccaaaccccgacgcgtacgacccccaccccgcaaccccgtccaaaccccgacgcgtacaacccccaccccgcaaccccgtccaaaccccgacgcgtacaacccccaccccgcaaccccgtccaaaccccgacgcgtacaacccccaccccgcaaccccgtccaaaccccgacgcgtacgacccccaccccgcaaccccgtccaaaccccgacgcgtacaacccccaccccgcaaccccgtccaaaccccgacgcgtacaacccccaccccgcaaccccgtccaaaccccgacgcgtacaacccccaccccgcaaccccgtccaaaccccgacgcgtacgacccccaccccgcaaccccgtccaaaccccgacgcgtacgacccccaccccgcaaccccgtccaaaccccgacgcgtacaacccc

SEQ ID NO: 37043 - DNA, 1007 bp, Artificial Sequence
  chemically treated genomic DNA (Homo sapiens) CpG-island No: 37043
cgtagtttcgtttaggttttaatgcgtgtagtttttatttcgtagtttcgtttaggtttcgacgcgtgtagtttttttttcgtagtatcgtttaggtttcgacgtgtgcggtttttatttcgtagtttcgtttaggtttcgacgcgtgtagtttttatttcgtagtttcgtttaggtttcgacgcgtgtagtttttatttcgtagtttcgtttaggtttcgacgcgtgcggtttttatttcgtagtttcgtttaggtttcgacgcgtgcggtttttattttttagttttgtttaggtttcgacgcgtgcgtgtagtttttatttcgtagttttgtttaggtttcgacgcgtgcgtgcggtttttatttcgtagttttgtttaggtttcgacgcgtgcgtgtagtttttatttcgtagtttcgtttaggtttcgacgcgtgcggtttttatttcgtagtttcgtttaggtttcgacgcgtgtagtttttatttcgtagtttcgtttaggtttcgacgcgtgtagtttttatttcgtagtttcgtttaggtttcgacgcgtgtagtttttatttcgtagtttcgtttaggtttcgacgcgtgcggtttttatttcgtagtttcgtttaggtttcgacgcgtgtagtttttatttcgtagtttcgtttaggtttcgacgcgtgtagtttttatttcgtagtttcgtttaggtttcgacgcgtgtagtttttatttcgtagtttcgtttaggtttcgacgcgtgcggtttttatttcgtagtttcgtttaggtttcgacgcgtgtagtttttatttcgtagtttcgtttaggtttcgacgcgtgtagtttttatttcgtagtttcgtttaggtttcgacgcgtgtagtttttatttcgtagtttcgtttaggtttcgacgcgtgcggtttttatttcgtagtttcgtttaggtttcgacgcgtgcggtttttatttcgtagtttcgtttaggtttcgacgcgtgtagtttt

SEQ ID NO: 37044 - DNA, 1007 bp, Artificial Sequence
  chemically treated genomic DNA (Homo sapiens) CpG-island No: 37044
aaaactacacgcgtcgaaacctaaacgaaactacgaaataaaaaccgcacgcgtcgaaacctaaacgaaactacgaaataaaaaccgcacgcgtcgaaacctaaacgaaactacgaaataaaaactacacgcgtcgaaacctaaacgaaactacgaaataaaaactacacgcgtcgaaacctaaacgaaactacgaaataaaaactacacgcgtcgaaacctaaacgaaactacgaaataaaaaccgcacgcgtcgaaacctaaacgaaactacgaaataaaaactacacgcgtcgaaacctaaacgaaactacgaaataaaaactacacgcgtcgaaacctaaacgaaactacgaaataaaaactacacgcgtcgaaacctaaacgaaactacgaaataaaaaccgcacgcgtcgaaacctaaacgaaactacgaaataaaaactacacgcgtcgaaacctaaacgaaactacgaaataaaaactacacgcgtcgaaacctaaacgaaactacgaaataaaaactacacgcgtcgaaacctaaacgaaactacgaaataaaaaccgcacgcgtcgaaacctaaacgaaactacgaaataaaaactacacgcacgcgtcgaaacctaaacaaaactacgaaataaaaaccgcacgcacgcgtcgaaacctaaacaaaactacgaaataaaaactacacgcacgcgtcgaaacctaaacaaaactaaaaaataaaaaccgcacgcgtcgaaacctaaacgaaactacgaaataaaaaccgcacgcgtcgaaacctaaacgaaactacgaaataaaaactacacgcgtcgaaacctaaacgaaactacgaaataaaaactacacgcgtcgaaacctaaacgaaactacgaaataaaaaccgcacacgtcgaaacctaaacgatactacgaaaaaaaaactacacgcgtcgaaacctaaacgaaactacgaaataaaaactacacgcattaaaacctaaacgaaactacg

SEQ ID NO: 37045 - DNA, 512 bp, Artificial Sequence
  chemically treated genomic DNA (Homo sapiens) CpG-island No: 37045
agttgaggacgcggtttttcggtggtaattttggtaattagttagcgcgtcgttggtttttcggaagttagatttcgtcgggttgagtcgagttacgttagcgtcgattggcgtcgtggaggagtttgcgtagaggagatatttgattcggtgggagacggttaggggagcgcgcgcggattggttggagtcgacgggggacggttgggcggggcgcggattgggggatcgtagtttcggggagcgtatcggaagttttcgtttggtttaggcgcggggtttaagatggtggcgttaggagtcgcgatttagtgatagcggtcgtggaggggttttcgatcgagcgggaggttgggggtagtttggaggtgagatttcgttgcgtttatagagttggcggtcgcggcgtttgcgtttatcggtaagcgaggagtggagtagagtttatatgtttatggggagaggtttgggggatcgtaggaggatgtaggcgtcgggtgcgtatgattggg

SEQ ID NO: 37046 - DNA, 512 bp, Artificial Sequence
  chemically treated genomic DNA (Homo sapiens) CpG-island No: 37046
cccaatcatacgcacccgacgcctacatcctcctacgatcccccaaacctctccccataaacatataaactctactccactcctcgcttaccgataaacgcaaacgccgcgaccgccaactctataaacgcaacgaaatctcacctccaaactacccccaacctcccgctcgatcgaaaacccctccacgaccgctatcactaaatcgcgactcctaacgccaccatcttaaaccccgcgcctaaaccaaacgaaaacttccgatacgctccccgaaactacgatcccccaatccgcgccccgcccaaccgtcccccgtcgactccaaccaatccgcgcgcgctcccctaaccgtctcccaccgaatcaaatatctcctctacgcaaactcctccacgacgccaatcgacgctaacgtaactcgactcaacccgacgaaatctaacttccgaaaaaccaacgacgcgctaactaattaccaaaattaccaccgaaaaaccgcgtcctcaact

SEQ ID NO: 37047 - DNA, 512 bp, Artificial Sequence
  chemically treated genomic DNA (Homo sapiens) CpG-island No: 37047
tttagttatgcgtattcggcgtttatatttttttgcggttttttaggtttttttttataggtatatgagttttgttttatttttcgtttgtcggtggacgtaggcgtcgcggtcgttagttttgtgaacgtagcggggttttatttttaggttatttttaatttttcgttcggtcgggggtttttttacggtcgttattattgggtcgcggtttttagcgttattattttggatttcgcgtttgggttaggcgagaattttcggtgcgtttttcgggattgcggttttttagttcgcgtttcgtttagtcgtttttcgtcggttttagttaattcgcgcgcgtttttttggtcgttttttatcggattaggtgttttttttgcgtagatttttttacgacgttagtcggcgttggcgtagttcggtttagttcggcggagtttgattttcggagggttagcggcgcgttggttggttattaaggttattatcgagaggtcgcgtttttagtt

SEQ ID NO: 37048 - DNA, 512 bp, Artificial Sequence
  chemically treated genomic DNA (Homo sapiens) CpG-island No: 37048
aactaaaaacgcgacctctcgataataaccttaataaccaaccaacgcgccgctaaccctccgaaaatcaaactccgccgaactaaaccgaactacgccaacgccgactaacgtcgtaaaaaaatctacgcaaaaaaaacacctaatccgataaaaaacgaccaaaaaaacgcgcgcgaattaactaaaaccgacgaaaaacgactaaacgaaacgcgaactaaaaaaccgcaatcccgaaaaacgcaccgaaaattctcgcctaacccaaacgcgaaatccaaaataataacgctaaaaaccgcgacccaataataacgaccgtaaaaaaacccccgaccgaacgaaaaattaaaaataacctaaaaataaaaccccgctacgttcacaaaactaacgaccgcgacgcctacgtccaccgacaaacgaaaaataaaacaaaactcatatacctataaaaaaaaacctaaaaaaccgcaaaaaaatataaacgccgaatacgcataactaaa

SEQ ID NO: 37049 - DNA, 699 bp, Artificial Sequence
  chemically treated genomic DNA (Homo sapiens) CpG-island No: 37049
  misc_feature (45)..(45): n is either a, c, g or t
  misc_feature (122)..(123): n is either a, c, g or t
tcgaaatagggttcgttttatttcggtcggggagcgcgggatttncgtggttatttagcgttatcgttcgcgggttcgttttgcgtaggcgcggcgttttcgttttttaaatttcggttcgnncgtggcgtggtgcgtaagcgtaatgtttttattagcgtttcgttttgattcggtcgtggtgcgtaggcgtagtttgcgtagggattggcgggattgcgcggaggcgattgtagacgtatcgggggttcggagtttgtcgcggttgttaagcgttcggcgtttggcgttggcgttggttaaggttgtgagtttttgtcgcggatcggggtagggtaggcgggggacgaggcggcggtaggagcgggacggtttttagcgggttcgagcggagcggtttttcgggttttcgcgttttttgttcggggatcgggaaggggttgggagagttttgggtcggtgcgagggggagtcgcggagtgtattcgggggtttggggagttcggtttttagtaggtaggtcgcgtttcggtgaaggtcgcgatttcgcgggtttgttgggcgtttttttcgtcgttttggttcgggtttggggttcggcgatttcgcgggttgaggtagtttttcgtttttgtttggcgggtggattcggggaggagtcgtgtttgtttaaggttatcggggtggagttttggttgg

SEQ ID NO: 37050 - DNA, 699 bp, Artificial Sequence
  chemically treated genomic DNA (Homo sapiens) CpG-island No: 37050
  misc_feature (577)..(578): n is either a, c, g or t
  misc_feature (655)..(655): n is either a, c, g or t
ccaaccaaaactccaccccgataaccttaaacaaacacgactcctccccgaatccacccgccaaacaaaaacgaaaaactacctcaacccgcgaaatcgccgaaccccaaacccgaaccaaaacgacgaaaaaaacgcccaacaaacccgcgaaatcgcgaccttcaccgaaacgcgacctacctactaaaaaccgaactccccaaacccccgaatacactccgcgactccccctcgcaccgacccaaaactctcccaaccccttcccgatccccgaacaaaaaacgcgaaaacccgaaaaaccgctccgctcgaacccgctaaaaaccgtcccgctcctaccgccgcctcgtcccccgcctaccctaccccgatccgcgacaaaaactcacaaccttaaccaacgccaacgccaaacgccgaacgcttaacaaccgcgacaaactccgaacccccgatacgtctacaatcgcctccgcgcaatcccgccaatccctacgcaaactacgcctacgcaccacgaccgaatcaaaacgaaacgctaataaaaacattacgcttacgcaccacgccacgnncgaaccgaaatttaaaaaacgaaaacgccgcgcctacgcaaaacgaacccgcgaacgataacgctaaataaccacgnaaatcccgcgctccccgaccgaaataaaacgaaccctatttcga

SEQ ID NO: 37051 - DNA, 699 bp, Artificial Sequence
  chemically treated genomic DNA (Homo sapiens) CpG-island No: 37051
  misc_feature (577)..(578): n is either a, c, g or t
  misc_feature (655)..(655): n is either a, c, g or t
ttagttaggattttatttcggtgattttgggtagatacgattttttttcgagtttattcgttaggtagaggcgaggggttattttagttcgcgaggtcgtcggattttaggttcggattaaagcggcggaggggacgtttagtaagttcgcggggtcgcgatttttatcgggacgcggtttatttgttaaggatcgagttttttaggttttcgagtatatttcgcggttttttttcgtatcggtttagggtttttttagttttttttcgattttcgggtagggggcgcggggattcggaagatcgtttcgttcggattcgttggggatcgtttcgtttttatcgtcgtttcgtttttcgtttgttttgtttcggttcgcggtagggatttatagttttggttagcgttagcgttaggcgtcgagcgtttagtagtcgcgataggtttcggattttcgatacgtttgtagtcgttttcgcgtagtttcgttagtttttgcgtagattgcgtttgcgtattacggtcgggttaaggcggggcgttagtggggatattgcgtttgcgtattacgttacgnncgggtcggggtttaaggggcggggacgtcgcgtttgcgtaaagcggattcgcggacggtggcgttgggtggttacgnaggtttcgcgtttttcgatcgagatagggcgggttttatttcgg

SEQ ID NO: 37052 - DNA, 699 bp, Artificial Sequence
  chemically treated genomic DNA (Homo sapiens) CpG-island No: 37052
  misc_feature (45)..(45): n is either a, c, g or t
  misc_feature (122)..(123): n is either a, c, g or t
ccgaaataaaacccgccctatctcgatcgaaaaacgcgaaacctncgtaaccacccaacgccaccgtccgcgaatccgctttacgcaaacgcgacgtccccgccccttaaaccccgacccgnncgtaacgtaatacgcaaacgcaatatccccactaacgccccgccttaacccgaccgtaatacgcaaacgcaatctacgcaaaaactaacgaaactacgcgaaaacgactacaaacgtatcgaaaatccgaaacctatcgcgactactaaacgctcgacgcctaacgctaacgctaaccaaaactataaatccctaccgcgaaccgaaacaaaacaaacgaaaaacgaaacgacgataaaaacgaaacgatccccaacgaatccgaacgaaacgatcttccgaatccccgcgccccctacccgaaaatcgaaaaaaaactaaaaaaaccctaaaccgatacgaaaaaaaaccgcgaaatatactcgaaaacctaaaaaactcgatccttaacaaataaaccgcgtcccgataaaaatcgcgaccccgcgaacttactaaacgtcccctccgccgctttaatccgaacctaaaatccgacgacctcgcgaactaaaataacccctcgcctctacctaacgaataaactcgaaaaaaaatcgtatctacccaaaatcaccgaaataaaatcctaactaa

SEQ ID NO: 37053 - DNA, 530 bp, Artificial Sequence
  chemically treated genomic DNA (Homo sapiens) CpG-island No: 37053
ggaagtagggttttcgcgtattttatggaattttttttgtagtatttggatcgttttttcgagtttttggcggttttaagtattatttacgttagtatttgggatttcgttatcgtgcgtcgggttttgtagtgggcgcgttatttgcgttatatttatcggcgttttggtcggtatggttttattcgtacggttttggagcggcggttgtataattagtggaggtaagagggcggttttgggcggggtttagtttcgggattagcgaatttttaggttttcggttattgtgacgttttgttttttttgcgtttgttggagaatcgggttttcggggatgtagttcgttattatttggtgtagtaattttttttcggtttcgtgtcgggacgtcgatgaggagatattttaagagagtttggttcgttttgttcgtcggcggtttgcggtgtatatgttgcgttttaatggttatagagagaatttaaatttttaggaggattttttgatgaagatttaggcggagttgt

SEQ ID NO: 37054 - DNA, 530 bp, Artificial Sequence
  chemically treated genomic DNA (Homo sapiens) CpG-island No: 37054
acaactccgcctaaatcttcatcaaaaaatcctcctaaaaatttaaattctctctataaccattaaaacgcaacatatacaccgcaaaccgccgacgaacaaaacgaaccaaactctcttaaaatatctcctcatcgacgtcccgacacgaaaccgaaaaaaaattactacaccaaataataacgaactacatccccgaaaacccgattctccaacaaacgcaaaaaaaacaaaacgtcacaataaccgaaaacctaaaaattcgctaatcccgaaactaaaccccgcccaaaaccgccctcttacctccactaattatacaaccgccgctccaaaaccgtacgaataaaaccataccgaccaaaacgccgataaatataacgcaaataacgcgcccactacaaaacccgacgcacgataacgaaatcccaaatactaacgtaaataatacttaaaaccgccaaaaactcgaaaaaacgatccaaatactacaaaaaaaattccataaaatacgcgaaaaccctacttcc

SEQ ID NO: 37055 - DNA, 530 bp, Artificial Sequence
  chemically treated genomic DNA (Homo sapiens) CpG-island No: 37055
gtagtttcgtttgggtttttattagagagtttttttggagatttgggttttttttatagttattgaagcgtagtatgtgtatcgtagatcgtcggcgggtaaggcgggttaggtttttttggagtgtttttttatcggcgtttcggtacggggtcgggaaagagttgttgtattaggtggtaacgagttgtattttcgagggttcggttttttagtaggcgtagagagagtaggacgttatagtgatcgagggtttggaagttcgttaatttcggaattggatttcgtttaaagtcgtttttttgtttttattggttgtgtagtcgtcgttttagagtcgtgcgaatggggttatgtcgattaaagcgtcgatggatgtggcgtaggtagcgcgtttattgtaaggttcggcgtacggtggcggggttttaggtgttgacgtaggtagtgtttgagatcgttagaagttcggaaaagcgatttaggtgttgtagaagggattttatgaggtgcgcgaaggttttattttt

SEQ ID NO: 37056 - DNA, 530 bp, Artificial Sequence
  chemically treated genomic DNA (Homo sapiens) CpG-island No: 37056
aaaaataaaaccttcgcgcacctcataaaatcccttctacaacacctaaatcgcttttccgaacttctaacgatctcaaacactacctacgtcaacacctaaaaccccgccaccgtacgccgaaccttacaataaacgcgctacctacgccacatccatcgacgctttaatcgacataaccccattcgcacgactctaaaacgacgactacacaaccaataaaaacaaaaaaacgactttaaacgaaatccaattccgaaattaacgaacttccaaaccctcgatcactataacgtcctactctctctacgcctactaaaaaaccgaaccctcgaaaatacaactcgttaccacctaatacaacaactctttcccgaccccgtaccgaaacgccgataaaaaaacactccaaaaaaacctaacccgccttacccgccgacgatctacgatacacatactacgcttcaataactataaaaaaaacccaaatctccaaaaaaactctctaataaaaacccaaacgaaactac

SEQ ID NO: 37057 - DNA, 1246 bp, Artificial Sequence
  chemically treated genomic DNA (Homo sapiens) CpG-island No: 37057
tcggttacgggtaagtaagtggtttcgcgttttcgttttttatttaggcggtcggtttggtttcgttatcgttcgtagcgttcgttcggggttcgcgcgggaagagggttttagttttatatgttgcggggtagtttcgggacgcgtagacgttagcgtcgttgagggtcgggttcgggatcggcgcggcgggggtttttagagcggtcggttacgtttttttaggttttaagtttttaatttgttgaatattttagattttaatagtaaaagcggttgacgttttcgcgggtaagcggtttttcggggtttgtagcgttttagggtattcgcgtcgttagttttacgcgcgagttcgcgtaggttttcgggttttcgtacgtttcgaggttttgagtttggacgaacgtaggtcgcgtggaggggtcggcgatttttgttcgagagtcgtttttttttggagggagcgagtataaggcgttcgcgggattcggttcgagtgttcgagcgtggaggggcgggcggttttcggcggtggggtcgttcgtagtgtttttagcgttcgggagggggcgttcggcggagcgtagacgggcgggttatcggcgcgggcgtttttgacgttatcggttcgcggtcgttagggtaacggttttatatcgcgtcgttagagtcgttagttttttgtaatcgttcgatttttcgtttttttttcgttcgcgttcggtcgcgcgtcgttttggcgttaaagcgacgtgtaaatgggaagttgcgtcgggcggcgggggcggggtagggggcggggattatcgggggtcggtatcgggcgcgggtcggggcgggatcgggtcgcgtgcggcggagcgcggcggtttcgggttgatatgcgcgcggtttcggaggtagtagtagcggcgcggtagtcggagtagtaggtattcgagtagtttagcggtcgagcgggcggttttttggtttgggcgtttcggtggcggcggaggtgaggcggcggtagcggcggtagcggcggtagcggcgggtttcgggcgggcggaggtggtcgtcgtgggggttcgcgcgggcgtcgggtcggggttcggggttgtagttatcgcgtagggtttttggttttgcgcgcgcggggttcgcgggcggggatttgatttggaacgtttcgggtttttttttgttggggggtcggggtaggagtgagttcgcggggtttaggggttggggagtcgggggt

SEQ ID NO: 37058 - DNA, 1246 bp, Artificial Sequence
  chemically treated genomic DNA (Homo sapiens) CpG-island No: 37058
acccccgactccccaacccctaaaccccgcgaactcactcctaccccgaccccccaacaaaaaaaaacccgaaacgttccaaatcaaatccccgcccgcgaaccccgcgcgcgcaaaaccaaaaaccctacgcgataactacaaccccgaaccccgacccgacgcccgcgcgaacccccacgacgaccacctccgcccgcccgaaacccgccgctaccgccgctaccgccgctaccgccgcctcacctccgccgccaccgaaacgcccaaaccaaaaaaccgcccgctcgaccgctaaactactcgaatacctactactccgactaccgcgccgctactactacctccgaaaccgcgcgcatatcaacccgaaaccgccgcgctccgccgcacgcgacccgatcccgccccgacccgcgcccgataccgacccccgataatccccgccccctaccccgcccccgccgcccgacgcaacttcccatttacacgtcgctttaacgccaaaacgacgcgcgaccgaacgcgaacgaaaaaaaaacgaaaaatcgaacgattacaaaaaactaacgactctaacgacgcgatataaaaccgttaccctaacgaccgcgaaccgataacgtcaaaaacgcccgcgccgataacccgcccgtctacgctccgccgaacgccccctcccgaacgctaaaaacactacgaacgaccccaccgccgaaaaccgcccgcccctccacgctcgaacactcgaaccgaatcccgcgaacgccttatactcgctccctccaaaaaaaaacgactctcgaacaaaaatcgccgacccctccacgcgacctacgttcgtccaaactcaaaacctcgaaacgtacgaaaacccgaaaacctacgcgaactcgcgcgtaaaactaacgacgcgaataccctaaaacgctacaaaccccgaaaaaccgcttacccgcgaaaacgtcaaccgcttttactattaaaatctaaaatattcaacaaattaaaaacttaaaacctaaaaaaacgtaaccgaccgctctaaaaacccccgccgcgccgatcccgaacccgaccctcaacgacgctaacgtctacgcgtcccgaaactaccccgcaacatataaaactaaaaccctcttcccgcgcgaaccccgaacgaacgctacgaacgataacgaaaccaaaccgaccgcctaaataaaaaacgaaaacgcgaaaccacttacttacccgtaaccga

SEQ ID NO: 37059 - DNA, 1246 bp, Artificial Sequence
  chemically treated genomic DNA (Homo sapiens) CpG-island No: 37059
attttcggttttttagtttttgagtttcgcggatttatttttatttcggttttttaataaaggggagttcgaggcgttttaggttagattttcgttcgcgaatttcgcgcgcgtaaggttagggattttgcgcggtggttgtaatttcgagtttcggttcggcgttcgcgcgagtttttacggcggttattttcgttcgttcggagttcgtcgttgtcgtcgttgtcgtcgttgtcgtcgttttattttcgtcgttatcggagcgtttaggttaggaagtcgttcgttcggtcgttgggttgttcgggtgtttattgtttcggttgtcgcgtcgttgttgttgttttcggggtcgcgcgtatgttagttcggagtcgtcgcgtttcgtcgtacgcggttcggtttcgtttcggttcgcgttcggtgtcgattttcggtagttttcgttttttgtttcgttttcgtcgttcggcgtagttttttatttgtacgtcgttttgacgttagagcgacgcgcggtcgagcgcgggcggagggagagcgggagatcgggcggttgtaagagattggcggttttgacggcgcggtatgaggtcgttgttttggcgatcgcgggtcggtgacgttaggggcgttcgcgtcgatggttcgttcgtttgcgtttcgtcgggcgttttttttcgggcgttgggggtattgcgggcggttttatcgtcgagggtcgttcgtttttttacgttcgggtattcgggtcgggtttcgcgggcgttttgtgttcgttttttttaggaggggacggttttcgggtaggggtcgtcggtttttttacgcggtttgcgttcgtttagatttagagtttcgggacgtgcgggggttcgggggtttgcgcgggttcgcgcgtggggttggcggcgcggatgttttggggcgttgtagatttcgagaggtcgtttgttcgcggggacgttagtcgtttttgttgttaaaatttgaaatgtttagtaagttagaaatttgaaatttaaggaagcgtgatcggtcgttttggaagttttcgtcgcgtcggtttcggattcggtttttagcggcgttggcgtttgcgcgtttcggggttgtttcgtagtatgtggggttgggatttttttttcgcgcgggtttcgggcggacgttgcgggcggtgacggagttaggtcggtcgtttgggtaggggacgggggcgcgggattatttgtttgttcgtggtcga

SEQ ID NO: 37060 - DNA, 1246 bp, Artificial Sequence
  chemically treated genomic DNA (Homo sapiens) CpG-island No: 37060
tcgaccacgaacaaacaaataatcccgcgcccccgtcccctacccaaacgaccgacctaactccgtcaccgcccgcaacgtccgcccgaaacccgcgcgaaaaaaaaatcccaaccccacatactacgaaacaaccccgaaacgcgcaaacgccaacgccgctaaaaaccgaatccgaaaccgacgcgacgaaaacttccaaaacgaccgatcacgcttccttaaatttcaaatttctaacttactaaacatttcaaattttaacaacaaaaacgactaacgtccccgcgaacaaacgacctctcgaaatctacaacgccccaaaacatccgcgccgccaaccccacgcgcgaacccgcgcaaacccccgaacccccgcacgtcccgaaactctaaatctaaacgaacgcaaaccgcgtaaaaaaaccgacgacccctacccgaaaaccgtcccctcctaaaaaaaacgaacacaaaacgcccgcgaaacccgacccgaatacccgaacgtaaaaaaacgaacgaccctcgacgataaaaccgcccgcaatacccccaacgcccgaaaaaaaacgcccgacgaaacgcaaacgaacgaaccatcgacgcgaacgcccctaacgtcaccgacccgcgatcgccaaaacaacgacctcataccgcgccgtcaaaaccgccaatctcttacaaccgcccgatctcccgctctccctccgcccgcgctcgaccgcgcgtcgctctaacgtcaaaacgacgtacaaataaaaaactacgccgaacgacgaaaacgaaacaaaaaacgaaaactaccgaaaatcgacaccgaacgcgaaccgaaacgaaaccgaaccgcgtacgacgaaacgcgacgactccgaactaacatacgcgcgaccccgaaaacaacaacaacgacgcgacaaccgaaacaataaacacccgaacaacccaacgaccgaacgaacgacttcctaacctaaacgctccgataacgacgaaaataaaacgacgacaacgacgacaacgacgacaacgacgaactccgaacgaacgaaaataaccgccgtaaaaactcgcgcgaacgccgaaccgaaactcgaaattacaaccaccgcgcaaaatccctaaccttacgcgcgcgaaattcgcgaacgaaaatctaacctaaaacgcctcgaactcccctttattaaaaaaccgaaataaaaataaatccgcgaaactcaaaaactaaaaaaccgaaaat

SEQ ID NO: 37061 - DNA, 504 bp, Artificial Sequence
  chemically treated genomic DNA (Homo sapiens) CpG-island No: 37061
  misc_feature (259)..(259): n is either a, c, g or t
tcgagcgcgtaatatattcggtttttattttcgtatatcgaagcggtttgacggtacgtcgaacggaattcgacgggtatttttcgggagaaataattacgaagcgtaacgcgttacgcgtaggttaagacgaagagacggcgttacggtttattcgtatacgtataggcgtacgcgattacgaatacgcgtagggaggacgttattttttacgcgggaggagagcgtaatagcgatacgcggcggttacgcggatttnacgtcgggcgggttatttatacggattcgatagggtatttttacgaaacgagaggggtaaatatattatatgcgtagacgcggggtttaatcggttcgttcggtttttttttatttgggcgatagaagcggcgggaattattttacgacggaggcgatcggacggaatattaattttacgttcgtagcgtacgatgggcggacgtttttttcgtaagggcgggggttttatttaattagataatt

SEQ ID NO: 37062 - DNA, 504 bp, Artificial Sequence
  chemically treated genomic DNA (Homo sapiens) CpG-island No: 37062
  misc_feature (246)..(246): n is either a, c, g or t
aattatctaattaaataaaacccccgcccttacgaaaaaaacgtccgcccatcgtacgctacgaacgtaaaattaatattccgtccgatcgcctccgtcgtaaaataattcccgccgcttctatcgcccaaataaaaaaaaaccgaacgaaccgattaaaccccgcgtctacgcatataatatatttacccctctcgtttcgtaaaaataccctatcgaatccgtataaataacccgcccgacgtnaaatccgcgtaaccgccgcgtatcgctattacgctctcctcccgcgtaaaaaataacgtcctccctacgcgtattcgtaatcgcgtacgcctatacgtatacgaataaaccgtaacgccgtctcttcgtcttaacctacgcgtaacgcgttacgcttcgtaattatttctcccgaaaaatacccgtcgaattccgttcgacgtaccgtcaaaccgcttcgatatacgaaaataaaaaccgaatatattacgcgctcga

SEQ ID NO: 37063 - DNA, 504 bp, Artificial Sequence
  chemically treated genomic DNA (Homo sapiens) CpG-island No: 37063
  misc_feature (246)..(246): n is either a, c, g or t
gattgtttaattggatgagattttcgtttttgcggagggggcgttcgtttatcgtgcgttgcgagcgtggggttggtgtttcgttcggtcgttttcgtcgtgaggtagttttcgtcgtttttgtcgtttaaatgaaaggggatcgagcgggtcggttaagtttcgcgtttgcgtatatagtgtgtttgtttttttcgtttcgtgggggtattttgtcgggttcgtatgggtaattcgttcgacgtnaggttcgcgtggtcgtcgcgtgtcgttgttgcgtttttttttcgcgtgagagatagcgttttttttgcgcgtgttcgtaatcgcgtgcgtttatgcgtgtacgagtaggtcgtagcgtcgttttttcgttttagtttacgcgtgacgcgttgcgtttcgtggttgtttttttcgagggatattcgtcgggtttcgttcgacgtgtcgttaggtcgtttcggtgtgcgagggtgaggatcgggtgtgttgcgcgttcgg

SEQ ID NO: 37064 - DNA, 504 bp, Artificial Sequence
  chemically treated genomic DNA (Homo sapiens) CpG-island No: 37064
  misc_feature (259)..(259): n is either a, c, g or t
ccgaacgcgcaacacacccgatcctcaccctcgcacaccgaaacgacctaacgacacgtcgaacgaaacccgacgaatatccctcgaaaaaaacaaccacgaaacgcaacgcgtcacgcgtaaactaaaacgaaaaaacgacgctacgacctactcgtacacgcataaacgcacgcgattacgaacacgcgcaaaaaaaacgctatctctcacgcgaaaaaaaaacgcaacaacgacacgcgacgaccacgcgaacctnacgtcgaacgaattacccatacgaacccgacaaaatacccccacgaaacgaaaaaaacaaacacactatatacgcaaacgcgaaacttaaccgacccgctcgatcccctttcatttaaacgacaaaaacgacgaaaactacctcacgacgaaaacgaccgaacgaaacaccaaccccacgctcgcaacgcacgataaacgaacgccccctccgcaaaaacgaaaatctcatccaattaaacaatc

SEQ ID NO: 37065 - DNA, 534 bp, Artificial Sequence
  chemically treated genomic DNA (Homo sapiens) CpG-island No: 37065
gacgtaggacgcgttttttattttgtggagcgttagagttgttaagtgcgttagttgtggagtggcgtagacgagttaagttttggtttgcgtggaggtcgacgatttcgtcgtagattacggatttgtttgggttttagtcgttaaagatttcgttcggtaggtgagtggtttattttgagggtaagttttttcggatcgaggtttttttatggtcgtttagatcgtgagcggtcggggttgttttttttgcggaggatggcgtttaatgagcgtagttgattcgaggtgggcgttggggtacgttttttttttggtatattgtttgaggggtattgaggtgaaagggcggttattgttcgggtcgtttttatatagcggttgtgcgttcgtttttgttagttttaatgtttttattttttggatacgtagaatagtgggtcgggatttttttgattttgttggcgatgcggttgggttttttgtagggcggtcgtagtgattttcgagaagggggttgttgggaggagaagg

SEQ ID NO: 37066 - DNA, 534 bp, Artificial Sequence
  chemically treated genomic DNA (Homo sapiens) CpG-island No: 37066
ccttctcctcccaacaacccccttctcgaaaatcactacgaccgccctacaaaaaacccaaccgcatcgccaacaaaatcaaaaaaatcccgacccactattctacgtatccaaaaaataaaaacattaaaactaacaaaaacgaacgcacaaccgctatataaaaacgacccgaacaataaccgccctttcacctcaatacccctcaaacaatataccaaaaaaaaaacgtaccccaacgcccacctcgaatcaactacgctcattaaacgccatcctccgcaaaaaaaacaaccccgaccgctcacgatctaaacgaccataaaaaaacctcgatccgaaaaaacttaccctcaaaataaaccactcacctaccgaacgaaatctttaacgactaaaacccaaacaaatccgtaatctacgacgaaatcgtcgacctccacgcaaaccaaaacttaactcgtctacgccactccacaactaacgcacttaacaactctaacgctccacaaaataaaaaacgcgtcctacgtc

SEQ ID NO: 37067 - DNA, 534 bp, Artificial Sequence
  chemically treated genomic DNA (Homo sapiens) CpG-island No: 37067
ttttttttttttagtaatttttttttcgggggttattgcggtcgttttataaaaggtttagtcgtatcgttagtaaagttagggagatttcggtttattattttacgtgtttaggagatgaagatattaagattggtagggacgggcgtataatcgttgtgtaaaaacgattcgaatagtgatcgtttttttattttagtattttttaaatagtatgttaaaagggagacgtgttttagcgtttatttcgaattaattgcgtttattagacgttatttttcgtaaagagagtagtttcggtcgtttacgatttgagcggttatgaagaagtttcgattcgagaaggtttgtttttaaagtgagttatttatttatcggacggggtttttggcggttgagatttagataggttcgtagtttgcgacggagtcgtcgatttttacgtagattaggatttaattcgtttacgttattttataattgacgtatttagtagttttggcgttttataaaatggagggcgcgttttacgtt

SEQ ID NO: 37068 - DNA, 534 bp, Artificial Sequence
  chemically treated genomic DNA (Homo sapiens) CpG-island No: 37068
aacgtaaaacgcgccctccattttataaaacgccaaaactactaaatacgtcaattataaaataacgtaaacgaattaaatcctaatctacgtaaaaatcgacgactccgtcgcaaactacgaacctatctaaatctcaaccgccaaaaaccccgtccgataaataaataactcactttaaaaacaaaccttctcgaatcgaaacttcttcataaccgctcaaatcgtaaacgaccgaaactactctctttacgaaaaataacgtctaataaacgcaattaattcgaaataaacgctaaaacacgtctcccttttaacatactatttaaaaaatactaaaataaaaaaacgatcactattcgaatcgtttttacacaacgattatacgcccgtccctaccaatcttaatatcttcatctcctaaacacgtaaaataataaaccgaaatctccctaactttactaacgatacgactaaaccttttataaaacgaccgcaataacccccgaaaaaaaaattactaaaaaaaaaaaa

SEQ ID NO: 37069 - DNA, 854 bp, Artificial Sequence
  chemically treated genomic DNA (Homo sapiens) CpG-island No: 37069
ttagattttcgatgcgttcgtttttgcgttacgtgattttttgtttgtttggtcgcgcgatttcgttttcgggttcgggttgttcggagttgttcgcgttgttgaggtcggcgggcggggcggggcggggcggggcgcgtagtaggtggagtaggcggttcgggtaggggcgtggtttgttatgaggggcgtggtttggcgggggtgtggtcggaagtttaaagtggtttggtcgtcggggcgggtcgtggagcggttagtcgcggcgatttttttttcgtttttggagtgttatcgttattatgtttttaatggtttcggttggtcggggtttgggggtcgtgtggtttttaatttacgtgtaggtgacggtgttgaggcgcgggtttggcgttaagggttcgggggtacgagcgagcgtacgcggtgatttaggtgggtaaggagaagtacgttatttcgtgtcggagcgtagtttggcgcgtgtggcgcgaggaggttattttcgagttgttatcgttgttgtttttcggattcgcggtcgtcgttattttgtagtttatcgtgttgtatcgcgcgttgttcggtttcgataagtttttgggtcgcgtcgaggtggatttgcgggatttgtatcgcgattagggtcgtaggaagacgtagtgagtgcgggcggggaggggagggttcggtttgggggcgcggatttttcggtagggcggtttgggcgttggatttttcgagagtaagtcgggtagtagcggggaaggtttttcgggacggagttttcggtcggtgttggtgtttttatttggtttttttttttgcggttgtttcgtttagttttgttagtt

SEQ ID NO: 37070 - DNA, 854 bp, Artificial Sequence
  chemically treated genomic DNA (Homo sapiens) CpG-island No: 37070
aactaacaaaactaaacgaaacaaccgcaaaaaaaaaaaccaaataaaaacaccaacaccgaccgaaaactccgtcccgaaaaaccttccccgctactacccgacttactctcgaaaaatccaacgcccaaaccgccctaccgaaaaatccgcgcccccaaaccgaaccctcccctccccgcccgcactcactacgtcttcctacgaccctaatcgcgatacaaatcccgcaaatccacctcgacgcgacccaaaaacttatcgaaaccgaacaacgcgcgatacaacacgataaactacaaaataacgacgaccgcgaatccgaaaaacaacaacgataacaactcgaaaataacctcctcgcgccacacgcgccaaactacgctccgacacgaaataacgtacttctccttacccacctaaatcaccgcgtacgctcgctcgtacccccgaacccttaacgccaaacccgcgcctcaacaccgtcacctacacgtaaattaaaaaccacacgacccccaaaccccgaccaaccgaaaccattaaaaacataataacgataacactccaaaaacgaaaaaaaaatcgccgcgactaaccgctccacgacccgccccgacgaccaaaccactttaaacttccgaccacacccccgccaaaccacgcccctcataacaaaccacgcccctacccgaaccgcctactccacctactacgcgccccgccccgccccgccccgcccgccgacctcaacaacgcgaacaactccgaacaacccgaacccgaaaacgaaatcgcgcgaccaaacaaacaaaaaatcacgtaacgcaaaaacgaacgcatcgaaaatctaa

SEQ ID NO: 37071 - DNA, 854 bp, Artificial Sequence
  chemically treated genomic DNA (Homo sapiens) CpG-island No: 37071
agttggtagagttgggcgggatagtcgtagaaggggaagttaggtgagaatattagtatcggtcgagggtttcgtttcgaaaggtttttttcgttgttgttcggtttattttcgaagggtttagcgtttagatcgttttgtcggagggttcgcgtttttaggtcgggttttttttttttcgttcgtatttattgcgtttttttgcggttttggtcgcggtgtagatttcgtaggtttatttcggcgcggtttaggaatttgtcgaggtcgagtagcgcgcggtgtagtacggtgagttgtagggtggcggcggtcgcgggttcggaggatagtagcgatggtagttcgaaggtggttttttcgcgttatacgcgttaggttgcgtttcgatacggagtggcgtatttttttttgtttatttggattatcgcgtacgttcgttcgtgttttcgggtttttggcgttaggttcgcgttttagtatcgttatttgtacgtgggttggggattatacggtttttaggtttcggttagtcgagattattagggatatggtgacgataatattttagaagcgaggagaagatcgtcgcgattggtcgttttacggttcgtttcggcgattaggttattttaagttttcggttatattttcgttaagttacgttttttatggtaagttacgtttttgttcgagtcgtttgttttatttgttgcgcgtttcgtttcgtttcgtttcgttcgtcggttttagtagcgcgggtagtttcgggtaattcgggttcggaggcggggtcgcgcggttaggtaggtaggggattacgtgacgtaggggcgggcgtatcgagaatttaa

SEQ ID NO: 37072 - DNA, 854 bp, Artificial Sequence
  chemically treated genomic DNA (Homo sapiens) CpG-island No: 37072
ttaaattctcgatacgcccgcccctacgtcacgtaatcccctacctacctaaccgcgcgaccccgcctccgaacccgaattacccgaaactacccgcgctactaaaaccgacgaacgaaacgaaacgaaacgaaacgcgcaacaaataaaacaaacgactcgaacaaaaacgtaacttaccataaaaaacgtaacttaacgaaaatataaccgaaaacttaaaataacctaatcgccgaaacgaaccgtaaaacgaccaatcgcgacgatcttctcctcgcttctaaaatattatcgtcaccatatccctaataatctcgactaaccgaaacctaaaaaccgtataatccccaacccacgtacaaataacgatactaaaacgcgaacctaacgccaaaaacccgaaaacacgaacgaacgtacgcgataatccaaataaacaaaaaaaaatacgccactccgtatcgaaacgcaacctaacgcgtataacgcgaaaaaaccaccttcgaactaccatcgctactatcctccgaacccgcgaccgccgccaccctacaactcaccgtactacaccgcgcgctactcgacctcgacaaattcctaaaccgcgccgaaataaacctacgaaatctacaccgcgaccaaaaccgcaaaaaaacgcaataaatacgaacgaaaaaaaaaaaacccgacctaaaaacgcgaaccctccgacaaaacgatctaaacgctaaacccttcgaaaataaaccgaacaacaacgaaaaaaacctttcgaaacgaaaccctcgaccgatactaatattctcacctaacttccccttctacgactatcccgcccaactctaccaact

SEQ ID NO: 37073 - DNA, 704 bp, Artificial Sequence
  chemically treated genomic DNA (Homo sapiens) CpG-island No: 37073
gcgcggtcgtcggttaggcgggtattttcggcggagcgtagttttatcggggtcggggttagagacgcgacggcgtcggcggagatttttcgggcggaaagcggtttagtttttacgtagtaagcgtagtggcgcgtagttattacgaaaattcgcgcgtagacgaagagtattacgagaagaggaaggtagaaggagacggaggaggatagtagtacgtagggtatgttggaggcgaaggtatagtagcgcgggttggagtggtagcgtgtttcggcgtcgtttttacgcgttattattggtttatgatgggcgtaaacgatatcgcggtcgatacgatttatattaggattatagttgttcgggcgtagcgtttggtgattagtgcgtcgtaacgtagcgggttggttatagttaggtagcggtttacggttagggcgtatagggtttcgatgttggcggttatatatagtacgtttatcgaggtttatagttcgtagttagtggcgtttaacggttagtggttagttagcgttaaggtggtcgtcggcggtattattaggagttttattattaggtcggttgcggttagcgaagttacgaatacgttggttatggtttggagtttcggagtttaggcgatggttacgatgattagtaggttgttttttacggtggttagtatcgttagcgttagtagggtt

SEQ ID NO: 37074 - DNA, 704 bp, Artificial Sequence
  chemically treated genomic DNA (Homo sapiens) CpG-island No: 37074
aaccctactaacgctaacgatactaaccaccgtaaaaaacaacctactaatcatcgtaaccatcgcctaaactccgaaactccaaaccataaccaacgtattcgtaacttcgctaaccgcaaccgacctaataataaaactcctaataataccgccgacgaccaccttaacgctaactaaccactaaccgttaaacgccactaactacgaactataaacctcgataaacgtactatatataaccgccaacatcgaaaccctatacgccctaaccgtaaaccgctacctaactataaccaacccgctacgttacgacgcactaatcaccaaacgctacgcccgaacaactataatcctaatataaatcgtatcgaccgcgatatcgtttacgcccatcataaaccaataataacgcgtaaaaacgacgccgaaacacgctaccactccaacccgcgctactataccttcgcctccaacataccctacgtactactatcctcctccgtctccttctaccttcctcttctcgtaatactcttcgtctacgcgcgaattttcgtaataactacgcgccactacgcttactacgtaaaaactaaaccgctttccgcccgaaaaatctccgccgacgccgtcgcgtctctaaccccgaccccgataaaactacgctccgccgaaaatacccgcctaaccgacgaccgcgc

SEQ ID NO: 37075 - DNA, 704 bp, Artificial Sequence
  chemically treated genomic DNA (Homo sapiens) CpG-island No: 37075
ggttttgttggcgttggcggtgttggttatcgtgggaggtaatttgttggttatcgtggttatcgtttggatttcgagattttagattatgattaacgtgttcgtgatttcgttggtcgtagtcgatttggtgatgggatttttggtggtgtcgtcggcggttattttggcgttgattggttattggtcgttgggcgttattggttgcgagttgtggatttcggtggacgtgttgtgtgtgatcgttagtatcgaaattttgtgcgttttggtcgtggatcgttatttggttgtgattaattcgttgcgttacggcgtattggttattaagcgttgcgttcggatagttgtggttttggtgtgggtcgtgtcggtcgcggtgtcgtttgcgtttattatgagttagtggtggcgcgtaggggcgacgtcgaggtacgttgttattttaattcgcgttgttgtgttttcgtttttaatatgttttacgtgttgttgttttttttcgtttttttttattttttttttttcgtgatgtttttcgtttacgcgcgggttttcgtggtggttacgcgttattgcgtttgttgcgtgggagttgggtcgtttttcgttcgaggagttttcgtcggcgtcgtcgcgtttttggtttcggtttcggtggagttgcgtttcgtcgaaggtgttcgtttggtcggcggtcgcgt

SEQ ID NO: 37076 - DNA, 704 bp, Artificial Sequence
  chemically treated genomic DNA (Homo sapiens) CpG-island No: 37076
acgcgaccgccgaccaaacgaacaccttcgacgaaacgcaactccaccgaaaccgaaaccaaaaacgcgacgacgccgacgaaaactcctcgaacgaaaaacgacccaactcccacgcaacaaacgcaataacgcgtaaccaccacgaaaacccgcgcgtaaacgaaaaacatcacgaaaaaaaaaaaataaaaaaaaacgaaaaaaaacaacaacacgtaaaacatattaaaaacgaaaacacaacaacgcgaattaaaataacaacgtacctcgacgtcgcccctacgcgccaccactaactcataataaacgcaaacgacaccgcgaccgacacgacccacaccaaaaccacaactatccgaacgcaacgcttaataaccaatacgccgtaacgcaacgaattaatcacaaccaaataacgatccacgaccaaaacgcacaaaatttcgatactaacgatcacacacaacacgtccaccgaaatccacaactcgcaaccaataacgcccaacgaccaataaccaatcaacgccaaaataaccgccgacgacaccaccaaaaatcccatcaccaaatcgactacgaccaacgaaatcacgaacacgttaatcataatctaaaatctcgaaatccaaacgataaccacgataaccaacaaattacctcccacgataaccaacaccgccaacgccaacaaaacc

SEQ ID NO: 37077 - DNA, 820 bp, Artificial Sequence
  chemically treated genomic DNA (Homo sapiens) CpG-island No: 37077
ggattttcgcgcggttttgagtcgtcgtttttaatttagttaaggattaatttaggcgagttatttcgttcgttatttttatattcgtttttgttagcgtggcgggagggatttcggacggaggggtagtcgttgcggggcggcgttagcgttcgtgcggaagagttcgtgagtagacgggagtgggtcggggggcggcgggggattttacgtggaagtagcgttttggagttgggtggggttgcggcgcggattataaattttaggggcgtggggcgggagaggcggaaggggcgttttggggcggggcgggacggggcgaggcggagcgaggttggaggcgcgggagggtagcgagaggttcgcgggtgtagcgtataggagattatgttcgggggtagtagttgtagttagattttaagtcgggttattttcgttattcgtcgggtggtgttcggcgacggcgtgtagttttcgttcggggattatagtacgattttcggcggtacgttttttagtattatttcgggaggtaggcgcgggtttggcgacgcgtttgtcggtttttgggcgggcgggaggatcgggaatcgcggattggatcgggtgtttaggtttaagggcgtcgtgattggaaagaacggaaaaggggtatcggagagatagcgagggttatggaagtggtcgttcgttttttttttgagtgcgttttttagattcgagttataaattgtttcgtttgttttttttttttgttaggtgttagatagttgatatttaataaatacgtacgtttttaggatagttatatgtcgagttg

SEQ ID NO: 37078 - DNA, 820 bp, Artificial Sequence
  chemically treated genomic DNA (Homo sapiens) CpG-island No: 37078
caactcgacatataactatcctaaaaacgtacgtatttattaaatatcaactatctaacacctaacaaaaaaaaaaaacaaacgaaacaatttataactcgaatctaaaaaacgcactcaaaaaaaaaacgaacgaccacttccataaccctcgctatctctccgataccccttttccgttctttccaatcacgacgcccttaaacctaaacacccgatccaatccgcgattcccgatcctcccgcccgcccaaaaaccgacaaacgcgtcgccaaacccgcgcctacctcccgaaataatactaaaaaacgtaccgccgaaaatcgtactataatccccgaacgaaaactacacgccgtcgccgaacaccacccgacgaataacgaaaataacccgacttaaaatctaactacaactactacccccgaacataatctcctatacgctacacccgcgaacctctcgctaccctcccgcgcctccaacctcgctccgcctcgccccgtcccgccccgccccaaaacgccccttccgcctctcccgccccacgcccctaaaatttataatccgcgccgcaaccccacccaactccaaaacgctacttccacgtaaaatcccccgccgccccccgacccactcccgtctactcacgaactcttccgcacgaacgctaacgccgccccgcaacgactacccctccgtccgaaatccctcccgccacgctaacaaaaacgaatataaaaataacgaacgaaataactcgcctaaattaatccttaactaaattaaaaacgacgactcaaaaccgcgcgaaaatcc

SEQ ID NO: 37079 - DNA, 820 bp, Artificial Sequence
  chemically treated genomic DNA (Homo sapiens) CpG-island No: 37079
tagttcggtatgtggttgttttggaggcgtgcgtgtttgttaggtgttagttgtttgatatttaatagaaagaggaaataaacggggtagtttgtaattcgggtttggaagacgtatttagaggggaagcgggcggttatttttatgattttcgttgttttttcgatgtttttttttcgttttttttaattacggcgtttttgagtttggatattcggtttaattcgcgattttcgattttttcgttcgtttaggagtcggtaagcgcgtcgttaagttcgcgtttatttttcggggtggtgttgaagagcgtgtcgtcgggggtcgtgttgtagttttcgggcgggagttgtacgtcgtcgtcgagtattattcggcgagtggcggggatggttcggtttggggtttggttgtagttgttgttttcggatatggttttttgtgcgttgtattcgcgaatttttcgttgttttttcgcgtttttagtttcgtttcgtttcgtttcgtttcgtttcgttttaggacgtttttttcgtttttttcgttttacgtttttgggatttgtagttcgcgtcgtagttttatttagttttaggacgttgtttttacgtgggatttttcgtcgtttttcgatttattttcgtttgtttacgggttttttcgtacgggcgttggcgtcgtttcgtagcgattgttttttcgttcggggtttttttcgttacgttggtagggacggatatggggatggcgggcgggatagttcgtttaaattaatttttggttgggttgggggcggcgatttaggatcgcgcggagattt

SEQ ID NO: 37080 - DNA, 820 bp, Artificial Sequence
  chemically treated genomic DNA (Homo sapiens) CpG-island No: 37080
aaatctccgcgcgatcctaaatcgccgcccccaacccaaccaaaaattaatttaaacgaactatcccgcccgccatccccatatccgtccctaccaacgtaacgaaaaaaaccccgaacgaaaaaacaatcgctacgaaacgacgccaacgcccgtacgaaaaaacccgtaaacaaacgaaaataaatcgaaaaacgacgaaaaatcccacgtaaaaacaacgtcctaaaactaaataaaactacgacgcgaactacaaatcccaaaaacgtaaaacgaaaaaaacgaaaaaaacgtcctaaaacgaaacgaaacgaaacgaaacgaaacgaaactaaaaacgcgaaaaaacaacgaaaaattcgcgaatacaacgcacaaaaaaccatatccgaaaacaacaactacaaccaaaccccaaaccgaaccatccccgccactcgccgaataatactcgacgacgacgtacaactcccgcccgaaaactacaacacgacccccgacgacacgctcttcaacaccaccccgaaaaataaacgcgaacttaacgacgcgcttaccgactcctaaacgaacgaaaaaatcgaaaatcgcgaattaaaccgaatatccaaactcaaaaacgccgtaattaaaaaaaacgaaaaaaaaacatcgaaaaaacaacgaaaatcataaaaataaccgcccgcttcccctctaaatacgtcttccaaacccgaattacaaactaccccgtttatttcctctttctattaaatatcaaacaactaacacctaacaaacacgcacgcctccaaaacaaccacataccgaacta

SEQ ID NO: 37081 - DNA, 949 bp, Artificial Sequence
  chemically treated genomic DNA (Homo sapiens) CpG-island No: 37081
tgtcgtcggtttttatttaggtcgaggtggttcggttttatgtatcgcgacgtaacgcggggaggtagataaggtatagggcggcgtttataatttatgttaattcgttttatgtgttcgtcgaggcggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcggtcgacgtttttttttatgcgatttttgtattaggaagtagtttagtagtaggttgaggtcgttgagtatcgtcgtcgtaaggaatggtgtatgtaaggagatggcgtttaatagtttttcggttacggggtttgttattatatttacgtcgaaataagcgtttatgagttcgaagtggcgagttcgattttttttatcggtgatgtcggcgatataggcgttagtaatcgtatttgtggcgtcggtgatgtcggttacgatgcgttcggcgtagaggatttattattgatttttaattaggtattttttttt

SEQ ID NO: 37082 - DNA, 949 bp, Artificial Sequence
  chemically treated genomic DNA (Homo sapiens) CpG-island No: 37082
aaaaaaaaatacctaattaaaaatcaataataaatcctctacgccgaacgcatcgtaaccgacatcaccgacgccacaaatacgattactaacgcctatatcgccgacatcaccgataaaaaaaatcgaactcgccacttcgaactcataaacgcttatttcgacgtaaatataataacaaaccccgtaaccgaaaaactattaaacgccatctccttacatacaccattccttacgacgacgatactcaacgacctcaacctactactaaactacttcctaatacaaaaatcgcataaaaaaaaacgtcgaccgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgcctcgacgaacacataaaacgaattaacataaattataaacgccgccctataccttatctacctccccgcgttacgtcgcgatacataaaaccgaaccacctcgacctaaataaaaaccgacgaca

SEQ ID NO: 37083 - DNA, 949 bp, Artificial Sequence
  chemically treated genomic DNA (Homo sapiens) CpG-island No: 37083
aaaaaaaaatatttaattgaaagttaataatagattttttacgtcggacgtatcgtggtcggtattatcggcgttataggtgcggttgttggcgtttatatcgtcgatattatcgatggggaagatcgggttcgttatttcgggtttatgagcgtttgtttcggcgtgggtatggtggtaggtttcgtggtcgggggattgttgggcgttatttttttgtatgtattattttttgcggcggcggtgtttaacggttttaatttattattgggttgttttttaatgtaggagtcgtataagggagagcgtcgatcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgtttcggcgagtatatggaacgggttggtatggattgtaggcgtcgttttatattttgtttgttttttcgcgttgcgtcgcggtgtatggagtcgggttatttcgatttgaatggaagtcggcggta

SEQ ID NO: 37084 - DNA, 949 bp, Artificial Sequence
  chemically treated genomic DNA (Homo sapiens) CpG-island No: 37084
taccgccgacttccattcaaatcgaaataacccgactccatacaccgcgacgcaacgcgaaaaaacaaacaaaatataaaacgacgcctacaatccataccaacccgttccatatactcgccgaaacgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgatcgacgctctcccttatacgactcctacattaaaaaacaacccaataataaattaaaaccgttaaacaccgccgccgcaaaaaataatacatacaaaaaaataacgcccaacaatcccccgaccacgaaacctaccaccatacccacgccgaaacaaacgctcataaacccgaaataacgaacccgatcttccccatcgataatatcgacgatataaacgccaacaaccgcacctataacgccgataataccgaccacgatacgtccgacgtaaaaaatctattattaactttcaattaaatattttttttt

SEQ ID NO: 37085 - DNA, 567 bp, Artificial Sequence
  chemically treated genomic DNA (Homo sapiens) CpG-island No: 37085
gcggcgtcggggcgcgcggggcgaatttcggcggcggtcggggagttgggggagagtcgcggaaggcgggcggtgggggtacggcgtagggagtttgcgggggtgtgcgtaatagcgttagaatttagttaggtagggtgggcgcgggcgttaggggacggtcgcggcgcggtgttggggcgcggggagtgcgaaaggtaggaggagggtttaggggttcgggcgttgggggcggcggcggggtcgggagcggggttaggtattttaggggcggcgttagtagtttttcgggcgttggggtcgcggggtttacggaggtggcgggcggggggatggagaagagtttcgtgaagttgggtatcgagtcgttgataaacgttacgtttttatagacgtgttgcgggaaggttttgttagcggattggtttttttcgggtttagggatttcggttgaagcgatttgcgacgtgcgtacgtggtacgggaagtttttgttggtcgttgatgggcgggttatgatttgaggttagggttaggagtaggtgtgagaggtattgttaggtcgga

SEQ ID NO: 37086 - DNA, 567 bp, Artificial Sequence
  chemically treated genomic DNA (Homo sapiens) CpG-island No: 37086
tccgacctaacaatacctctcacacctactcctaaccctaacctcaaatcataacccgcccatcaacgaccaacaaaaacttcccgtaccacgtacgcacgtcgcaaatcgcttcaaccgaaatccctaaacccgaaaaaaaccaatccgctaacaaaaccttcccgcaacacgtctataaaaacgtaacgtttatcaacgactcgatacccaacttcacgaaactcttctccatccccccgcccgccacctccgtaaaccccgcgaccccaacgcccgaaaaactactaacgccgcccctaaaatacctaaccccgctcccgaccccgccgccgcccccaacgcccgaacccctaaaccctcctcctacctttcgcactccccgcgccccaacaccgcgccgcgaccgtcccctaacgcccgcgcccaccctacctaactaaattctaacgctattacgcacacccccgcaaactccctacgccgtacccccaccgcccgccttccgcgactctcccccaactccccgaccgccgccgaaattcgccccgcgcgccccgacgccgc

SEQ ID NO: 37087 - DNA, 567 bp, Artificial Sequence
  chemically treated genomic DNA (Homo sapiens) CpG-island No: 37087
ttcggtttgatagtgttttttatatttgtttttggttttggttttagattatgattcgtttattagcggttaataagaatttttcgtattacgtgcgtacgtcgtagatcgttttagtcggagtttttggattcggagggagttaattcgttgataaggttttttcgtagtacgtttatgggaacgtgacgtttattagcgattcggtgtttaattttacggagtttttttttattttttcgttcgttattttcgtaagtttcgcggttttagcgttcgaggagttgttggcgtcgtttttggagtatttgatttcgttttcggtttcgtcgtcgtttttagcgttcggatttttgagttttttttttgtttttcgtatttttcgcgttttaatatcgcgtcgcgatcgttttttggcgttcgcgtttattttgtttgattgggttttggcgttgttgcgtatattttcgtagattttttgcgtcgtgtttttatcgttcgtttttcgcggtttttttttagtttttcggtcgtcgtcggagttcgtttcgcgcgtttcgacgtcgt

SEQ ID NO: 37088 - DNA, 567 bp, Artificial Sequence
  chemically treated genomic DNA (Homo sapiens) CpG-island No: 37088
acgacgtcgaaacgcgcgaaacgaactccgacgacgaccgaaaaactaaaaaaaaaccgcgaaaaacgaacgataaaaacacgacgcaaaaaatctacgaaaatatacgcaacaacgccaaaacccaatcaaacaaaataaacgcgaacgccaaaaaacgatcgcgacgcgatattaaaacgcgaaaaatacgaaaaacaaaaaaaaaactcaaaaatccgaacgctaaaaacgacgacgaaaccgaaaacgaaatcaaatactccaaaaacgacgccaacaactcctcgaacgctaaaaccgcgaaacttacgaaaataacgaacgaaaaaataaaaaaaaactccgtaaaattaaacaccgaatcgctaataaacgtcacgttcccataaacgtactacgaaaaaaccttatcaacgaattaactccctccgaatccaaaaactccgactaaaacgatctacgacgtacgcacgtaatacgaaaaattcttattaaccgctaataaacgaatcataatctaaaaccaaaaccaaaaacaaatataaaaaacactatcaaaccgaa

SEQ ID NO: 37089 - DNA, 541 bp, Artificial Sequence
  chemically treated genomic DNA (Homo sapiens) CpG-island No: 37089
ttcgcgtcggtcgttattttttcggtttcggtgatcgagtacgcgtgtttttttattagtttttgaaacgtgatggttttcgagttcgcggcgttggtgatttgtaaatatagtaatcgttagattggtcgtattcgttttttttttttttcggattttttcgttttttttgttttattgtcgggcgggatcgtcggacgtattagcgtagcggtcgaggtttggggtgggaggtttagggttgcgtttttttgtatttggagaattttttttatttcgtttaaatgtttgaacgtcgagaatattagagaaaaggcggaatgtaattttttcgcggaacgagtataggtattttcgtgtgaatagcgtatttacggatttttgtaggttgggaagggcgggaaagggcgtacggtcgagagagggttggagggggttttcgatggcgtagggaaagggcgtacggtcgagagagggtcggagggggttttcgatggcgtagggttgatatttagatagttttgagtggtttagggatatt

SEQ ID NO: 37090 - DNA, 541 bp, Artificial Sequence
  chemically treated genomic DNA (Homo sapiens) CpG-island No: 37090
aatatccctaaaccactcaaaactatctaaatatcaaccctacgccatcgaaaaccccctccgaccctctctcgaccgtacgccctttccctacgccatcgaaaaccccctccaaccctctctcgaccgtacgccctttcccgcccttcccaacctacaaaaatccgtaaatacgctattcacacgaaaatacctatactcgttccgcgaaaaaattacattccgccttttctctaatattctcgacgttcaaacatttaaacgaaataaaaaaaattctccaaatacaaaaaaacgcaaccctaaacctcccaccccaaacctcgaccgctacgctaatacgtccgacgatcccgcccgacaataaaacaaaaaaaacgaaaaaatccgaaaaaaaaaaaaaacgaatacgaccaatctaacgattactatatttacaaatcaccaacgccgcgaactcgaaaaccatcacgtttcaaaaactaataaaaaaacacgcgtactcgatcaccgaaaccgaaaaaataacgaccgacgcgaa

SEQ ID NO: 37091 - DNA, 541 bp, Artificial Sequence
  chemically treated genomic DNA (Homo sapiens) CpG-island No: 37091
agtgtttttgggttatttaaggttgtttgggtattagttttgcgttatcgaggatttttttcggttttttttcggtcgtgcgttttttttttgcgttatcgaggattttttttagttttttttcggtcgtgcgttttttttcgttttttttagtttgtagaaattcgtggatgcgttatttatacgggaatgtttgtgttcgtttcgcgagagggttgtatttcgttttttttttggtattttcggcgtttaagtatttgaacggggtaggaaaggttttttaagtgtaagaaagcgtagttttgagttttttattttaggtttcggtcgttgcgttagtgcgttcggcggtttcgttcggtagtaggatagagggagcgagggagttcgggaggaagggagagcgggtgcggttagtttgacggttgttgtgtttgtagattattagcgtcgcggattcggaggttattacgttttagaagttggtgaaggggtacgcgtattcggttatcggagtcgaggaggtaacggtcggcgcgga

SEQ ID NO: 37092 - DNA, 541 bp, Artificial Sequence
  chemically treated genomic DNA (Homo sapiens) CpG-island No: 37092
tccgcgccgaccgttacctcctcgactccgataaccgaatacgcgtaccccttcaccaacttctaaaacgtaataacctccgaatccgcgacgctaataatctacaaacacaacaaccgtcaaactaaccgcacccgctctcccttcctcccgaactccctcgctccctctatcctactaccgaacgaaaccgccgaacgcactaacgcaacgaccgaaacctaaaataaaaaactcaaaactacgctttcttacacttaaaaaacctttcctaccccgttcaaatacttaaacgccgaaaataccaaaaaaaaaacgaaatacaaccctctcgcgaaacgaacacaaacattcccgtataaataacgcatccacgaatttctacaaactaaaaaaaacgaaaaaaaacgcacgaccgaaaaaaaactaaaaaaaatcctcgataacgcaaaaaaaaaacgcacgaccgaaaaaaaaccgaaaaaaatcctcgataacgcaaaactaatacccaaacaaccttaaataacccaaaaacact

SEQ ID NO: 37093 - DNA, 1216 bp, Artificial Sequence
  chemically treated genomic DNA (Homo sapiens) CpG-island No: 37093
cgcgggcggttcgtttgatttcggagtagttggaggaattcgtttcgaggttagggtttcgtcgcgtttttacgacggttgtgggcgtagagtttagaggatggagttttttttttttgaaattcgttcgaagttcggaaagtttcggttttttcgcgcgggttgcggtttttaggtttttttttcgacgcgttcgagggcgcggattagttttcggtacgcgatttcgtatattttcgggttcgacgttttggtcgttcgtttatttatcggtattattttggattcgaatcgtatggaagcgggtggttagattgcggtttcggtcgagttgaggtgtttcggagggtcgcggatgcgggggaggggagcggagagcgaggtcgttcggatttgttgcgaggcggcggcggcggtagcggcggcgcgcgggttcgaagggtttttcgcgcgggttggggtattaataagtttcgggttttttcgtttcggtcgggttttttgacgcggttttgttttttcgacgttcgtgacggtcggggttttttttttcgtttcgaaattaattaatttcgggtcgggttttagtcgagttcgtgtcggttttcgtttttcgcgtcgatttcgttcgcggcgcgttcggcggtttgggggaggggcggtcgcgggaacgggagttgcgcgcgtttgcgcgggttcggttgggtagacggggagcggcgggagtcggtcgtttttttttttttcgtttcggattgaagtgcggtcggggtcgcgcggcggagcggttggagcgcgcgttttttagcggagtcggggtaattggaaggtcgcgttttaggaaaataggatggtagtgaatggtatcgagtcgttttagggttgtcgtcgttattttttcggcggtttcgagtcgtgcgaggtaggggattttttgtttttagaatagggcgttcgacgttgggcgcgtggatagagtttttcggcggtcgcgtcgttgggttaggcggagagaggcggacggattttaggggaggttcgggttacgtcgcggaaattattcgattttttggaggcggttaggatcgattttgtttcgataaaatggagtttttcgtgtggttttagttcgcggcgcgtttttagagttttttagtgattcggttttcggattgttcgttttttattttatttgtcgttgtttaaattttaattt

SEQ ID NO: 37094 - DNA, 1216 bp, Artificial Sequence
  chemically treated genomic DNA (Homo sapiens) CpG-island No: 37094
aaattaaaatttaaacaacgacaaataaaataaaaaacgaacaatccgaaaaccgaatcactaaaaaactctaaaaacgcgccgcgaactaaaaccacacgaaaaactccattttatcgaaacaaaatcgatcctaaccgcctccaaaaaatcgaataatttccgcgacgtaacccgaacctcccctaaaatccgtccgcctctctccgcctaacccaacgacgcgaccgccgaaaaactctatccacgcgcccaacgtcgaacgccctattctaaaaacaaaaaatcccctacctcgcacgactcgaaaccgccgaaaaaataacgacgacaaccctaaaacgactcgataccattcactaccatcctattttcctaaaacgcgaccttccaattaccccgactccgctaaaaaacgcgcgctccaaccgctccgccgcgcgaccccgaccgcacttcaatccgaaacgaaaaaaaaaaaaacgaccgactcccgccgctccccgtctacccaaccgaacccgcgcaaacgcgcgcaactcccgttcccgcgaccgcccctcccccaaaccgccgaacgcgccgcgaacgaaatcgacgcgaaaaacgaaaaccgacacgaactcgactaaaacccgacccgaaattaattaatttcgaaacgaaaaaaaaaaccccgaccgtcacgaacgtcgaaaaaacaaaaccgcgtcaaaaaacccgaccgaaacgaaaaaacccgaaacttattaataccccaacccgcgcgaaaaacccttcgaacccgcgcgccgccgctaccgccgccgccgcctcgcaacaaatccgaacgacctcgctctccgctcccctcccccgcatccgcgaccctccgaaacacctcaactcgaccgaaaccgcaatctaaccacccgcttccatacgattcgaatccaaaataataccgataaataaacgaacgaccaaaacgtcgaacccgaaaatatacgaaatcgcgtaccgaaaactaatccgcgccctcgaacgcgtcgaaaaaaaaacctaaaaaccgcaacccgcgcgaaaaaaccgaaactttccgaacttcgaacgaatttcaaaaaaaaaaaactccatcctctaaactctacgcccacaaccgtcgtaaaaacgcgacgaaaccctaacctcgaaacgaattcctccaactactccgaaatcaaacgaaccgcccgcg

SEQ ID NO: 37095 - DNA, 1216 bp, Artificial Sequence
  chemically treated genomic DNA (Homo sapiens) CpG-island No: 37095
aaattagaatttggataacggtaaatgagatgaaaggcgaataattcgaaagtcggattattgaggagttttgggaacgcgtcgcgagttgaagttatacggggaattttattttgtcgggatagggtcggttttggtcgtttttagggagtcgggtagttttcgcggcgtggttcgggttttttttgaagttcgttcgttttttttcgtttggtttagcggcgcggtcgtcggaggattttgtttacgcgtttaacgtcgggcgttttgttttgaaggtaaagggttttttgtttcgtacgattcggagtcgtcgaggaggtgacggcggtagttttggggcggttcggtgttatttattattattttgtttttttgaggcgcggttttttaattgtttcggtttcgttaggaggcgcgcgttttagtcgtttcgtcgcgcggtttcgatcgtattttagttcggggcgaagaaagaaaaggcggtcggttttcgtcgtttttcgtttatttagtcgggttcgcgtaggcgcgcgtagttttcgttttcgcggtcgttttttttttaggtcgtcgggcgcgtcgcgggcggggtcggcgcggggggcgggagtcggtacgggttcggttggggttcgattcgggattagttggtttcggagcggaggagggagtttcgatcgttacgagcgtcgaagagataaagtcgcgttagggggttcggtcggggcgggggagttcggggtttgttggtgttttagttcgcgcggagggtttttcggattcgcgcgtcgtcgttgtcgtcgtcgtcgtttcgtaataggttcgggcggtttcgtttttcgtttttttttttcgtattcgcgatttttcggggtattttagttcggtcggggtcgtagtttggttattcgtttttatgcggttcgggtttaagatgatgtcggtaagtgggcgagcggttagggcgtcgggttcggaagtgtgcggggtcgcgtgtcgggggttggttcgcgttttcgggcgcgtcggggaaggagtttgggggtcgtagttcgcgcggaggggtcggggtttttcgagtttcgagcgggttttaggaaggggaggttttattttttgggttttgcgtttatagtcgtcgtgggggcgcggcgagattttaatttcgaggcgggtttttttagttgtttcggagttaggcgagtcgttcgcg

SEQ ID NO: 37096 - DNA, 1216 bp, Artificial Sequence
  chemically treated genomic DNA (Homo sapiens) CpG-island No: 37096
cgcgaacgactcgcctaactccgaaacaactaaaaaaacccgcctcgaaattaaaatctcgccgcgcccccacgacgactataaacgcaaaacccaaaaaataaaacctccccttcctaaaacccgctcgaaactcgaaaaaccccgacccctccgcgcgaactacgacccccaaactccttccccgacgcgcccgaaaacgcgaaccaacccccgacacgcgaccccgcacacttccgaacccgacgccctaaccgctcgcccacttaccgacatcatcttaaacccgaaccgcataaaaacgaataaccaaactacgaccccgaccgaactaaaataccccgaaaaatcgcgaatacgaaaaaaaaaaacgaaaaacgaaaccgcccgaacctattacgaaacgacgacgacgacaacgacgacgcgcgaatccgaaaaaccctccgcgcgaactaaaacaccaacaaaccccgaactcccccgccccgaccgaaccccctaacgcgactttatctcttcgacgctcgtaacgatcgaaactccctcctccgctccgaaaccaactaatcccgaatcgaaccccaaccgaacccgtaccgactcccgccccccgcgccgaccccgcccgcgacgcgcccgacgacctaaaaaaaaaacgaccgcgaaaacgaaaactacgcgcgcctacgcgaacccgactaaataaacgaaaaacgacgaaaaccgaccgccttttctttcttcgccccgaactaaaatacgatcgaaaccgcgcgacgaaacgactaaaacgcgcgcctcctaacgaaaccgaaacaattaaaaaaccgcgcctcaaaaaaacaaaataataataaataacaccgaaccgccccaaaactaccgccgtcacctcctcgacgactccgaatcgtacgaaacaaaaaaccctttaccttcaaaacaaaacgcccgacgttaaacgcgtaaacaaaatcctccgacgaccgcgccgctaaaccaaacgaaaaaaaacgaacgaacttcaaaaaaaacccgaaccacgccgcgaaaactacccgactccctaaaaacgaccaaaaccgaccctatcccgacaaaataaaattccccgtataacttcaactcgcgacgcgttcccaaaactcctcaataatccgactttcgaattattcgcctttcatctcatttaccgttatccaaattctaattt

SEQ ID NO: 37097 - DNA, 585 bp, Artificial Sequence
  chemically treated genomic DNA (Homo sapiens) CpG-island No: 37097
ggtgcgcgcgggttgtcggcgtggtgtaggtggggatcgtagtgcgcgtggcgggtgtcgagggcgcgcgggtcggggggggggtgcggcggtcgtggggggttcgcggggttggcggcggcggcggcgcgcgggaggcggttggtcgggcgggcgggtcgcgcggtgggggggtgtggggggcggggcgcgggcggggggggcgcgggggttgcggggggagggcgcgtggggggtcggcgggggggcgcgcgcggggcgcgggcggcggcgggttggggggttgaggcgacggggcgggcgtcggtcggacgggcgcgggggcgcggggcgcgtttgtcgggggggtgggtcgcgtgcgggggcggcgcggtgtcgtgcggggtttggcggtgggaggcggcggggtaggggcgcggggtgcggggcgcgaggcgggcgagggcgggggcggggcgtgtgcgcgcgcgcggggggaggtgggcgaggagggggtggggcgagggtgggtaggagggggcgtgttggaggttgtggggggtggggcgcggcggcgtcgagcgtgcgggggggcggggtgacggg

SEQ ID NO: 37098 - DNA, 585 bp, Artificial Sequence
  chemically treated genomic DNA (Homo sapiens) CpG-island No: 37098
cccgtcaccccgcccccccgcacgctcgacgccgccgcgccccaccccccacaacctccaacacgccccctcctacccaccctcgccccaccccctcctcgcccacctccccccgcgcgcgcgcacacgccccgcccccgccctcgcccgcctcgcgccccgcaccccgcgcccctaccccgccgcctcccaccgccaaaccccgcacgacaccgcgccgcccccgcacgcgacccacccccccgacaaacgcgccccgcgcccccgcgcccgtccgaccgacgcccgccccgtcgcctcaaccccccaacccgccgccgcccgcgccccgcgcgcgcccccccgccgaccccccacgcgccctccccccgcaacccccgcgccccccccgcccgcgccccgccccccacacccccccaccgcgcgacccgcccgcccgaccaaccgcctcccgcgcgccgccgccgccgccaaccccgcgaaccccccacgaccgccgcaccccccccccgacccgcgcgccctcgacacccgccacgcgcactacgatccccacctacaccacgccgacaacccgcgcgcacc

SEQ ID NO: 37099 - DNA, 585 bp, Artificial Sequence
  chemically treated genomic DNA (Homo sapiens) CpG-island No: 37099
ttcgttatttcgttttttcgtacgttcgacgtcgtcgcgttttattttttataatttttaatacgtttttttttatttattttcgttttatttttttttcgtttattttttttcgcgcgcgcgtatacgtttcgttttcgttttcgttcgtttcgcgtttcgtatttcgcgtttttatttcgtcgttttttatcgttaggtttcgtacggtatcgcgtcgttttcgtacgcggtttattttttcgataggcgcgtttcgcgttttcgcgttcgttcggtcgacgttcgtttcgtcgttttaattttttagttcgtcgtcgttcgcgtttcgcgcgcgttttttcgtcggttttttacgcgtttttttttcgtagttttcgcgtttttttcgttcgcgtttcgttttttatatttttttatcgcgcggttcgttcgttcggttaatcgtttttcgcgcgtcgtcgtcgtcgttagtttcgcgggttttttacggtcgtcgtatttttttttcgattcgcgcgttttcgatattcgttacgcgtattgcgatttttatttgtattacgtcggtaattcgcgcgtatt

SEQ ID NO: 37100 - DNA, 585 bp, Artificial Sequence
  chemically treated genomic DNA (Homo sapiens) CpG-island No: 37100
aatacgcgcgaattaccgacgtaatacaaataaaaatcgcaatacgcgtaacgaatatcgaaaacgcgcgaatcgaaaaaaaaatacgacgaccgtaaaaaacccgcgaaactaacgacgacgacgacgcgcgaaaaacgattaaccgaacgaacgaaccgcgcgataaaaaaatataaaaaacgaaacgcgaacgaaaaaaacgcgaaaactacgaaaaaaaaacgcgtaaaaaaccgacgaaaaaacgcgcgcgaaacgcgaacgacgacgaactaaaaaattaaaacgacgaaacgaacgtcgaccgaacgaacgcgaaaacgcgaaacgcgcctatcgaaaaaataaaccgcgtacgaaaacgacgcgataccgtacgaaacctaacgataaaaaacgacgaaataaaaacgcgaaatacgaaacgcgaaacgaacgaaaacgaaaacgaaacgtatacgcgcgcgcgaaaaaaaataaacgaaaaaaaaataaaacgaaaataaataaaaaaaaacgtattaaaaattataaaaaataaaacgcgacgacgtcgaacgtacgaaaaaacgaaataacgaa

SEQ ID NO: 37101 - DNA, 777 bp, Artificial Sequence
  chemically treated genomic DNA (Homo sapiens) CpG-island No: 37101
agtgttgcgcgcgtcggtttacgaggcggcgtaggttacgtcgttataaaaaatggaaaaattgtcgtcgcgttttgataacgttattttggtgaagcgcgaagatcgttagttagtgtatagttttaagttgcgcggcgtatacgttatgatggcgggtttgacggaagaatagaaagcgtacggcgtgattattgtttttgcgggtaattacgcgtagggcgtcgcgtttttttttgcgcggttaggcgtgaaggttttgatcgttatgttaatcgttatcgtcgatattaaagtcgacgcggtgcgcggtttcggcggcgaagtgttgttttacggcgcgaattttgatgaagcgaaagttaaagcgatcgaattgttatagtagtaggggtttatttgggtgtcgtcgttcgattattcgatggtgattgtcgggtaaggtacgttggcgttggaattgttttagtaggacgtttatttcgatcgcgtatttgtgttagtcgggcggcggcggtttggttgttggcgtggcggtgttgattaaataattgatgtcgtaaattaaagtgatcgtcgtagaagcggaagatttcgtttgtttgaaagtagcgttggatgcgggttattcggttgatttgtcgcgcgtagggttatttgttgaaggcgtagcggtaaaacgtatcggtgacgaaatttttcgttatagtataggagtatttcgacgatattattatcgtcgatagcgatgcgatttgtgcggcgatgaaggattta

SEQ ID NO: 37102 - DNA, 777 bp, Artificial Sequence
  chemically treated genomic DNA (Homo sapiens) CpG-island No: 37102
taaatccttcatcgccgcacaaatcgcatcgctatcgacgataataatatcgtcgaaatactcctatactataacgaaaaatttcgtcaccgatacgttttaccgctacgccttcaacaaataaccctacgcgcgacaaatcaaccgaataacccgcatccaacgctactttcaaacaaacgaaatcttccgcttctacgacgatcactttaatttacgacatcaattatttaatcaacaccgccacgccaacaaccaaaccgccgccgcccgactaacacaaatacgcgatcgaaataaacgtcctactaaaacaattccaacgccaacgtaccttacccgacaatcaccatcgaataatcgaacgacgacacccaaataaacccctactactataacaattcgatcgctttaactttcgcttcatcaaaattcgcgccgtaaaacaacacttcgccgccgaaaccgcgcaccgcgtcgactttaatatcgacgataacgattaacataacgatcaaaaccttcacgcctaaccgcgcaaaaaaaaacgcgacgccctacgcgtaattacccgcaaaaacaataatcacgccgtacgctttctattcttccgtcaaacccgccatcataacgtatacgccgcgcaacttaaaactatacactaactaacgatcttcgcgcttcaccaaaataacgttatcaaaacgcgacgacaatttttccattttttataacgacgtaacctacgccgcctcgtaaaccgacgcgcgcaacact

SEQ ID NO: 37103 - DNA, 777 bp, Artificial Sequence
  chemically treated genomic DNA (Homo sapiens) CpG-island No: 37103
taaattttttatcgtcgtatagatcgtatcgttatcgacggtgatgatgtcgtcgagatatttttgtgttataacggaaggtttcgttatcgatgcgttttatcgttacgtttttagtaaatagttttacgcgcggtagattaatcggatgattcgtatttagcgttgtttttaggtaggcggagtttttcgtttttacggcgattattttgatttgcggtattagttgtttgattagtatcgttacgttagtagttagatcgtcgtcgttcgattggtataaatacgcggtcgagatgggcgttttgttggagtagttttagcgttagcgtgttttgttcggtaattattatcggatggtcgaacggcggtatttaggtgaatttttgttgttgtgatagttcgatcgttttggttttcgttttattaaagttcgcgtcgtggagtagtatttcgtcgtcgaagtcgcgtatcgcgtcgattttgatgtcggcggtggcggttggtataacgattagggtttttacgtttaatcgcgtagaagaaaacgcgacgttttgcgcgtggttattcgtagaagtagtgattacgtcgtgcgttttttgttttttcgttaggttcgttattatggcgtatgcgtcgcgtagtttaaagttgtgtattggttggcgattttcgcgttttattagaatgacgttattaagacgcgacgatagtttttttattttttgtagcggcgtaatttgcgtcgtttcgtaaatcggcgcgcgtagtatt

SEQ ID NO: 37104 - DNA, 777 bp, Artificial Sequence
  chemically treated genomic DNA (Homo sapiens) CpG-island No: 37104
aatactacgcgcgccgatttacgaaacgacgcaaattacgccgctacaaaaaataaaaaaactatcgtcgcgtcttaataacgtcattctaataaaacgcgaaaatcgccaaccaatacacaactttaaactacgcgacgcatacgccataataacgaacctaacgaaaaaacaaaaaacgcacgacgtaatcactacttctacgaataaccacgcgcaaaacgtcgcgttttcttctacgcgattaaacgtaaaaaccctaatcgttataccaaccgccaccgccgacatcaaaatcgacgcgatacgcgacttcgacgacgaaatactactccacgacgcgaactttaataaaacgaaaaccaaaacgatcgaactatcacaacaacaaaaattcacctaaataccgccgttcgaccatccgataataattaccgaacaaaacacgctaacgctaaaactactccaacaaaacgcccatctcgaccgcgtatttataccaatcgaacgacgacgatctaactactaacgtaacgatactaatcaaacaactaataccgcaaatcaaaataatcgccgtaaaaacgaaaaactccgcctacctaaaaacaacgctaaatacgaatcatccgattaatctaccgcgcgtaaaactatttactaaaaacgtaacgataaaacgcatcgataacgaaaccttccgttataacacaaaaatatctcgacgacatcatcaccgtcgataacgatacgatctatacgacgataaaaaattta

SEQ ID NO: 37105 - DNA, 698 bp, Artificial Sequence
  chemically treated genomic DNA (Homo sapiens) CpG-island No: 37105
ttcgcgcgtatttgcgttgtttattaggaggcgttttcgtattcgtttcgtaggcgtttttcgtcgtcggtcggtgcgtgggtacgcgtagaaatcgttaggtggcgacggtttttttttttacgcgcggacgtcggcgtgggtcgacgcggtcggagcgttcgcgcgtgcgtagagtcgaggttaggttgttttcgaagcggggcggggcgaagcggggcggggtcgagtagggcggggcgggggtttgaggtgatttttaagtcgcggggcggtttcggtggtgcggggaaatcgaaagtgggcggcggtcgcggcggggtttttggcggagacggcggtaggagttgggtttagagacgcggggacgggtcgtgggttttcggaacgaggtgagtgtaggttttgcgggtttcgggcgcgataggtgtcgggcgacgtcggacgagatttcgggcgggcgcggcgtatttgggttatcggtgggatcgcggttagggtcgggggttttaataggttcggggttttttttttgtagtcgtaggggattgttttcgtttcgacgtttgggaatcgggttgggcgtcgggggagttggagttttagagcgttgtgttttaaatttttgaagggattttgtttcgggtcgggcgtttacgcgggagtcggacggagttttttgtcgtttcggaagtttt

SEQ ID NO: 37106 - DNA, 698 bp, Artificial Sequence
  chemically treated genomic DNA (Homo sapiens) CpG-island No: 37106
aaaacttccgaaacgacaaaaaactccgtccgactcccgcgtaaacgcccgacccgaaacaaaatcccttcaaaaatttaaaacacaacgctctaaaactccaactcccccgacgcccaacccgattcccaaacgtcgaaacgaaaacaatcccctacgactacaaaaaaaaaaccccgaacctattaaaacccccgaccctaaccgcgatcccaccgataacccaaatacgccgcgcccgcccgaaatctcgtccgacgtcgcccgacacctatcgcgcccgaaacccgcaaaacctacactcacctcgttccgaaaacccacgacccgtccccgcgtctctaaacccaactcctaccgccgtctccgccaaaaaccccgccgcgaccgccgcccactttcgatttccccgcaccaccgaaaccgccccgcgacttaaaaatcacctcaaacccccgccccgccctactcgaccccgccccgcttcgccccgccccgcttcgaaaacaacctaacctcgactctacgcacgcgcgaacgctccgaccgcgtcgacccacgccgacgtccgcgcgtaaaaaaaaaaaccgtcgccacctaacgatttctacgcgtacccacgcaccgaccgacgacgaaaaacgcctacgaaacgaatacgaaaacgcctcctaataaacaacgcaaatacgcgcgaa

SEQ ID NO: 37107 - DNA, 698 bp, Artificial Sequence
  chemically treated genomic DNA (Homo sapiens) CpG-island No: 37107
agagttttcgaggcggtaggaggtttcgttcgattttcgcgtgaacgttcggttcggagtagggtttttttagagatttaaaatataacgttttggaattttaattttttcggcgtttagttcggtttttaggcgtcggggcgggggtaattttttgcggttgtagggaaaaggtttcgagtttgttggagttttcggttttggtcgcggttttatcggtgatttaggtgcgtcgcgttcgttcgaaatttcgttcgacgtcgttcggtatttgtcgcgttcggagttcgtaggatttgtatttatttcgtttcgggggtttacggttcgttttcgcgtttttgggtttagtttttgtcgtcgttttcgttaggggtttcgtcgcggtcgtcgtttattttcggttttttcgtattatcggagtcgtttcgcggtttgggaattattttaagttttcgtttcgttttgttcggtttcgtttcgtttcgtttcgtttcgtttcgagggtagtttggtttcggttttgcgtacgcgcgggcgtttcggtcgcgtcggtttacgtcggcgttcgcgcgtgggaagggaaatcgtcgttatttagcggtttttgcgcgtgtttacgtatcggtcggcggcggaagacgtttgcggggcgggtgcgggagcgttttttggtggataacgtaggtacgcgcggg

SEQ ID NO: 37108 - DNA, 698 bp, Artificial Sequence
  chemically treated genomic DNA (Homo sapiens) CpG-island No: 37108
cccgcgcgtacctacgttatccaccaaaaaacgctcccgcacccgccccgcaaacgtcttccgccgccgaccgatacgtaaacacgcgcaaaaaccgctaaataacgacgatttcccttcccacgcgcgaacgccgacgtaaaccgacgcgaccgaaacgcccgcgcgtacgcaaaaccgaaaccaaactaccctcgaaacgaaacgaaacgaaacgaaacgaaaccgaacaaaacgaaacgaaaacttaaaataattcccaaaccgcgaaacgactccgataatacgaaaaaaccgaaaataaacgacgaccgcgacgaaacccctaacgaaaacgacgacaaaaactaaacccaaaaacgcgaaaacgaaccgtaaacccccgaaacgaaataaatacaaatcctacgaactccgaacgcgacaaataccgaacgacgtcgaacgaaatttcgaacgaacgcgacgcacctaaatcaccgataaaaccgcgaccaaaaccgaaaactccaacaaactcgaaaccttttccctacaaccgcaaaaaattacccccgccccgacgcctaaaaaccgaactaaacgccgaaaaaattaaaattccaaaacgttatattttaaatctctaaaaaaaccctactccgaaccgaacgttcacgcgaaaatcgaacgaaacctcctaccgcctcgaaaactct

SEQ ID NO: 37109 - DNA, 838 bp, Artificial Sequence
  chemically treated genomic DNA (Homo sapiens) CpG-island No: 37109
cggaatttgtcgttgagcgaatgtattcgtttagattcgatttttttttttagggcgcggttttcgggtaggtttttttacgagttttttattcgagtagagtagggtttcgcggaggcgtcgatcgggcgcgaggttttttgtttgtttaggtttttcggcgattttgagcgaattttttcggggttagtttcgtttaggttgagaagggaacggcggaaggcggagtgcgttttcgggagttcggagttgggattgtagtttttatggggttaagtttacggggtgcggtcgcgcggttaatgagcgttttttatgttttgacggtgtttcgtttcgcggcgttgtcgcgttttcgttttttcgttttttcgtcgcgcgttcgggatttcgattagttttgatcgtacgggggtcgcggttacggggcgtaggggttatggtgcgcggtaggatttttcggttttcggttcgggacgtgcgtttttttacgtcgtttgggggttacggcgcggacgttatggtaagcgcggacgttatggtaagcgcggacgttatggtaagcgcggacgttatggtaagcgcggacgttatggtaagcgcggacgttatggtaagcgcggacgttatggtaagcgcggacgttatggtaagcgcggacgttatggtacgcgcggtttgcggttcgggtttttttcgtttcgtcgattgtagttttgcgggtttcgggtagtttttcgatttcgaatttattgtttttgtatagtgggaggcgcgtttgggggagatattcgttttttatgttttggagtaattgtataagtatttagaaattttt

SEQ ID NO: 37110 - DNA, 838 bp, Artificial Sequence
  chemically treated genomic DNA (Homo sapiens) CpG-island No: 37110
aaaaatttctaaatacttatacaattactccaaaacataaaaaacgaatatctcccccaaacgcgcctcccactatacaaaaacaataaattcgaaatcgaaaaactacccgaaacccgcaaaactacaatcgacgaaacgaaaaaaacccgaaccgcaaaccgcgcgtaccataacgtccgcgcttaccataacgtccgcgcttaccataacgtccgcgcttaccataacgtccgcgcttaccataacgtccgcgcttaccataacgtccgcgcttaccataacgtccgcgcttaccataacgtccgcgcttaccataacgtccgcgccgtaacccccaaacgacgtaaaaaaacgcacgtcccgaaccgaaaaccgaaaaatcctaccgcgcaccataacccctacgccccgtaaccgcgacccccgtacgatcaaaactaatcgaaatcccgaacgcgcgacgaaaaaacgaaaaaacgaaaacgcgacaacgccgcgaaacgaaacaccgtcaaaacataaaaaacgctcattaaccgcgcgaccgcaccccgtaaacttaaccccataaaaactacaatcccaactccgaactcccgaaaacgcactccgccttccgccgttcccttctcaacctaaacgaaactaaccccgaaaaaattcgctcaaaatcgccgaaaaacctaaacaaacaaaaaacctcgcgcccgatcgacgcctccgcgaaaccctactctactcgaataaaaaactcgtaaaaaaacctacccgaaaaccgcgccctaaaaaaaaaaatcgaatctaaacgaatacattcgctcaacgacaaattccg

SEQ ID NO: 37111 - DNA, 838 bp, Artificial Sequence
  chemically treated genomic DNA (Homo sapiens) CpG-island No: 37111
gaaagtttttggatatttatataattgttttaaggtatgaaaagcgagtgttttttttaggcgcgttttttattgtatagaagtaatgggttcgaagtcgggaagttgttcggggttcgtagagttgtagtcggcggggcgggagggattcgggtcgtaagtcgcgcgtattatggcgttcgcgtttattatggcgttcgcgtttattatggcgttcgcgtttattatggcgttcgcgtttattatggcgttcgcgtttattatggcgttcgcgtttattatggcgttcgcgtttattatggcgttcgcgtttattatggcgttcgcgtcgtggtttttaagcgacgtggggaagcgtacgtttcggatcgagagtcgggagattttgtcgcgtattatggtttttgcgtttcgtggtcgcggttttcgtgcggttaggattggtcgggatttcgagcgcgcggcgggagggcgggagggcgggagcgcggtagcgtcgcgaggcggggtatcgttagggtatagagggcgtttattggtcgcgcggtcgtatttcgtgaatttggttttatgggagttgtagttttagtttcgggttttcgggggcgtatttcgtttttcgtcgttttttttttagtttagacggagttgatttcgagagggttcgtttagggtcgtcggggaatttgggtaggtaggaggtttcgcgttcggtcggcgttttcgcgggattttgttttgttcggatggaagattcgtgaagggatttgttcgggagtcgcgttttagagggagaagtcgggtttgagcgagtgtattcgtttagcggtagatttcg

SEQ ID NO: 37112 - DNA, 838 bp, Artificial Sequence
  chemically treated genomic DNA (Homo sapiens) CpG-island No: 37112
cgaaatctaccgctaaacgaatacactcgctcaaacccgacttctccctctaaaacgcgactcccgaacaaatcccttcacgaatcttccatccgaacaaaacaaaatcccgcgaaaacgccgaccgaacgcgaaacctcctacctacccaaattccccgacgaccctaaacgaaccctctcgaaatcaactccgtctaaactaaaaaaaaaacgacgaaaaacgaaatacgcccccgaaaacccgaaactaaaactacaactcccataaaaccaaattcacgaaatacgaccgcgcgaccaataaacgccctctataccctaacgataccccgcctcgcgacgctaccgcgctcccgccctcccgccctcccgccgcgcgctcgaaatcccgaccaatcctaaccgcacgaaaaccgcgaccacgaaacgcaaaaaccataatacgcgacaaaatctcccgactctcgatccgaaacgtacgcttccccacgtcgcttaaaaaccacgacgcgaacgccataataaacgcgaacgccataataaacgcgaacgccataataaacgcgaacgccataataaacgcgaacgccataataaacgcgaacgccataataaacgcgaacgccataataaacgcgaacgccataataaacgcgaacgccataatacgcgcgacttacgacccgaatccctcccgccccgccgactacaactctacgaaccccgaacaacttcccgacttcgaacccattacttctatacaataaaaaacgcgcctaaaaaaaacactcgcttttcataccttaaaacaattatataaatatccaaaaactttc

SEQ ID NO: 37113 - DNA, 695 bp, Artificial Sequence
  chemically treated genomic DNA (Homo sapiens) CpG-island No: 37113
gtcgatttacgtgtttttttggaagtcggtaggttttacgtattttattacgttcgttttgtgggcgtttacggtgacgaattcgttttttcggagttatttcgggatttcgttagttttttcggaattagaggttagggtttgtttttcggcgttcgggtcgcgtatttttttcggttttcggggagtagtcggggtttttagttagtatgcgcgagaaggagcgtaatttcgaggttcgtatttttcggacgcggaacggggagtcgggcgtcggggtttcgatgtcggggcgttttcgacggcggtttacgagttgttgggggttagggggtttttcggcggggacggtcgtaggcggtggggggtggttgataggcgtttcgggttcggcgttaagggcggtgggtatggatttcggcggtcgttagcgtttaggttcgggttacggcgttcgatagatcgcggtggagacgttgtgtgataagtatcgttataggttttatttacggggttggggggtcgttttgtgttttttgagtcgggttgacgttgtgatagttatgataggcggtgcggaaagtattttggtatgtttgtcgtagatttttaggttcgggacgttatcgtgtggataagaatattaggtttattttcggttgagttgtagtaggacggggtagtagggttgagat

SEQ ID NO: 37114 - DNA, 695 bp, Artificial Sequence
  chemically treated genomic DNA (Homo sapiens) CpG-island No: 37114
atctcaaccctactaccccgtcctactacaactcaaccgaaaataaacctaatattcttatccacacgataacgtcccgaacctaaaaatctacgacaaacataccaaaatactttccgcaccgcctatcataactatcacaacgtcaacccgactcaaaaaacacaaaacgaccccccaaccccgtaaataaaacctataacgatacttatcacacaacgtctccaccgcgatctatcgaacgccgtaacccgaacctaaacgctaacgaccgccgaaatccatacccaccgcccttaacgccgaacccgaaacgcctatcaaccaccccccaccgcctacgaccgtccccgccgaaaaaccccctaacccccaacaactcgtaaaccgccgtcgaaaacgccccgacatcgaaaccccgacgcccgactccccgttccgcgtccgaaaaatacgaacctcgaaattacgctccttctcgcgcatactaactaaaaaccccgactactccccgaaaaccgaaaaaaatacgcgacccgaacgccgaaaaacaaaccctaacctctaattccgaaaaaactaacgaaatcccgaaataactccgaaaaaacgaattcgtcaccgtaaacgcccacaaaacgaacgtaataaaatacgtaaaacctaccgacttccaaaaaaacacgtaaatcgac

SEQ ID NO: 37115 - DNA, 695 bp, Artificial Sequence
  chemically treated genomic DNA (Homo sapiens) CpG-island No: 37115
gttttagttttgttatttcgttttgttgtagtttagtcggagatgggtttgatgtttttgtttatacgatggcgtttcgggtttgaagatttgcgataaatatgttaaagtgtttttcgtatcgtttgttatagttgttatagcgttagttcgatttaggaggtataggacggttttttagtttcgtgagtgaagtttgtagcggtatttgttatatagcgtttttatcgcgatttgtcggacgtcgtggttcgagtttggacgttagcggtcgtcggggtttatgtttatcgtttttgacgtcgagttcgaggcgtttattagttattttttatcgtttacggtcgttttcgtcgaggagttttttggtttttagtagttcgtgagtcgtcgtcgagagcgtttcgatatcgaggtttcggcgttcggtttttcgtttcgcgttcggagggtgcgggtttcggagttgcgttttttttcgcgtatgttggttggggatttcggttgtttttcgggggtcgaggggaatgcgcggttcgggcgtcgggggataggttttggtttttgatttcgaggaagttgacgaggtttcggagtggtttcgagagggcgagttcgttatcgtgggcgtttataaaacgggcgtggtgagatacgtggggtttgtcgatttttaagagggtacgtgggtcggt

SEQ ID NO: 37116 - DNA, 695 bp, Artificial Sequence
  chemically treated genomic DNA (Homo sapiens) CpG-island No: 37116
accgacccacgtaccctcttaaaaatcgacaaaccccacgtatctcaccacgcccgttttataaacgcccacgataacgaactcgccctctcgaaaccactccgaaacctcgtcaacttcctcgaaatcaaaaaccaaaacctatcccccgacgcccgaaccgcgcattcccctcgacccccgaaaaacaaccgaaatccccaaccaacatacgcgaaaaaaaacgcaactccgaaacccgcaccctccgaacgcgaaacgaaaaaccgaacgccgaaacctcgatatcgaaacgctctcgacgacgactcacgaactactaaaaaccaaaaaactcctcgacgaaaacgaccgtaaacgataaaaaataactaataaacgcctcgaactcgacgtcaaaaacgataaacataaaccccgacgaccgctaacgtccaaactcgaaccacgacgtccgacaaatcgcgataaaaacgctatataacaaataccgctacaaacttcactcacgaaactaaaaaaccgtcctatacctcctaaatcgaactaacgctataacaactataacaaacgatacgaaaaacactttaacatatttatcgcaaatcttcaaacccgaaacgccatcgtataaacaaaaacatcaaacccatctccgactaaactacaacaaaacgaaataacaaaactaaaac

SEQ ID NO: 37117 - DNA, 586 bp, Artificial Sequence
  chemically treated genomic DNA (Homo sapiens) CpG-island No: 37117
ttcgtcgtcgggttttacggggatcgcggagtttttttagaggatcgcggcgggggacggcggtattttattcgagttgtttatggcgtttacgttgttcggcggggtaacggtagtttttagggtttttgggcgagcgtcgggattgcgttgcggttcgttgtttagggggttcgatttgtttttcgtattcggagcgtcggaaaaaggaaatcggttcggcggcggcggcggcggcggcggcggggaggttgaggttgggagaaacggggttcgcggagggataaaatttttttttcgcgttgttgagttagcgtcgtcggggttggtcgttcgggggagggtcgacgggggcggtttagttgacgcgttgggttcgttagcgttcgggggttgaggtcgcgtttgttttcgcgtaggatcgtatagatggtttgcgcgttagagggggtcggcgttttttttttttaggttttcgttttcgggtcgcgcgggcgtttttcgggattaggttcgttttaaggagggaggttgacgggttttttgtgggtttagatttttagtattttagtatcggggaatcgtt

SEQ ID NO: 37118 - DNA, 586 bp, Artificial Sequence
  chemically treated genomic DNA (Homo sapiens) CpG-island No: 37118
aacgattccccgatactaaaatactaaaaatctaaacccacaaaaaacccgtcaacctccctccttaaaacgaacctaatcccgaaaaacgcccgcgcgacccgaaaacgaaaacctaaaaaaaaaaaacgccgaccccctctaacgcgcaaaccatctatacgatcctacgcgaaaacaaacgcgacctcaacccccgaacgctaacgaacccaacgcgtcaactaaaccgcccccgtcgaccctcccccgaacgaccaaccccgacgacgctaactcaacaacgcgaaaaaaaaattttatccctccgcgaaccccgtttctcccaacctcaacctccccgccgccgccgccgccgccgccgccgaaccgatttcctttttccgacgctccgaatacgaaaaacaaatcgaaccccctaaacaacgaaccgcaacgcaatcccgacgctcgcccaaaaaccctaaaaactaccgttaccccgccgaacaacgtaaacgccataaacaactcgaataaaataccgccgtcccccgccgcgatcctctaaaaaaactccgcgatccccgtaaaacccgacgacgaa

SEQ ID NO: 37119 - DNA, 586 bp, Artificial Sequence
  chemically treated genomic DNA (Homo sapiens) CpG-island No: 37119
gacgatttttcgatgttagagtattgggggtttgggtttatagggaattcgttagtttttttttttggagcgggtttgatttcgggaggcgttcgcgcggttcggaggcgggaatttagggggagaaggcgtcggttttttttggcgcgtagattatttgtgcggttttgcgcgggggtaggcgcggttttagttttcgggcgttggcggatttagcgcgttagttaggtcgttttcgtcggttttttttcgggcggttagtttcgacggcgttgatttagtaacgcgaggggggagttttgttttttcgcggatttcgttttttttagttttagttttttcgtcgtcgtcgtcgtcgtcgtcgtcgagtcggtttttttttttcggcgtttcgggtgcgagagataggtcgggttttttaggtagcgagtcgtagcgtaatttcggcgttcgtttaaggattttggaagttatcgttatttcgtcgggtagcgtgggcgttatgagtagttcgggtgaggtgtcgtcgtttttcgtcgcggttttttggaggagtttcgcggttttcgtgaggttcggcggcggg

SEQ ID NO: 37120 - DNA, 586 bp, Artificial Sequence
  chemically treated genomic DNA (Homo sapiens) CpG-island No: 37120
cccgccgccgaacctcacgaaaaccgcgaaactcctccaaaaaaccgcgacgaaaaacgacgacacctcacccgaactactcataacgcccacgctacccgacgaaataacgataacttccaaaatccttaaacgaacgccgaaattacgctacgactcgctacctaaaaaacccgacctatctctcgcacccgaaacgccgaaaaaaaaaaaccgactcgacgacgacgacgacgacgacgacgaaaaaactaaaactaaaaaaaacgaaatccgcgaaaaaacaaaactcccccctcgcgttactaaatcaacgccgtcgaaactaaccgcccgaaaaaaaaccgacgaaaacgacctaactaacgcgctaaatccgccaacgcccgaaaactaaaaccgcgcctacccccgcgcaaaaccgcacaaataatctacgcgccaaaaaaaaccgacgccttctccccctaaattcccgcctccgaaccgcgcgaacgcctcccgaaatcaaacccgctccaaaaaaaaaaactaacgaattccctataaacccaaacccccaatactctaacatcgaaaaatcgtc

SEQ ID NO: 37121 - DNA, 602 bp, Artificial Sequence
  chemically treated genomic DNA (Homo sapiens) CpG-island No: 37121
ggtttatcggttttcgtttttttattttgtgttttttttcgttttttcgtttttttttttgttttattttcgcgtgtttttttttttatttttttttttttttcgttgttttttttcgttttcgttcgttttttgttggcgtttttcgtttttgttttgtttttttttcggttttttttttttttttttttttgttttcgtttttgttcgttggtgtttttttttttttttttgtttttttcgtcgttcgtggttgtttttttttttgttttttcgtgtcgttttttttcgttgtcgtttcgttcgtttcgtttttttacgtttttttgttttttttgttcgttttttttgttgtgtcgcgtcgtgttttttcgtttttgttttttgcgttttttggttttcgcgttgttttgtttttttggtttcgtgttttttcggtttttgtcggtcgttggcgtgtcgttttttttttttcgtttcgtcggtgttgttggcgttcgtgttcgttttttgtcgtgttttgttgtttcggttttttttttgtgttttttttagttgtgggtttttcgtcgtattttttcgcggttcgttttgttttgttt

SEQ ID NO: 37122 - DNA, 602 bp, Artificial Sequence
  chemically treated genomic DNA (Homo sapiens) CpG-island No: 37122
aaacaaaacaaaacgaaccgcgaaaaaatacgacgaaaaacccacaactaaaaaaaacacaaaaaaaaaaccgaaacaacaaaacacgacaaaaaacgaacacgaacgccaacaacaccgacgaaacgaaaaaaaaaaaacgacacgccaacgaccgacaaaaaccgaaaaaacacgaaaccaaaaaaacaaaacaacgcgaaaaccaaaaaacgcaaaaaacaaaaacgaaaaaacacgacgcgacacaacaaaaaaaacgaacaaaaaaaacaaaaaaacgtaaaaaaacgaaacgaacgaaacgacaacgaaaaaaaacgacacgaaaaaacaaaaaaaaaaacaaccacgaacgacgaaaaaaacaaaaaaaaaaaaaaaaacaccaacgaacaaaaacgaaaacaaaaaaaaaaaaaaaaaaaaaaccgaaaaaaaaacaaaacaaaaacgaaaaacgccaacaaaaaacgaacgaaaacgaaaaaaaacaacgaaaaaaaaaaaaaaataaaaaaaaaaacacgcgaaaataaaacaaaaaaaaaaacgaaaaaacgaaaaaaaacacaaaataaaaaaacgaaaaccgataaacc

SEQ ID NO: 37123 - DNA, 602 bp, Artificial Sequence
  chemically treated genomic DNA (Homo sapiens) CpG-island No: 37123
gagtagggtaagacgagtcgcgggagggtacggcgaagagtttatagttgaagagggtataaaaggaggatcggagtaataaggtacgatagagaacgagtacgagcgttagtaatatcgacgagacgaagagggagagacggtacgttagcgatcgataaggatcgagagaatacggaattaggagaatagagtagcgcggaggttagaggacgtagagagtagagacgaggaggtacgacgcggtataataaggggagcgaataggggagatagagaagcgtgagggggcgagacgggcgaagcgatagcggaagagagcggtacgagagggtaaagagaggagtagttacgagcggcggagaaaataagaggagaggagagagtattagcgggtagaggcgggaataaaaaggaagaaaaaggaagagtcgagaagaaggtagaataaagacgaaggacgttaataaggggcgagcgaaaacggaggagggtagcgaggagaggaggggaatggggagagagatacgcgagagtagagtaggagggaaggcgggggagcgagagagggtatagagtgaagaggcgggagtcgatgggtt

SEQ ID NO: 37124 - DNA, 602 bp, Artificial Sequence
  chemically treated genomic DNA (Homo sapiens) CpG-island No: 37124
aacccatcgactcccgcctcttcactctataccctctctcgctcccccgccttccctcctactctactctcgcgtatctctctccccattcccctcctctcctcgctaccctcctccgttttcgctcgccccttattaacgtccttcgtctttattctaccttcttctcgactcttcctttttcttcctttttattcccgcctctacccgctaatactctctcctctcctcttattttctccgccgctcgtaactactcctctctttaccctctcgtaccgctctcttccgctatcgcttcgcccgtctcgccccctcacgcttctctatctcccctattcgctccccttattataccgcgtcgtacctcctcgtctctactctctacgtcctctaacctccgcgctactctattctcctaattccgtattctctcgatccttatcgatcgctaacgtaccgtctctccctcttcgtctcgtcgatattactaacgctcgtactcgttctctatcgtaccttattactccgatcctccttttataccctcttcaactataaactcttcgccgtaccctcccgcgactcgtcttaccctactc

SEQ ID NO: 37125 - DNA, 536 bp, Artificial Sequence
  chemically treated genomic DNA (Homo sapiens) CpG-island No: 37125
cgagggtagcgtcgttagtatacgttttagtattatttttttttgacgttcgttttcggatgtttgacgatcgttttcgtttgtcgtttttataaaggggattttttttaatattcgatcgatttttatttcgttttgcgtcgcgcgttttcgtcggtgcgtatatttgttaattttgtgcgtttttaggtttttggagacgtcgagtgaggagttgttttgatcgttcggaatcgattcgtattttatcgcgatatatatcgtagtttcgttttttgtagtttcgtaattatatttttcgcggttttagggggcggtggcgcgtgcggagattttttcggtgtagttatgattttaggtaggagcggagcgttattatcgcgcgtacgcgtcgaaatttcggaaattttttggtatcgattcgttttgtattatagcgtagggcgcgttattttttttttaggtacgatgcgagcgtagtattttgtttgttaattgtgttgttagcgtttatatgtataaagtttgttattaga

SEQ ID NO: 37126 - DNA, 536 bp, Artificial Sequence
  chemically treated genomic DNA (Homo sapiens) CpG-island No: 37126
tctaataacaaactttatacatataaacgctaacaacacaattaacaaacaaaatactacgctcgcatcgtacctaaaaaaaaaataacgcgccctacgctataatacaaaacgaatcgataccaaaaaatttccgaaatttcgacgcgtacgcgcgataataacgctccgctcctacctaaaatcataactacaccgaaaaaatctccgcacgcgccaccgccccctaaaaccgcgaaaaatataattacgaaactacaaaaaacgaaactacgatatatatcgcgataaaatacgaatcgattccgaacgatcaaaacaactcctcactcgacgtctccaaaaacctaaaaacgcacaaaattaacaaatatacgcaccgacgaaaacgcgcgacgcaaaacgaaataaaaatcgatcgaatattaaaaaaaatcccctttataaaaacgacaaacgaaaacgatcgtcaaacatccgaaaacgaacgtcaaaaaaaaataatactaaaacgtatactaacgacgctaccctcg

SEQ ID NO: 37127 - DNA, 536 bp, Artificial Sequence
  chemically treated genomic DNA (Homo sapiens) CpG-island No: 37127
tttgataatagattttgtatatatgaacgttgatagtatagttgatagataggatgttgcgttcgtatcgtatttagaggaaaaatggcgcgttttgcgttgtaatataggacgggtcggtgttagagaattttcgaggtttcggcgcgtacgcgcggtaatgacgtttcgtttttatttggagttatggttgtatcgagagaattttcgtacgcgttatcgttttttggaatcgcgaggggtgtggttgcgaggttgtagaaagcgagattgcggtgtgtgtcgcggtggagtgcggatcgatttcgggcggttagagtagttttttattcggcgtttttaagaatttgggagcgtatagagttgataggtgtacgtatcggcggaggcgcgcggcgtagggcgaggtgggaatcgatcgagtattgggaaaagttttttttataagggcggtaggcgggggcgatcgttagatattcggaggcggacgttagaggagagtggtgttagggcgtgtgttagcgacgttgttttcg

SEQ ID NO: 37128 - DNA, 536 bp, Artificial Sequence
  chemically treated genomic DNA (Homo sapiens) CpG-island No: 37128
cgaaaacaacgtcgctaacacacgccctaacaccactctcctctaacgtccgcctccgaatatctaacgatcgcccccgcctaccgcccttataaaaaaaacttttcccaatactcgatcgattcccacctcgccctacgccgcgcgcctccgccgatacgtacacctatcaactctatacgctcccaaattcttaaaaacgccgaataaaaaactactctaaccgcccgaaatcgatccgcactccaccgcgacacacaccgcaatctcgctttctacaacctcgcaaccacacccctcgcgattccaaaaaacgataacgcgtacgaaaattctctcgatacaaccataactccaaataaaaacgaaacgtcattaccgcgcgtacgcgccgaaacctcgaaaattctctaacaccgacccgtcctatattacaacgcaaaacgcgccatttttcctctaaatacgatacgaacgcaacatcctatctatcaactatactatcaacgttcatatatacaaaatctattatcaaa

SEQ ID NO: 37129 - DNA, 978 bp, Artificial Sequence
  chemically treated genomic DNA (Homo sapiens) CpG-island No: 37129
  misc_feature (177)..(178): n is either a, c, g or t
  misc_feature (186)..(186): n is either a, c, g or t
  misc_feature (285)..(286): n is either a, c, g or t
  misc_feature (291)..(291): n is either a, c, g or t
  misc_feature (295)..(297): n is either a, c, g or t
ttatcgagtaatttttttagcgttttagaagaacgttggcgtgcgcgcgtttttagtatatggtcgagattgattagatcgatattatcgcgttggtttcgtaataaagatgtcgcgtttttatcgggattattgcggttaggtgcgtttatcgaatagagttacgttacgtttagnntatttagncgttattagcgtatttatcgtcgtcgtatcgtttagtaggtttttatgtattgggtaaaaatggtcgcggcgaaaatttattacgtggttttagggggnntttanttannnggtcgataattaattataggttgcggttgttagcggtgattattatgttatcgtcgattattttttagattattatcgggatatttatcgttagtgcgataattgtttgttagcggaagcgttttatcgtagcgacggcggttttttgttggcgttcgcggcgtttagcgttatttttaatcgttttcgcgtcgtagttcgtttgttttatcgtttgtattaaattttgtggggaggtattgtttattattagcgtagtacgtttcgttaggtttattcgtgtttgagtgacgttcggtacgttttgtagcgtattttgtacgcgggtgatatagttggcgtagtttatgtcgtttagtagtaattgttggttgttatcgttatcggcggtcgttgtcggaagcgttttagaaatcgttgttagtgttttcgacgggattgatgatttcgttagcggtttagtttttgggtggtttatagatgcgttataattcgtttgtttgatggtttcgattagttgttttgtattggtagtttcggtaacgtgcgttttagtgatagatatattcgtttgtttaatattcggacgttgtttaagatttttttttacgcgtttaacgtagtgatcgtaggataggtcgtttagggttaggtcgatagtttgtgatataaaatattttt

SEQ ID NO: 37130 - DNA, 978 bp, Artificial Sequence
  chemically treated genomic DNA (Homo sapiens) CpG-island No: 37130
  misc_feature (682)..(684): n is either a, c, g or t
  misc_feature (688)..(688): n is either a, c, g or t
  misc_feature (693)..(694): n is either a, c, g or t
  misc_feature (793)..(793): n is either a, c, g or t
  misc_feature (801)..(802): n is either a, c, g or t
aaaaatattttatatcacaaactatcgacctaaccctaaacgacctatcctacgatcactacgttaaacgcgtaaaaaaaaatcttaaacaacgtccgaatattaaacaaacgaatatatctatcactaaaacgcacgttaccgaaactaccaatacaaaacaactaatcgaaaccatcaaacaaacgaattataacgcatctataaaccacccaaaaactaaaccgctaacgaaatcatcaatcccgtcgaaaacactaacaacgatttctaaaacgcttccgacaacgaccgccgataacgataacaaccaacaattactactaaacgacataaactacgccaactatatcacccgcgtacaaaatacgctacaaaacgtaccgaacgtcactcaaacacgaataaacctaacgaaacgtactacgctaataataaacaatacctccccacaaaatttaatacaaacgataaaacaaacgaactacgacgcgaaaacgattaaaaataacgctaaacgccgcgaacgccaacaaaaaaccgccgtcgctacgataaaacgcttccgctaacaaacaattatcgcactaacgataaatatcccgataataatctaaaaaataatcgacgataacataataatcaccgctaacaaccgcaacctataattaattatcgaccnnntaantaaannccccctaaaaccacgtaataaattttcgccgcgaccatttttacccaatacataaaaacctactaaacgatacgacgacgataaatacgctaataacgnctaaatannctaaacgtaacgtaactctattcgataaacgcacctaaccgcaataatcccgataaaaacgcgacatctttattacgaaaccaacgcgataatatcgatctaatcaatctcgaccatatactaaaaacgcgcgcacgccaacgttcttctaaaacgctaaaaaaattactcgataa

SEQ ID NO: 37131 - DNA, 978 bp, Artificial Sequence
  chemically treated genomic DNA (Homo sapiens) CpG-island No: 37131
  misc_feature (682)..(684): n is either a, c, g or t
  misc_feature (688)..(688): n is either a, c, g or t
  misc_feature (693)..(694): n is either a, c, g or t
  misc_feature (793)..(793): n is either a, c, g or t
  misc_feature (801)..(802): n is either a, c, g or t
aggagtgttttatgttataaattatcgatttgattttggacggtttgttttgcggttattgcgttaaacgcgtgaaagaaagttttgaatagcgttcggatgttgagtaggcggatgtgtttattattgaagcgtacgttatcgggattgttagtgtagaatagttgatcgaaattattaaataagcgggttatgacgtatttgtaagttatttaaaggttaaatcgttggcggagttattaatttcgtcggaagtattgatagcggtttttgaggcgttttcggtagcgatcgtcgatgacgatgatagttagtagttgttgttgagcggtatgagttgcgttagttgtgttattcgcgtataaaatgcgttgtaaagcgtatcgggcgttatttaggtacgggtaaatttggcggagcgtattgcgttggtgatgggtagtgtttttttataagatttagtgtaggcggtggaataagcgggttacggcgcggaagcgattgaagatgacgttaaacgtcgcgagcgttagtaagaaatcgtcgtcgttacgatgaagcgttttcgttggtaggtaattgtcgtattggcggtgggtatttcggtgatggtttgggggatgatcggcgataatatgatggttatcgttgataatcgtagtttgtggttggttatcggttnnntgantaaannttttttggggttacgtgatgggttttcgtcgcggttatttttatttagtgtatggaagtttgttgaacggtgcggcgacgatggatacgttggtggcgnttgggtannttgggcgtggcgtggttttattcgatgagcgtatttggtcgtagtggtttcgatggaagcgcgatatttttattacgaagttagcgcgatgatatcggtttgattaatttcggttatatgttggaagcgcgcgtacgttagcgtttttttaaggcgttggaaaagttattcgataa

SEQ ID NO: 37132 - DNA, 978 bp, Artificial Sequence
  chemically treated genomic DNA (Homo sapiens) CpG-island No: 37132
  misc_feature (177)..(178): n is either a, c, g or t
  misc_feature (186)..(186): n is either a, c, g or t
  misc_feature (285)..(286): n is either a, c, g or t
  misc_feature (291)..(291): n is either a, c, g or t
  misc_feature (295)..(297): n is either a, c, g or t
ttatcgaataacttttccaacgccttaaaaaaacgctaacgtacgcgcgcttccaacatataaccgaaattaatcaaaccgatatcatcgcgctaacttcgtaataaaaatatcgcgcttccatcgaaaccactacgaccaaatacgctcatcgaataaaaccacgccacgcccaanntacccaancgccaccaacgtatccatcgtcgccgcaccgttcaacaaacttccatacactaaataaaaataaccgcgacgaaaacccatcacgtaaccccaaaaaanntttantcannnaaccgataaccaaccacaaactacgattatcaacgataaccatcatattatcgccgatcatcccccaaaccatcaccgaaatacccaccgccaatacgacaattacctaccaacgaaaacgcttcatcgtaacgacgacgatttcttactaacgctcgcgacgtttaacgtcatcttcaatcgcttccgcgccgtaacccgcttattccaccgcctacactaaatcttataaaaaaacactacccatcaccaacgcaatacgctccgccaaatttacccgtacctaaataacgcccgatacgctttacaacgcattttatacgcgaataacacaactaacgcaactcataccgctcaacaacaactactaactatcatcgtcatcgacgatcgctaccgaaaacgcctcaaaaaccgctatcaatacttccgacgaaattaataactccgccaacgatttaacctttaaataacttacaaatacgtcataacccgcttatttaataatttcgatcaactattctacactaacaatcccgataacgtacgcttcaataataaacacatccgcctactcaacatccgaacgctattcaaaactttctttcacgcgtttaacgcaataaccgcaaaacaaaccgtccaaaatcaaatcgataatttataacataaaacactcct

SEQ ID NO: 37133 - DNA, 642 bp, Artificial Sequence
  chemically treated genomic DNA (Homo sapiens) CpG-island No: 37133
ttatcgcgttgagtgtttgttgtattaacggtagattatcgtttgttagtatcgggatttcgttgtattgtaagttttttatttttagtcggaaattcgggttagcggttttttgcgtattgcgggagttggcgtatagcgttgtatcgttttggttatcgttacgtatggcgattatcggtttgataaaagcgattttattcggcgttgttataatgtatatcgtatcgatacgatcgttattattggtgaattggttatcggttggcgtggtttgtagcgttggattgttggtcgttatgtcggagtcggttgtcgttttgagagtaatcgggttattcgttaaagtaatattagaatcgtcgttaatattcgcgcgtaattcgttggtggaattaaatttttgttgtagaacggtgtcgtcgtttagtttttgttatttttgcgtaaacgtattggttacgcgatcgtttaatgaattgcgtgggattagtattagcggcgtttgtttattttggttacgaatatgacgcgttgtatcgcgcgtttcgtttttcggtgaaagcgcgaagtaataaatattgacgcgattttcgatatttttcggttggtttagtgttagtacgtttagcggagtgttgt

SEQ ID NO: 37134 - DNA, 642 bp, Artificial Sequence
  chemically treated genomic DNA (Homo sapiens) CpG-island No: 37134
acaacactccgctaaacgtactaacactaaaccaaccgaaaaatatcgaaaatcgcgtcaatatttattacttcgcgctttcaccgaaaaacgaaacgcgcgatacaacgcgtcatattcgtaaccaaaataaacaaacgccgctaatactaatcccacgcaattcattaaacgatcgcgtaaccaatacgtttacgcaaaaataacaaaaactaaacgacgacaccgttctacaacaaaaatttaattccaccaacgaattacgcgcgaatattaacgacgattctaatattactttaacgaataacccgattactctcaaaacgacaaccgactccgacataacgaccaacaatccaacgctacaaaccacgccaaccgataaccaattcaccaataataacgatcgtatcgatacgatatacattataacaacgccgaataaaatcgcttttatcaaaccgataatcgccatacgtaacgataaccaaaacgatacaacgctatacgccaactcccgcaatacgcaaaaaaccgctaacccgaatttccgactaaaaataaaaaacttacaatacaacgaaatcccgatactaacaaacgataatctaccgttaatacaacaaacactcaacgcgataa

SEQ ID NO: 37135 - DNA, 642 bp, Artificial Sequence
  chemically treated genomic DNA (Homo sapiens) CpG-island No: 37135
gtaatatttcgttgaacgtattggtattgaattagtcggagaatatcgaaaatcgcgttaatatttgttatttcgcgtttttatcggaagacgaagcgcgcgatgtagcgcgttatattcgtgattagggtaaataagcgtcgttggtgttgattttacgtagtttattgggcgatcgcgtagttaatgcgtttgcgtaagagtggtagaaattgggcggcggtatcgttttgtaataaaaatttggttttattagcgaattacgcgcgggtgttaacggcggttttggtattgttttaacgggtagttcgattatttttagagcgataatcgatttcggtatgacgattaataatttaacgttgtaaattacgttaatcgatgattagtttattaataatggcggtcgtgtcgatgcggtgtatattgtggtaacgtcgggtgaaatcgtttttattaaatcgatgatcgttatgcgtaacggtagttagagcggtgtaacgttgtacgttagttttcgtagtgcgtaagggatcgttggttcggattttcgattggagatggaaggtttgtagtatagcgaaatttcgatgttggtaggcggtaatttatcgttaatgtagtaggtatttagcgcggtga

SEQ ID NO: 37136 - DNA, 642 bp, Artificial Sequence
  chemically treated genomic DNA (Homo sapiens) CpG-island No: 37136
tcaccgcgctaaatacctactacattaacgataaattaccgcctaccaacatcgaaatttcgctatactacaaaccttccatctccaatcgaaaatccgaaccaacgatcccttacgcactacgaaaactaacgtacaacgttacaccgctctaactaccgttacgcataacgatcatcgatttaataaaaacgatttcacccgacgttaccacaatatacaccgcatcgacacgaccgccattattaataaactaatcatcgattaacgtaatttacaacgttaaattattaatcgtcataccgaaatcgattatcgctctaaaaataatcgaactacccgttaaaacaataccaaaaccgccgttaacacccgcgcgtaattcgctaataaaaccaaatttttattacaaaacgataccgccgcccaatttctaccactcttacgcaaacgcattaactacgcgatcgcccaataaactacgtaaaatcaacaccaacgacgcttatttaccctaatcacgaatataacgcgctacatcgcgcgcttcgtcttccgataaaaacgcgaaataacaaatattaacgcgattttcgatattctccgactaattcaataccaatacgttcaacgaaatattac

SEQ ID NO: 37137 - DNA, 670 bp, Artificial Sequence
  chemically treated genomic DNA (Homo sapiens) CpG-island No: 37137
ttcggggcgtaaagtggggtatttgaatttgatcgatagcgatatatcgcgtttgattgcgacgttggaagttttaatttcgttgttgtcgtcggaatatgttagcggcgtgatttgggcgtagagtaagttcggttaattggtgttttatttttgtcggatgcggcgtaaacgttttattcggtttatcgattcggtatttattgtaggtttgataagatgcgttaagtatcgtattaggtattgtgtattaattgtcggatgcggtatcggttgtaggtttgataagacgcgttaagcgtcgtattaggtataaatgtttaatgtttacgattatagcgaaatataggttttcgtttcgttcgttagcgtttttttaattcgcgataacgttttaatttacgcgggtttattacggtttttgatataattatttatcgtcgttatattcggttttatcgaattatcggttttggtaaatggcgttaatttattcggtgtggtatggcgaatggtacgttgttgcggcgttttttagtttttatatatcgtattagtatcggtgaggattattagtttatttgtattaatttgttcggcgagtaacgtagcggcgagatttttatttattattgttttattttttggttcgttatttcggtttacgggt

SEQ ID NO: 37138 - DNA, 670 bp, Artificial Sequence
  chemically treated genomic DNA (Homo sapiens) CpG-island No: 37138
acccgtaaaccgaaataacgaaccaaaaaataaaacaataataaataaaaatctcgccgctacgttactcgccgaacaaattaatacaaataaactaataatcctcaccgatactaatacgatatataaaaactaaaaaacgccgcaacaacgtaccattcgccataccacaccgaataaattaacgccatttaccaaaaccgataattcgataaaaccgaatataacgacgataaataattatatcaaaaaccgtaataaacccgcgtaaattaaaacgttatcgcgaattaaaaaaacgctaacgaacgaaacgaaaacctatatttcgctataatcgtaaacattaaacatttatacctaatacgacgcttaacgcgtcttatcaaacctacaaccgataccgcatccgacaattaatacacaatacctaatacgatacttaacgcatcttatcaaacctacaataaataccgaatcgataaaccgaataaaacgtttacgccgcatccgacaaaaataaaacaccaattaaccgaacttactctacgcccaaatcacgccgctaacatattccgacgacaacaacgaaattaaaacttccaacgtcgcaatcaaacgcgatatatcgctatcgatcaaattcaaataccccactttacgccccgaa

SEQ ID NO: 37139 - DNA, 670 bp, Artificial Sequence
  chemically treated genomic DNA (Homo sapiens) CpG-island No: 37139
gttcgtgggtcggaatgacggattagggagtgaagtagtgatggataaagatttcgtcgttgcgttgttcgtcgagtagattaatgtagatggattggtgatttttatcgatgttgatgcggtatatgaaaattggggaacgtcgtagtaacgtgttattcgttatgttatatcggatgagttagcgttatttgttaaagtcgatggttcgatggggtcgaatgtaacggcggtgagtggttatgttagaagtcgtggtaaattcgcgtggattggggcgttatcgcgaattgaagagacgttggcgggcgaagcggggatttgtatttcgttgtagtcgtaggtattagatatttgtgtttgatgcgacgtttgacgcgttttattaggtttataatcggtgtcgtattcggtaattggtgtataatgtttgatgcgatgtttgacgtattttattaggtttataatgggtatcggatcggtaggtcggataaggcgtttacgtcgtattcggtaagaatagagtattagttaatcgaatttattttgcgtttaaattacgtcgttggtatatttcggcggtagtagcgggattaaggtttttagcgtcgtagttagacgcgatgtgtcgttgtcggttaaatttagatgttttattttacgtttcgga

SEQ ID NO: 37140 - DNA, 670 bp, Artificial Sequence
  chemically treated genomic DNA (Homo sapiens) CpG-island No: 37140
tccgaaacgtaaaataaaacatctaaatttaaccgacaacgacacatcgcgtctaactacgacgctaaaaaccttaatcccgctactaccgccgaaatataccaacgacgtaatttaaacgcaaaataaattcgattaactaatactctattcttaccgaatacgacgtaaacgccttatccgacctaccgatccgatacccattataaacctaataaaatacgtcaaacatcgcatcaaacattatacaccaattaccgaatacgacaccgattataaacctaataaaacgcgtcaaacgtcgcatcaaacacaaatatctaatacctacgactacaacgaaatacaaatccccgcttcgcccgccaacgtctcttcaattcgcgataacgccccaatccacgcgaatttaccacgacttctaacataaccactcaccgccgttacattcgaccccatcgaaccatcgactttaacaaataacgctaactcatccgatataacataacgaataacacgttactacgacgttccccaattttcatataccgcatcaacatcgataaaaatcaccaatccatctacattaatctactcgacgaacaacgcaacgacgaaatctttatccatcactacttcactccctaatccgtcattccgacccacgaac

SEQ ID NO: 37141 - DNA, 1098 bp, Artificial Sequence
  chemically treated genomic DNA (Homo sapiens) CpG-island No: 37141
agtttcggcggcgaaggttagcgtcgacggtagtcggtatttgacggcgtgatcgattcgagtcggtaatcgcgttttttttcggggtcgcgagggcgggcggggggcgggcggtaggcggggggcgtcgcgtttttattttcggtcgcgattgttttttttgcgtcgagtttcgatagagtcgtgcgttttcgagaggttgtttttgtgtgcggggatcgtcgtcggagtgcgcggaaaacgggagttgtatttcggaggcgtagcgacgttggggagttggggtttgggggtggggagggcgggaagcgacggggagacgcggagttttcgggagagaaaggaggcgttttagcgttttgcgagagtttaggagacgagtttcggagcgcgaggcgggcggaggttgtagttcgcggcgcgggcgagaggtgagcgtcgaggcgcggtcgggggtgcgggcgcggttttcgtttcgaggagcgagtgtttattgtttagttcggtgcggggtcggcggagatcgaggttttaatttttcgggggtagcgcggtagagtcgagaaggtgaattttgggaaggtgtattttttaatggaagcgcggagcggttgtagcggagagtgggagtcgggcgaggggaggtaggattcgggaagtgttgggggtgtgtgaaggtgaagcggggtgtcggggcggtcggcgagttgtagcgcggggcggggaaggggagtcgcggttcggcgggtggttcgggttcgtgttagtttcgggggtggggggcgaggggcgtcgagtatcgcgggcggacgggaaggagttgcggcgggcggggcgggcggcgcgttggggtcgagtaggtcgggtcgtggtgggggcggggagtcgggggtcgggtttcggcggcgtcgagtcgggttcgtttttgattgaattttttgggtgcgggcgtgtatgtaggaggcgcgttggggtcggggtcgggggcgggaggcggatcgggaggtttcgggttggttcgttagcgtttttttttttcgttttttttttttcgtttttgaagggataggttttcggggttttaggcgggaagcggga

SEQ ID NO: 37142 - DNA, 1098 bp, Artificial Sequence
  chemically treated genomic DNA (Homo sapiens) CpG-island No: 37142
tcccgcttcccgcctaaaaccccgaaaacctatcccttcaaaaacgaaaaaaaaaaaacgaaaaaaaaaaacgctaacgaaccaacccgaaacctcccgatccgcctcccgcccccgaccccgaccccaacgcgcctcctacatacacgcccgcacccaaaaaattcaatcaaaaacgaacccgactcgacgccgccgaaacccgacccccgactccccgcccccaccacgacccgacctactcgaccccaacgcgccgcccgccccgcccgccgcaactccttcccgtccgcccgcgatactcgacgcccctcgccccccacccccgaaactaacacgaacccgaaccacccgccgaaccgcgactccccttccccgccccgcgctacaactcgccgaccgccccgacaccccgcttcaccttcacacacccccaacacttcccgaatcctacctcccctcgcccgactcccactctccgctacaaccgctccgcgcttccattaaaaaatacaccttcccaaaattcaccttctcgactctaccgcgctacccccgaaaaattaaaacctcgatctccgccgaccccgcaccgaactaaacaataaacactcgctcctcgaaacgaaaaccgcgcccgcacccccgaccgcgcctcgacgctcacctctcgcccgcgccgcgaactacaacctccgcccgcctcgcgctccgaaactcgtctcctaaactctcgcaaaacgctaaaacgcctcctttctctcccgaaaactccgcgtctccccgtcgcttcccgccctccccacccccaaaccccaactccccaacgtcgctacgcctccgaaatacaactcccgttttccgcgcactccgacgacgatccccgcacacaaaaacaacctctcgaaaacgcacgactctatcgaaactcgacgcaaaaaaaacaatcgcgaccgaaaataaaaacgcgacgccccccgcctaccgcccgccccccgcccgccctcgcgaccccgaaaaaaaacgcgattaccgactcgaatcgatcacgccgtcaaataccgactaccgtcgacgctaaccttcgccgccgaaact

SEQ ID NO: 37143 - DNA, 1098 bp, Artificial Sequence
  chemically treated genomic DNA (Homo sapiens) CpG-island No: 37143
tttcgtttttcgtttggggtttcgagggtttgtttttttaggggcggagagaagggggcgagaaaagggggcgttggcgagttaattcggaatttttcggttcgtttttcgttttcggtttcggttttagcgcgttttttgtatatacgttcgtatttagaaagtttagttaggggcgagttcggttcggcgtcgtcggggttcggttttcggtttttcgtttttattacggttcggtttgttcggttttagcgcgtcgttcgtttcgttcgtcgtagttttttttcgttcgttcgcggtgttcggcgtttttcgttttttattttcggggttgatacgggttcgggttattcgtcgggtcgcggtttttttttttcgtttcgcgttgtagttcgtcggtcgtttcgatatttcgttttatttttatatatttttagtatttttcgagttttgttttttttcgttcggtttttatttttcgttgtagtcgtttcgcgtttttattaaagaatgtatttttttaggatttattttttcggttttgtcgcgttgttttcgaggggttagagtttcggttttcgtcgatttcgtatcgggttgggtaatgggtattcgtttttcggggcgggggtcgcgttcgtattttcggtcgcgtttcggcgtttatttttcgttcgcgtcgcgggttgtagttttcgttcgtttcgcgtttcgggattcgttttttgagttttcgtaaggcgttggagcgttttttttttttttcggggatttcgcgttttttcgtcgtttttcgttttttttatttttaagttttaattttttagcgtcgttgcgttttcgggatgtaattttcgtttttcgcgtatttcggcggcggttttcgtatataaaaatagtttttcggaggcgtacggttttgtcggagttcggcgtaggaagggtagtcgcggtcgggggtggggacgcggcgtttttcgtttgtcgttcgtttttcgttcgttttcgcggtttcgggggaaggcgcggttatcggttcgggtcggttacgtcgttaggtgtcggttgtcgtcggcgttgattttcgtcgtcgaagtt

SEQ ID NO: 37144 - DNA, 1098 bp, Artificial Sequence
  chemically treated genomic DNA (Homo sapiens) CpG-island No: 37144
aacttcgacgacgaaaatcaacgccgacgacaaccgacacctaacgacgtaaccgacccgaaccgataaccgcgccttcccccgaaaccgcgaaaacgaacgaaaaacgaacgacaaacgaaaaacgccgcgtccccacccccgaccgcgactacccttcctacgccgaactccgacaaaaccgtacgcctccgaaaaactatttttatatacgaaaaccgccgccgaaatacgcgaaaaacgaaaattacatcccgaaaacgcaacgacgctaaaaaattaaaacttaaaaataaaaaaaacgaaaaacgacgaaaaaacgcgaaatccccgaaaaaaaaaaaaaacgctccaacgccttacgaaaactcaaaaaacgaatcccgaaacgcgaaacgaacgaaaactacaacccgcgacgcgaacgaaaaataaacgccgaaacgcgaccgaaaatacgaacgcgacccccgccccgaaaaacgaatacccattacccaacccgatacgaaatcgacgaaaaccgaaactctaacccctcgaaaacaacgcgacaaaaccgaaaaaataaatcctaaaaaaatacattctttaataaaaacgcgaaacgactacaacgaaaaataaaaaccgaacgaaaaaaaacaaaactcgaaaaatactaaaaatatataaaaataaaacgaaatatcgaaacgaccgacgaactacaacgcgaaacgaaaaaaaaaaaccgcgacccgacgaataacccgaacccgtatcaaccccgaaaataaaaaacgaaaaacgccgaacaccgcgaacgaacgaaaaaaaactacgacgaacgaaacgaacgacgcgctaaaaccgaacaaaccgaaccgtaataaaaacgaaaaaccgaaaaccgaaccccgacgacgccgaaccgaactcgcccctaactaaactttctaaatacgaacgtatatacaaaaaacgcgctaaaaccgaaaccgaaaacgaaaaacgaaccgaaaaattccgaattaactcgccaacgcccccttttctcgcccccttctctccgcccctaaaaaaacaaaccctcgaaaccccaaacgaaaaacgaaa

SEQ ID NO: 37145 - DNA, 960 bp, Artificial Sequence
  chemically treated genomic DNA (Homo sapiens) CpG-island No: 37145
tgtcgtcggtttttatttaggtcgaggtggttcggttttatgtatcgcgacgtaacgcggggaggtagataaggtatagggcggcgtttataatttatgttaattcgttttatgtgttcgtcgaggcggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcggtcgacgtttttttttatgcgatttttgtattaggaagtagtttagtagtaggttgaggtcgttgagtatcgtcgtcgtaaggaatggtgtatgtaaggagatggcgtttaatagtttttcggttacggggtttgttattatatttacgtcgaaataagcgtttatgagttcgaagtggcgagttcgattttttttatcggtgatgtcggcgatataggcgttagtaatcgtatttgtggcgtcggtgatgtcggttacgatgcgttcggcgtagaggattagttatattattgttattataaatatttattaataagaaaata

SEQ ID NO: 37146 - DNA, 960 bp, Artificial Sequence
  chemically treated genomic DNA (Homo sapiens) CpG-island No: 37146
tattttcttattaataaatatttataataacaataatataactaatcctctacgccgaacgcatcgtaaccgacatcaccgacgccacaaatacgattactaacgcctatatcgccgacatcaccgataaaaaaaatcgaactcgccacttcgaactcataaacgcttatttcgacgtaaatataataacaaaccccgtaaccgaaaaactattaaacgccatctccttacatacaccattccttacgacgacgatactcaacgacctcaacctactactaaactacttcctaatacaaaaatcgcataaaaaaaaacgtcgaccgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgcctcgacgaacacataaaacgaattaacataaattataaacgccgccctataccttatctacctccccgcgttacgtcgcgatacataaaaccgaaccacctcgacctaaataaaaaccgacgaca

SEQ ID NO: 37147 - DNA, 960 bp, Artificial Sequence
  chemically treated genomic DNA (Homo sapiens) CpG-island No: 37147
tatttttttgttaatagatgtttatgataataatgatgtggttgattttttacgtcggacgtatcgtggtcggtattatcggcgttataggtgcggttgttggcgtttatatcgtcgatattatcgatggggaagatcgggttcgttatttcgggtttatgagcgtttgtttcggcgtgggtatggtggtaggtttcgtggtcgggggattgttgggcgttatttttttgtatgtattattttttgcggcggcggtgtttaacggttttaatttattattgggttgttttttaatgtaggagtcgtataagggagagcgtcgatcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgtttcggcgagtatatggaacgggttggtatggattgtaggcgtcgttttatattttgtttgttttttcgcgttgcgtcgcggtgtatggagtcgggttatttcgatttgaatggaagtcggcggta

SEQ ID NO: 37148 - DNA, 960 bp, Artificial Sequence
  chemically treated genomic DNA (Homo sapiens) CpG-island No: 37148
taccgccgacttccattcaaatcgaaataacccgactccatacaccgcgacgcaacgcgaaaaaacaaacaaaatataaaacgacgcctacaatccataccaacccgttccatatactcgccgaaacgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgatcgacgctctcccttatacgactcctacattaaaaaacaacccaataataaattaaaaccgttaaacaccgccgccgcaaaaaataatacatacaaaaaaataacgcccaacaatcccccgaccacgaaacctaccaccatacccacgccgaaacaaacgctcataaacccgaaataacgaacccgatcttccccatcgataatatcgacgatataaacgccaacaaccgcacctataacgccgataataccgaccacgatacgtccgacgtaaaaaatcaaccacatcattattatcataaacatctattaacaaaaaaata

SEQ ID NO: 37149 - DNA, 641 bp, Artificial Sequence
  chemically treated genomic DNA (Homo sapiens) CpG-island No: 37149
tgcgttcggcgcgcgttcgcggtaggagcggggacggggacggggacggggacggacggggacgcggacgggggaggaggtcgcggtaggggcgggcgcggtatttgcgggtcgatgtcgtttatcgcgtaatatttgatttttttgaatatttttttaggaattttgggcgtttggttcgatatgatcgcggcggttcgggaggtttcgcggcggcgttcggtttcgtttatttttcgttttcggttttcgcggcgttcggcgtttttattcgtttcgttaacggttttgttcgcgtagttcgggttcggttttgcgaatcggggttcgttttttcgtttttcgcgttttcgttcgcgttcgcgtcgagcgttcgaagcgcgggagtcgcgcgcgttttgcgggacgtattatttcgtttcggttatcgagggggagcgtcgaggagtcgttcggtttttagtgacgtttcgcgtttttgtcgttagttacggtttcggggtagttggcgtcggtagttcgttttggtttttgcggtttcgtggtcgtcgttttgtaacgagggggtttcgaggacgaggggaaattagtttttttttcggcggggttggagtgagtcggtttcgggtaggaggggagtt

SEQ ID NO: 37150 - DNA, 641 bp, Artificial Sequence
  chemically treated genomic DNA (Homo sapiens) CpG-island No: 37150
aactcccctcctacccgaaaccgactcactccaaccccgccgaaaaaaaaactaatttcccctcgtcctcgaaaccccctcgttacaaaacgacgaccacgaaaccgcaaaaaccaaaacgaactaccgacgccaactaccccgaaaccgtaactaacgacaaaaacgcgaaacgtcactaaaaaccgaacgactcctcgacgctccccctcgataaccgaaacgaaataatacgtcccgcaaaacgcgcgcgactcccgcgcttcgaacgctcgacgcgaacgcgaacgaaaacgcgaaaaacgaaaaaacgaaccccgattcgcaaaaccgaacccgaactacgcgaacaaaaccgttaacgaaacgaataaaaacgccgaacgccgcgaaaaccgaaaacgaaaaataaacgaaaccgaacgccgccgcgaaacctcccgaaccgccgcgatcatatcgaaccaaacgcccaaaattcctaaaaaaatattcaaaaaaatcaaatattacgcgataaacgacatcgacccgcaaataccgcgcccgcccctaccgcgacctcctcccccgtccgcgtccccgtccgtccccgtccccgtccccgtccccgctcctaccgcgaacgcgcgccgaacgca

SEQ ID NO: 37151 - DNA, 641 bp, Artificial Sequence
  chemically treated genomic DNA (Homo sapiens) CpG-island No: 37151
agttttttttttgttcgggatcggtttattttagtttcgtcgaggggggagttggttttttttcgttttcggggttttttcgttgtagagcggcggttacggaatcgtaagggttagagcgggttgtcggcgttagttatttcggagtcgtggttggcggtagaggcgcggggcgttattggaggtcgggcggtttttcggcgttttttttcggtggtcggggcgggatggtgcgtttcgtagggcgcgcgcggttttcgcgtttcgggcgttcggcgcgggcgcgggcgggggcgcggagggcgggggagcggatttcgattcgtaggatcgggttcgggttgcgcgggtagggtcgttggcggggcgagtgggggcgtcgggcgtcgcgggggtcgggggcggggggtgggcggggtcgggcgtcgtcgcggagtttttcgggtcgtcgcgattatgtcggattaggcgtttaaagtttttgaggagatgtttagggaggttaagtattacgcggtgggcgatatcgattcgtaggtatcgcgttcgtttttgtcgcggttttttttttcgttcgcgttttcgttcgttttcgttttcgttttcgttttcgtttttgtcgcgggcgcgcgtcgggcgta

SEQ ID NO: 37152 - DNA, 641 bp, Artificial Sequence
  chemically treated genomic DNA (Homo sapiens) CpG-island No: 37152
tacgcccgacgcgcgcccgcgacaaaaacgaaaacgaaaacgaaaacgaaaacgaacgaaaacgcgaacgaaaaaaaaaaccgcgacaaaaacgaacgcgatacctacgaatcgatatcgcccaccgcgtaatacttaacctccctaaacatctcctcaaaaactttaaacgcctaatccgacataatcgcgacgacccgaaaaactccgcgacgacgcccgaccccgcccaccccccgcccccgacccccgcgacgcccgacgcccccactcgccccgccaacgaccctacccgcgcaacccgaacccgatcctacgaatcgaaatccgctcccccgccctccgcgcccccgcccgcgcccgcgccgaacgcccgaaacgcgaaaaccgcgcgcgccctacgaaacgcaccatcccgccccgaccaccgaaaaaaaacgccgaaaaaccgcccgacctccaataacgccccgcgcctctaccgccaaccacgactccgaaataactaacgccgacaacccgctctaacccttacgattccgtaaccgccgctctacaacgaaaaaaccccgaaaacgaaaaaaaaccaactcccccctcgacgaaactaaaataaaccgatcccgaacaaaaaaaaaact

SEQ ID NO: 37153 - DNA, 680 bp, Artificial Sequence
  chemically treated genomic DNA (Homo sapiens) CpG-island No: 37153
gcggcgtatgcgcgcggcggaggggggggtggggttttggggtcgcgagtgggagcgggagcggttttgcggttttttcgggttttttggttttgggcggagtgggattgggtgtttcggttgttcgtagtggtcgcgagtgcggtcggatttggagtagtatttgagtcgttttggtcgagtaaggcgcggggtttcggtttatatcgcgttggattcggttatgtcgtgacggaattttcgaggtcgtagcgttacgcgagacgcgtattggtggttttcgcggcgagttttggggttttcgtaaggttttagtgttcgagttggggacgtgttggggggaggttcggtttcgtcgttgttcgaggtttcgttgtttcggtcggatcggtttggtttttggcgttttgtcgggttcgcgttggaggagagttttagatagtagagttcgcggtgtagttttagtttcgggaagtttcgcgtttaataggttaatattatatagcggcgattttaatggttacgtttttatttatagttcgtttttttttcgttaagatttatagaatacggtagagtggtttcgggattatttgtttaagatatttgtacgatcggaagttgggagaagaaattaaggttatgatgatgaacgtagtttttttcgtttatttttaatt

SEQ ID NO: 37154 - DNA, 680 bp, Artificial Sequence
  chemically treated genomic DNA (Homo sapiens) CpG-island No: 37154
aattaaaaataaacgaaaaaaactacgttcatcatcataaccttaatttcttctcccaacttccgatcgtacaaatatcttaaacaaataatcccgaaaccactctaccgtattctataaatcttaacgaaaaaaaaacgaactataaataaaaacgtaaccattaaaatcgccgctatataatattaacctattaaacgcgaaacttcccgaaactaaaactacaccgcgaactctactatctaaaactctcctccaacgcgaacccgacaaaacgccaaaaaccaaaccgatccgaccgaaacaacgaaacctcgaacaacgacgaaaccgaacctccccccaacacgtccccaactcgaacactaaaaccttacgaaaaccccaaaactcgccgcgaaaaccaccaatacgcgtctcgcgtaacgctacgacctcgaaaattccgtcacgacataaccgaatccaacgcgatataaaccgaaaccccgcgccttactcgaccaaaacgactcaaatactactccaaatccgaccgcactcgcgaccactacgaacaaccgaaacacccaatcccactccgcccaaaaccaaaaaacccgaaaaaaccgcaaaaccgctcccgctcccactcgcgaccccaaaaccccacccccccctccgccgcgcgcatacgccgc

SEQ ID NO: 37155 - DNA, 680 bp, Artificial Sequence
  chemically treated genomic DNA (Homo sapiens) CpG-island No: 37155
gattggaaataaacgagaaaggttgcgtttattattatggttttaatttttttttttaattttcggtcgtgtaggtgttttgggtaggtgatttcgaggttattttgtcgtgttttgtgaattttggcggaagggaggcgagttgtaaataaaagcgtgattattagaatcgtcgttgtgtagtattaatttgttgagcgcggggtttttcggggttggagttgtatcgcgggttttgttgtttgggatttttttttagcgcggattcgataggacgttagggattaggtcggttcggtcgggatagcggggtttcgggtagcgacggggtcgggtttttttttagtacgtttttagttcgggtattgaggttttgcggagattttaggattcgtcgcggaggttattagtgcgcgtttcgcgtggcgttacggtttcgggaatttcgttacggtatagtcgggtttagcgcggtgtagatcggggtttcgcgttttgttcggttagagcggtttaagtattattttaggttcggtcgtattcgcggttattgcgaatagtcgggatatttaattttatttcgtttagggttaagaagttcgaggaggtcgtagaatcgttttcgtttttattcgcggttttaaggttttattttttttttcgtcgcgcgtatgcgtcgt

SEQ ID NO: 37156 - DNA, 680 bp, Artificial Sequence
  chemically treated genomic DNA (Homo sapiens) CpG-island No: 37156
acgacgcatacgcgcgacgaaaaaaaaaataaaaccttaaaaccgcgaataaaaacgaaaacgattctacgacctcctcgaacttcttaaccctaaacgaaataaaattaaatatcccgactattcgcaataaccgcgaatacgaccgaacctaaaataatacttaaaccgctctaaccgaacaaaacgcgaaaccccgatctacaccgcgctaaacccgactataccgtaacgaaattcccgaaaccgtaacgccacgcgaaacgcgcactaataacctccgcgacgaatcctaaaatctccgcaaaacctcaatacccgaactaaaaacgtactaaaaaaaaacccgaccccgtcgctacccgaaaccccgctatcccgaccgaaccgacctaatccctaacgtcctatcgaatccgcgctaaaaaaaaatcccaaacaacaaaacccgcgatacaactccaaccccgaaaaaccccgcgctcaacaaattaatactacacaacgacgattctaataatcacgcttttatttacaactcgcctcccttccgccaaaattcacaaaacacgacaaaataacctcgaaatcacctacccaaaacacctacacgaccgaaaattaaaaaaaaaaattaaaaccataataataaacgcaacctttctcgtttatttccaatc

SEQ ID NO: 37157 - DNA, 966 bp, Artificial Sequence
  chemically treated genomic DNA (Homo sapiens) CpG-island No: 37157
tgtcgtcggtttttatttaggtcgaggtggttcggttttatgtatcgcgacgtaacgcggggaggtagataaggtatagggcggcgtttataatttatgttaattcgttttatgtgttcgtcgaggcggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcggtcgacgtttttttttatgcgatttttgtattaggaagtagtttagtagtaggttgaggtcgttgagtatcgtcgtcgtaaggaatggtgtatgtaaggagatggcgtttaatagtttttcggttacggggtttgttattatatttacgtcgaaataagcgtttatgagttcgaagtggcgagttcgattttttttatcggtgatgtcggcgatataggcgttagtaatcgtatttgtggcgtcggtgatgtcggttacgatgcgttcggcgtagaggattttttattttattagtttttttaatagtgtgatgttgataatttttttat

SEQ ID NO: 37158 - DNA, 966 bp, Artificial Sequence
  chemically treated genomic DNA (Homo sapiens) CpG-island No: 37158
ataaaaaaattatcaacatcacactattaaaaaaactaataaaataaaaaatcctctacgccgaacgcatcgtaaccgacatcaccgacgccacaaatacgattactaacgcctatatcgccgacatcaccgataaaaaaaatcgaactcgccacttcgaactcataaacgcttatttcgacgtaaatataataacaaaccccgtaaccgaaaaactattaaacgccatctccttacatacaccattccttacgacgacgatactcaacgacctcaacctactactaaactacttcctaatacaaaaatcgcataaaaaaaaacgtcgaccgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgcctcgacgaacacataaaacgaattaacataaattataaacgccgccctataccttatctacctccccgcgttacgtcgcgatacataaaaccgaaccacctcgacctaaataaaaaccgacgaca

SEQ ID NO: 37159 - DNA, 966 bp, Artificial Sequence
  chemically treated genomic DNA (Homo sapiens) CpG-island No: 37159
atagggaaattattaatattatattattagaggaattaataagatggaagattttttacgtcggacgtatcgtggtcggtattatcggcgttataggtgcggttgttggcgtttatatcgtcgatattatcgatggggaagatcgggttcgttatttcgggtttatgagcgtttgtttcggcgtgggtatggtggtaggtttcgtggtcgggggattgttgggcgttatttttttgtatgtattattttttgcggcggcggtgtttaacggttttaatttattattgggttgttttttaatgtaggagtcgtataagggagagcgtcgatcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgtttcggcgagtatatggaacgggttggtatggattgtaggcgtcgttttatattttgtttgttttttcgcgttgcgtcgcggtgtatggagtcgggttatttcgatttgaatggaagtcggcggta

SEQ ID NO: 37160 - DNA, 966 bp, Artificial Sequence
  chemically treated genomic DNA (Homo sapiens) CpG-island No: 37160
taccgccgacttccattcaaatcgaaataacccgactccatacaccgcgacgcaacgcgaaaaaacaaacaaaatataaaacgacgcctacaatccataccaacccgttccatatactcgccgaaacgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgatcgacgctctcccttatacgactcctacattaaaaaacaacccaataataaattaaaaccgttaaacaccgccgccgcaaaaaataatacatacaaaaaaataacgcccaacaatcccccgaccacgaaacctaccaccatacccacgccgaaacaaacgctcataaacccgaaataacgaacccgatcttccccatcgataatatcgacgatataaacgccaacaaccgcacctataacgccgataataccgaccacgatacgtccgacgtaaaaaatcttccatcttattaattcctctaataatataatattaataatttccctat

SEQ ID NO: 37161 - DNA, 1086 bp, Artificial Sequence
  chemically treated genomic DNA (Homo sapiens) CpG-island No: 37161
acggtgtagttttttttttattcgcgttttttttagttttagtcgtgcgtagtcggtttcggttaagtggggttgtcgtcgagtgcgttttttttcgggacgtttattttcgtgtcggggggcggtgttgcggcggcgcggggcgggtcgcgggggcggggacgttgggcgtaggaggcgcggtcgggagcgtcgcgcgtcgggagcggggcggcgggcgtcggggttggtatggcgtggttttgtattagtcgtttgtgttgtttggcgcggcgttggaattagttggatcgtttcgacgtggcggtgtcgtttattttgtacggttattcggatttcgatagcgaggagtcgggtacgggcggcgtcgtttcgcgtaggggttagtttttcgcgggcgttcgggatttcggtcgggacgtgtcgtttatttagtattagcgggatttcggtttgtggattacgttcgtcgggtttaaggattcgtcgtcggggcgcggatcgggggcgggcggtcgtaggggtaaatttttcgcgtagtttttcgcgttatttgcgttcggcgttcgcggggtttacgtgttgtttatcggcgacgcggacgcggttgtagtagtgattacgtcgtataggtatgggttgggtagggatcgtaacgagtttttattttgtggtgggaggacgcggaggttcggagttagagggatggggtgggcggtagagcggaggcgtttggagttcggattttacgcgatttcggagttgtcggcggttttagaggttattttcgtttggttcgtgggtattgtaggcggcgttttcgttgttttatgttcggatttagtgttcgagtattttcgtgtcgggagcgtatcgttgttttcgtagtcgtttttttgggggtagtcgttagaatggtttgtttttagtcgagttggaatcggtttttttttaatttttatcgtcgggtttagtcgtgcgaggggtgcgcgtaggttatgttttttagtttttttcggttattgtttagtgtgcgggcgttggtggtgaggatcgagcgtagggtttcgtgtgggtgagtttttt

SEQ ID NO: 37162 - DNA, 1086 bp, Artificial Sequence
  chemically treated genomic DNA (Homo sapiens) CpG-island No: 37162
aaaaaactcacccacacgaaaccctacgctcgatcctcaccaccaacgcccgcacactaaacaataaccgaaaaaaactaaaaaacataacctacgcgcacccctcgcacgactaaacccgacgataaaaattaaaaaaaaaccgattccaactcgactaaaaacaaaccattctaacgactacccccaaaaaaacgactacgaaaacaacgatacgctcccgacacgaaaatactcgaacactaaatccgaacataaaacaacgaaaacgccgcctacaatacccacgaaccaaacgaaaataacctctaaaaccgccgacaactccgaaatcgcgtaaaatccgaactccaaacgcctccgctctaccgcccaccccatccctctaactccgaacctccgcgtcctcccaccacaaaataaaaactcgttacgatccctacccaacccatacctatacgacgtaatcactactacaaccgcgtccgcgtcgccgataaacaacacgtaaaccccgcgaacgccgaacgcaaataacgcgaaaaactacgcgaaaaatttacccctacgaccgcccgcccccgatccgcgccccgacgacgaatccttaaacccgacgaacgtaatccacaaaccgaaatcccgctaatactaaataaacgacacgtcccgaccgaaatcccgaacgcccgcgaaaaactaacccctacgcgaaacgacgccgcccgtacccgactcctcgctatcgaaatccgaataaccgtacaaaataaacgacaccgccacgtcgaaacgatccaactaattccaacgccgcgccaaacaacacaaacgactaatacaaaaccacgccataccaaccccgacgcccgccgccccgctcccgacgcgcgacgctcccgaccgcgcctcctacgcccaacgtccccgcccccgcgacccgccccgcgccgccgcaacaccgccccccgacacgaaaataaacgtcccgaaaaaaaacgcactcgacgacaaccccacttaaccgaaaccgactacgcacgactaaaactaaaaaaaacgcgaataaaaaaaaaactacaccgt

SEQ ID NO: 37163 - DNA, 1086 bp, Artificial Sequence
  chemically treated genomic DNA (Homo sapiens) CpG-island No: 37163
gaagggtttatttatacgggattttgcgttcggtttttattattaacgttcgtatattaggtagtgatcggagagagttgggggatatggtttgcgcgtatttttcgtacggttaggttcggcggtgggagttaaagggaggtcggttttaattcggttgaaggtaggttattttgacggttgtttttaggagggcggttgcgagggtagcggtgcgttttcggtacgggggtgttcgagtattgagttcgggtatggagtagcgaaggcgtcgtttgtagtgtttacggattaaacgggggtgatttttgaggtcgtcggtagtttcgaggtcgcgtgggattcgggttttaggcgttttcgttttgtcgtttattttatttttttggtttcgggttttcgcgtttttttattatagggtggggattcgttgcggtttttatttagtttatatttgtacgacgtggttattgttgtagtcgcgttcgcgtcgtcgatgggtagtacgtagatttcgcgggcgtcgggcgtaggtggcgcggaggattgcgcggaggatttgtttttgcggtcgttcgttttcggttcgcgtttcggcggcggatttttgggttcggcgggcgtggtttataagtcgaagtttcgttggtattgagtgagcggtacgtttcggtcggaatttcgggcgttcgcgggaggttggtttttgcgcgaggcggcgtcgttcgtgttcggtttttcgttgtcgaggttcgagtagtcgtgtagagtgagcggtatcgttacgtcggagcggtttagttggttttagcgtcgcgttaggtagtataggcggttgatatagggttacgttatgttagtttcggcgttcgtcgtttcgttttcggcgcgcggcgttttcggtcgcgttttttgcgtttagcgttttcgttttcgcggttcgtttcgcgtcgtcgtagtatcgtttttcggtacgagggtgggcgtttcgggagggggcgtattcggcggtagttttatttggtcggggtcggttgcgtacggttggagttggagggagcgcggatgggggaaaggttgtatcgt

SEQ ID NO: 37164 - DNA, 1086 bp, Artificial Sequence
  chemically treated genomic DNA (Homo sapiens) CpG-island No: 37164
acgatacaacctttcccccatccgcgctccctccaactccaaccgtacgcaaccgaccccgaccaaataaaactaccgccgaatacgccccctcccgaaacgcccaccctcgtaccgaaaaacgatactacgacgacgcgaaacgaaccgcgaaaacgaaaacgctaaacgcaaaaaacgcgaccgaaaacgccgcgcgccgaaaacgaaacgacgaacgccgaaactaacataacgtaaccctatatcaaccgcctatactacctaacgcgacgctaaaaccaactaaaccgctccgacgtaacgataccgctcactctacacgactactcgaacctcgacaacgaaaaaccgaacacgaacgacgccgcctcgcgcaaaaaccaacctcccgcgaacgcccgaaattccgaccgaaacgtaccgctcactcaataccaacgaaacttcgacttataaaccacgcccgccgaacccaaaaatccgccgccgaaacgcgaaccgaaaacgaacgaccgcaaaaacaaatcctccgcgcaatcctccgcgccacctacgcccgacgcccgcgaaatctacgtactacccatcgacgacgcgaacgcgactacaacaataaccacgtcgtacaaatataaactaaataaaaaccgcaacgaatccccaccctataataaaaaaacgcgaaaacccgaaaccaaaaaaataaaataaacgacaaaacgaaaacgcctaaaacccgaatcccacgcgacctcgaaactaccgacgacctcaaaaatcacccccgtttaatccgtaaacactacaaacgacgccttcgctactccatacccgaactcaatactcgaacacccccgtaccgaaaacgcaccgctaccctcgcaaccgccctcctaaaaacaaccgtcaaaataacctaccttcaaccgaattaaaaccgacctccctttaactcccaccgccgaacctaaccgtacgaaaaatacgcgcaaaccatatcccccaactctctccgatcactacctaatatacgaacgttaataataaaaaccgaacgcaaaatcccgtataaataaacccttc

SEQ ID NO: 37165 - DNA, 695 bp, Artificial Sequence
  chemically treated genomic DNA (Homo sapiens) CpG-island No: 37165
cgcggagaagacggttattacgtatacgaaggcgggggtttcgttttgttggaattgtcgtcgcgtcgcgcgttttaggttttcgacgtcgtcgtcgttcgcgttcgcgttttgtaggttggtgttcgattcggcggtagttaggaggttgtatttttcggtcgcgttcgtcgcgttcggtttcggttgttttttgcgtcgttcgtttattaggttgtttaggtttcgtagcgtgtattttatattttcgtttgttttgcgggatatagggtaggggttcggggttgttcggggggacgcggtttcgcgggtcggtagtttcggcgagttagatagttcgagtcggcgggagtaatcgtcgttgtcgtcgttttttttttttcggttttcgtttcggttgttacggtagtagtcgtcgttacggtcgtttcggggagaaagttgttgttcgtcgcgtttcgacgttgcggagttggagttcggcgggttttattttatatttacgtttcgcgtttgtcgagttggcgttgcggagcgggcgggaggcgggatcgcgggttacgtgtaatttcgggtcggcggggcggggttcgggaaacgtttcgttttttttttgggcggggttaggtttagttcgtttcggatttttaaatttcgttttttcggtgggtgcgatttttgatttaggttttttt

SEQ ID NO: 37166 - DNA, 695 bp, Artificial Sequence
  chemically treated genomic DNA (Homo sapiens) CpG-island No: 37166
aaaaaaacctaaatcaaaaatcgcacccaccgaaaaaacgaaatttaaaaatccgaaacgaactaaacctaaccccgcccaaaaaaaaaacgaaacgtttcccgaaccccgccccgccgacccgaaattacacgtaacccgcgatcccgcctcccgcccgctccgcaacgccaactcgacaaacgcgaaacgtaaatataaaataaaacccgccgaactccaactccgcaacgtcgaaacgcgacgaacaacaactttctccccgaaacgaccgtaacgacgactactaccgtaacaaccgaaacgaaaaccgaaaaaaaaaaaacgacgacaacgacgattactcccgccgactcgaactatctaactcgccgaaactaccgacccgcgaaaccgcgtccccccgaacaaccccgaacccctaccctatatcccgcaaaacaaacgaaaatataaaatacacgctacgaaacctaaacaacctaataaacgaacgacgcaaaaaacaaccgaaaccgaacgcgacgaacgcgaccgaaaaatacaacctcctaactaccgccgaatcgaacaccaacctacaaaacgcgaacgcgaacgacgacgacgtcgaaaacctaaaacgcgcgacgcgacgacaattccaacaaaacgaaacccccgccttcgtatacgtaataaccgtcttctccgcg

SEQ ID NO: 37167 - DNA, 695 bp, Artificial Sequence
  chemically treated genomic DNA (Homo sapiens) CpG-island No: 37167
gagggagtttaggttagaggtcgtatttatcgggagggcggggtttaggggttcggggcgggttgagtttggtttcgtttaaggagggggcgggacgtttttcgggtttcgtttcgtcggttcggggttgtacgtgattcgcggtttcgtttttcgttcgtttcgtagcgttagttcggtaggcgcggggcgtgagtgtggagtgagattcgtcgggttttaatttcgtagcgtcggagcgcggcgggtagtaatttttttttcggagcggtcgtggcggcggttgttgtcgtggtagtcggagcggaagtcgggaggaagaaagcggcggtagcggcggttgttttcgtcggttcgggttgtttagttcgtcgagattgtcggttcgcggagtcgcgttttttcgggtagtttcgggtttttgttttatgtttcgtaaggtaagcgagaatgtggagtatacgttgcggagtttgagtagtttgatgggcgagcggcgtaggaagtagtcggagtcggacgcggcgagcgcggtcggggagtgtagttttttggttgtcgtcgaatcgagtattagtttgtagagcgcgggcgcgggcggcggcggcgtcggggatttggagcgcgcggcgcggcggtagttttagtaggacgagattttcgttttcgtgtacgtggtggtcgtttttttcgcg

SEQ ID NO: 37168 - DNA, 695 bp, Artificial Sequence
  chemically treated genomic DNA (Homo sapiens) CpG-island No: 37168
cgcgaaaaaaacgaccaccacgtacacgaaaacgaaaatctcgtcctactaaaactaccgccgcgccgcgcgctccaaatccccgacgccgccgccgcccgcgcccgcgctctacaaactaatactcgattcgacgacaaccaaaaaactacactccccgaccgcgctcgccgcgtccgactccgactacttcctacgccgctcgcccatcaaactactcaaactccgcaacgtatactccacattctcgcttaccttacgaaacataaaacaaaaacccgaaactacccgaaaaaacgcgactccgcgaaccgacaatctcgacgaactaaacaacccgaaccgacgaaaacaaccgccgctaccgccgctttcttcctcccgacttccgctccgactaccacgacaacaaccgccgccacgaccgctccgaaaaaaaaattactacccgccgcgctccgacgctacgaaattaaaacccgacgaatctcactccacactcacgccccgcgcctaccgaactaacgctacgaaacgaacgaaaaacgaaaccgcgaatcacgtacaaccccgaaccgacgaaacgaaacccgaaaaacgtcccgccccctccttaaacgaaaccaaactcaacccgccccgaacccctaaaccccgccctcccgataaatacgacctctaacctaaactccctc

SEQ ID NO: 37169 - DNA, 511 bp, Artificial Sequence
  chemically treated genomic DNA (Homo sapiens) CpG-island No: 37169
cgttcgggtgtcggttataatgtttcgggttacggcgttaggtattggggcggcgggttcgggatttgcgagcgagtgtttcggattttttcgtttcgttagttttagattcgggcgttgttgtcgttaggtcgcgcgtttcgtttcgtttatcgagttcgtagacgggtgttatttacggcgggaggttgagttgtcgcggtcgcggtcgcggtaggcgcggcgggagcggcgggcgcggcgggcgcggcgggcgcggcgggcgcggcgggaacgggggacgcggcggggtgcgttgggttcggttttgtagttttttttttttagagcgttcggtattcgttcgtcgagtagattaggagtcgagggggcggagcggttagtttcgttttaggcgtcggttggaggcgcgttcggttgttcgggacggggttcggggcgttttttgttggagttttttttcggatagtttcggggcgagagtttagtttttcggtcgggtaggggatat

SEQ ID NO: 37170 - DNA, 511 bp, Artificial Sequence
  chemically treated genomic DNA (Homo sapiens) CpG-island No: 37170
atatcccctacccgaccgaaaaactaaactctcgccccgaaactatccgaaaaaaaactccaacaaaaaacgccccgaaccccgtcccgaacaaccgaacgcgcctccaaccgacgcctaaaacgaaactaaccgctccgccccctcgactcctaatctactcgacgaacgaataccgaacgctctaaaaaaaaaaaactacaaaaccgaacccaacgcaccccgccgcgtcccccgttcccgccgcgcccgccgcgcccgccgcgcccgccgcgcccgccgctcccgccgcgcctaccgcgaccgcgaccgcgacaactcaacctcccgccgtaaataacacccgtctacgaactcgataaacgaaacgaaacgcgcgacctaacgacaacaacgcccgaatctaaaactaacgaaacgaaaaaatccgaaacactcgctcgcaaatcccgaacccgccgccccaatacctaacgccgtaacccgaaacattataaccgacacccgaacg

SEQ ID NO: 37171 - DNA, 511 bp, Artificial Sequence
  chemically treated genomic DNA (Homo sapiens) CpG-island No: 37171
gtgttttttattcggtcgggaagttgggttttcgtttcgggattgttcgggagggggttttagtagggggcgtttcgagtttcgtttcgggtagtcgggcgcgtttttagtcggcgtttgggacggggttggtcgtttcgttttttcggtttttagtttgttcggcgggcgggtgtcgggcgttttgggaggagaggattgtagggtcgagtttagcgtatttcgtcgcgtttttcgttttcgtcgcgttcgtcgcgttcgtcgcgttcgtcgcgttcgtcgttttcgtcgcgtttgtcgcggtcgcgatcgcggtagtttagtttttcgtcgtgagtagtattcgtttgcgggttcgatgggcgggacggggcgcgcggtttgacggtagtagcgttcgggtttggggttggcggggcgaagagattcggggtattcgttcgtagatttcgggttcgtcgttttaatgtttgacgtcgtggttcggggtattgtggtcggtattcgagcg

SEQ ID NO: 37172 - DNA, 511 bp, Artificial Sequence
  chemically treated genomic DNA (Homo sapiens) CpG-island No: 37172
cgctcgaataccgaccacaataccccgaaccacgacgtcaaacattaaaacgacgaacccgaaatctacgaacgaataccccgaatctcttcgccccgccaaccccaaacccgaacgctactaccgtcaaaccgcgcgccccgtcccgcccatcgaacccgcaaacgaatactactcacgacgaaaaactaaactaccgcgatcgcgaccgcgacaaacgcgacgaaaacgacgaacgcgacgaacgcgacgaacgcgacgaacgcgacgaaaacgaaaaacgcgacgaaatacgctaaactcgaccctacaatcctctcctcccaaaacgcccgacacccgcccgccgaacaaactaaaaaccgaaaaaacgaaacgaccaaccccgtcccaaacgccgactaaaaacgcgcccgactacccgaaacgaaactcgaaacgccccctactaaaaccccctcccgaacaatcccgaaacgaaaacccaacttcccgaccgaataaaaaacac

SEQ ID NO: 37173 - DNA, 544 bp, Artificial Sequence
  chemically treated genomic DNA (Homo sapiens) CpG-island No: 37173
cgtcgggtaggagtagcgcgtgggtcgatttgttgtagtttaggatgattcgtaggttttgcgaggcggtttcgtttacgaatattgaggggatggcgatttggttttttaagttttcgtagacgtgggttatgtttacgaggtcgtcggagtggacgttgtgtacgatggtcgtttcgaagtcggcgcgttgggcgtttagtattttgaggtcgaaggtgtagtcgtagcggcggattagtacgatggcgtttagagagcggttgtttagtcgcggggtttcgatgggatggtacgcgttggttggtttgatttttattaggtagtttcgtatgttttcgggggttagggggacgtcgaatagcgtcggtagattcgtaaagtttatcgagttcgagttgttttttagtacggttcgtattatcgtttgcgcgggtatttggagtagcgataagattagtaaggttttgattgttacgagggttcggttcggtcgtggttattttatggttattcgtttcgttgtttgtgtgttgttaggttt

SEQ ID NO: 37174 - DNA, 544 bp, Artificial Sequence
  chemically treated genomic DNA (Homo sapiens) CpG-island No: 37174
aaacctaacaacacacaaacaacgaaacgaataaccataaaataaccacgaccgaaccgaaccctcgtaacaatcaaaaccttactaatcttatcgctactccaaatacccgcgcaaacgataatacgaaccgtactaaaaaacaactcgaactcgataaactttacgaatctaccgacgctattcgacgtccccctaacccccgaaaacatacgaaactacctaataaaaatcaaaccaaccaacgcgtaccatcccatcgaaaccccgcgactaaacaaccgctctctaaacgccatcgtactaatccgccgctacgactacaccttcgacctcaaaatactaaacgcccaacgcgccgacttcgaaacgaccatcgtacacaacgtccactccgacgacctcgtaaacataacccacgtctacgaaaacttaaaaaaccaaatcgccatcccctcaatattcgtaaacgaaaccgcctcgcaaaacctacgaatcatcctaaactacaacaaatcgacccacgcgctactcctacccgacg

SEQ ID NO: 37175 - DNA, 544 bp, Artificial Sequence
  chemically treated genomic DNA (Homo sapiens) CpG-island No: 37175
ggatttagtagtatatagatagcgaagcgggtgattatggggtggttacggtcgggtcgagttttcgtggtagttaaagttttgttggttttgtcgttgttttaggtgttcgcgtaggcggtggtacgggtcgtgttggaagataattcgagttcggtggattttgcggatttgtcggcgttgttcggcgtttttttggttttcgagggtatacggggttatttgatggaggttaagttagttaacgcgtgttattttatcgaggtttcgcgattgggtaatcgttttttgggcgttatcgtgttgattcgtcgttacgattgtattttcgattttaaggtgttgaacgtttagcgcgtcggtttcgaggcggttatcgtgtataacgtttatttcgacgatttcgtgagtatgatttacgtttacgaggatttgaggggttagatcgttatttttttagtgttcgtgagcgaggtcgtttcgtaggatttgcgggttattttgggttgtaataagtcggtttacgcgttgtttttgttcgacg

SEQ ID NO: 37176 - DNA, 544 bp, Artificial Sequence
  chemically treated genomic DNA (Homo sapiens) CpG-island No: 37176
cgtcgaacaaaaacaacgcgtaaaccgacttattacaacccaaaataacccgcaaatcctacgaaacgacctcgctcacgaacactaaaaaaataacgatctaacccctcaaatcctcgtaaacgtaaatcatactcacgaaatcgtcgaaataaacgttatacacgataaccgcctcgaaaccgacgcgctaaacgttcaacaccttaaaatcgaaaatacaatcgtaacgacgaatcaacacgataacgcccaaaaaacgattacccaatcgcgaaacctcgataaaataacacgcgttaactaacttaacctccatcaaataaccccgtataccctcgaaaaccaaaaaaacgccgaacaacgccgacaaatccgcaaaatccaccgaactcgaattatcttccaacacgacccgtaccaccgcctacgcgaacacctaaaacaacgacaaaaccaacaaaactttaactaccacgaaaactcgacccgaccgtaaccaccccataatcacccgcttcgctatctatatactactaaatcc

SEQ ID NO: 37177 - DNA, 529 bp, Artificial Sequence
  chemically treated genomic DNA (Homo sapiens) CpG-island No: 37177
gtaggaatgtggagtataggtagtatttcggtatcgtggtgaggttaatcggtataggaacgtggagtataggtagtattttagtatcgtggtgaggttaatcggtgtaggaacgtggagtataggtagtattcgggtatcgcggtgaggttaattggtgtaggaatacggagtagaagtagtattcgggtatcgcggtgaggttaataggtataggaacgtggagtagaggtagaattcgggtatcgcggtgaggttaatcggtgtaggaacgtggagtagaattagtatttgggtatcgcggtgaggttaatcggtgtaggaacgtggagtagaattagtatttgggtattacggtgaggttaatcggtgtaggaacgtggagtagaggtagtatttgggtattatagtgaggttaattggtgcgggaacgtggagtagaagtagtattcgggtatcgtaggaggttaatcggtgtaggaatttgtagtggtcgttttttttgtatagtttttagagtcggtgttta

SEQ ID NO: 37178 - DNA, 529 bp, Artificial Sequence
  chemically treated genomic DNA (Homo sapiens) CpG-island No: 37178
taaacaccgactctaaaaactatacaaaaaaaacgaccactacaaattcctacaccgattaacctcctacgatacccgaatactacttctactccacgttcccgcaccaattaacctcactataatacccaaatactacctctactccacgttcctacaccgattaacctcaccgtaatacccaaatactaattctactccacgttcctacaccgattaacctcaccgcgatacccaaatactaattctactccacgttcctacaccgattaacctcaccgcgatacccgaattctacctctactccacgttcctatacctattaacctcaccgcgatacccgaatactacttctactccgtattcctacaccaattaacctcaccgcgatacccgaatactacctatactccacgttcctacaccgattaacctcaccacgatactaaaatactacctatactccacgttcctataccgattaacctcaccacgataccgaaatactacctatactccacattcctac

SEQ ID NO: 37179 - DNA, 529 bp, Artificial Sequence
  chemically treated genomic DNA (Homo sapiens) CpG-island No: 37179
taagtatcggttttgggggttgtgtaagaagggcgattattgtaagtttttgtatcggttgattttttgcgatgttcgaatgttatttttattttacgttttcgtattagttgattttattgtgatgtttaaatgttgtttttattttacgtttttatatcggttgattttatcgtgatgtttaagtgttaattttattttacgtttttgtatcggttgattttatcgcgatgtttaagtgttaattttattttacgtttttgtatcggttgattttatcgcgatgttcgaattttatttttattttacgtttttgtatttgttgattttatcgcgatgttcgaatgttatttttatttcgtgtttttgtattagttgattttatcgcgatgttcgaatgttatttgtattttacgtttttatatcggttgattttattacgatgttggaatgttatttgtattttacgtttttgtatcggttgattttattacgatgtcggaatgttatttgtattttatatttttgt

SEQ ID NO: 37180 - DNA, 529 bp, Artificial Sequence
  chemically treated genomic DNA (Homo sapiens) CpG-island No: 37180
acaaaaatataaaatacaaataacattccgacatcgtaataaaatcaaccgatacaaaaacgtaaaatacaaataacattccaacatcgtaataaaatcaaccgatataaaaacgtaaaatacaaataacattcgaacatcgcgataaaatcaactaatacaaaaacacgaaataaaaataacattcgaacatcgcgataaaatcaacaaatacaaaaacgtaaaataaaaataaaattcgaacatcgcgataaaatcaaccgatacaaaaacgtaaaataaaattaacacttaaacatcgcgataaaatcaaccgatacaaaaacgtaaaataaaattaacacttaaacatcacgataaaatcaaccgatataaaaacgtaaaataaaaacaacatttaaacatcacaataaaatcaactaatacgaaaacgtaaaataaaaataacattcgaacatcgcaaaaaatcaaccgatacaaaaacttacaataatcgcccttcttacacaacccccaaaaccgatactta

SEQ ID NO: 37181 - DNA, 652 bp, Artificial Sequence
  chemically treated genomic DNA (Homo sapiens) CpG-island No: 37181
atagacgtcgcgttatattttagattttgcgtcgtattttatagattttgcgttttatattatagacgtcgcgttatattttatagacgtcgtgttatattttatagattttgcgttttattttatagacgtcgcgttatattttatagatttcgcgttttattttatagatttcgcgttttattttatagacgtcgcgttatattttatagacgtcgcgttatattttatagacgtcgcgttatattttatagacgtcgtgttatattttatagattttgcgtcgtattttatagattttgcgttttacgttatagacgtcgcgttatattttatagacgtcgcgttatattttatagacgtcgcgttatattttatagacgtcgtgttatattttatagattttgcgtcgtattttatagacgtcgcgtcgtattttatagacgtcgcgttatattttatagacgtcgcgttatattttatagattttgcgtcgtattttatagattttgcgttttacgttatagacgtcgcgtagtattttatatattttgcgtcgtattttatagacgtcgcgttttattttatagatttatagacgttgtatcgtattgtatagatattgtatttttatagatattgtatcgtattt

SEQ ID NO: 37182 - DNA, 652 bp, Artificial Sequence
  chemically treated genomic DNA (Homo sapiens) CpG-island No: 37182
aaatacgatacaatatctataaaaatacaatatctatacaatacgatacaacgtctataaatctataaaataaaacgcgacgtctataaaatacgacgcaaaatatataaaatactacgcgacgtctataacgtaaaacgcaaaatctataaaatacgacgcaaaatctataaaatataacgcgacgtctataaaatataacgcgacgtctataaaatacgacgcgacgtctataaaatacgacgcaaaatctataaaatataacacgacgtctataaaatataacgcgacgtctataaaatataacgcgacgtctataaaatataacgcgacgtctataacgtaaaacgcaaaatctataaaatacgacgcaaaatctataaaatataacacgacgtctataaaatataacgcgacgtctataaaatataacgcgacgtctataaaatataacgcgacgtctataaaataaaacgcgaaatctataaaataaaacgcgaaatctataaaatataacgcgacgtctataaaataaaacgcaaaatctataaaatataacacgacgtctataaaatataacgcgacgtctataatataaaacgcaaaatctataaaatacgacgcaaaatctaaaatataacgcgacgtctat

SEQ ID NO: 37183 - DNA, 652 bp, Artificial Sequence
  chemically treated genomic DNA (Homo sapiens) CpG-island No: 37183
aagtgcgatgtagtatttatgaaaatgtagtgtttgtgtagtgcggtgtagcgtttgtgaatttgtgaggtggggcgcggcgtttgtgagatgcggcgtagggtgtgtgaggtgttacgcggcgtttgtgacgtagggcgtagggtttgtgaggtgcggcgtagggtttgtgaggtgtggcgcggcgtttgtgaggtgtggcgcggcgtttgtgaggtgcggcgcggcgtttgtgaggtgcggcgtagggtttgtgaggtgtggtacggcgtttgtgaggtgtggcgcggcgtttgtgaggtgtggcgcggcgtttgtgaggtgtggcgcggcgtttgtgacgtagggcgtagggtttgtgaggtgcggcgtagggtttgtgaggtgtggtacggcgtttgtgaggtgtggcgcggcgtttgtgaggtgtggcgcggcgtttgtgaggtgtggcgcggcgtttgtgaggtggggcgcggggtttgtgaggtggggcgcggggtttgtgaggtgtggcgcggcgtttgtgaggtggggcgtagggtttgtgaggtgtggtacggcgtttgtgaggtgtggcgcggcgtttgtgatgtagggcgtagggtttgtgaggtgcggcgtagggtttgaggtgtggcgcggcgtttgt

SEQ ID NO: 37184 - DNA, 652 bp, Artificial Sequence
  chemically treated genomic DNA (Homo sapiens) CpG-island No: 37184
acaaacgccgcgccacacctcaaaccctacgccgcacctcacaaaccctacgccctacatcacaaacgccgcgccacacctcacaaacgccgtaccacacctcacaaaccctacgccccacctcacaaacgccgcgccacacctcacaaaccccgcgccccacctcacaaaccccgcgccccacctcacaaacgccgcgccacacctcacaaacgccgcgccacacctcacaaacgccgcgccacacctcacaaacgccgtaccacacctcacaaaccctacgccgcacctcacaaaccctacgccctacgtcacaaacgccgcgccacacctcacaaacgccgcgccacacctcacaaacgccgcgccacacctcacaaacgccgtaccacacctcacaaaccctacgccgcacctcacaaacgccgcgccgcacctcacaaacgccgcgccacacctcacaaacgccgcgccacacctcacaaaccctacgccgcacctcacaaaccctacgccctacgtcacaaacgccgcgtaacacctcacacaccctacgccgcatctcacaaacgccgcgccccacctcacaaattcacaaacgctacaccgcactacacaaacactacattttcataaatactacatcgcactt

SEQ ID NO: 37185 - DNA, 1974 bp, Artificial Sequence
  chemically treated genomic DNA (Homo sapiens) CpG-island No: 37185
ttagtttttttcgttagcgcgcgttcgcgcgttttttagttagttttacgttattttgattgatagtttagtttcgtcgtttttttttttatcgatttttttattattagtgttaattttcgcgaatcgtcgttttttattggttggttttggcgtttcgcggtttttttaggaatagttttttattaagttcgggaggacgcggttggcggaggaggggtcgggatgggaagggagatcgaggagacggcggagatggaagcgagaggagggggggagggagaacgtttcgttcggcgttgcgttgttataggtttcggggaggagcgcgttagcgttttacgttggttgtagcgtacgcgattggttgatgcgggttttttgtttttttttatttttaatttttcgggtttacgtttttcgtcggtttcgcgttcgcgtttttcgttcgaacggggttgggcggggtcggcgttggttagtttcggagtgtgaaatcgcgtgttaatgtaagcggcgcgagaggcgcgggcggcggcggcggtgggagcggcggttgtagaagtagtagtagtagaaatagcggcgggtattttgtgtttcgcgtttcggaggtagtcgattgcgttattttattttcgtacggtcgggcgggattcgcgttattagttcggattttcgtcgtttcgcggcgattaaaattttcgttggttttatcgttgtgattattttggattcgttcgtagagtttgttcgtcggggagggtggtcgattggcggagcgtatttttgttgttttttttattatttcgtggatgtcgtttttcgggtggtgagagaattttgtagtgggttggagcgttttttgcggagaagtatacgaaggtgaaggaaggaaagaaagaagatcgaggaagaaggagttcggaagaagggttcggagcggtcggttcggtcgtgtagggcgagtgcgttcgaggcgcggcgttttgatgtttttcgggttcgaggagtattgggtatttgcgggattgttttcggtggagtagtttcgtcgggttcggagggtttgtgtaatcgcggagaatatcgagtgttggtcgtacggggcgtgtcgagtcgtttttcggcgcgtttttcgtatttttttcgtttcgttattcgtcgtttttcggttaggagttttcgttgcgtttttaatttcgtttttttttgcgtttcgggagtttgcgagtattcggtcgaaggcgtagtcgaattttgcgggagtcgtttcgaaagcgtcgggtttgtgtggggttagcgggggtcgtcgcgttatttgtatttcgttcgtcgtcgtttcggggaaagttcgaagaggaggcggattaggagaagagtaaagaaaagtagttcgtttggatttgtttgtttaggattggcgtcgcgtacgcggatcgtcgaggggagtgcggtcggagttatcgcgttttcgttttttcgttcgggtagttgaggtcgggggttggagcgttgttttcgcgtatagttttcgagcgttcgacgttttcgcgtaggtttttgaagtagttgggtttggggcgtttattaatgtggttttgagggtcggagttcgtatcgacgggagcgggagtcggagtagttgcgggcgtcgagtggtcggtgcgttcggcggagcgcgcgtgcgtggttagcgcgtttttcgtttttgtttggtttttcggtttaatttttttcggcgggattaaagttggaaattgatcggagaattgagttgtcggggaatagagtttcggtcgtcgttagagcgatgttttcgtagagtcggtattcggtgaggcgcggttgggtggtggtggggggttaggatcgttggggaggcgtttttttcgggcggtagggagattggtggtttttgaggttcggcggattttttcgtttttagcggtgtaaggttggggaggtttgggg

SEQ ID NO: 37186 - DNA, 1974 bp, Artificial Sequence
  chemically treated genomic DNA (Homo sapiens) CpG-island No: 37186
ccccaaacctccccaaccttacaccgctaaaaacgaaaaaatccgccgaacctcaaaaaccaccaatctccctaccgcccgaaaaaaacgcctccccaacgatcctaaccccccaccaccacccaaccgcgcctcaccgaataccgactctacgaaaacatcgctctaacgacgaccgaaactctattccccgacaactcaattctccgatcaatttccaactttaatcccgccgaaaaaaattaaaccgaaaaaccaaacaaaaacgaaaaacgcgctaaccacgcacgcgcgctccgccgaacgcaccgaccactcgacgcccgcaactactccgactcccgctcccgtcgatacgaactccgaccctcaaaaccacattaataaacgccccaaacccaactacttcaaaaacctacgcgaaaacgtcgaacgctcgaaaactatacgcgaaaacaacgctccaacccccgacctcaactacccgaacgaaaaaacgaaaacgcgataactccgaccgcactcccctcgacgatccgcgtacgcgacgccaatcctaaacaaacaaatccaaacgaactacttttctttactcttctcctaatccgcctcctcttcgaactttccccgaaacgacgacgaacgaaatacaaataacgcgacgacccccgctaaccccacacaaacccgacgctttcgaaacgactcccgcaaaattcgactacgccttcgaccgaatactcgcaaactcccgaaacgcaaaaaaaaacgaaattaaaaacgcaacgaaaactcctaaccgaaaaacgacgaataacgaaacgaaaaaaatacgaaaaacgcgccgaaaaacgactcgacacgccccgtacgaccaacactcgatattctccgcgattacacaaaccctccgaacccgacgaaactactccaccgaaaacaatcccgcaaatacccaatactcctcgaacccgaaaaacatcaaaacgccgcgcctcgaacgcactcgccctacacgaccgaaccgaccgctccgaacccttcttccgaactccttcttcctcgatcttctttctttccttccttcaccttcgtatacttctccgcaaaaaacgctccaacccactacaaaattctctcaccacccgaaaaacgacatccacgaaataataaaaaaaacaacaaaaatacgctccgccaatcgaccaccctccccgacgaacaaactctacgaacgaatccaaaataatcacaacgataaaaccaacgaaaattttaatcgccgcgaaacgacgaaaatccgaactaataacgcgaatcccgcccgaccgtacgaaaataaaataacgcaatcgactacctccgaaacgcgaaacacaaaatacccgccgctatttctactactactacttctacaaccgccgctcccaccgccgccgccgcccgcgcctctcgcgccgcttacattaacacgcgatttcacactccgaaactaaccaacgccgaccccgcccaaccccgttcgaacgaaaaacgcgaacgcgaaaccgacgaaaaacgtaaacccgaaaaattaaaaataaaaaaaaacaaaaaacccgcatcaaccaatcgcgtacgctacaaccaacgtaaaacgctaacgcgctcctccccgaaacctataacaacgcaacgccgaacgaaacgttctccctccccccctcctctcgcttccatctccgccgtctcctcgatctcccttcccatcccgacccctcctccgccaaccgcgtcctcccgaacttaataaaaaactattcctaaaaaaaccgcgaaacgccaaaaccaaccaataaaaaacgacgattcgcgaaaattaacactaataataaaaaaatcgataaaaaaaaaaacgacgaaactaaactatcaatcaaaataacgtaaaactaactaaaaaacgcgcgaacgcgcgctaacgaaaaaaactaa

SEQ ID NO: 37187 - DNA, 1974 bp, Artificial Sequence
  chemically treated genomic DNA (Homo sapiens) CpG-island No: 37187
ttttagatttttttagttttatatcgttgagggcgagaaggttcgtcgggttttagaagttattagtttttttatcgttcgggagaagcgtttttttaacgattttggttttttattattatttagtcgcgttttatcgggtgtcggttttgcgggaatatcgttttggcggcggtcggggttttgtttttcggtaatttaatttttcggttaatttttaattttaatttcgtcgaggaaaattaagtcggaaagttaagtagaagcggggagcgcgttggttacgtacgcgcgtttcgtcgggcgtatcggttattcggcgttcgtagttgtttcggttttcgttttcgtcggtgcgggtttcggtttttagggttatattagtgggcgttttaggtttagttgttttaagaatttgcgcggagacgtcgggcgttcggggattgtacgcgggggtagcgttttaattttcggttttagttgttcgggcggggaggcgggggcgcggtgatttcgatcgtatttttttcggcgattcgcgtgcgcggcgttagttttgggtaaataaatttagacggattgtttttttttgttttttttttggttcgtttttttttcgggtttttttcgaggcggcggcgggcgaggtgtaggtggcgcggcggttttcgttaattttatataaattcgacgttttcggggcgattttcgtaagattcggttgcgttttcggtcgggtgttcgtaggttttcgggacgtaaaggggagcgaggttgaagacgtagcggaggtttttggtcggggagcgacggatgacgaggcggggaaagtgcggagggcgcgtcgggaggcggttcggtacgtttcgtgcgattagtattcggtgtttttcgcggttgtataaatttttcgggttcgacggggttattttatcgagagtagtttcgtaagtgtttaatgtttttcgagttcggggagtattagggcgtcgcgtttcgggcgtattcgttttgtacggtcggatcggtcgtttcggatttttttttcgagttttttttttttcggtttttttttttttttttttttattttcgtgtgttttttcgtaaagggcgttttagtttattgtaaagtttttttattattcgagggacgatatttacgagatggtggggaaaatagtaggagtgcgtttcgttaatcggttatttttttcggcgggtaaattttgcgggcgagtttagagtagttatagcggtggggttagcgggggttttggtcgtcgcgggacgacggaggttcgggttggtggcgcgggtttcgttcggtcgtgcgagggtggggtggcgtagtcggttgttttcgggacgcggggtatagagtattcgtcgttgtttttgttgttgttgtttttgtagtcgtcgtttttatcgtcgtcgtcgttcgcgtttttcgcgtcgtttatattaatacgcggttttatatttcggagttaattagcgtcggtttcgtttagtttcgttcgggcggggggcgcgagcgcggagtcggcgggggacgtgagttcgggaggttgggggtgggggggggtagaaggttcgtattagttaatcgcgtgcgttgtaattaacgtggggcgttgacgcgttttttttcggagtttatggtagcgtagcgtcggacggggcgtttttttttttttttttttttcgtttttattttcgtcgttttttcggtttttttttttatttcggtttttttttcgttagtcgcgttttttcgggtttggtgaggaattgtttttggaggagtcgcgggacgttaaaattagttaatgggaagcggcgattcgcggagattggtattgatgatgggaaggtcggtgggaaggagagcggcggggttgggttgttaattaaagtaacgtggggttggttagagagcgcgcgggcgcgcgttagcgggagggattgg

SEQ ID NO: 37188 - DNA, 1974 bp, Artificial Sequence
  chemically treated genomic DNA (Homo sapiens) CpG-island No: 37188
ccaatccctcccgctaacgcgcgcccgcgcgctctctaaccaaccccacgttactttaattaacaacccaaccccgccgctctccttcccaccgaccttcccatcatcaataccaatctccgcgaatcgccgcttcccattaactaattttaacgtcccgcgactcctccaaaaacaattcctcaccaaacccgaaaaaacgcgactaacgaaaaaaaaaccgaaataaaaaaaaaaaccgaaaaaacgacgaaaataaaaacgaaaaaaaaaaaaaaaaaaaaacgccccgtccgacgctacgctaccataaactccgaaaaaaaacgcgtcaacgccccacgttaattacaacgcacgcgattaactaatacgaaccttctacccccccccacccccaacctcccgaactcacgtcccccgccgactccgcgctcgcgccccccgcccgaacgaaactaaacgaaaccgacgctaattaactccgaaatataaaaccgcgtattaatataaacgacgcgaaaaacgcgaacgacgacgacgataaaaacgacgactacaaaaacaacaacaacaaaaacaacgacgaatactctataccccgcgtcccgaaaacaaccgactacgccaccccaccctcgcacgaccgaacgaaacccgcgccaccaacccgaacctccgtcgtcccgcgacgaccaaaacccccgctaaccccaccgctataactactctaaactcgcccgcaaaatttacccgccgaaaaaaataaccgattaacgaaacgcactcctactattttccccaccatctcgtaaatatcgtccctcgaataataaaaaaactttacaataaactaaaacgccctttacgaaaaaacacacgaaaataaaaaaaaaaaaaaaaaaaaaccgaaaaaaaaaaaactcgaaaaaaaaatccgaaacgaccgatccgaccgtacaaaacgaatacgcccgaaacgcgacgccctaatactccccgaactcgaaaaacattaaacacttacgaaactactctcgataaaataaccccgtcgaacccgaaaaatttatacaaccgcgaaaaacaccgaatactaatcgcacgaaacgtaccgaaccgcctcccgacgcgccctccgcactttccccgcctcgtcatccgtcgctccccgaccaaaaacctccgctacgtcttcaacctcgctcccctttacgtcccgaaaacctacgaacacccgaccgaaaacgcaaccgaatcttacgaaaatcgccccgaaaacgtcgaatttatataaaattaacgaaaaccgccgcgccacctacacctcgcccgccgccgcctcgaaaaaaacccgaaaaaaaaacgaaccaaaaaaaaaacaaaaaaaaacaatccgtctaaatttatttacccaaaactaacgccgcgcacgcgaatcgccgaaaaaaatacgatcgaaatcaccgcgcccccgcctccccgcccgaacaactaaaaccgaaaattaaaacgctacccccgcgtacaatccccgaacgcccgacgtctccgcgcaaattcttaaaacaactaaacctaaaacgcccactaatataaccctaaaaaccgaaacccgcaccgacgaaaacgaaaaccgaaacaactacgaacgccgaataaccgatacgcccgacgaaacgcgcgtacgtaaccaacgcgctccccgcttctacttaactttccgacttaattttcctcgacgaaattaaaattaaaaattaaccgaaaaattaaattaccgaaaaacaaaaccccgaccgccgccaaaacgatattcccgcaaaaccgacacccgataaaacgcgactaaataataataaaaaaccaaaatcgttaaaaaaacgcttctcccgaacgataaaaaaactaataacttctaaaacccgacgaaccttctcgccctcaacgatataaaactaaaaaaatctaaaa

SEQ ID NO: 37189 - DNA, 565 bp, Artificial Sequence
  chemically treated genomic DNA (Homo sapiens) CpG-island No: 37189
tttttcgtagagtttttagtttataattcggattcgcgttcgtcggaatttacgggggcgttcgcgcgggagttatttcgtttttagttcgtcggcgcgcggtcgacgcgcgagtacgattcgttaattcgacggtcgtcggggtttcggcgtcggttttattcggttttaggttacgttttgcggagagcgcggtattcgagatagcgtattcgggtttttttcgtacggttagcgttcgggcgttagtagtagacggaggggtagagtcgggtcggagcggaaaattacgtagttcggttcgggaatcgatttgtggagatcgttatttttttttgtagttcgacgtagtcgttcgtacgtacgtacgaatcgtcgcgcgttattttcgggagcgcgtcgttttgtacgcgttatagcggatttcgttttcggcgggcgcggggcgattcgagggatagcgcgtacgtgggtcgaggggtcgcggggtttcgttgttgttttcgtaatttttttgtgaatttcgtttttaaaatgaaacgttaaagaataagtttatgagggt

SEQ ID NO: 37190 - DNA, 565 bp, Artificial Sequence
  chemically treated genomic DNA (Homo sapiens) CpG-island No: 37190
accctcataaacttattctttaacgtttcattttaaaaacgaaattcacaaaaaaattacgaaaacaacaacgaaaccccgcgacccctcgacccacgtacgcgctatccctcgaatcgccccgcgcccgccgaaaacgaaatccgctataacgcgtacaaaacgacgcgctcccgaaaataacgcgcgacgattcgtacgtacgtacgaacgactacgtcgaactacaaaaaaaaataacgatctccacaaatcgattcccgaaccgaactacgtaattttccgctccgacccgactctacccctccgtctactactaacgcccgaacgctaaccgtacgaaaaaaacccgaatacgctatctcgaataccgcgctctccgcaaaacgtaacctaaaaccgaataaaaccgacgccgaaaccccgacgaccgtcgaattaacgaatcgtactcgcgcgtcgaccgcgcgccgacgaactaaaaacgaaataactcccgcgcgaacgcccccgtaaattccgacgaacgcgaatccgaattataaactaaaaactctacgaaaaa

SEQ ID NO: 37191 - DNA, 565 bp, Artificial Sequence
  chemically treated genomic DNA (Homo sapiens) CpG-island No: 37191
gtttttatgaatttattttttagcgttttattttgagagcgggatttataagggaattgcggaaatagtagcgaggtttcgcgatttttcggtttacgtgcgcgttgtttttcgggtcgtttcgcgttcgtcgggggcggagttcgttgtgacgcgtgtagggcggcgcgttttcggaagtgacgcgcgacggttcgtgcgtgcgtgcgggcggttgcgtcgggttgtaggagaagatggcggtttttataggtcggttttcgggtcgggttgcgtgatttttcgtttcgattcggttttgttttttcgtttgttgttggcgttcgagcgttgatcgtgcgggagaagttcgagtgcgttgtttcgaatgtcgcgtttttcgtagagcgtagtttgggatcgggtgggatcggcgtcgaggtttcggcggtcgtcgggttggcgggtcgtgttcgcgcgtcggtcgcgcgtcggcgggttgggggcggggtggttttcgcgcgggcgttttcgtaggtttcggcgggcgcgggttcgagttgtaggttgaaggttttacgggagg

SEQ ID NO: 37192 - DNA, 565 bp, Artificial Sequence
  chemically treated genomic DNA (Homo sapiens) CpG-island No: 37192
cctcccgtaaaaccttcaacctacaactcgaacccgcgcccgccgaaacctacgaaaacgcccgcgcgaaaaccaccccgcccccaacccgccgacgcgcgaccgacgcgcgaacacgacccgccaacccgacgaccgccgaaacctcgacgccgatcccacccgatcccaaactacgctctacgaaaaacgcgacattcgaaacaacgcactcgaacttctcccgcacgatcaacgctcgaacgccaacaacaaacgaaaaaacaaaaccgaatcgaaacgaaaaatcacgcaacccgacccgaaaaccgacctataaaaaccgccatcttctcctacaacccgacgcaaccgcccgcacgcacgcacgaaccgtcgcgcgtcacttccgaaaacgcgccgccctacacgcgtcacaacgaactccgcccccgacgaacgcgaaacgacccgaaaaacaacgcgcacgtaaaccgaaaaatcgcgaaacctcgctactatttccgcaattcccttataaatcccgctctcaaaataaaacgctaaaaaataaattcataaaaac

SEQ ID NO: 37193 - DNA, 532 bp, Artificial Sequence
  chemically treated genomic DNA (Homo sapiens) CpG-island No: 37193
taagttcgcgcggtcgcggagtcgtagagttatagttttaaggcgcgcggcggatttcgttcgttttattttttcgtttcgcgtttcgggatagttttcgtttttttcgagcggttttagtttcgttgttagcgttttttttgttcgtttagtcgcggtatgggttgttattttattaatatacgcgcgcgcgtatatatatatatatatatatatatatatatatatattttttgtttcgttaagcgtttatattcgttaacgttttcgtttcgtttttcggttatcgtagtagaggttacgcgtgatatttaggattacgcgtgattatcgcgattaaacgacggttacggtttgtgttcgtagggaagtgaagttagatttttgttggatgtcgtgtgttttttaggattgcgttttttcgcgtagataggtacgtgtttggggtgtgtatatagtttcggtgataagtgttaaagagaattttcgtgtttgtagtttttgttttatagttaagattcgcgttggtgtt

SEQ ID NO: 37194 - DNA, 532 bp, Artificial Sequence
  chemically treated genomic DNA (Homo sapiens) CpG-island No: 37194
aacaccaacgcgaatcttaactataaaacaaaaactacaaacacgaaaattctctttaacacttatcaccgaaactatatacacaccccaaacacgtacctatctacgcgaaaaaacgcaatcctaaaaaacacacgacatccaacaaaaatctaacttcacttccctacgaacacaaaccgtaaccgtcgtttaatcgcgataatcacgcgtaatcctaaatatcacgcgtaacctctactacgataaccgaaaaacgaaacgaaaacgttaacgaatataaacgcttaacgaaacaaaaaatatatatatatatatatatatatatatatatatatacgcgcgcgcgtatattaataaaataacaacccataccgcgactaaacgaacaaaaaaaacgctaacaacgaaactaaaaccgctcgaaaaaaacgaaaactatcccgaaacgcgaaacgaaaaaataaaacgaacgaaatccgccgcgcgccttaaaactataactctacgactccgcgaccgcgcgaactta

SEQ ID NO: 37195 - DNA, 532 bp, Artificial Sequence
  chemically treated genomic DNA (Homo sapiens) CpG-island No: 37195
aatattaacgcgagttttgattgtagaataggggttgtaagtacgaaaattttttttgatatttattatcgaggttatgtgtatattttaggtacgtatttgtttgcgcgggaggacgtagttttaggggatatacgatatttagtagaggtttgattttatttttttacgaatatagatcgtagtcgtcgtttgatcgcggtggttacgcgtggttttaaatgttacgcgtggtttttgttgcggtggtcgaagggcggggcgggggcgttggcgagtgtgggcgtttggcgaggtaaagggtgtgtgtgtgtgtgtgtgtgtgtgtgtgtgtgtatgcgcgcgcgcgtgtgttagtggagtagtagtttatgtcgcggttggacgggtaaagggggcgttggtagcgaagttgaggtcgttcggaggaaacgggagttgtttcgaggcgcgaggcgaggagatggggcgggcgaagttcgtcgcgcgttttggggttgtaattttgcggtttcgcggtcgcgcggatttg

SEQ ID NO: 37196 - DNA, 532 bp, Artificial Sequence
  chemically treated genomic DNA (Homo sapiens) CpG-island No: 37196
caaatccgcgcgaccgcgaaaccgcaaaattacaaccccaaaacgcgcgacgaacttcgcccgccccatctcctcgcctcgcgcctcgaaacaactcccgtttcctccgaacgacctcaacttcgctaccaacgccccctttacccgtccaaccgcgacataaactactactccactaacacacgcgcgcgcgcatacacacacacacacacacacacacacacacacaccctttacctcgccaaacgcccacactcgccaacgcccccgccccgcccttcgaccaccgcaacaaaaaccacgcgtaacatttaaaaccacgcgtaaccaccgcgatcaaacgacgactacgatctatattcgtaaaaaaataaaatcaaacctctactaaatatcgtatatcccctaaaactacgtcctcccgcgcaaacaaatacgtacctaaaatatacacataacctcgataataaatatcaaaaaaaattttcgtacttacaacccctattctacaatcaaaactcgcgttaatatt

SEQ ID NO: 37197 - DNA, 726 bp, Artificial Sequence
  chemically treated genomic DNA (Homo sapiens) CpG-island No: 37197
tagggcgcgttatagtggtttttttcgtttagttacgcgtagtgaaattttcggtaatcgggttagttaagatacgggatttgtatcgtagttttttagtttttggagtcggagtcgagcgttttcggtagtttttttaattttttttttaaagtgcgaagggaaaagtttcgtttgttttacgattgtaaggtcggcggatttgggagtcgcgttcggtttcggaggattcggcgggttcggggtttttcggtagcggtttttttgttaggggttaatagtagttttcgcggtcgggcgggcgcggacgttttttttttattcgttcgggaacgtggatatcgcgttcgtaggatgttcgtcggttgggatcggtagttaggaaatatgagaaggtttcgttatttttgttttcgggcggcgcgcgtcgggttgggtaaataaagtcgagacgacggcggtggcggtggtgagcgcgttggagttcgcgtggagaatatgcggcggggatgggagtgcgtttagtttcgaggcgggagagttagtcgttttgtagtcggtcgtcggtttcgtagttataggtatagttttcgcgtcgtcgagttttagtcggttgcggcggaacgttaggttcgttttggtttttgcgttttgggcgtcggtgttttttcgttttttttttaatttttttttaaggtttggtggagaggcgttcgggtagcggtt

SEQ ID NO: 37198 - DNA, 726 bp, Artificial Sequence
  chemically treated genomic DNA (Homo sapiens) CpG-island No: 37198
aaccgctacccgaacgcctctccaccaaaccttaaaaaaaaattaaaaaaaaaacgaaaaaacaccgacgcccaaaacgcaaaaaccaaaacgaacctaacgttccgccgcaaccgactaaaactcgacgacgcgaaaactatacctataactacgaaaccgacgaccgactacaaaacgactaactctcccgcctcgaaactaaacgcactcccatccccgccgcatattctccacgcgaactccaacgcgctcaccaccgccaccgccgtcgtctcgactttatttacccaacccgacgcgcgccgcccgaaaacaaaaataacgaaaccttctcatatttcctaactaccgatcccaaccgacgaacatcctacgaacgcgatatccacgttcccgaacgaataaaaaaaaaacgtccgcgcccgcccgaccgcgaaaactactattaacccctaacaaaaaaaccgctaccgaaaaaccccgaacccgccgaatcctccgaaaccgaacgcgactcccaaatccgccgaccttacaatcgtaaaacaaacgaaacttttcccttcgcactttaaaaaaaaaattaaaaaaactaccgaaaacgctcgactccgactccaaaaactaaaaaactacgatacaaatcccgtatcttaactaacccgattaccgaaaatttcactacgcgtaactaaacgaaaaaaaccactataacgcgcccta

SEQ ID NO: 37199 - DNA, 726 bp, Artificial Sequence
  chemically treated genomic DNA (Homo sapiens) CpG-island No: 37199
ggtcgttattcgagcgtttttttattagattttggagggaagttgggggaagggcgggagagtatcggcgtttagggcgtaggggttagagcgagtttggcgtttcgtcgtagtcggttgagattcggcgacgcgggggttgtatttgtggttgcggggtcgacggtcggttgtagggcggttggttttttcgtttcgagattaggcgtatttttattttcgtcgtatgttttttacgcgggttttagcgcgtttattatcgttatcgtcgtcgtttcggttttatttatttagttcggcgcgcgtcgttcgggaataggaatagcgaggtttttttatgttttttgattgtcggttttagtcggcgaatattttgcgggcgcggtatttacgttttcgggcgggtggagaggaagcgttcgcgttcgttcggtcgcgggggttgttgttaatttttagtagaggagtcgttgtcggggagtttcgggttcgtcgagtttttcggagtcgggcgcggtttttagattcgtcggttttgtagtcgtggagtagacggggttttttttttcgtattttaggagagaaattggagaagttgtcgggagcgttcggtttcggttttagaagttgagaggttgcggtgtaaatttcgtgttttagttggttcgattgtcggaaattttattgcgcgtggttaggcgggagaggttattgtgacgcgttttg

SEQ ID NO: 37200 - DNA, 726 bp, Artificial Sequence
  chemically treated genomic DNA (Homo sapiens) CpG-island No: 37200
caaaacgcgtcacaataacctctcccgcctaaccacgcgcaataaaatttccgacaatcgaaccaactaaaacacgaaatttacaccgcaacctctcaacttctaaaaccgaaaccgaacgctcccgacaacttctccaatttctctcctaaaatacgaaaaaaaaaaccccgtctactccacgactacaaaaccgacgaatctaaaaaccgcgcccgactccgaaaaactcgacgaacccgaaactccccgacaacgactcctctactaaaaattaacaacaacccccgcgaccgaacgaacgcgaacgcttcctctccacccgcccgaaaacgtaaataccgcgcccgcaaaatattcgccgactaaaaccgacaatcaaaaaacataaaaaaacctcgctattcctattcccgaacgacgcgcgccgaactaaataaataaaaccgaaacgacgacgataacgataataaacgcgctaaaacccgcgtaaaaaacatacgacgaaaataaaaatacgcctaatctcgaaacgaaaaaaccaaccgccctacaaccgaccgtcgaccccgcaaccacaaatacaacccccgcgtcgccgaatctcaaccgactacgacgaaacgccaaactcgctctaacccctacgccctaaacgccgatactctcccgcccttcccccaacttccctccaaaatctaataaaaaaacgctcgaataacgacc

SEQ ID NO: 37201 - DNA, 573 bp, Artificial Sequence
  chemically treated genomic DNA (Homo sapiens) CpG-island No: 37201
agtcgacggttggcgcgttagggattttagtagatagcgtttttcgtcgttttgtcgtttagttcggggttttcggggatgcggtttttacgttatttatcgcgcgtgtaagttcgagaataggtagaggaggagtagtagtttcggggttatggtgtcgtggagttcggggcgtagggttcggggtttcggtcgggcgcggtttttttcggcgcggatttggttttcgtcggttttttttgttttggtttttttcgaggttgttggtcgcggcgggcgggataggtatttattttggcgttggtcgcgttttcgcggggcgtatacgggacgtatacgggacgtcgggttatcgcggcgcgtcgtttttattcgcgtattagcgtcggttcgcgtaatcgggcggcgggagtaatgggcgtcggggattttttggcgcggcgtcgtttatttcgtttggagtcgcgagcgggcgcgggtgtttaggtcggggttgtgtgcgttgtgttgggaggtgggggtagttgggcggttgttttttggtagcgttttcgaggcggtttcggcggggag

SEQ ID NO: 37202 - DNA, 573 bp, Artificial Sequence
  chemically treated genomic DNA (Homo sapiens) CpG-island No: 37202
ctccccgccgaaaccgcctcgaaaacgctaccaaaaaacaaccgcccaactacccccacctcccaacacaacgcacacaaccccgacctaaacacccgcgcccgctcgcgactccaaacgaaataaacgacgccgcgccaaaaaatccccgacgcccattactcccgccgcccgattacgcgaaccgacgctaatacgcgaataaaaacgacgcgccgcgataacccgacgtcccgtatacgtcccgtatacgccccgcgaaaacgcgaccaacgccaaaataaatacctatcccgcccgccgcgaccaacaacctcgaaaaaaaccaaaacaaaaaaaaccgacgaaaaccaaatccgcgccgaaaaaaaccgcgcccgaccgaaaccccgaaccctacgccccgaactccacgacaccataaccccgaaactactactcctcctctacctattctcgaacttacacgcgcgataaataacgtaaaaaccgcatccccgaaaaccccgaactaaacgacaaaacgacgaaaaacgctatctactaaaatccctaacgcgccaaccgtcgact

SEQ ID NO: 37203 - DNA, 573 bp, Artificial Sequence
  chemically treated genomic DNA (Homo sapiens) CpG-island No: 37203
tttttcgtcgggatcgtttcggaggcgttgttaggggatagtcgtttagttgtttttattttttagtatagcgtatatagtttcggtttgggtattcgcgttcgttcgcggttttaggcggggtgggcggcgtcgcgttagggggttttcggcgtttattgttttcgtcgttcggttgcgcggatcggcgttagtgcgcgggtgggggcggcgcgtcgcggtggttcggcgtttcgtgtgcgtttcgtgtgcgtttcgcgggggcgcggttagcgttagagtagatatttgtttcgttcgtcgcggttagtagtttcggaggaagttagggtaaagagggtcggcggagattaggttcgcgtcggaggaagtcgcgttcggtcgaggtttcggattttgcgtttcgagttttacggtattatggtttcgaagttgttgttttttttttgtttgttttcgggtttgtacgcgcggtaagtggcgtgggggtcgtattttcggaggtttcgagttgggcgatagggcggcggggggcgttgtttgttggagtttttggcgcgttagtcgtcggtt

SEQ ID NO: 37204 - DNA, 573 bp, Artificial Sequence
  chemically treated genomic DNA (Homo sapiens) CpG-island No: 37204
aaccgacgactaacgcgccaaaaactccaacaaacaacgccccccgccgccctatcgcccaactcgaaacctccgaaaatacgacccccacgccacttaccgcgcgtacaaacccgaaaacaaacaaaaaaaaaacaacaacttcgaaaccataataccgtaaaactcgaaacgcaaaatccgaaacctcgaccgaacgcgacttcctccgacgcgaacctaatctccgccgaccctctttaccctaacttcctccgaaactactaaccgcgacgaacgaaacaaatatctactctaacgctaaccgcgcccccgcgaaacgcacacgaaacgcacacgaaacgccgaaccaccgcgacgcgccgcccccacccgcgcactaacgccgatccgcgcaaccgaacgacgaaaacaataaacgccgaaaaccccctaacgcgacgccgcccaccccgcctaaaaccgcgaacgaacgcgaatacccaaaccgaaactatatacgctatactaaaaaataaaaacaactaaacgactatcccctaacaacgcctccgaaacgatcccgacgaaaaa

SEQ ID NO: 37205 - DNA, 519 bp, Artificial Sequence
  chemically treated genomic DNA (Homo sapiens) CpG-island No: 37205
tagcggggatagcgtgtagcgtaggcggcgtagcgtcgttttcgaggtgaggttttagagttacgcggagacggcgtcggggtttaatagtatcgtttagagtagcgatagttttaggaagaggagcggtagcgttagtagtatttgtagcgcgtttagtacgtatcgtttgcggggcgaaaggcgggtaggtgggggatcgcggtcgcgtttatcgttcggtttatttgatggttagcgcgcgagggtcgtcgaatagtcgcgttttttgcggggagagagggtcgtatttagttattttcgcgttcgcggcgtcggttcggtttttaggaggagggggaggcggtatcgcgggggggacggggagggttgtttcgttttagtttatttcgttcggattcgcgtaggcgtttattcggttcgttttggttattttttttatgagcgattcggtgttgtattgtatttcgcgaagttgttcgttatatttgcggggataggtatgtaggtgggagttta

SEQ ID NO: 37206 - DNA, 519 bp, Artificial Sequence
  chemically treated genomic DNA (Homo sapiens) CpG-island No: 37206
taaactcccacctacatacctatccccgcaaatataacgaacaacttcgcgaaatacaatacaacaccgaatcgctcataaaaaaaataaccaaaacgaaccgaataaacgcctacgcgaatccgaacgaaataaactaaaacgaaacaaccctccccgtcccccccgcgataccgcctccccctcctcctaaaaaccgaaccgacgccgcgaacgcgaaaataactaaatacgaccctctctccccgcaaaaaacgcgactattcgacgaccctcgcgcgctaaccatcaaataaaccgaacgataaacgcgaccgcgatcccccacctacccgcctttcgccccgcaaacgatacgtactaaacgcgctacaaatactactaacgctaccgctcctcttcctaaaactatcgctactctaaacgatactattaaaccccgacgccgtctccgcgtaactctaaaacctcacctcgaaaacgacgctacgccgcctacgctacacgctatccccgcta

SEQ ID NO: 37207 - DNA, 519 bp, Artificial Sequence
  chemically treated genomic DNA (Homo sapiens) CpG-island No: 37207
tgggtttttatttgtatgtttgttttcgtaggtgtgacgggtagtttcgcggagtgtagtatagtatcgagtcgtttatggaggagatggttagggcggatcgagtgagcgtttgcgcgggttcgggcggggtgggttggagcgggataatttttttcgtttttttcgcggtatcgtttttttttttttttggaaatcgggtcggcgtcgcgggcgcggaggtagttggatgcggtttttttttttcgtaggagacgcggttgttcggcggttttcgcgcgttggttattaggtgagtcgggcggtgggcgcggtcgcggttttttatttgttcgtttttcgtttcgtaggcggtgcgtgttgggcgcgttgtaggtgttgttgacgttgtcgtttttttttttggggttgtcgttgttttggacggtgttgttggatttcggcgtcgttttcgcgtggttttggagttttatttcggagacgacgttgcgtcgtttgcgttatacgttgttttcgttg

SEQ ID NO: 37208 - DNA, 519 bp, Artificial Sequence
  chemically treated genomic DNA (Homo sapiens) CpG-island No: 37208
caacgaaaacaacgtataacgcaaacgacgcaacgtcgtctccgaaataaaactccaaaaccacgcgaaaacgacgccgaaatccaacaacaccgtccaaaacaacgacaaccccaaaaaaaaaaacgacaacgtcaacaacacctacaacgcgcccaacacgcaccgcctacgaaacgaaaaacgaacaaataaaaaaccgcgaccgcgcccaccgcccgactcacctaataaccaacgcgcgaaaaccgccgaacaaccgcgtctcctacgaaaaaaaaaaaccgcatccaactacctccgcgcccgcgacgccgacccgatttccaaaaaaaaaaaaaaacgataccgcgaaaaaaacgaaaaaaattatcccgctccaacccaccccgcccgaacccgcgcaaacgctcactcgatccgccctaaccatctcctccataaacgactcgatactatactacactccgcgaaactacccgtcacacctacgaaaacaaacatacaaataaaaaccca

SEQ ID NO: 37209 - DNA, 908 bp, Artificial Sequence
  chemically treated genomic DNA (Homo sapiens) CpG-island No: 37209
aagcggagaataagtagttgcggcgtgtaggttgtttttattaggtagacgagaaggtgaagcggtttaaggtaaagcgcgcggagttgatcgggttcgcgcggcgtttagttgatcgcgttcgtaagttgtaggagattaattttcgggtcgtgagcgcgtttatattcggcgagagttgcgtcggtttggagttgtgttaagtttttgttcgttagcgcgttcgggatttgtcggagtaggcgagcgcgtcgttggttaaggataagtagatcgaagagttgcggtaggagtgttattttttgtaggcgcgtgtcgtttcgggtttttgtagcgatttgtatattggaaggggcggtttttgtatttagtggtttaacgttagagatttagatcgtttgtagcgcgagttttagcgggaagtgttgcgtttgtagaggtagttgatgttttagtagggtaacggtggcgtttggttcgaggcgggcggttagagcgtaatttgcgaggaggtgcgacggtagatgttggcgttggagcgcgagttggattagcggcggcgcgagtgttaggagttgggcgcgtaggcggtttcggcgcggcgacgtggcgaggaggtcgagatatagttgtaggcggcgttgtttaaaaacgtttggttggcggaggagaatgggcggttgtaggttaagatcgattgggtgcggaaggtggaggttgagaatagcgaagtgcgcggttatttgggtcgcgcgtgttaagagcgcgatgttttcggtttgatcgtcgaatagttgttgtagtaggcggcgcgcgggtaggataggtagtagtagttgtaacgcgattcgtagaaggttttgtgtgatttttattttttttggaaggagatataggcgttttagtgt

SEQ ID NO: 37210 - DNA, 908 bp, Artificial Sequence
  chemically treated genomic DNA (Homo sapiens) CpG-island No: 37210
acactaaaacgcctatatctccttccaaaaaaaataaaaatcacacaaaaccttctacgaatcgcgttacaactactactacctatcctacccgcgcgccgcctactacaacaactattcgacgatcaaaccgaaaacatcgcgctcttaacacgcgcgacccaaataaccgcgcacttcgctattctcaacctccaccttccgcacccaatcgatcttaacctacaaccgcccattctcctccgccaaccaaacgtttttaaacaacgccgcctacaactatatctcgacctcctcgccacgtcgccgcgccgaaaccgcctacgcgcccaactcctaacactcgcgccgccgctaatccaactcgcgctccaacgccaacatctaccgtcgcacctcctcgcaaattacgctctaaccgcccgcctcgaaccaaacgccaccgttaccctactaaaacatcaactacctctacaaacgcaacacttcccgctaaaactcgcgctacaaacgatctaaatctctaacgttaaaccactaaatacaaaaaccgccccttccaatatacaaatcgctacaaaaacccgaaacgacacgcgcctacaaaaaataacactcctaccgcaactcttcgatctacttatccttaaccaacgacgcgctcgcctactccgacaaatcccgaacgcgctaacgaacaaaaacttaacacaactccaaaccgacgcaactctcgccgaatataaacgcgctcacgacccgaaaattaatctcctacaacttacgaacgcgatcaactaaacgccgcgcgaacccgatcaactccgcgcgctttaccttaaaccgcttcaccttctcgtctacctaataaaaacaacctacacgccgcaactacttattctccgctt

SEQ ID NO: 37211 - DNA, 908 bp, Artificial Sequence
  chemically treated genomic DNA (Homo sapiens) CpG-island No: 37211
atattggagcgtttgtatttttttttaggaaggatggaggttatatagggttttttgcgggtcgcgttgtagttgttgttgtttgttttgttcgcgcgtcgtttgttgtagtagttgttcggcgattaagtcggaggtatcgcgtttttgatacgcgcggtttaggtggtcgcgtatttcgttatttttagtttttatttttcgtatttagtcggttttggtttgtagtcgtttattttttttcgttagttaggcgtttttgagtagcgtcgtttgtagttgtgtttcggttttttcgttacgtcgtcgcgtcggggtcgtttgcgcgtttagtttttggtattcgcgtcgtcgttggtttagttcgcgttttagcgttagtatttgtcgtcgtattttttcgtaggttgcgttttggtcgttcgtttcgggttaagcgttatcgttgttttgttgaagtattaattgtttttgtaggcgtagtatttttcgttgggattcgcgttgtaggcggtttaagtttttgacgttgagttattgggtgtaggggtcgttttttttagtatgtaggtcgttgtagggattcgaggcgatacgcgtttgtaggaggtggtatttttgtcgtagtttttcgatttgtttgtttttggttagcggcgcgttcgtttgtttcgataggtttcgagcgcgttggcgggtaaagatttggtatagttttaggtcggcgtaattttcgtcgggtataggcgcgtttacggttcggaggttggttttttgtagtttgcgggcgcggttagttaggcgtcgcgcgagttcggttagtttcgcgcgttttattttgagtcgttttattttttcgtttgtttggtaggggtagtttgtacgtcgtagttgtttgtttttcgttt

SEQ ID NO: 37212 - DNA, 908 bp, Artificial Sequence
  chemically treated genomic DNA (Homo sapiens) CpG-island No: 37212
aaacgaaaaacaaacaactacgacgtacaaactacccctaccaaacaaacgaaaaaataaaacgactcaaaataaaacgcgcgaaactaaccgaactcgcgcgacgcctaactaaccgcgcccgcaaactacaaaaaaccaacctccgaaccgtaaacgcgcctatacccgacgaaaattacgccgacctaaaactataccaaatctttacccgccaacgcgctcgaaacctatcgaaacaaacgaacgcgccgctaaccaaaaacaaacaaatcgaaaaactacgacaaaaataccacctcctacaaacgcgtatcgcctcgaatccctacaacgacctacatactaaaaaaaacgacccctacacccaataactcaacgtcaaaaacttaaaccgcctacaacgcgaatcccaacgaaaaatactacgcctacaaaaacaattaatacttcaacaaaacaacgataacgcttaacccgaaacgaacgaccaaaacgcaacctacgaaaaaatacgacgacaaatactaacgctaaaacgcgaactaaaccaacgacgacgcgaataccaaaaactaaacgcgcaaacgaccccgacgcgacgacgtaacgaaaaaaccgaaacacaactacaaacgacgctactcaaaaacgcctaactaacgaaaaaaaataaacgactacaaaccaaaaccgactaaatacgaaaaataaaaactaaaaataacgaaatacgcgaccacctaaaccgcgcgtatcaaaaacgcgatacctccgacttaatcgccgaacaactactacaacaaacgacgcgcgaacaaaacaaacaacaacaactacaacgcgacccgcaaaaaaccctatataacctccatccttcctaaaaaaaaatacaaacgctccaatat

SEQ ID NO: 37213 - DNA, 522 bp, Artificial Sequence
  chemically treated genomic DNA (Homo sapiens) CpG-island No: 37213
ttttaagttttttcgttcgttcgttttcgttttcgttgggtttcgtagtcggaggaggggcggtttttcgttttcgttcgttggattttagagtcgtcgtttcgggcgtcgggttgtagtcgttacgtttcgggagaggatcgatcgtttagatcgtcggttcggggttttttggttacgtcgattacggggagtttttcgattgttttttagaataaagtgggaaagggaagtttagttcgtcgttgtcgttttcgagtagttcgttaggtgagcgtcgggataggtaggggatttaggtcgggatttaagcgttagtttcgttttcgtttatagttggggcgtttcgggaaggattttcgcgttaggttttgttcggaggggcgggtttttgggagttttataattcgtagcgtcgttttttcgggttttttttcggtttgaggtttttttaaatttaaagttatataaatgtacgttagaaagttttaaatttggaagggttttgttttgaacgtgggt

SEQ ID NO: 37214 - DNA, 522 bp, Artificial Sequence
  chemically treated genomic DNA (Homo sapiens) CpG-island No: 37214
acccacgttcaaaacaaaacccttccaaatttaaaactttctaacgtacatttatataactttaaatttaaaaaaacctcaaaccgaaaaaaaacccgaaaaaacgacgctacgaattataaaactcccaaaaacccgcccctccgaacaaaacctaacgcgaaaatccttcccgaaacgccccaactataaacgaaaacgaaactaacgcttaaatcccgacctaaatcccctacctatcccgacgctcacctaacgaactactcgaaaacgacaacgacgaactaaacttccctttcccactttattctaaaaaacaatcgaaaaactccccgtaatcgacgtaaccaaaaaaccccgaaccgacgatctaaacgatcgatcctctcccgaaacgtaacgactacaacccgacgcccgaaacgacgactctaaaatccaacgaacgaaaacgaaaaaccgcccctcctccgactacgaaacccaacgaaaacgaaaacgaacgaacgaaaaaacttaaaa

SEQ ID NO: 37215 - DNA, 522 bp, Artificial Sequence
  chemically treated genomic DNA (Homo sapiens) CpG-island No: 37215
atttacgtttaaagtaaagtttttttagatttagggttttttaacgtgtatttgtataattttgggtttaaaggagttttaggtcgagggagggttcgggaaagcgacgttgcgggttatgggatttttagggattcgttttttcgggtagggtttggcgcgggaatttttttcggggcgttttagttgtgggcgagaacgggattgacgtttgggtttcgatttgggttttttatttgtttcggcgtttatttggcgggttgttcggaggcggtagcggcgggttaagttttttttttttattttgttttgggaggtagtcgaggggtttttcgtgatcggcgtggttagggggtttcggatcggcggtttgggcggtcggttttttttcggggcgtggcggttgtagttcggcgttcggggcggcgattttgagatttagcgggcgggggcgggaggtcgtttttttttcggttgcggggtttagcgggagcgagggcgggcgggcgggggagtttggag

SEQ ID NO: 37216 - DNA, 522 bp, Artificial Sequence
  chemically treated genomic DNA (Homo sapiens) CpG-island No: 37216
ctccaaactcccccgcccgcccgccctcgctcccgctaaaccccgcaaccgaaaaaaaaacgacctcccgcccccgcccgctaaatctcaaaatcgccgccccgaacgccgaactacaaccgccacgccccgaaaaaaaaccgaccgcccaaaccgccgatccgaaaccccctaaccacgccgatcacgaaaaacccctcgactacctcccaaaacaaaataaaaaaaaaaaacttaacccgccgctaccgcctccgaacaacccgccaaataaacgccgaaacaaataaaaaacccaaatcgaaacccaaacgtcaatcccgttctcgcccacaactaaaacgccccgaaaaaaattcccgcgccaaaccctacccgaaaaaacgaatccctaaaaatcccataacccgcaacgtcgctttcccgaaccctccctcgacctaaaactcctttaaacccaaaattatacaaatacacgttaaaaaaccctaaatctaaaaaaactttactttaaacgtaaat

SEQ ID NO: 37217 - DNA, 638 bp, Artificial Sequence
  chemically treated genomic DNA (Homo sapiens) CpG-island No: 37217
ggttttttcgtcgcgcgcgtaggtgagtattatcgtgacggtggcgaaggtggtagcgttgacggggaaggcgcgtagtagcgtggacgttagttttcgtgtgaagacgcgttagttttcggcgcggtagttttggtgtacgtagtttaggatgtcgcggtagcgcggggcgtttcgtagttcgttcgtttgtagtcgcgatttgattacgtttataggataggtagagagttaggatacgatgtttgacgtatcgttcgttaatagtagtttgggtattagtaggcggtcgttcggttcgtagtttagcgttcgcgtgagagcgttataggtgaggaagtagacgtcgaagttgggcgttttacgtagtaacgtggatattatgtttcggttgacgttacgtagattttcgtgttcgtagatttgcgcgaggtagtttagcgagtttttgtaggtgcgcgttgggttcgcgttttgtagttgtagtcgcgttttggttagttttatggggtagtagatgacgtattggatggcgttcgtcgtcgtatttgttaggaattggttgaggggcgagtcgtggtttagggttcggagggtgttgttttgtatttcgaatattagcgcgttgatgaaggtga

SEQ ID NO: 37218 - DNA, 638 bp, Artificial Sequence
  chemically treated genomic DNA (Homo sapiens) CpG-island No: 37218
tcaccttcatcaacgcgctaatattcgaaatacaaaacaacaccctccgaaccctaaaccacgactcgcccctcaaccaattcctaacaaatacgacgacgaacgccatccaatacgtcatctactaccccataaaactaaccaaaacgcgactacaactacaaaacgcgaacccaacgcgcacctacaaaaactcgctaaactacctcgcgcaaatctacgaacacgaaaatctacgtaacgtcaaccgaaacataatatccacgttactacgtaaaacgcccaacttcgacgtctacttcctcacctataacgctctcacgcgaacgctaaactacgaaccgaacgaccgcctactaatacccaaactactattaacgaacgatacgtcaaacatcgtatcctaactctctacctatcctataaacgtaatcaaatcgcgactacaaacgaacgaactacgaaacgccccgcgctaccgcgacatcctaaactacgtacaccaaaactaccgcgccgaaaactaacgcgtcttcacacgaaaactaacgtccacgctactacgcgccttccccgtcaacgctaccaccttcgccaccgtcacgataatactcacctacgcgcgcgacgaaaaaacc

SEQ ID NO: 37219 - DNA, 638 bp, Artificial Sequence
  chemically treated genomic DNA (Homo sapiens) CpG-island No: 37219
ttatttttattaacgcgttggtgttcggggtgtagggtaatatttttcgggttttgggttacgattcgttttttaattagtttttggtaggtgcggcggcgggcgttatttagtgcgttatttgttgttttatggagttggttaagacgcggttgtagttgtaggacgcgggtttagcgcgtatttataagggttcgttggattgtttcgcgtagatttacgggtacgagggtttgcgtggcgttaatcggggtatggtgtttacgttgttgcgtgagacgtttagtttcggcgtttatttttttatttatgacgtttttacgcgggcgttgggttgcgagtcgggcgatcgtttgttggtgtttaagttgttgttggcgggcggtacgttaggtatcgtgttttggttttttatttattttgtggacgtggttaagtcgcggttgtaggcggacggattgcggggcgtttcgcgttatcgcggtattttggattgcgtgtattagagttatcgcgtcgagggttggcgcgtttttatacgggggttggcgtttacgttgttgcgcgtttttttcgttaacgttgttattttcgttatcgttacggtggtgtttatttacgcgcgcggcgaggaggtt

SEQ ID NO: 37220 - DNA, 638 bp, Artificial Sequence
  chemically treated genomic DNA (Homo sapiens) CpG-island No: 37220
aacctcctcgccgcgcgcgtaaataaacaccaccgtaacgataacgaaaataacaacgttaacgaaaaaaacgcgcaacaacgtaaacgccaacccccgtataaaaacgcgccaaccctcgacgcgataactctaatacacgcaatccaaaataccgcgataacgcgaaacgccccgcaatccgtccgcctacaaccgcgacttaaccacgtccacaaaataaataaaaaaccaaaacacgatacctaacgtaccgcccgccaacaacaacttaaacaccaacaaacgatcgcccgactcgcaacccaacgcccgcgtaaaaacgtcataaataaaaaaataaacgccgaaactaaacgtctcacgcaacaacgtaaacaccataccccgattaacgccacgcaaaccctcgtacccgtaaatctacgcgaaacaatccaacgaacccttataaatacgcgctaaacccgcgtcctacaactacaaccgcgtcttaaccaactccataaaacaacaaataacgcactaaataacgcccgccgccgcacctaccaaaaactaattaaaaaacgaatcgtaacccaaaacccgaaaaatattaccctacaccccgaacaccaacgcgttaataaaaataa

SEQ ID NO: 37221 - DNA, 1185 bp, Artificial Sequence
  chemically treated genomic DNA (Homo sapiens) CpG-island No: 37221
  misc_feature (279)..(279): n is either a, c, g or t
gatttttcgttcgagcgtgtttagagagaataaagatatttgttttcgcggatagttcgggtttgaagttaatttacgtttacgagattcgttcgaggtaagagaattgtggtttttatttatagacgcggcgattttcgttagcgggaagtcgcgaggttagggcgtgttggtgggtcgattttttttttcggacgtttcgtttcggttcggttcggttcgtcgtttttttatttttcgcgtatttagttaagaagtttagcgttatggtcgggtttntcggcgaggtcgtttttttttttcgttttttttttgaggtttttcgtcgggttgggcgtcgtcggggttttcgagcgcgcggtgtcggggttgggtttggtcgttttttttggcgcggagttcgggtaggcgcggttagggatggtggggatggcggtagtagttagattcgcgttggtttttcggcggtagttgattcgttggatttttttcggttcgcggttttttatttcgggtcgcgcgtttcgtttttcgtttgtcggtagggttcgggtgggggcgtcgagtgaggttaatgggcgggtacggcgcggataatatttcgggtattgcgtttcgtcgtcgcgttttattggtcgggcgtgcgcgggaggcggggcgcgggggacgtggtgggcgcgcgggcgggcgcgggtattttttagataaagagcgcgttgggtgcgtaggttcggcgggagggtacgcgcggggtagcgggcgtgagtcgaggatttttttattcggagtacgcggggtggttttggtttggatcgggtcgggaatcggattttgggttcggagttcggcgtcgtcgtagaattttagcgttttagtttgtgtcgtgcggattttgtcgcgaaaacggtcgtggagcgtcgggacgtttcgaggttcgtagattgggacgtcgttagttgcgaaatttcgcgagcgggaatcgttcgtggggagtttttgttcgtttcgtttgcgcgttcgcggcggcggtggttttcggggttttcggatttttggtcgaattcgtcgggttttgggggtcggacgcgtacgggcgttttttgcggagtttgaggttgggatttgggcggagagtagggaattttaaaagggaaaggggttatgggtaaagggcgtagtaggttt

SEQ ID NO: 37222 - DNA, 1185 bp, Artificial Sequence
  chemically treated genomic DNA (Homo sapiens) CpG-island No: 37222
  misc_feature (907)..(907): n is either a, c, g or t
aaacctactacgccctttacccataacccctttcccttttaaaattccctactctccgcccaaatcccaacctcaaactccgcaaaaaacgcccgtacgcgtccgacccccaaaacccgacgaattcgaccaaaaatccgaaaaccccgaaaaccaccgccgccgcgaacgcgcaaacgaaacgaacaaaaactccccacgaacgattcccgctcgcgaaatttcgcaactaacgacgtcccaatctacgaacctcgaaacgtcccgacgctccacgaccgttttcgcgacaaaatccgcacgacacaaactaaaacgctaaaattctacgacgacgccgaactccgaacccaaaatccgattcccgacccgatccaaaccaaaaccaccccgcgtactccgaataaaaaaatcctcgactcacgcccgctaccccgcgcgtaccctcccgccgaacctacgcacccaacgcgctctttatctaaaaaatacccgcgcccgcccgcgcgcccaccacgtcccccgcgccccgcctcccgcgcacgcccgaccaataaaacgcgacgacgaaacgcaatacccgaaatattatccgcgccgtacccgcccattaacctcactcgacgcccccacccgaaccctaccgacaaacgaaaaacgaaacgcgcgacccgaaataaaaaaccgcgaaccgaaaaaaatccaacgaatcaactaccgccgaaaaaccaacgcgaatctaactactaccgccatccccaccatccctaaccgcgcctacccgaactccgcgccaaaaaaaacgaccaaacccaaccccgacaccgcgcgctcgaaaaccccgacgacgcccaacccgacgaaaaacctcaaaaaaaaaacgaaaaaaaaaaacgacctcgccganaaacccgaccataacgctaaacttcttaactaaatacgcgaaaaataaaaaaacgacgaaccgaaccgaaccgaaacgaaacgtccgaaaaaaaaaatcgacccaccaacacgccctaacctcgcgacttcccgctaacgaaaatcgccgcgtctataaataaaaaccacaattctcttacctcgaacgaatctcgtaaacgtaaattaacttcaaacccgaactatccgcgaaaacaaatatctttattctctctaaacacgctcgaacgaaaaatc

SEQ ID NO: 37223 - DNA, 1185 bp, Artificial Sequence
  chemically treated genomic DNA (Homo sapiens) CpG-island No: 37223
  misc_feature (907)..(907): n is either a, c, g or t
aagtttgttgcgttttttgtttatggttttttttttttttaaggttttttgtttttcgtttaaattttagttttaggtttcgtaggaagcgttcgtgcgcgttcgatttttagaattcggcgggttcggttaggagttcggaagtttcggaggttatcgtcgtcgcgggcgcgtaggcgggacgggtagaggttttttacgggcgattttcgttcgcggagtttcgtaattagcggcgttttagtttgcgggtttcggaacgtttcggcgttttacggtcgttttcgcggtagggttcgtacggtatagattagggcgttgaggttttgcggcggcgtcggatttcgaatttagggttcggttttcgattcggtttagattagagttatttcgcgtatttcgggtgggggagttttcggtttacgttcgttatttcgcgcgtgttttttcgtcggatttgcgtatttagcgcgttttttgtttgaagggtattcgcgttcgttcgcgcgtttattacgtttttcgcgtttcgtttttcgcgtacgttcggttaatgaggcgcggcggcgaagcgtagtgttcggggtgttgttcgcgtcgtgttcgtttattggttttattcggcgtttttattcgggttttgtcggtagacgaggggcggggcgcgcggttcgaggtgagggatcgcgggtcggaggggatttagcgagttagttgtcgtcgagggattagcgcgggtttagttgttgtcgttatttttattatttttgatcgcgtttgttcgggtttcgcgttaggaggagcggttaggtttagtttcggtatcgcgcgttcggggatttcgacggcgtttagttcggcgaggggttttagggggaggacgaggaggaaaggcggtttcgtcggnggattcggttatggcgttggattttttggttggatgcgcggggggtaaggaggcggcgggtcgggtcgggtcggggcgaggcgttcggggagggaggtcggtttattagtacgttttggtttcgcggtttttcgttggcgggggtcgtcgcgtttgtgaatggggattatagtttttttgtttcgggcgggtttcgtgggcgtaaattgattttaggttcgggttgttcgcgagggtaggtgtttttattttttttgggtacgttcggacgggaggtt

SEQ ID NO: 37224 - DNA, 1185 bp, Artificial Sequence
  chemically treated genomic DNA (Homo sapiens) CpG-island No: 37224
  misc_feature (279)..(279): n is either a, c, g or t
aacctcccgtccgaacgtacccaaaaaaaataaaaacacctaccctcgcgaacaacccgaacctaaaatcaatttacgcccacgaaacccgcccgaaacaaaaaaactataatccccattcacaaacgcgacgacccccgccaacgaaaaaccgcgaaaccaaaacgtactaataaaccgacctccctccccgaacgcctcgccccgacccgacccgacccgccgcctccttaccccccgcgcatccaaccaaaaaatccaacgccataaccgaatccnccgacgaaaccgcctttcctcctcgtcctccccctaaaacccctcgccgaactaaacgccgtcgaaatccccgaacgcgcgataccgaaactaaacctaaccgctcctcctaacgcgaaacccgaacaaacgcgatcaaaaataataaaaataacgacaacaactaaacccgcgctaatccctcgacgacaactaactcgctaaatcccctccgacccgcgatccctcacctcgaaccgcgcgccccgcccctcgtctaccgacaaaacccgaataaaaacgccgaataaaaccaataaacgaacacgacgcgaacaacaccccgaacactacgcttcgccgccgcgcctcattaaccgaacgtacgcgaaaaacgaaacgcgaaaaacgtaataaacgcgcgaacgaacgcgaatacccttcaaacaaaaaacgcgctaaatacgcaaatccgacgaaaaaacacgcgcgaaataacgaacgtaaaccgaaaactcccccacccgaaatacgcgaaataactctaatctaaaccgaatcgaaaaccgaaccctaaattcgaaatccgacgccgccgcaaaacctcaacgccctaatctataccgtacgaaccctaccgcgaaaacgaccgtaaaacgccgaaacgttccgaaacccgcaaactaaaacgccgctaattacgaaactccgcgaacgaaaatcgcccgtaaaaaacctctacccgtcccgcctacgcgcccgcgacgacgataacctccgaaacttccgaactcctaaccgaacccgccgaattctaaaaatcgaacgcgcacgaacgcttcctacgaaacctaaaactaaaatttaaacgaaaaacaaaaaaccttaaaaaaaaaaaaaaccataaacaaaaaacgcaacaaactt

SEQ ID NO: 37225 - DNA, 585 bp, Artificial Sequence
  chemically treated genomic DNA (Homo sapiens) CpG-island No: 37225
gcggttttcgttcggcgtagcgtttgcgttttcgtcgttttttttagtgttacgaggaagttgcggtaggaagaagggcggaggtgtttcgggcgtttgagacgttcggtaatggtttcgttattttcgtcgcgtatacgtaaagtcgttttttaggtagttgcggcgttcggggttttttttcgggtcgggttttcgtcggtcgtttgttcgtataggtgtttttcggtttcgtgattgcgatttttttagcggagagggttttttaggaagtaggggcgaggagttttcgaaggtttcgggcggtagcggttttcggcgtagagggcggagggtacgatcgcgatataggcggggcggtagttagttcgcgaggtgtattcggtataggtttcgtttcgcgttttcggtttttagggttttcgtgtttcgtttcgttttttttttcggggtttttcgtttttcgcgttcgtttagtttcgtttcggttgtgttggattttcgacgtttatcgttaggggtggaattttagtttcgtttaatataggtggaaagaggcgtagagaggtttagtgacgagttggg

SEQ ID NO: 37226 - DNA, 585 bp, Artificial Sequence
  chemically treated genomic DNA (Homo sapiens) CpG-island No: 37226
cccaactcgtcactaaacctctctacgcctctttccacctatattaaacgaaactaaaattccacccctaacgataaacgtcgaaaatccaacacaaccgaaacgaaactaaacgaacgcgaaaaacgaaaaaccccgaaaaaaaaaacgaaacgaaacacgaaaaccctaaaaaccgaaaacgcgaaacgaaacctataccgaatacacctcgcgaactaactaccgccccgcctatatcgcgatcgtaccctccgccctctacgccgaaaaccgctaccgcccgaaaccttcgaaaactcctcgcccctacttcctaaaaaaccctctccgctaaaaaaatcgcaatcacgaaaccgaaaaacacctatacgaacaaacgaccgacgaaaacccgacccgaaaaaaaaccccgaacgccgcaactacctaaaaaacgactttacgtatacgcgacgaaaataacgaaaccattaccgaacgtctcaaacgcccgaaacacctccgcccttcttcctaccgcaacttcctcgtaacactaaaaaaaacgacgaaaacgcaaacgctacgccgaacgaaaaccgc

SEQ ID NO: 37227 - DNA, 585 bp, Artificial Sequence
  chemically treated genomic DNA (Homo sapiens) CpG-island No: 37227
tttagttcgttattaggtttttttgcgtttttttttatttgtgttaggcggggttgggattttatttttggcgatgggcgtcgaggatttagtatagtcggggcggggttaggcgggcgcgggggacgaggggtttcggagaggagggcggggcggggtacgagggttttgagagtcggaagcgcggggcggggtttgtgtcgggtgtatttcgcgagttagttgtcgtttcgtttgtgtcgcggtcgtatttttcgttttttgcgtcgagagtcgttgtcgttcgagattttcgagggtttttcgtttttgttttttgggagatttttttcgttgggagagtcgtagttacggagtcgggggatatttgtacgggtaggcggtcggcgaaggttcggttcgagaggaagtttcgaacgtcgtaattgtttgggaagcggttttgcgtgtgcgcggcgagagtagcggggttattgtcgggcgttttaggcgttcggggtattttcgtttttttttttgtcgtagttttttcgtggtattgggaagggcggcgggaacgtaggcgttgcgtcgggcgaaggtcgt

SEQ ID NO: 37228 - DNA, 585 bp, Artificial Sequence
  chemically treated genomic DNA (Homo sapiens) CpG-island No: 37228
acgaccttcgcccgacgcaacgcctacgttcccgccgcccttcccaataccacgaaaaaactacgacaaaaaaaaaaacgaaaataccccgaacgcctaaaacgcccgacaataaccccgctactctcgccgcgcacacgcaaaaccgcttcccaaacaattacgacgttcgaaacttcctctcgaaccgaaccttcgccgaccgcctacccgtacaaatatcccccgactccgtaactacgactctcccaacgaaaaaaatctcccaaaaaacaaaaacgaaaaaccctcgaaaatctcgaacgacaacgactctcgacgcaaaaaacgaaaaatacgaccgcgacacaaacgaaacgacaactaactcgcgaaatacacccgacacaaaccccgccccgcgcttccgactctcaaaaccctcgtaccccgccccgccctcctctccgaaacccctcgtcccccgcgcccgcctaaccccgccccgactatactaaatcctcgacgcccatcgccaaaaataaaatcccaaccccgcctaacacaaataaaaaaaaacgcaaaaaaacctaataacgaactaaa

SEQ ID NO: 37229 - DNA, 2324 bp, Artificial Sequence
  chemically treated genomic DNA (Homo sapiens) CpG-island No: 37229
  misc_feature (2107)..(2107): n is either a, c, g or t
  misc_feature (2142)..(2142): n is either a, c, g or t
  misc_feature (2242)..(2242): n is either a, c, g or t
  misc_feature (2291)..(2291): n is either a, c, g or t
  misc_feature (2294)..(2295): n is either a, c, g or t
tttaggttttcgcgggttattaaagaataacggatatttttttaacggtggttttggggtttcgcgggcgttttcgtcgagttcgcgtcgatttcgcgttcggtttcgtatttcgtcgggcgttcgcggcgagatatcggacgttgttcgcgtcgttcgattttgttcgttcggttttttatatttatttcgcggttatcgttcgttcgaagttaggcgataagaataaatatttttcgacgcgaaaaaggaagtataggcgattttcgttaaagtagattttattggggcgatagggtcgtttcgtacgcgttagtcggtttttcgcgtcgttttcgttttttttttttttttttatttcgttttcggtcggttttttttttttttttttttaggttttcgttttcgtggtgttcggggtcgcgcggatcgtttatcggtttttaaggtagcggttgtagcggcgacgtttcgttttcgagtgcggtttcggttcgaggcggcgggttttgtggttgttgtatcgcgaagggcggtagcgcgcgatatcgggaagcgggaggcggtggcggcggcggcggcgcgttgacgttacgcgtcggggttagttagggcgcgtgcgagtcgtttcgttttcggttttatcggttttaattcgggaggagttcggcgagtgggcggggtcgcggaggttagcggatagatcgattggtcgagaggagaatcgagagggcgaacgggcgagtggtagcgaggcggggcgggttgaggttagcgcggaagtttcgcgaggtcgggttcgagtagagtgtggcggcggcggcgagatttgggttcgggttgaggagttggtatttgtgtggaaggaggcggaggcgtaggaggaagggggaagcggagcgtcggttcggagggcgggaggaggcgcggttagggcgggcggttgcggcgaggcgaggcgaggcggggagtcgagacgagtagcggtcgagcgagcgcgggcgcgggcgtatcgaggcgagggaggcggggaagtttcgtcgtcgtcgcggcgttcgttttttttttcgtcgttcgtttttttttttttcgttcgttcgtcgtttttttttttttgttttttttttttacggtcggtcgttttttcgttcgttcgttcgtagtcgaggagtcgaggtcgtcgcggtcgtggcggcggagtttttagttatggtttcgggcgatattttttatatcgttacggacggttcggagatgtcggtcgagatcgtggagttgtacgagatcgaggtggagattatttcggtggagattatcgagattatagtggtgggcgaggaggaggaggaggacgacgacgacgaggacggcggcggtggcgattacggcggcgggggcggttacgggtacgtcggttattattattattattattattattattattattcgtttatgatcgttttgtagtcgttggttatcgacgattcgatttaggtgtattattattaggaggtgattttggtgtagacgcgcgaggaggtggtgggcggcgacgattcggacgggttgcgcgtcgaggacggtttcgaggattagatttttatttcggtgttcgcgtcggtcggcggcgacgacgattatattgaataaacgttggttatcgtggcggcggtcggtaagagcggcggcggcggttcgtcgtcgtcgggaggcggtcgcgttaagaagggcggcggtaagaagagcggtaagaagagttattttagcggcggggtcggcgcggcgggcggcggcggcgtcgattcgggtaataagaagtgggagtagaagtaggtgtagattaagattttggagggcgagttttcggttattatgtggtttttaggtgagcgtcggtcgcgcgtttcggtttcgggatgtttttgttttgaagggaagttatgttttatgtgtgtgatgggcgtcgttatttttttcgttagggtaagtatggcggttttaaaagatggcgggtcgtgcggcggcgggggcgcggcggcggcggcgggcggcgggtcgcgaagatggcggtaggcgcgggggggaggggtcgcgcgttcgttangcgtaatgcgtatttttttagaggggaacgcgttngtgcgatacgtcggggaagggcgttttttttttcgtttttttttcgcgtttattattgtcgtcgcgcgcgtgtgcgagtgttttttcgtcggcggacggnatttttagtggtggttcgtttcggtagtatttgtgcgttttattttttnttnnttttttttatatttaatgttcgtttatcg

SEQ ID NO: 37230 - DNA, 2324 bp, Artificial Sequence
  chemically treated genomic DNA (Homo sapiens) CpG-island No: 37230
  misc_feature (30)..(31): n is either a, c, g or t
  misc_feature (34)..(34): n is either a, c, g or t
  misc_feature (83)..(83): n is either a, c, g or t
  misc_feature (183)..(183): n is either a, c, g or t
  misc_feature (218)..(218): n is either a, c, g or t
cgataaacgaacattaaatataaaaaaaannaanaaaaaataaaacgcacaaatactaccgaaacgaaccaccactaaaaatnccgtccgccgacgaaaaaacactcgcacacgcgcgcgacgacaataataaacgcgaaaaaaaaacgaaaaaaaaaacgcccttccccgacgtatcgcacnaacgcgttcccctctaaaaaaatacgcattacgcntaacgaacgcgcgacccctcccccccgcgcctaccgccatcttcgcgacccgccgcccgccgccgccgccgcgcccccgccgccgcacgacccgccatcttttaaaaccgccatacttaccctaacgaaaaaaataacgacgcccatcacacacataaaacataacttcccttcaaaacaaaaacatcccgaaaccgaaacgcgcgaccgacgctcacctaaaaaccacataataaccgaaaactcgccctccaaaatcttaatctacacctacttctactcccacttcttattacccgaatcgacgccgccgccgcccgccgcgccgaccccgccgctaaaataactcttcttaccgctcttcttaccgccgcccttcttaacgcgaccgcctcccgacgacgacgaaccgccgccgccgctcttaccgaccgccgccacgataaccaacgtttattcaatataatcgtcgtcgccgccgaccgacgcgaacaccgaaataaaaatctaatcctcgaaaccgtcctcgacgcgcaacccgtccgaatcgtcgccgcccaccacctcctcgcgcgtctacaccaaaatcacctcctaataataatacacctaaatcgaatcgtcgataaccaacgactacaaaacgatcataaacgaataataataataataataataataataataataaccgacgtacccgtaaccgcccccgccgccgtaatcgccaccgccgccgtcctcgtcgtcgtcgtcctcctcctcctcctcgcccaccactataatctcgataatctccaccgaaataatctccacctcgatctcgtacaactccacgatctcgaccgacatctccgaaccgtccgtaacgatataaaaaatatcgcccgaaaccataactaaaaactccgccgccacgaccgcgacgacctcgactcctcgactacgaacgaacgaacgaaaaaacgaccgaccgtaaaaaaaaaaaacaaaaaaaaaaaaacgacgaacgaacgaaaaaaaaaaaaacgaacgacgaaaaaaaaaacgaacgccgcgacgacgacgaaacttccccgcctccctcgcctcgatacgcccgcgcccgcgctcgctcgaccgctactcgtctcgactccccgcctcgcctcgcctcgccgcaaccgcccgccctaaccgcgcctcctcccgccctccgaaccgacgctccgcttcccccttcctcctacgcctccgcctccttccacacaaataccaactcctcaacccgaacccaaatctcgccgccgccgccacactctactcgaacccgacctcgcgaaacttccgcgctaacctcaacccgccccgcctcgctaccactcgcccgttcgccctctcgattctcctctcgaccaatcgatctatccgctaacctccgcgaccccgcccactcgccgaactcctcccgaattaaaaccgataaaaccgaaaacgaaacgactcgcacgcgccctaactaaccccgacgcgtaacgtcaacgcgccgccgccgccgccaccgcctcccgcttcccgatatcgcgcgctaccgcccttcgcgatacaacaaccacaaaacccgccgcctcgaaccgaaaccgcactcgaaaacgaaacgtcgccgctacaaccgctaccttaaaaaccgataaacgatccgcgcgaccccgaacaccacgaaaacgaaaacctaaaaaaaaaaaaaaaaaaaaccgaccgaaaacgaaataaaaaaaaaaaaaaaaaacgaaaacgacgcgaaaaaccgactaacgcgtacgaaacgaccctatcgccccaataaaatctactttaacgaaaatcgcctatacttcctttttcgcgtcgaaaaatatttattcttatcgcctaacttcgaacgaacgataaccgcgaaataaatataaaaaaccgaacgaacaaaatcgaacgacgcgaacaacgtccgatatctcgccgcgaacgcccgacgaaatacgaaaccgaacgcgaaatcgacgcgaactcgacgaaaacgcccgcgaaaccccaaaaccaccgttaaaaaaatatccgttattctttaataacccgcgaaaacctaaa

SEQ ID NO: 37231 - DNA, 2324 bp, Artificial Sequence
  chemically treated genomic DNA (Homo sapiens) CpG-island No: 37231
  misc_feature (30)..(31): n is either a, c, g or t
  misc_feature (34)..(34): n is either a, c, g or t
  misc_feature (83)..(83): n is either a, c, g or t
  misc_feature (183)..(183): n is either a, c, g or t
  misc_feature (218)..(218): n is either a, c, g or t
cggtaagcgggtattagatatgaaaggagnnggngggaggtgagacgtatagatattgtcggagcgggttattattaagaatntcgttcgtcggcggggaagtattcgtatacgcgcgcggcggtagtgatgggcgcggaggaggagcgggaggaggggcgttttttttcggcgtatcgtatnggcgcgtttttttttagagaaatacgtattgcgtntagcgggcgcgcggtttttttttttcgcgtttgtcgttattttcgcggttcgtcgttcgtcgtcgtcgtcgcgttttcgtcgtcgtacggttcgttattttttggggtcgttatatttgttttggcgaagaagatggcggcgtttattatatatataaaatatggtttttttttaaaataaaaatatttcggggtcggggcgcgcggtcggcgtttatttgaggattatatggtgatcgagaattcgttttttagggttttgatttgtatttgtttttgtttttattttttgttgttcgggtcggcgtcgtcgtcgttcgtcgcgtcggtttcgtcgttgaggtaattttttttgtcgttttttttgtcgtcgttttttttgacgcggtcgtttttcgacgacgacgagtcgtcgtcgtcgtttttgtcggtcgtcgttacggtgattagcgtttgtttaatgtagtcgtcgtcgtcgtcggtcggcgcgggtatcgggatgagaatttgattttcgaagtcgttttcggcgcgtagttcgttcgagtcgtcgtcgtttattattttttcgcgcgtttgtattaggattattttttggtggtggtgtatttgggtcgggtcgtcggtgattagcggttgtagagcgattatgggcgggtggtggtggtggtgatggtggtggtggtggtggtcggcgtgttcgtggtcgttttcgtcgtcgtggtcgttatcgtcgtcgttttcgtcgtcgtcgttttttttttttttttcgtttattattgtggtttcgatggtttttatcgggatggtttttatttcgatttcgtgtagttttacgatttcggtcggtattttcgagtcgttcgtggcgatgtagagggtgtcgttcgaggttatggttgagggtttcgtcgttacggtcgcggcggtttcggtttttcggttgcgggcgggcgggcgaggaggcggtcggtcgtggggaaggaaggtagagggaggaaggcggcgagcgggcggggggagagggggcgggcggcgggggaaggggcgggcgtcgcggcggcggcggggttttttcgtttttttcgtttcggtgcgttcgcgttcgcgttcgttcggtcgttgttcgtttcggtttttcgtttcgtttcgtttcgtcgtaatcgttcgttttggtcgcgttttttttcgtttttcgggtcggcgtttcgttttttttttttttttgcgttttcgtttttttttatataaatattaattttttaattcgagtttagatttcgtcgtcgtcgttatattttgttcgggttcggtttcgcgagattttcgcgttggttttagttcgtttcgtttcgttgttattcgttcgttcgttttttcgatttttttttcggttaatcgatttgttcgttggttttcgcggtttcgtttattcgtcgggtttttttcggattggggtcgatgggatcgggggcggggcggttcgtacgcgttttggttggtttcggcgcgtgacgttagcgcgtcgtcgtcgtcgttatcgtttttcgtttttcggtgtcgcgcgttgtcgtttttcgcggtgtaatagttataaaattcgtcgtttcgggtcggggtcgtattcgggaacggggcgtcgtcgttatagtcgttgttttgggagtcggtgagcggttcgcgcggtttcgggtattacgggggcgggagtttgaggagaagggagggaggggtcggtcgggagcggggtggaggaggggagggagggcgggggcggcgcggggagtcggttggcgcgtgcggggcggttttgtcgttttaataaagtttgttttgacgagaatcgtttgtgttttttttttcgcgtcgggaggtgtttgtttttgtcgtttggtttcgggcgagcgatggtcgcggggtgagtgtggaggatcgaacggataaaatcgggcgacgcgggtagcgttcggtatttcgtcgcgagcgttcggcggggtgcggggtcgagcgcggggtcggcgcgagttcggcggaagcgttcgcggagttttagggttatcgttgggaggatgttcgttattttttagtgattcgcggaaatttgag

SEQ ID NO: 37232 - DNA, 2324 bp, Artificial Sequence
  chemically treated genomic DNA (Homo sapiens) CpG-island No: 37232
  misc_feature (2107)..(2107): n is either a, c, g or t
  misc_feature (2142)..(2142): n is either a, c, g or t
  misc_feature (2242)..(2242): n is either a, c, g or t
  misc_feature (2291)..(2291): n is either a, c, g or t
  misc_feature (2294)..(2295): n is either a, c, g or t
ctcaaatttccgcgaatcactaaaaaataacgaacatcctcccaacgataaccctaaaactccgcgaacgcttccgccgaactcgcgccgaccccgcgctcgaccccgcaccccgccgaacgctcgcgacgaaataccgaacgctacccgcgtcgcccgattttatccgttcgatcctccacactcaccccgcgaccatcgctcgcccgaaaccaaacgacaaaaacaaacacctcccgacgcgaaaaaaaaaacacaaacgattctcgtcaaaacaaactttattaaaacgacaaaaccgccccgcacgcgccaaccgactccccgcgccgcccccgccctccctcccctcctccaccccgctcccgaccgacccctccctcccttctcctcaaactcccgcccccgtaatacccgaaaccgcgcgaaccgctcaccgactcccaaaacaacgactataacgacgacgccccgttcccgaatacgaccccgacccgaaacgacgaattttataactattacaccgcgaaaaacgacaacgcgcgacaccgaaaaacgaaaaacgataacgacgacgacgacgcgctaacgtcacgcgccgaaaccaaccaaaacgcgtacgaaccgccccgcccccgatcccatcgaccccaatccgaaaaaaacccgacgaataaacgaaaccgcgaaaaccaacgaacaaatcgattaaccgaaaaaaaaatcgaaaaaacgaacgaacgaataacaacgaaacgaaacgaactaaaaccaacgcgaaaatctcgcgaaaccgaacccgaacaaaatataacgacgacgacgaaatctaaactcgaattaaaaaattaatatttatataaaaaaaaacgaaaacgcaaaaaaaaaaaaaaaacgaaacgccgacccgaaaaacgaaaaaaaacgcgaccaaaacgaacgattacgacgaaacgaaacgaaacgaaaaaccgaaacgaacaacgaccgaacgaacgcgaacgcgaacgcaccgaaacgaaaaaaacgaaaaaaccccgccgccgccgcgacgcccgccccttcccccgccgcccgccccctctccccccgcccgctcgccgccttcctccctctaccttccttccccacgaccgaccgcctcctcgcccgcccgcccgcaaccgaaaaaccgaaaccgccgcgaccgtaacgacgaaaccctcaaccataacctcgaacgacaccctctacatcgccacgaacgactcgaaaataccgaccgaaatcgtaaaactacacgaaatcgaaataaaaaccatcccgataaaaaccatcgaaaccacaataataaacgaaaaaaaaaaaaaaaacgacgacgacgaaaacgacgacgataacgaccacgacgacgaaaacgaccacgaacacgccgaccaccaccaccaccaccatcaccaccaccaccacccgcccataatcgctctacaaccgctaatcaccgacgacccgacccaaatacaccaccaccaaaaaataatcctaatacaaacgcgcgaaaaaataataaacgacgacgactcgaacgaactacgcgccgaaaacgacttcgaaaatcaaattctcatcccgatacccgcgccgaccgacgacgacgacgactacattaaacaaacgctaatcaccgtaacgacgaccgacaaaaacgacgacgacgactcgtcgtcgtcgaaaaacgaccgcgtcaaaaaaaacgacgacaaaaaaaacgacaaaaaaaattacctcaacgacgaaaccgacgcgacgaacgacgacgacgccgacccgaacaacaaaaaataaaaacaaaaacaaatacaaatcaaaaccctaaaaaacgaattctcgatcaccatataatcctcaaataaacgccgaccgcgcgccccgaccccgaaatatttttattttaaaaaaaaaccatattttatatatataataaacgccgccatcttcttcgccaaaacaaatataacgaccccaaaaaataacgaaccgtacgacgacgaaaacgcgacgacgacgacgaacgacgaaccgcgaaaataacgacaaacgcgaaaaaaaaaaaccgcgcgcccgctanacgcaatacgtatttctctaaaaaaaaacgcgccnatacgatacgccgaaaaaaaacgcccctcctcccgctcctcctccgcgcccatcactaccgccgcgcgcgtatacgaatacttccccgccgacgaacganattcttaataataacccgctccgacaatatctatacgtctcacctcccnccnnctcctttcatatctaatacccgcttaccg

SEQ ID NO: 37233 - DNA, 528 bp, Artificial Sequence
  chemically treated genomic DNA (Homo sapiens) CpG-island No: 37233
gacggcgattggagggggtgggaggggtaacgacgtttaggtttttttttcggcggtttttttggggcgcgggggcgtatttatcgtcgggattatttggtcgacggtttgtcgaaaggttttttttatagtacgtcgtagagttgtattttggtgttgatatttagggcgttcgagttagtttgttttagggacggcgagggcgatatcgagttggatttggacgtgaatattttgttttagcggggttgtgttcggttcggattttattttttcggggttagtagggattcggggcgagaggcgagggcggagtcgtcggagagcgttttagcgagtagagaagtagagcggttcggttcggagttgtagtattaaagcgcgttgggtattggacgcggtattaagggggcgtagggcgcgtagtcggcggtttgggtttcggattgtagagggtcgggcgggaatttcgcggggagggtggtttagtttcgggtcggtagtatttttttttttttcgttttagtt

SEQ ID NO: 37234 - DNA, 528 bp, Artificial Sequence
  chemically treated genomic DNA (Homo sapiens) CpG-island No: 37234
aactaaaacgaaaaaaaaaaaaatactaccgacccgaaactaaaccaccctccccgcgaaattcccgcccgaccctctacaatccgaaacccaaaccgccgactacgcgccctacgcccccttaataccgcgtccaatacccaacgcgctttaatactacaactccgaaccgaaccgctctacttctctactcgctaaaacgctctccgacgactccgccctcgcctctcgccccgaatccctactaaccccgaaaaaataaaatccgaaccgaacacaaccccgctaaaacaaaatattcacgtccaaatccaactcgatatcgccctcgccgtccctaaaacaaactaactcgaacgccctaaatatcaacaccaaaatacaactctacgacgtactataaaaaaaacctttcgacaaaccgtcgaccaaataatcccgacgataaatacgcccccgcgccccaaaaaaaccgccgaaaaaaaaacctaaacgtcgttacccctcccaccccctccaatcgccgtc

SEQ ID NO: 37235 - DNA, 528 bp, Artificial Sequence
  chemically treated genomic DNA (Homo sapiens) CpG-island No: 37235
ggttagggcgggaggggaggagatgttgtcggttcgaggttgagttatttttttcgcggagttttcgttcggttttttgtaattcggagtttaagtcgtcggttacgcgttttgcgtttttttggtgtcgcgtttagtgtttagcgcgttttgatgttgtagtttcgggtcgggtcgttttgtttttttgttcgttgggacgtttttcgacggtttcgttttcgtttttcgtttcgagtttttgttgatttcggggaggtggggttcgggtcgggtatagtttcgttgaggtaggatgtttacgtttaagtttaattcggtgtcgttttcgtcgtttttggagtaggttgattcggacgttttggatattagtattaaagtgtagttttacggcgtgttgtggaagaggtttttcggtaggtcgtcggttaagtggtttcggcggtgagtgcgttttcgcgttttaaggagatcgtcggggagagagtttgggcgtcgttattttttttattttttttagtcgtcgtt

SEQ ID NO: 37236 - DNA, 528 bp, Artificial Sequence
  chemically treated genomic DNA (Homo sapiens) CpG-island No: 37236
aacgacgactaaaaaaaataaaaaaaataacgacgcccaaactctctccccgacgatctccttaaaacgcgaaaacgcactcaccgccgaaaccacttaaccgacgacctaccgaaaaacctcttccacaacacgccgtaaaactacactttaatactaatatccaaaacgtccgaatcaacctactccaaaaacgacgaaaacgacaccgaattaaacttaaacgtaaacatcctacctcaacgaaactatacccgacccgaaccccacctccccgaaatcaacaaaaactcgaaacgaaaaacgaaaacgaaaccgtcgaaaaacgtcccaacgaacaaaaaaacaaaacgacccgacccgaaactacaacatcaaaacgcgctaaacactaaacgcgacaccaaaaaaacgcaaaacgcgtaaccgacgacttaaactccgaattacaaaaaaccgaacgaaaactccgcgaaaaaaataactcaacctcgaaccgacaacatctcctcccctcccgccctaacc

SEQ ID NO: 37237 - DNA, 540 bp, Artificial Sequence
  chemically treated genomic DNA (Homo sapiens) CpG-island No: 37237
gggcgaagttaggagttgtatcgtttttttttttcgttatggggtaatagtttcgttttattagtttagatgttttcgagcgttcgcgtgttttagcgagagtcgggggtgggtttttaagtattcgcgtttttatcgttttttttcgttttcggtttcggtttcggttcgcgttttagtatcgtcgttttttgggtttttttcggagtgggagggagtcgcggtttcgttttcgcgttcgtttttttttaggtttttcggtcgtcgcgtcgagtttttcgcgcgtggatagattgttcggtcgacggacggacgtaggagtcggttgcggtcgtcgggatttcgcgggtgggaggaggtttcggtcgtgtttcgggaggagaggggagggggcggaggaggaggaaggggaggagatagatttcggttttgcgtatcggcgttgatacgcgagtttcggggcgttttaaattttcggttaggttttttcgagattttaaggggttttttgattttaagtagagcgtgaggtagggagtg

SEQ ID NO: 37238 - DNA, 540 bp, Artificial Sequence
  chemically treated genomic DNA (Homo sapiens) CpG-island No: 37238
cactccctacctcacgctctacttaaaatcaaaaaaccccttaaaatctcgaaaaaacctaaccgaaaatttaaaacgccccgaaactcgcgtatcaacgccgatacgcaaaaccgaaatctatctcctccccttcctcctcctccgccccctcccctctcctcccgaaacacgaccgaaacctcctcccacccgcgaaatcccgacgaccgcaaccgactcctacgtccgtccgtcgaccgaacaatctatccacgcgcgaaaaactcgacgcgacgaccgaaaaacctaaaaaaaaacgaacgcgaaaacgaaaccgcgactccctcccactccgaaaaaaacccaaaaaacgacgatactaaaacgcgaaccgaaaccgaaaccgaaaacgaaaaaaaacgataaaaacgcgaatacttaaaaacccacccccgactctcgctaaaacacgcgaacgctcgaaaacatctaaactaataaaacgaaactattaccccataacgaaaaaaaaaaacgatacaactcctaacttcgccc

SEQ ID NO: 37239 - DNA, 540 bp, Artificial Sequence
  chemically treated genomic DNA (Homo sapiens) CpG-island No: 37239
tattttttgttttacgttttgtttggggttagaaggttttttggggtttcgggagggtttggtcgaggatttggggcgtttcgagattcgcgtgttagcgtcggtgcgtagggtcgagatttgttttttttttttttttttttttcgttttttttttttttttttcggagtacggtcgaggtttttttttattcgcgagatttcggcggtcgtagtcggtttttgcgttcgttcgtcggtcgggtagtttgtttacgcgcggaaagttcggcgcggcggtcgaggggtttgggagggaacgggcgcggaggcgggatcgcggtttttttttatttcggggggagtttaggaggcggcggtgttggagcgcgagtcggagtcggagtcggagacgaagagaggcggtgagaacgcgggtgtttagggatttattttcggttttcgttagggtacgcgagcgttcggagatatttgagttggtgaagcgaggttgttattttatggcgagagggagagacgatgtagtttttggtttcgttt

SEQ ID NO: 37240 - DNA, 540 bp, Artificial Sequence
  chemically treated genomic DNA (Homo sapiens) CpG-island No: 37240
aaacgaaaccaaaaactacatcgtctctccctctcgccataaaataacaacctcgcttcaccaactcaaatatctccgaacgctcgcgtaccctaacgaaaaccgaaaataaatccctaaacacccgcgttctcaccgcctctcttcgtctccgactccgactccgactcgcgctccaacaccgccgcctcctaaactccccccgaaataaaaaaaaaccgcgatcccgcctccgcgcccgttccctcccaaacccctcgaccgccgcgccgaactttccgcgcgtaaacaaactacccgaccgacgaacgaacgcaaaaaccgactacgaccgccgaaatctcgcgaataaaaaaaaacctcgaccgtactccgaaaaaaaaaaaaaaaaaacgaaaaaaaaaaaaaaaaaaaaaacaaatctcgaccctacgcaccgacgctaacacgcgaatctcgaaacgccccaaatcctcgaccaaaccctcccgaaaccccaaaaaaccttctaaccccaaacaaaacgtaaaacaaaaaata

SEQ ID NO: 37241 - DNA, 613 bp, Artificial Sequence
  chemically treated genomic DNA (Homo sapiens) CpG-island No: 37241
gggattcggagtttagcgtaaagtagtcgcggttttttcggatttcgttttttttttttttttatttttcgggggtttcggttttttttgttgcggttcggtttcgtagttgtaaaaaataattttcggttggagataattagttgagaaattcgagtatttgaggcgttcgtttcgtattgtgggttcgcgtcgattggtttaggtaggtacgttttttgagcgtcgcgttcggaaggttacgggtcgtaggattcgtcgttcgagggtttcgagatttgattgggcgcgtaatttttttattttttttcgtttttgtattttttatttacgttgttgattggttttgttattgtatcgttcgttcgcgtcggcgggaggattttgtaatcgtttgttattttcgtttcgtttattacgttttttattggttagagagtgtttcgcgtagggagtacgaggagaaggaggagtttcgtaggttgtttttttttaggaggtcgatttcgtcgagtcggtggcggttgtaggttgggagggagaagtgttacgtttttgtaggttggcgaagtggttttaggttattcggttagtttggtacggtttcgttttt

SEQ ID NO: 37242 - DNA, 613 bp, Artificial Sequence
  chemically treated genomic DNA (Homo sapiens) CpG-island No: 37242
aaaaacgaaaccgtaccaaactaaccgaataacctaaaaccacttcgccaacctacaaaaacgtaacacttctccctcccaacctacaaccgccaccgactcgacgaaatcgacctcctaaaaaaaaacaacctacgaaactcctccttctcctcgtactccctacgcgaaacactctctaaccaataaaaaacgtaataaacgaaacgaaaataacaaacgattacaaaatcctcccgccgacgcgaacgaacgatacaataacaaaaccaatcaacaacgtaaataaaaaatacaaaaacgaaaaaaaataaaaaaattacgcgcccaatcaaatctcgaaaccctcgaacgacgaatcctacgacccgtaaccttccgaacgcgacgctcaaaaaacgtacctacctaaaccaatcgacgcgaacccacaatacgaaacgaacgcctcaaatactcgaatttctcaactaattatctccaaccgaaaattattttttacaactacgaaaccgaaccgcaacaaaaaaaaccgaaacccccgaaaaataaaaaaaaaaaaaaaacgaaatccgaaaaaaccgcgactactttacgctaaactccgaatccc

SEQ ID NO: 37243 - DNA, 613 bp, Artificial Sequence
  chemically treated genomic DNA (Homo sapiens) CpG-island No: 37243
gaagacggggtcgtgttagattagtcgggtagtttggaattatttcgttaatttgtaaaggcgtagtattttttttttttagtttgtagtcgttatcgattcggcggagtcggttttttgggaaaaaataatttgcgaagttttttttttttttcgtgttttttacgcgaggtattttttaattaatgggaaacgtggtgggcggagcgagagtgatagacgattatagagttttttcgtcggcgcgaacgggcggtgtagtagtagggttaattagtagcgtgggtgggaagtataggggcgggagaaagtagggaaattacgcgtttaattagatttcggggttttcgagcgacgggttttgcggttcgtggtttttcgagcgcggcgtttagggggcgtgtttgtttgggttaatcggcgcgagtttatagtgcggagcgagcgttttaaatgttcgggttttttagttgattgtttttagtcgagagttgttttttgtagttacggagtcgagtcgtagtaggaggagtcgagattttcggggggtggggggaaagaggaggcggggttcgggggagtcgcggttgttttgcgttggatttcgggtttt

SEQ ID NO: 37244 - DNA, 613 bp, Artificial Sequence
  chemically treated genomic DNA (Homo sapiens) CpG-island No: 37244
aaaacccgaaatccaacgcaaaacaaccgcgactcccccgaaccccgcctcctctttccccccaccccccgaaaatctcgactcctcctactacgactcgactccgtaactacaaaaaacaactctcgactaaaaacaatcaactaaaaaacccgaacatttaaaacgctcgctccgcactataaactcgcgccgattaacccaaacaaacacgccccctaaacgccgcgctcgaaaaaccacgaaccgcaaaacccgtcgctcgaaaaccccgaaatctaattaaacgcgtaatttccctactttctcccgcccctatacttcccacccacgctactaattaaccctactactacaccgcccgttcgcgccgacgaaaaaactctataatcgtctatcactctcgctccgcccaccacgtttcccattaattaaaaaatacctcgcgtaaaaaacacgaaaaaaaaaaaaaacttcgcaaattattttttcccaaaaaaccgactccgccgaatcgataacgactacaaactaaaaaaaaaaaatactacgcctttacaaattaacgaaataattccaaactacccgactaatctaacacgaccccgtcttc

SEQ ID NO: 37245 - DNA, 611 bp, Artificial Sequence
  chemically treated genomic DNA (Homo sapiens) CpG-island No: 37245
tttcgttttgttgtttttagtttttttttcggattcgagatttggggagttacgtatcgggtttagtttataagtttcgagggtagacgcgttagttcgcggtagtatacgttttgggggaatagggatagttgtcgtgacggtaggagttgggttcgggttcgggttcgcgtttttcgcgggcggcgaagttcgttcgtgtacgagagttgcgcggttattttttttttttagtagttattcgggattcgagtttttcgcggtcgcgttgttttttttaatttttttgttagttttcgggatttcggggtttattttaggttttttgttacgtgaacgtttttcgtagttaatgggcgcgttcgggattttagtcgtcgattaatgggcgcgtagttacggcgttggggagtatcgtttcgttacgtgatcggtagcgcgttcggagtgattcggttgcgggttagggtttgggaagggggtggtgggtcgtcgttttattagaagtcggaggacgggcgttagggggtaattttttataggagggcgtttcgttagaatgatagggtttttgtaaaagtttgatattcgtggtatagagcgttttagat

SEQ ID NO: 37246 - DNA, 611 bp, Artificial Sequence
  chemically treated genomic DNA (Homo sapiens) CpG-island No: 37246
atctaaaacgctctataccacgaatatcaaacttttacaaaaaccctatcattctaacgaaacgccctcctataaaaaattaccccctaacgcccgtcctccgacttctaataaaacgacgacccaccacccccttcccaaaccctaacccgcaaccgaatcactccgaacgcgctaccgatcacgtaacgaaacgatactccccaacgccgtaactacgcgcccattaatcgacgactaaaatcccgaacgcgcccattaactacgaaaaacgttcacgtaacaaaaaacctaaaataaaccccgaaatcccgaaaactaacaaaaaaattaaaaaaaacaacgcgaccgcgaaaaactcgaatcccgaataactactaaaaaaaaaaaataaccgcgcaactctcgtacacgaacgaacttcgccgcccgcgaaaaacgcgaacccgaacccgaacccaactcctaccgtcacgacaactatccctattcccccaaaacgtatactaccgcgaactaacgcgtctaccctcgaaacttataaactaaacccgatacgtaactccccaaatctcgaatccgaaaaaaaaactaaaaacaacaaaacgaaa

SEQ ID NO: 37247 - DNA, 611 bp, Artificial Sequence
  chemically treated genomic DNA (Homo sapiens) CpG-island No: 37247
atttggggcgttttgtgttacgggtgttagatttttgtaaaagttttgttattttaacgggacgtttttttgtaggaagttgttttttggcgttcgtttttcggtttttgatgaaacggcgatttattattttttttttagattttggttcgtagtcggattatttcgggcgcgttgtcgattacgtggcgaagcggtgttttttagcgtcgtggttgcgcgtttattggtcggcggttggagtttcgggcgcgtttattggttgcggggggcgtttacgtggtagggggtttgggatggatttcggggtttcgagagttggtaggaaagttaaagggggtagcgcggtcgcggggagttcgagtttcgggtgattgttggagggaggaggtgatcgcgtagttttcgtgtacggacggatttcgtcgttcgcggggggcgcgaattcgagttcgggtttagtttttgtcgttacggtagttgtttttgtttttttagggcgtatgttgtcgcgggttggcgcgtttgttttcgggatttatgagttgaattcggtacgtagttttttaagtttcgagttcgagggaagggttggggataataaggcgagg

SEQ ID NO: 37248 - DNA, 611 bp, Artificial Sequence
  chemically treated genomic DNA (Homo sapiens) CpG-island No: 37248
cctcgccttattatccccaacccttccctcgaactcgaaacttaaaaaactacgtaccgaattcaactcataaatcccgaaaacaaacgcgccaacccgcgacaacatacgccctaaaaaaacaaaaacaactaccgtaacgacaaaaactaaacccgaactcgaattcgcgccccccgcgaacgacgaaatccgtccgtacacgaaaactacgcgatcacctcctccctccaacaatcacccgaaactcgaactccccgcgaccgcgctaccccctttaactttcctaccaactctcgaaaccccgaaatccatcccaaaccccctaccacgtaaacgccccccgcaaccaataaacgcgcccgaaactccaaccgccgaccaataaacgcgcaaccacgacgctaaaaaacaccgcttcgccacgtaatcgacaacgcgcccgaaataatccgactacgaaccaaaatctaaaaaaaaaataataaatcgccgtttcatcaaaaaccgaaaaacgaacgccaaaaaacaacttcctacaaaaaaacgtcccgttaaaataacaaaacttttacaaaaatctaacacccgtaacacaaaacgccccaaat

SEQ ID NO: 37249 - DNA, 575 bp, Artificial Sequence
  chemically treated genomic DNA (Homo sapiens) CpG-island No: 37249
cgttaagacggtgatgatcgtttgcgttagttttttttttttcgatttcgacgagatttttaatatttttaattacgttagtcgcgtttagaatattcgtaatcgcgttacggttaattggcggttcgaggtcgagcggttattcgaagagacggcgagcggcgcgcggggttcgttacggtatcgtttcgagattcgtattatttatcgcggtcggcgcgttttaggtttagttatcgttttcgcggcggtcgttatgcgtttgggcgtcgagtgcgcgcgttatcgggtttgtatcgacgtcgtttatagttttttgcgcgagttgtaggtcgagttcgggttgttcggcgtcgtcgttcgtaaggtgcgcgattggttgtgcgtcgtcgagggcgagcgtagcgttttgagtttcgttttcgggttcgatagcggtatcgagagcgttttcgtcgaggattaggcggcgtagggggtcggcgggcgaaaggtggtcgagggataggttgtggttgtggttgtgggtagtggggagtggtggagaggaaggaagagggtttttagatagtagt

SEQ ID NO: 37250 - DNA, 575 bp, Artificial Sequence
  chemically treated genomic DNA (Homo sapiens) CpG-island No: 37250
actactatctaaaaaccctcttccttcctctccaccactccccactacccacaaccacaaccacaacctatccctcgaccacctttcgcccgccgaccccctacgccgcctaatcctcgacgaaaacgctctcgataccgctatcgaacccgaaaacgaaactcaaaacgctacgctcgccctcgacgacgcacaaccaatcgcgcaccttacgaacgacgacgccgaacaacccgaactcgacctacaactcgcgcaaaaaactataaacgacgtcgatacaaacccgataacgcgcgcactcgacgcccaaacgcataacgaccgccgcgaaaacgataactaaacctaaaacgcgccgaccgcgataaataatacgaatctcgaaacgataccgtaacgaaccccgcgcgccgctcgccgtctcttcgaataaccgctcgacctcgaaccgccaattaaccgtaacgcgattacgaatattctaaacgcgactaacgtaattaaaaatattaaaaatctcgtcgaaatcgaaaaaaaaaaaactaacgcaaacgatcatcaccgtcttaacg

SEQ ID NO: 37251 - DNA, 575 bp, Artificial Sequence
  chemically treated genomic DNA (Homo sapiens) CpG-island No: 37251
gttgttgtttgaagattttttttttttttttttattattttttattgtttataattataattataatttgtttttcggttatttttcgttcgtcggttttttgcgtcgtttggttttcgacggaggcgttttcgatgtcgttatcgggttcggaggcggagtttagggcgttgcgttcgttttcgacggcgtatagttagtcgcgtattttgcgggcggcggcgtcgggtagttcgggttcggtttgtagttcgcgtaagaggttgtaggcggcgtcggtgtaggttcggtagcgcgcgtattcggcgtttaggcgtatggcggtcgtcgcggaggcggtggttgggtttggggcgcgtcggtcgcggtggatgatgcgggtttcggagcggtgtcgtggcggatttcgcgcgtcgttcgtcgttttttcgggtggtcgttcggtttcgggtcgttagttgatcgtggcgcggttgcggatgttttgggcgcggttggcgtagttgagggtgttgagggtttcgtcgaagtcggaggaggaagggttgacgtaggcgattattatcgttttggcg

SEQ ID NO: 37252 - DNA, 575 bp, Artificial Sequence
  chemically treated genomic DNA (Homo sapiens) CpG-island No: 37252
cgccaaaacgataataatcgcctacgtcaacccttcctcctccgacttcgacgaaaccctcaacaccctcaactacgccaaccgcgcccaaaacatccgcaaccgcgccacgatcaactaacgacccgaaaccgaacgaccacccgaaaaaacgacgaacgacgcgcgaaatccgccacgacaccgctccgaaacccgcatcatccaccgcgaccgacgcgccccaaacccaaccaccgcctccgcgacgaccgccatacgcctaaacgccgaatacgcgcgctaccgaacctacaccgacgccgcctacaacctcttacgcgaactacaaaccgaacccgaactacccgacgccgccgcccgcaaaatacgcgactaactatacgccgtcgaaaacgaacgcaacgccctaaactccgcctccgaacccgataacgacatcgaaaacgcctccgtcgaaaaccaaacgacgcaaaaaaccgacgaacgaaaaataaccgaaaaacaaattataattataattataaacaataaaaaataataaaaaaaaaaaaaaaaaatcttcaaacaacaac

SEQ ID NO: 37253 - DNA, 595 bp, Artificial Sequence
  chemically treated genomic DNA (Homo sapiens) CpG-island No: 37253
tggcgcgggttcggatcggggtttcggggcggcggtacggtcgatatggtatgttgttataaagtaatgttgttgttggatatcgcgggcggcgtcgttcgttatagtcgggttcggcgggtcgttttgcgtttttttatttatttgagttgtcgattcggtttggttagggtttattgggtttttaagttttttgattcgtagggggcgcggagtcggtcgtttcgcgtgtttgattttcgcgagttggggtttcgttcgtgggaggattttgaggaggagttggaggttaggttcgaggatcgcgtttatttgttcggttcggcgtttagggttatttatacgtacggcgttttgatggagacgttgttagattattagtgggatcggttcgagattacgtcgtttacgaagtcgattttgcggagtagcgggaggagattgttggacgtggagagcgaggttaaggaggtcgaggtcgcgttcgggggtttggtgaacgtcgttttttttttggttttttgttcgtattcgtagagggagttgttgtagttcgtgtttgggtgcgaggtttaggtttagcgtttgtcgttta

SEQ ID NO: 37254 - DNA, 595 bp, Artificial Sequence
  chemically treated genomic DNA (Homo sapiens) CpG-island No: 37254
taaacgacaaacgctaaacctaaacctcgcacccaaacacgaactacaacaactccctctacgaatacgaacaaaaaaccaaaaaaaaaacgacgttcaccaaacccccgaacgcgacctcgacctccttaacctcgctctccacgtccaacaatctcctcccgctactccgcaaaatcgacttcgtaaacgacgtaatctcgaaccgatcccactaataatctaacaacgtctccatcaaaacgccgtacgtataaataaccctaaacgccgaaccgaacaaataaacgcgatcctcgaacctaacctccaactcctcctcaaaatcctcccacgaacgaaaccccaactcgcgaaaatcaaacacgcgaaacgaccgactccgcgccccctacgaatcaaaaaacttaaaaacccaataaaccctaaccaaaccgaatcgacaactcaaataaataaaaaaacgcaaaacgacccgccgaacccgactataacgaacgacgccgcccgcgatatccaacaacaacattactttataacaacataccatatcgaccgtaccgccgccccgaaaccccgatccgaacccgcgcca

SEQ ID NO: 37255 - DNA, 595 bp, Artificial Sequence
  chemically treated genomic DNA (Homo sapiens) CpG-island No: 37255
tgggcggtaggcgttgggtttgggtttcgtatttagatacgaattgtagtagttttttttgcgagtgcggatagggggttaggaggaagacggcgtttattaagttttcgagcgcggtttcggtttttttggtttcgttttttacgtttagtagttttttttcgttgtttcgtaggatcggtttcgtgggcgacgtgatttcgggtcggttttattggtagtttagtagcgtttttattagggcgtcgtgcgtgtgggtggttttgggcgtcgggtcgggtaggtgggcgcgattttcgagtttggtttttagtttttttttaaagtttttttacgagcgggattttagttcgcggaagttagatacgcgggacggtcggtttcgcgttttttgcgagttaaagaatttgaaggtttagtggattttggttaggtcgaatcggtaatttagataggtgaggaggcgtagggcggttcgtcggattcggttgtggcgggcggcgtcgttcgcggtgtttagtagtagtattattttgtgatagtatgttatatcggtcgtgtcgtcgtttcggggtttcggttcgggttcgcgtta

SEQ ID NO: 37256 - DNA, 595 bp, Artificial Sequence
  chemically treated genomic DNA (Homo sapiens) CpG-island No: 37256
taacgcgaacccgaaccgaaaccccgaaacgacgacacgaccgatataacatactatcacaaaataatactactactaaacaccgcgaacgacgccgcccgccacaaccgaatccgacgaaccgccctacgcctcctcacctatctaaattaccgattcgacctaaccaaaatccactaaaccttcaaattctttaactcgcaaaaaacgcgaaaccgaccgtcccgcgtatctaacttccgcgaactaaaatcccgctcgtaaaaaaactttaaaaaaaaactaaaaaccaaactcgaaaatcgcgcccacctacccgacccgacgcccaaaaccacccacacgcacgacgccctaataaaaacgctactaaactaccaataaaaccgacccgaaatcacgtcgcccacgaaaccgatcctacgaaacaacgaaaaaaaactactaaacgtaaaaaacgaaaccaaaaaaaccgaaaccgcgctcgaaaacttaataaacgccgtcttcctcctaaccccctatccgcactcgcaaaaaaaactactacaattcgtatctaaatacgaaacccaaacccaacgcctaccgccca

SEQ ID NO: 37257 - DNA, 938 bp, Artificial Sequence
  chemically treated genomic DNA (Homo sapiens) CpG-island No: 37257
tgtcgtcggtttttatttaggtcgaggtggttcggttttatgtatcgcgacgtaacgcggggaggtagataaggtatagggcggcgtttataatttatgttaattcgttttatgtgttcgtcgaggcggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcggtcgacgtttttttttatgcgatttttgtattaggaagtagtttagtagtaggttgaggtcgttgagtatcgtcgtcgtaaggaatggtgtatgtaaggagatggcgtttaatagtttttcggttacggggtttgttattatatttacgtcgaaataagcgtttatgagttcgaagtggcgagttcgattttttttatcggtgatgtcggcgatataggcgttagtaatcgtatttgtggcgtcggtgatgtcggttacgatgcgttcggcgtagaggattaggaaatggagaataagtttt

SEQ ID NO: 37258 - DNA, 938 bp, Artificial Sequence
  chemically treated genomic DNA (Homo sapiens) CpG-island No: 37258
aaaacttattctccatttcctaatcctctacgccgaacgcatcgtaaccgacatcaccgacgccacaaatacgattactaacgcctatatcgccgacatcaccgataaaaaaaatcgaactcgccacttcgaactcataaacgcttatttcgacgtaaatataataacaaaccccgtaaccgaaaaactattaaacgccatctccttacatacaccattccttacgacgacgatactcaacgacctcaacctactactaaactacttcctaatacaaaaatcgcataaaaaaaaacgtcgaccgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgcctcgacgaacacataaaacgaattaacataaattataaacgccgccctataccttatctacctccccgcgttacgtcgcgatacataaaaccgaaccacctcgacctaaataaaaaccgacgaca

SEQ ID NO: 37259 - DNA, 938 bp, Artificial Sequence
  chemically treated genomic DNA (Homo sapiens) CpG-island No: 37259
agagtttattttttattttttgattttttacgtcggacgtatcgtggtcggtattatcggcgttataggtgcggttgttggcgtttatatcgtcgatattatcgatggggaagatcgggttcgttatttcgggtttatgagcgtttgtttcggcgtgggtatggtggtaggtttcgtggtcgggggattgttgggcgttatttttttgtatgtattattttttgcggcggcggtgtttaacggttttaatttattattgggttgttttttaatgtaggagtcgtataagggagagcgtcgatcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgtttcggcgagtatatggaacgggttggtatggattgtaggcgtcgttttatattttgtttgttttttcgcgttgcgtcgcggtgtatggagtcgggttatttcgatttgaatggaagtcggcggta

SEQ ID NO: 37260 - DNA, 938 bp, Artificial Sequence
  chemically treated genomic DNA (Homo sapiens) CpG-island No: 37260
taccgccgacttccattcaaatcgaaataacccgactccatacaccgcgacgcaacgcgaaaaaacaaacaaaatataaaacgacgcctacaatccataccaacccgttccatatactcgccgaaacgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgatcgacgctctcccttatacgactcctacattaaaaaacaacccaataataaattaaaaccgttaaacaccgccgccgcaaaaaataatacatacaaaaaaataacgcccaacaatcccccgaccacgaaacctaccaccatacccacgccgaaacaaacgctcataaacccgaaataacgaacccgatcttccccatcgataatatcgacgatataaacgccaacaaccgcacctataacgccgataataccgaccacgatacgtccgacgtaaaaaatcaaaaaataaaaaataaactct

SEQ ID NO: 37261 - DNA, 530 bp, Artificial Sequence
  chemically treated genomic DNA (Homo sapiens) CpG-island No: 37261
  misc_feature (521)..(521): n is either a, c, g or t
ttagcgtaagtcgatttttgcgagggagatatacgagggcgatattcgcgagggagatacgcggggtcgattttcgcgaggtttcgcgtcggggaggtatcgagcggtagtttcggcgcggggagcgataggggtcggaggagtcgtttgttgggttcgggttttcgtagggttttcgagtatagttttagtttttttaattgtgaaatgggcgtcgttatttcgttcgttttttttatagggatttgggagattaatgaatgataaacgcgcggttaacgatttggtcgcgttcgtcgttcgtttcgtcgcgtttggtttttagcggcgcggtttagtatcggttcgaagattataaatgttttagtatcgcgtttgttgtttcgtttcggtaatgagcgttcgtagtagtcgtttattttggttattagttgaataatggtgatattatgggtcgggcggggtttttcgttcgcggttattatttatttattgcgatcgtcgttgtatgcggtagtcgngggtagggt

SEQ ID NO: 37262 - DNA, 530 bp, Artificial Sequence
  chemically treated genomic DNA (Homo sapiens) CpG-island No: 37262
  misc_feature (10)..(10): n is either a, c, g or t
accctacccncgactaccgcatacaacgacgatcgcaataaataaataataaccgcgaacgaaaaaccccgcccgacccataatatcaccattattcaactaataaccaaaataaacgactactacgaacgctcattaccgaaacgaaacaacaaacgcgatactaaaacatttataatcttcgaaccgatactaaaccgcgccgctaaaaaccaaacgcgacgaaacgaacgacgaacgcgaccaaatcgttaaccgcgcgtttatcattcattaatctcccaaatccctataaaaaaaacgaacgaaataacgacgcccatttcacaattaaaaaaactaaaactatactcgaaaaccctacgaaaacccgaacccaacaaacgactcctccgacccctatcgctccccgcgccgaaactaccgctcgatacctccccgacgcgaaacctcgcgaaaatcgaccccgcgtatctccctcgcgaatatcgccctcgtatatctccctcgcaaaaatcgacttacgctaa

SEQ ID NO: 37263 - DNA, 530 bp, Artificial Sequence
  chemically treated genomic DNA (Homo sapiens) CpG-island No: 37263
  misc_feature (10)..(10): n is either a, c, g or t
gttttgtttncggttgtcgtatgtaacggcggtcgtagtaagtgagtggtagtcgcggacgaagagtttcgttcggtttatgatattattattgtttagttggtgattaaggtaggcggttgttgcgggcgtttattatcggagcggagtagtaggcgcggtgttagaatatttataattttcgggtcggtgttgagtcgcgtcgttggagattaggcgcggcggggcgagcggcgggcgcgattaggtcgttagtcgcgcgtttattatttattagttttttagatttttgtggggaggacgggcgaggtagcggcgtttattttatagttggggagattgaggttgtattcggggattttgcgggagttcgaatttagtaggcggttttttcggtttttgtcgtttttcgcgtcggagttgtcgttcggtgttttttcggcgcgggatttcgcggaagtcgatttcgcgtgtttttttcgcgggtgtcgttttcgtgtgtttttttcgtagaagtcggtttgcgttgg

SEQ ID NO: 37264 - DNA, 530 bp, Artificial Sequence
  chemically treated genomic DNA (Homo sapiens) CpG-island No: 37264
  misc_feature (521)..(521): n is either a, c, g or t
ccaacgcaaaccgacttctacgaaaaaaacacacgaaaacgacacccgcgaaaaaaacacgcgaaatcgacttccgcgaaatcccgcgccgaaaaaacaccgaacgacaactccgacgcgaaaaacgacaaaaaccgaaaaaaccgcctactaaattcgaactcccgcaaaatccccgaatacaacctcaatctccccaactataaaataaacgccgctacctcgcccgtcctccccacaaaaatctaaaaaactaataaataataaacgcgcgactaacgacctaatcgcgcccgccgctcgccccgccgcgcctaatctccaacgacgcgactcaacaccgacccgaaaattataaatattctaacaccgcgcctactactccgctccgataataaacgcccgcaacaaccgcctaccttaatcaccaactaaacaataataatatcataaaccgaacgaaactcttcgtccgcgactaccactcacttactacgaccgccgttacatacgacaaccgnaaacaaaac

SEQ ID NO: 37265 - DNA, 883 bp, Artificial Sequence
  chemically treated genomic DNA (Homo sapiens) CpG-island No: 37265
cgtcgtcgtcgcgttatggagttcgagtgagcgcggcgcgggttcgttcggtcgtcggataatatggaggaagcgtcgttcgggtcgtcgtggtcgttgttgttgttgttgttgttgttgttggcgttgtgcggttgttcggttttcgtcgcgggtaggtgggcgtaggtcggtcgggggtcgcgggttgttcggataatggttcgggcggtttcgcggttaagtgcgcgggcgtcgtcgtcgtttcggaagcgatttggcgagttgggagcgagttggggcgcgcgttcgggatttttttgtcgttttcggcgttttcgttacgcgcgggttttttgtttttttattcgggtttttttcggggacgttgcgtttcgggttggcgaggagggcgttcgtttcgttaggtgcggcgcgggcgggtttttatttgttcgagttcgcgggaagtcgggagtcgagtcgagttcgcgttgggttcgtgtggttcgggtcgggtatcgagcggggatttggggcgcggaggcgggtttggttcggggagtcggttcgtaagtttgtttttagcggtcgcgcggtcgtttcgcgtgtttcgaggacgggttgaagttgtagcgagaaagttttgagttcgggcgcggggcggtttggtcggtggcgttgtttttgtgagtcgcgtggttgtgggtttttaagcggattgatatttgttaggtgttcgggcgattcgaatgtttcgtgtggtcgtcgggtttttagatagtgtttattttcgggtcggttacgcggaggtgacgtggttttagatcgcggggtagtgggggaggtaggtttgtgttttagttgtatattttcgtggggagaggtagggcgggggaatttt

SEQ ID NO: 37266 - DNA, 883 bp, Artificial Sequence
  chemically treated genomic DNA (Homo sapiens) CpG-island No: 37266
aaaattcccccgccctacctctccccacgaaaatatacaactaaaacacaaacctacctcccccactaccccgcgatctaaaaccacgtcacctccgcgtaaccgacccgaaaataaacactatctaaaaacccgacgaccacacgaaacattcgaatcgcccgaacacctaacaaatatcaatccgcttaaaaacccacaaccacgcgactcacaaaaacaacgccaccgaccaaaccgccccgcgcccgaactcaaaactttctcgctacaacttcaacccgtcctcgaaacacgcgaaacgaccgcgcgaccgctaaaaacaaacttacgaaccgactccccgaaccaaacccgcctccgcgccccaaatccccgctcgatacccgacccgaaccacacgaacccaacgcgaactcgactcgactcccgacttcccgcgaactcgaacaaataaaaacccgcccgcgccgcacctaacgaaacgaacgccctcctcgccaacccgaaacgcaacgtccccgaaaaaaacccgaataaaaaaacaaaaaacccgcgcgtaacgaaaacgccgaaaacgacaaaaaaatcccgaacgcgcgccccaactcgctcccaactcgccaaatcgcttccgaaacgacgacgacgcccgcgcacttaaccgcgaaaccgcccgaaccattatccgaacaacccgcgacccccgaccgacctacgcccacctacccgcgacgaaaaccgaacaaccgcacaacgccaacaacaacaacaacaacaacaacaacgaccacgacgacccgaacgacgcttcctccatattatccgacgaccgaacgaacccgcgccgcgctcactcgaactccataacgcgacgacgacg

SEQ ID NO: 37267 - DNA, 883 bp, Artificial Sequence
  chemically treated genomic DNA (Homo sapiens) CpG-island No: 37267
aaagttttttcgttttatttttttttacgggagtgtataattgaggtataagtttgttttttttattgtttcgcgatttgggattacgttattttcgcgtagtcgattcggggatggatattatttggggattcggcggttatacggggtattcgggtcgttcgggtatttggtaggtgttagttcgtttggaaatttatagttacgcggtttataggagtagcgttatcggttaggtcgtttcgcgttcgggtttagaattttttcgttgtaattttagttcgttttcggagtacgcggggcggtcgcgcggtcgttggaaataggtttgcgaatcggtttttcgggttaggttcgttttcgcgttttaagttttcgttcggtgttcggttcgggttatacgggtttagcgcgggttcggttcggttttcggtttttcgcgggttcgggtaggtgaggattcgttcgcgtcgtatttggcggagcgggcgtttttttcgttagttcgggacgtagcgttttcggggagggttcgggtggggagataaagggttcgcgcgtggcggggacgtcggggacggtagggggatttcgggcgcgcgttttaattcgtttttaattcgttaagtcgttttcgagacggcggcggcgttcgcgtatttggtcgcggggtcgttcgggttattgttcgagtaattcgcggttttcggtcggtttgcgtttatttattcgcggcgggggtcgggtagtcgtatagcgttagtagtagtagtagtagtagtagtagcggttacggcggttcgggcggcgttttttttatgttgttcggcggtcggacgggttcgcgtcgcgtttattcgggttttatggcgcggcggcggcg

SEQ ID NO: 37268 - DNA, 883 bp, Artificial Sequence
  chemically treated genomic DNA (Homo sapiens) CpG-island No: 37268
cgccgccgccgcgccataaaacccgaataaacgcgacgcgaacccgtccgaccgccgaacaacataaaaaaaacgccgcccgaaccgccgtaaccgctactactactactactactactactaacgctatacgactacccgacccccgccgcgaataaataaacgcaaaccgaccgaaaaccgcgaattactcgaacaataacccgaacgaccccgcgaccaaatacgcgaacgccgccgccgtctcgaaaacgacttaacgaattaaaaacgaattaaaacgcgcgcccgaaatccccctaccgtccccgacgtccccgccacgcgcgaaccctttatctccccacccgaaccctccccgaaaacgctacgtcccgaactaacgaaaaaaacgcccgctccgccaaatacgacgcgaacgaatcctcacctacccgaacccgcgaaaaaccgaaaaccgaaccgaacccgcgctaaacccgtataacccgaaccgaacaccgaacgaaaacttaaaacgcgaaaacgaacctaacccgaaaaaccgattcgcaaacctatttccaacgaccgcgcgaccgccccgcgtactccgaaaacgaactaaaattacaacgaaaaaattctaaacccgaacgcgaaacgacctaaccgataacgctactcctataaaccgcgtaactataaatttccaaacgaactaacacctaccaaatacccgaacgacccgaataccccgtataaccgccgaatccccaaataatatccatccccgaatcgactacgcgaaaataacgtaatcccaaatcgcgaaacaataaaaaaaacaaacttatacctcaattatacactcccgtaaaaaaaaataaaacgaaaaaacttt

SEQ ID NO: 37269 - DNA, 684 bp, Artificial Sequence
  chemically treated genomic DNA (Homo sapiens) CpG-island No: 37269
ggacgttttatttttaattcgttatttttaaagagatttttaaatatcgttcggttttttttagaattgagttttttttcggttatcggatcggttttttttattttagcggttgttttttagtcgttcgtttttatatattttattttaagtttggttcgggtttcgtatatgtttatttcgcgtttagacgtttcgtattcggtgtttaggtcgtttagtcgttcgcgttttttgtgtttagggtcgtttagggggttatcgtgggaagagggagcggtggttgaggacgcggcggtagcgttgttgtcggttgcgtcggatgcgaaggagaagttggaggataaggatgaggatgagacgggcgcgttttttagtttttatggaattttcgtttcggttcgttgttaggagttttcgaggttcggatttcgttttttttgttttgttgtttcgggtgcgaggcggtcgtagttttttcgcgataataaatagattagacgttggggagtatagagatagtgcgcgagggttagagcgtcgtcggatagggcgtttttgggtgtttcgttagttatttattttcggtttttattgttttcgttatttttttcgtttttcgtttttatttttttttttttttttttggtttttaaattaggttttttttgtttattcgttggg

SEQ ID NO: 37270 - DNA, 684 bp, Artificial Sequence
  chemically treated genomic DNA (Homo sapiens) CpG-island No: 37270
cccaacgaataaacaaaaaaaacctaatttaaaaaccaaaaaaaaaaaaaaaaaaataaaaacgaaaaacgaaaaaaataacgaaaacaataaaaaccgaaaataaataactaacgaaacacccaaaaacgccctatccgacgacgctctaaccctcgcgcactatctctatactccccaacgtctaatctatttattatcgcgaaaaaactacgaccgcctcgcacccgaaacaacaaaacaaaaaaaacgaaatccgaacctcgaaaactcctaacaacgaaccgaaacgaaaattccataaaaactaaaaaacgcgcccgtctcatcctcatccttatcctccaacttctccttcgcatccgacgcaaccgacaacaacgctaccgccgcgtcctcaaccaccgctccctcttcccacgataaccccctaaacgaccctaaacacaaaaaacgcgaacgactaaacgacctaaacaccgaatacgaaacgtctaaacgcgaaataaacatatacgaaacccgaaccaaacttaaaataaaatatataaaaacgaacgactaaaaaacaaccgctaaaataaaaaaaaccgatccgataaccgaaaaaaaactcaattctaaaaaaaaccgaacgatatttaaaaatctctttaaaaataacgaattaaaaataaaacgtcc

SEQ ID NO: 37271 - DNA, 684 bp, Artificial Sequence
  chemically treated genomic DNA (Homo sapiens) CpG-island No: 37271
tttagcgggtgggtaggaggggtttgatttggggattaggaaggaggaaggaagggtgggggcgggggacggggaaagtgacgggagtagtgagagtcggaaatgagtggttagcgaggtatttaggagcgttttgttcggcggcgttttagttttcgcgtattgtttttatgttttttagcgtttagtttatttattgtcgcggggaagttgcggtcgtttcgtattcggaataataaagtaaggaagacggagttcgagtttcgggggtttttagtaacgggtcggggcgggagttttatggagattggggagcgcgttcgttttatttttatttttgttttttagtttttttttcgtattcgacgtaatcggtagtagcgttgtcgtcgcgtttttagttatcgttttttttttttacggtaattttttaggcgattttgggtatagggagcgcgggcggttgagcggtttgagtatcgggtgcggggcgtttgggcgcggggtgggtatgtgcggagttcgggttagatttggggtgggatgtgtgggggcgggcgattggagggtagtcgttgaggtgggggaaatcggttcggtggtcgagggagggtttagttttgaagaggatcgggcgatatttggggatttttttagggataacgggttgggggtggggcgttt

SEQ ID NO: 37272 - DNA, 684 bp, Artificial Sequence
  chemically treated genomic DNA (Homo sapiens) CpG-island No: 37272
aaacgccccacccccaacccgttatccctaaaaaaatccccaaatatcgcccgatcctcttcaaaactaaaccctccctcgaccaccgaaccgatttcccccacctcaacgactaccctccaatcgcccgcccccacacatcccaccccaaatctaacccgaactccgcacatacccaccccgcgcccaaacgccccgcacccgatactcaaaccgctcaaccgcccgcgctccctatacccaaaatcgcctaaaaaattaccgtaaaaaaaaaaaacgataactaaaaacgcgacgacaacgctactaccgattacgtcgaatacgaaaaaaaaactaaaaaacaaaaataaaaataaaacgaacgcgctccccaatctccataaaactcccgccccgacccgttactaaaaacccccgaaactcgaactccgtcttccttactttattattccgaatacgaaacgaccgcaacttccccgcgacaataaataaactaaacgctaaaaaacataaaaacaatacgcgaaaactaaaacgccgccgaacaaaacgctcctaaatacctcgctaaccactcatttccgactctcactactcccgtcactttccccgtcccccgcccccacccttccttcctccttcctaatccccaaatcaaacccctcctacccacccgctaaa

SEQ ID NO: 37273 - DNA, 566 bp, Artificial Sequence
  chemically treated genomic DNA (Homo sapiens) CpG-island No: 37273
agtacgtcgggagagttagtcgtgttatttgggggggcgttaggcgggagtggtttagttagtcggacgggtttttgtcgggagtcgcgagtcggtgttagcggcgttcgggttgggtcgtttagcgtttgtgcgcgtttcggttcgtatttcggttttcgattcggaattttcggttttagagagtcgagggtagagcgacggtggtcggggagcgtacggtgtttttgttcgaggaaagtttaagaggaggtcgaggagaggattagtgtagcgagcgggtcggtttcgggtagggcgtcgggttatggaggagtcgcgtagtagcgggtagtcgagtttcgagttttagattcggttgcgaagcggcggagttcgcggttagatagggtcgggaagcgtttgtcgcgtcgagagttttacgagcgttcggacgcggttttaagtagtttttattcgttacgtacgattttcgttgtatttcgaggtttgttttagttttttaggtttgattgttttcgttcgttttttttttttttttttttttttcgcggttttttttttcg

SEQ ID NO: 37274 - DNA, 566 bp, Artificial Sequence
  chemically treated genomic DNA (Homo sapiens) CpG-island No: 37274
cgaaaaaaaaaaccgcgaaaaaaaaaaaaaaaaaaaaaaaacgaacgaaaacaatcaaacctaaaaaactaaaacaaacctcgaaatacaacgaaaatcgtacgtaacgaataaaaactacttaaaaccgcgtccgaacgctcgtaaaactctcgacgcgacaaacgcttcccgaccctatctaaccgcgaactccgccgcttcgcaaccgaatctaaaactcgaaactcgactacccgctactacgcgactcctccataacccgacgccctacccgaaaccgacccgctcgctacactaatcctctcctcgacctcctcttaaactttcctcgaacaaaaacaccgtacgctccccgaccaccgtcgctctaccctcgactctctaaaaccgaaaattccgaatcgaaaaccgaaatacgaaccgaaacgcgcacaaacgctaaacgacccaacccgaacgccgctaacaccgactcgcgactcccgacaaaaacccgtccgactaactaaaccactcccgcctaacgcccccccaaataacacgactaactctcccgacgtact

SEQ ID NO: 37275 - DNA, 566 bp, Artificial Sequence
  chemically treated genomic DNA (Homo sapiens) CpG-island No: 37275
cggagggggaggtcgcgggggagggggaaggggagaggaagcgagcgaggataattagatttaaaaggttggggtagatttcgggatgtagcgggggtcgtgcgtagcgggtaggagttgtttgggatcgcgttcgggcgttcgtggggttttcggcgcggtaggcgtttttcggttttgtttggtcgcgggtttcgtcgtttcgtagtcgagtttgggattcgggattcggttgttcgttgttgcgcggtttttttatgattcggcgttttgttcgggatcggttcgttcgttgtattggtttttttttcggtttttttttgagtttttttcggataggggtatcgtgcgtttttcggttatcgtcgttttgttttcggttttttggggtcggggatttcggatcgggagtcgggatgcgggtcggggcgcgtatagacgttaggcggtttagttcgggcgtcgttggtatcggttcgcggttttcggtaaaaattcgttcgattggttgggttattttcgtttgacgtttttttagatgatacgattagttttttcggcgtgtt

SEQ ID NO: 37276 - DNA, 566 bp, Artificial Sequence
  chemically treated genomic DNA (Homo sapiens) CpG-island No: 37276
aacacgccgaaaaaactaatcgtatcatctaaaaaaacgtcaaacgaaaataacccaaccaatcgaacgaatttttaccgaaaaccgcgaaccgataccaacgacgcccgaactaaaccgcctaacgtctatacgcgccccgacccgcatcccgactcccgatccgaaatccccgaccccaaaaaaccgaaaacaaaacgacgataaccgaaaaacgcacgatacccctatccgaaaaaaactcaaaaaaaaaccgaaaaaaaaaccaatacaacgaacgaaccgatcccgaacaaaacgccgaatcataaaaaaaccgcgcaacaacgaacaaccgaatcccgaatcccaaactcgactacgaaacgacgaaacccgcgaccaaacaaaaccgaaaaacgcctaccgcgccgaaaaccccacgaacgcccgaacgcgatcccaaacaactcctacccgctacgcacgacccccgctacatcccgaaatctaccccaaccttttaaatctaattatcctcgctcgcttcctctccccttccccctcccccgcgacctccccctccg

SEQ ID NO: 37277 - DNA, 813 bp, Artificial Sequence
  chemically treated genomic DNA (Homo sapiens) CpG-island No: 37277
gagtcggacggaaaagcggggattgtggtttaaagtttgggattcggttttggtcgggatgagggtcggggtcgggtaggatttgggggtgatttacgacgtttaatacgcggttttttttttgttttcgtaggtttcgtgtttttgtttaagtttaatagtaatgtcgttttcgttatttttattaataaggataattttttcggcggcgtggtgaattttaacgaagttttttgtttagtttcgggtcgtttttcgttttttagttttatttcgaagtataaggttacggtggcggaagtgtagcggcggtttttattattcgagtgttttaacgcgtcgttgttgggcggagtgtttcggaggtgaggttcggtacggtttcgttcgtttcgtttcgcggtcgggggaattattgcgtttgcgtcggggcggtggcggcgacgtaaataggtttcgcgtcgcggttttttttacgcgggaaaggaaagggggcggggagaagagcgtagagttaagtgggcgggatttgggggcgggggagcgggcgatgcggcgcgcgtttgcgtttttcgttgttttttcgcgagcgagttttggtgcgcgtttcgttcgttgtcgcgcgttcgcggagtttttcgtttcgttttttttttcgcgtaagcgtagttcgtttcgtcgcgggtttaatttcggttattgtagtcgcggggcgtcgtatagttatttttttttttttcgcgtatattttgtaagtttaggaaaagttttttttaggtttttcgttttgttttatttttttgagtagggttt

SEQ ID NO: 37278 - DNA, 813 bp, Artificial Sequence
  chemically treated genomic DNA (Homo sapiens) CpG-island No: 37278
aaaccctactcaaaaaaataaaacaaaacgaaaaacctaaaaaaaacttttcctaaacttacaaaatatacgcgaaaaaaaaaaaaataactatacgacgccccgcgactacaataaccgaaattaaacccgcgacgaaacgaactacgcttacgcgaaaaaaaaaacgaaacgaaaaactccgcgaacgcgcgacaacgaacgaaacgcgcaccaaaactcgctcgcgaaaaaacaacgaaaaacgcaaacgcgcgccgcatcgcccgctcccccgcccccaaatcccgcccacttaactctacgctcttctccccgccccctttcctttcccgcgtaaaaaaaaccgcgacgcgaaacctatttacgtcgccgccaccgccccgacgcaaacgcaataattcccccgaccgcgaaacgaaacgaacgaaaccgtaccgaacctcacctccgaaacactccgcccaacaacgacgcgttaaaacactcgaataataaaaaccgccgctacacttccgccaccgtaaccttatacttcgaaataaaactaaaaaacgaaaaacgacccgaaactaaacaaaaaacttcgttaaaattcaccacgccgccgaaaaaattatccttattaataaaaataacgaaaacgacattactattaaacttaaacaaaaacacgaaacctacgaaaacaaaaaaaaaaccgcgtattaaacgtcgtaaatcacccccaaatcctacccgaccccgaccctcatcccgaccaaaaccgaatcccaaactttaaaccacaatccccgcttttccgtccgactc

SEQ ID NO: 37279 - DNA, 813 bp, Artificial Sequence
  chemically treated genomic DNA (Homo sapiens) CpG-island No: 37279
agattttatttagagaggtaaggtaaagcgaggagtttgagaggaattttttttgggtttgtaaggtgtgcgcgaagagggaaaaggtggttgtacggcgtttcgcggttgtagtggtcgggattgagttcgcggcggagcgagttgcgtttgcgcgaggaggagggcggagcggaggatttcgcgagcgcgcggtagcgaacgaagcgcgtattagaattcgttcgcgggaaagtagcggagagcgtaggcgcgcgtcgtatcgttcgttttttcgtttttagatttcgtttatttggttttacgttttttttttcgtttttttttttttttcgcgtagggagggtcgcggcgcgaggtttgtttgcgtcgtcgttatcgtttcggcgtaagcgtagtggttttttcggtcgcggggcggggcgggcggggtcgtgtcgggttttattttcggagtatttcgtttagtagcgacgcgttgagatattcgggtggtgagagtcgtcgttgtattttcgttatcgtgattttgtatttcgaggtggagttgaggagcgagaggcgattcggaattgaatagaagatttcgttggggtttattacgtcgtcgaagaggttgtttttgttaatagggatggcggagacggtattgttgttggatttggatagggatacggggtttgcggagatagaggggaggtcgcgtgttgggcgtcgtggattatttttaaattttgttcgatttcggtttttatttcggttagggtcggattttaggttttgggttatagttttcgttttttcgttcggttt

SEQ ID NO: 37280 - DNA, 813 bp, Artificial Sequence
  chemically treated genomic DNA (Homo sapiens) CpG-island No: 37280
aaaccgaacgaaaaaacgaaaactataacccaaaacctaaaatccgaccctaaccgaaataaaaaccgaaatcgaacaaaatttaaaaataatccacgacgcccaacacgcgacctcccctctatctccgcaaaccccgtatccctatccaaatccaacaacaataccgtctccgccatccctattaacaaaaacaacctcttcgacgacgtaataaaccccaacgaaatcttctattcaattccgaatcgcctctcgctcctcaactccacctcgaaatacaaaatcacgataacgaaaatacaacgacgactctcaccacccgaatatctcaacgcgtcgctactaaacgaaatactccgaaaataaaacccgacacgaccccgcccgccccgccccgcgaccgaaaaaaccactacgcttacgccgaaacgataacgacgacgcaaacaaacctcgcgccgcgaccctccctacgcgaaaaaaaaaaaaaaacgaaaaaaaaaacgtaaaaccaaataaacgaaatctaaaaacgaaaaaacgaacgatacgacgcgcgcctacgctctccgctactttcccgcgaacgaattctaatacgcgcttcgttcgctaccgcgcgctcgcgaaatcctccgctccgccctcctcctcgcgcaaacgcaactcgctccgccgcgaactcaatcccgaccactacaaccgcgaaacgccgtacaaccaccttttccctcttcgcgcacaccttacaaacccaaaaaaaattcctctcaaactcctcgctttaccttacctctctaaataaaatct

SEQ ID NO: 37281 - DNA, 503 bp, Artificial Sequence
  chemically treated genomic DNA (Homo sapiens) CpG-island No: 37281
gcggatggtagcggattatttagtttcgaacgtcgtaaagcgagtttattatgatggcgttttttgttcggttaggttcggaaagagagaacgggttggggtgggcggggaaagttttaagcgagtggcgtcgtcgtgacgttatatgggtgcgacgcggcgttttattacgattcggatttttttgtggtgagttggacgattgattagtcgggcgataacggtagagagtatagagcgtaggaataagcgtaacgtttaagagggaagggttagtacgtcgggggtttttttggttttatttaggtcgtgttttcgatagtttttcggaagaaagggatttgggagcgagatgcgtgtagttagtacgatgcgtcgcgcggtgacgttttggttcgacgtcgacggttttttagtggttttcggaggattcggcgggtttagtgttggaggtgaggaggcggggttggtagggttagtcggggtatttggaaattttcgat

SEQ ID NO: 37282 - DNA, 503 bp, Artificial Sequence
  chemically treated genomic DNA (Homo sapiens) CpG-island No: 37282
atcgaaaatttccaaataccccgactaaccctaccaaccccgcctcctcacctccaacactaaacccgccgaatcctccgaaaaccactaaaaaaccgtcgacgtcgaaccaaaacgtcaccgcgcgacgcatcgtactaactacacgcatctcgctcccaaatccctttcttccgaaaaactatcgaaaacacgacctaaataaaaccaaaaaaacccccgacgtactaacccttccctcttaaacgttacgcttattcctacgctctatactctctaccgttatcgcccgactaatcaatcgtccaactcaccacaaaaaaatccgaatcgtaataaaacgccgcgtcgcacccatataacgtcacgacgacgccactcgcttaaaactttccccgcccaccccaacccgttctctctttccgaacctaaccgaacaaaaaacgccatcataataaactcgctttacgacgttcgaaactaaataatccgctaccatccgc

SEQ ID NO: 37283 - DNA, 503 bp, Artificial Sequence
  chemically treated genomic DNA (Homo sapiens) CpG-island No: 37283
gtcggaaatttttagatgtttcgattagttttgttagtttcgtttttttatttttaatattgggttcgtcgggtttttcgggagttattgagaggtcgtcggcgtcgggttagagcgttatcgcgcgacgtatcgtgttagttatacgtatttcgtttttagatttttttttttcggaaagttatcgagaatacggtttgggtagggttagagaggttttcgacgtgttggttttttttttttggacgttgcgtttgtttttgcgttttatgttttttgtcgttatcgttcggttagttagtcgtttaatttattatagagaagttcggatcgtggtagagcgtcgcgtcgtatttatgtgacgttacggcggcgttattcgtttgaggtttttttcgtttattttagttcgtttttttttttcggatttggtcgagtaggaggcgttattatggtgagttcgttttgcggcgttcggggttggataattcgttgttattcgt

SEQ ID NO: 37284 - DNA, 503 bp, Artificial Sequence
  chemically treated genomic DNA (Homo sapiens) CpG-island No: 37284
acgaataacaacgaattatccaaccccgaacgccgcaaaacgaactcaccataataacgcctcctactcgaccaaatccgaaaaaaaaaaacgaactaaaataaacgaaaaaaacctcaaacgaataacgccgccgtaacgtcacataaatacgacgcgacgctctaccacgatccgaacttctctataataaattaaacgactaactaaccgaacgataacgacaaaaaacataaaacgcaaaaacaaacgcaacgtccaaaaaaaaaaaaccaacacgtcgaaaacctctctaaccctacccaaaccgtattctcgataactttccgaaaaaaaaaaatctaaaaacgaaatacgtataactaacacgatacgtcgcgcgataacgctctaacccgacgccgacgacctctcaataactcccgaaaaacccgacgaacccaatattaaaaataaaaaaacgaaactaacaaaactaatcgaaacatctaaaaatttccgac

SEQ ID NO: 37285 - DNA, 882 bp, Artificial Sequence
  chemically treated genomic DNA (Homo sapiens) CpG-island No: 37285
cgggttcgcgattacgttttttttatttatagtcgagtttgacgcggcggtggtttatgcgttttttcgttttagtttttagttacggattatacgttttattttaggcgtttcgtttttttttcgtttttcgttttcggcgcgttttttttaggttgtcggtttcggtgtttgagcggtcgcgttcgcgagtcgtgagcgatgattggttgcgttacggcggcgggcggttcgtgggcgtatatatttttttcgcgtagttaatgggcgtgcgtacgttattgattcggaggttcgcgggtcggtagttttttaataagttatattgttgtatgaaatttcggcgtaggagtttcgggttgtcgttggtaatatcgtgttatttagttaagaaaattcgcgggttcgagttacgcgtttgtgaatcggagaggttttattgttcgagtggagtcgggttgagattttttttaagttgagttttagtgattttgtggtcgaagttagcgttttgacgtgggataatcggatacgtcgttaggagagaattgaggcgttttttagtagttgtgacgttaaaattacgttttcggagattcgcgtttttcgttagtcgggcgtattttcgtcggtagttttttttgtgcgtcgttcggatttttagttttcggttcggtagtcgagttttagtataaagtagtcggatcgcgtcgttcgttttttttttcgcgttttcgtttcggttttttaattttgcgtcgtcgggtcgcggtaggatgattgtttcgtatttgtttgtttatttttttacggagtttaattatgattaagtgtagaaggtaagttagcgcgggcggggcggtaggttgggttttggtaaag

SEQ ID NO: 37286 - DNA, 882 bp, Artificial Sequence
  chemically treated genomic DNA (Homo sapiens) CpG-island No: 37286
ctttaccaaaacccaacctaccgccccgcccgcgctaacttaccttctacacttaatcataattaaactccgtaaaaaaataaacaaacaaatacgaaacaatcatcctaccgcgacccgacgacgcaaaattaaaaaaccgaaacgaaaacgcgaaaaaaaaaacgaacgacgcgatccgactactttatactaaaactcgactaccgaaccgaaaactaaaaatccgaacgacgcacaaaaaaaactaccgacgaaaatacgcccgactaacgaaaaacgcgaatctccgaaaacgtaattttaacgtcacaactactaaaaaacgcctcaattctctcctaacgacgtatccgattatcccacgtcaaaacgctaacttcgaccacaaaatcactaaaactcaacttaaaaaaaatctcaacccgactccactcgaacaataaaacctctccgattcacaaacgcgtaactcgaacccgcgaattttcttaactaaataacacgatattaccaacgacaacccgaaactcctacgccgaaatttcatacaacaatataacttattaaaaaactaccgacccgcgaacctccgaatcaataacgtacgcacgcccattaactacgcgaaaaaaatatatacgcccacgaaccgcccgccgccgtaacgcaaccaatcatcgctcacgactcgcgaacgcgaccgctcaaacaccgaaaccgacaacctaaaaaaaacgcgccgaaaacgaaaaacgaaaaaaaaacgaaacgcctaaaataaaacgtataatccgtaactaaaaactaaaacgaaaaaacgcataaaccaccgccgcgtcaaactcgactataaataaaaaaaacgtaatcgcgaacccg

SEQ ID NO: 37287 - DNA, 882 bp, Artificial Sequence
  chemically treated genomic DNA (Homo sapiens) CpG-island No: 37287
ttttgttagagtttagtttgtcgtttcgttcgcgttgatttattttttgtatttggttatggttgagtttcgtgaagaagtaggtaagtagatgcgaggtaattattttgtcgcggttcgacggcgtagagttgggaaatcgaggcggagacgcgagaggggaggcgggcggcgcggttcgattgttttgtgttggggttcggttgtcgggtcgggagttgggagttcggacggcgtataaagaaggttatcggcgagggtgcgttcggttggcggagggcgcgggttttcggagacgtgattttggcgttataattgttagaaggcgttttagtttttttttggcgacgtgttcggttgttttacgttaaggcgttaatttcggttataggattattgaggtttaatttgagaagaattttagttcggttttattcgggtagtgggattttttcgatttataggcgcgtggttcgggttcgcggatttttttagttgggtgatacgatgttgttagcggtagttcgggatttttgcgtcggagttttatgtaataatgtggtttattgaggggttgtcggttcgcgggttttcggattagtgacgtgcgtacgtttattggttgcgcggggagggtgtgtgcgtttacggatcgttcgtcgtcgtggcgtagttaattatcgtttacggttcgcgggcgcggtcgtttagatatcggagtcggtagtttggggaggacgcgtcgggggcggggggcgggggaggggcggggcgtttgagatgggacgtgtggttcgtggttaaaggttgggacggaaaggcgtatgagttatcgtcgcgttaggttcggttatgggtggggggagcgtgatcgcggattcg

SEQ ID NO: 37288 - DNA, 882 bp, Artificial Sequence
  chemically treated genomic DNA (Homo sapiens) CpG-island No: 37288
cgaatccgcgatcacgctccccccacccataaccgaacctaacgcgacgataactcatacgcctttccgtcccaacctttaaccacgaaccacacgtcccatctcaaacgccccgcccctcccccgccccccgcccccgacgcgtcctccccaaactaccgactccgatatctaaacgaccgcgcccgcgaaccgtaaacgataattaactacgccacgacgacgaacgatccgtaaacgcacacaccctccccgcgcaaccaataaacgtacgcacgtcactaatccgaaaacccgcgaaccgacaacccctcaataaaccacattattacataaaactccgacgcaaaaatcccgaactaccgctaacaacatcgtatcacccaactaaaaaaatccgcgaacccgaaccacgcgcctataaatcgaaaaaatcccactacccgaataaaaccgaactaaaattcttctcaaattaaacctcaataatcctataaccgaaattaacgccttaacgtaaaacaaccgaacacgtcgccaaaaaaaaactaaaacgccttctaacaattataacgccaaaatcacgtctccgaaaacccgcgccctccgccaaccgaacgcaccctcgccgataaccttctttatacgccgtccgaactcccaactcccgacccgacaaccgaaccccaacacaaaacaatcgaaccgcgccgcccgcctcccctctcgcgtctccgcctcgatttcccaactctacgccgtcgaaccgcgacaaaataattacctcgcatctacttacctacttcttcacgaaactcaaccataaccaaatacaaaaaataaatcaacgcgaacgaaacgacaaactaaactctaacaaaa

SEQ ID NO: 37289 - DNA, 539 bp, Artificial Sequence
  chemically treated genomic DNA (Homo sapiens) CpG-island No: 37289
  misc_feature (454)..(454): n is either a, c, g or t
gatcgcgttttttttaaatttttgtgagcgttgcggaagtacgcggggttcgggtcgttgagcgttgtaagataggggagggagtcgggcgggagagggaggggcggcgtcggggcgggttttgatatagagtaggcgtcgcgggtcgtagtatagtgcggagatcgtattttcggagttcgggttagggtttatttgtattcgtagcgtcggttcgcgtttttttgtcgtagttatcggtgagtgtcgcggatttgagattttcgggtcggatgcgcggcggttttagttttcgagcgtttgtttttttcgatttgggttgttcggtttttttgggtttttcggcggttgcgcggagttaaggcgtttcgttttgggcgttcgtcgcgggtgtcgatttatgttgttcggagttttgagtcgatataggagagatatagttgcggagtttgtntatcgcggatatttgttttgcgatgtattcgtttttttgggttgttttgtggttttttcgattgttgtattgattggtttttatt

SEQ ID NO: 37290 - DNA, 539 bp, Artificial Sequence
  chemically treated genomic DNA (Homo sapiens) CpG-island No: 37290
  misc_feature (86)..(86): n is either a, c, g or t
aataaaaaccaatcaatacaacaatcgaaaaaaccacaaaacaacccaaaaaaacgaatacatcgcaaaacaaatatccgcgatanacaaactccgcaactatatctctcctatatcgactcaaaactccgaacaacataaatcgacacccgcgacgaacgcccaaaacgaaacgccttaactccgcgcaaccgccgaaaaacccaaaaaaaccgaacaacccaaatcgaaaaaaacaaacgctcgaaaactaaaaccgccgcgcatccgacccgaaaatctcaaatccgcgacactcaccgataactacgacaaaaaaacgcgaaccgacgctacgaatacaaataaaccctaacccgaactccgaaaatacgatctccgcactatactacgacccgcgacgcctactctatatcaaaacccgccccgacgccgcccctccctctcccgcccgactccctcccctatcttacaacgctcaacgacccgaaccccgcgtacttccgcaacgctcacaaaaatttaaaaaaaacgcgatc

SEQ ID NO: 37291 - DNA, 539 bp, Artificial Sequence
  chemically treated genomic DNA (Homo sapiens) CpG-island No: 37291
  misc_feature (86)..(86): n is either a, c, g or t
agtaaggattagttagtgtaatagtcggagggattataaggtagtttaggaaggcgagtgtatcgtagggtagatgttcgcggtgngtagatttcgtagttgtattttttttatgtcggtttaggatttcgggtagtatggatcggtattcgcggcggacgtttagaacggggcgttttgatttcgcgtagtcgtcggggagtttagggagatcgggtagtttaggtcgggggaggtagacgttcgggagttggggtcgtcgcgtattcggttcggggattttaggttcgcggtatttatcggtggttgcggtaggagggcgcgagtcggcgttgcgggtataggtggattttggttcgggtttcgggggtgcggttttcgtattgtgttgcgattcgcggcgtttgttttatattagggttcgtttcggcgtcgtttttttttttttcgttcggtttttttttttgttttgtagcgtttagcgattcggatttcgcgtgttttcgtaacgtttataaagatttgggggaagcgcgatt

SEQ ID NO: 37292 - DNA, 539 bp, Artificial Sequence
  chemically treated genomic DNA (Homo sapiens) CpG-island No: 37292
  misc_feature (454)..(454): n is either a, c, g or t
aatcgcgcttcccccaaatctttataaacgttacgaaaacacgcgaaatccgaatcgctaaacgctacaaaacaaaaaaaaaaaccgaacgaaaaaaaaaaaaacgacgccgaaacgaaccctaatataaaacaaacgccgcgaatcgcaacacaatacgaaaaccgcacccccgaaacccgaaccaaaatccacctatacccgcaacgccgactcgcgccctcctaccgcaaccaccgataaataccgcgaacctaaaatccccgaaccgaatacgcgacgaccccaactcccgaacgtctacctcccccgacctaaactacccgatctccctaaactccccgacgactacgcgaaatcaaaacgccccgttctaaacgtccgccgcgaataccgatccatactacccgaaatcctaaaccgacataaaaaaaatacaactacgaaatctacncaccgcgaacatctaccctacgatacactcgccttcctaaactaccttataatccctccgactattacactaactaatccttact

SEQ ID NO: 37293 - DNA, 614 bp, Artificial Sequence
  chemically treated genomic DNA (Homo sapiens) CpG-island No: 37293
tttcgcgtacgggtttttttttttttgggcgtcgtagttcggagtaggtcgagggggtcgggttgtagggtcgcgtcgggttagaagggcgcgttttgggtagcgcggacgtacgtagtcggtttttttcgcgtttcgttgtatttcggtagggagttcgttttcgttaatgtttaatttttcgaatcgttgatttttcggattttagttaagttatttattcgtttcgttttcgggacgaatttttggtatagttttttcgcgcggttcgtttatcgtggggttttttggagtcggggacggcgggaagacgtttcgaggtggcggtttttatattcgttttacgtttcgtttttagatttgttttatcgttttagatagtttagagatggttttcggaatgtttatcgttcgtcgttttcgggatgtttttttagttttacgtagttcgggcgttttttgcggcggaggtagagtttgttcggtttattttagtgtcgttaatttgcgggatcgcggatagagagtttttcggtgcgtcggttagttcgtggtttggggtttttggtgtttttagtttttattatagtcgtttcgttttattttaagaagag

SEQ ID NO: 37294 - DNA, 614 bp, Artificial Sequence
  chemically treated genomic DNA (Homo sapiens) CpG-island No: 37294
ctcttcttaaaataaaacgaaacgactataataaaaactaaaaacaccaaaaaccccaaaccacgaactaaccgacgcaccgaaaaactctctatccgcgatcccgcaaattaacgacactaaaataaaccgaacaaactctacctccgccgcaaaaaacgcccgaactacgtaaaactaaaaaaacatcccgaaaacgacgaacgataaacattccgaaaaccatctctaaactatctaaaacgataaaacaaatctaaaaacgaaacgtaaaacgaatataaaaaccgccacctcgaaacgtcttcccgccgtccccgactccaaaaaaccccacgataaacgaaccgcgcgaaaaaactataccaaaaattcgtcccgaaaacgaaacgaataaataacttaactaaaatccgaaaaatcaacgattcgaaaaattaaacattaacgaaaacgaactccctaccgaaatacaacgaaacgcgaaaaaaaccgactacgtacgtccgcgctacccaaaacgcgcccttctaacccgacgcgaccctacaacccgaccccctcgacctactccgaactacgacgcccaaaaaaaaaaaaacccgtacgcgaaa

SEQ ID NO: 37295 - DNA, 614 bp, Artificial Sequence
  chemically treated genomic DNA (Homo sapiens) CpG-island No: 37295
ttttttttgaggtggggcggggcggttgtagtaggagttggaggtattagagattttaagttacgagttgatcgacgtatcgaggagttttttgttcgcggtttcgtaggttggcggtattggagtgggtcgggtaggttttgttttcgtcgtagagagcgttcggattgcgtggggttggggaagtatttcgggaacggcgggcggtgagtatttcgggaattatttttgggttgtttggggcggtggagtaagtttggaggcgggacgtggggcgagtatgggagtcgttatttcgagacgttttttcgtcgttttcggttttaggagattttacggtgagcgggtcgcgcgggaaaattatgttaggaattcgtttcgggagcggggcgggtgggtagtttggttggagttcgagggattagcgattcgggaggttaaatattagcgggggcgaattttttgtcggggtgtagcggggcgcgggaggagtcggttgcgtgcgttcgcgttgtttagggcgcgtttttttggttcggcgcggttttgtagttcggttttttcggtttgtttcgaattgcggcgtttagggagggaaggattcgtgcgcgggg

SEQ ID NO: 37296 - DNA, 614 bp, Artificial Sequence
  chemically treated genomic DNA (Homo sapiens) CpG-island No: 37296
ccccgcgcacgaatccttccctccctaaacgccgcaattcgaaacaaaccgaaaaaaccgaactacaaaaccgcgccgaaccaaaaaaacgcgccctaaacaacgcgaacgcacgcaaccgactcctcccgcgccccgctacaccccgacaaaaaattcgcccccgctaatatttaacctcccgaatcgctaatccctcgaactccaaccaaactacccacccgccccgctcccgaaacgaattcctaacataattttcccgcgcgacccgctcaccgtaaaatctcctaaaaccgaaaacgacgaaaaaacgtctcgaaataacgactcccatactcgccccacgtcccgcctccaaacttactccaccgccccaaacaacccaaaaataattcccgaaatactcaccgcccgccgttcccgaaatacttccccaaccccacgcaatccgaacgctctctacgacgaaaacaaaacctacccgacccactccaataccgccaacctacgaaaccgcgaacaaaaaactcctcgatacgtcgatcaactcgtaacttaaaatctctaatacctccaactcctactacaaccgccccgccccacctcaaaaaaaa

SEQ ID NO: 37297 - DNA, 533 bp, Artificial Sequence
  chemically treated genomic DNA (Homo sapiens) CpG-island No: 37297
gggatcggggcggcggggcgagaggagaatttcgttttttttagggatcgggcgttgggttcgggaagttgggattgaggtcgtcgggaggaggtcgcgcggggtcgggggtggacggggtttcgtcgttttaacgcgcgtcgtttcggagttatttcggggtttaggggttcgttttcggcgagggtttttggttcggatcgacgcgattaaaagagtcgcggagttgttcgggttagggaagtcgtatttggagggattcggatagttagaggtatcgttatttttcgcgtagcgcgcgtcgtttttcgcgcgtcgtaggtttcgttttcgtatgggcgggattttatagacgtttcgtttttttagcggtttttaggtttcgttcgacgtgggcggtattttagggaagtttcgtttatttatagacgttaaggcgagttttgttttggttttggggtcggaatttcggtcggaatttatgtttgttagatttacgatcgaaggaagaatggatttattattatttatta

SEQ ID NO: 37298 - DNA, 533 bp, Artificial Sequence
  chemically treated genomic DNA (Homo sapiens) CpG-island No: 37298
taataaataataataaatccattcttccttcgatcgtaaatctaacaaacataaattccgaccgaaattccgaccccaaaaccaaaacaaaactcgccttaacgtctataaataaacgaaacttccctaaaataccgcccacgtcgaacgaaacctaaaaaccgctaaaaaaacgaaacgtctataaaatcccgcccatacgaaaacgaaacctacgacgcgcgaaaaacgacgcgcgctacgcgaaaaataacgatacctctaactatccgaatccctccaaatacgacttccctaacccgaacaactccgcgactcttttaatcgcgtcgatccgaaccaaaaaccctcgccgaaaacgaacccctaaaccccgaaataactccgaaacgacgcgcgttaaaacgacgaaaccccgtccacccccgaccccgcgcgacctcctcccgacgacctcaatcccaacttcccgaacccaacgcccgatccctaaaaaaaacgaaattctcctctcgccccgccgccccgatccc

SEQ ID NO: 37299 - DNA, 533 bp, Artificial Sequence
  chemically treated genomic DNA (Homo sapiens) CpG-island No: 37299
taataaataataatgaatttatttttttttcggtcgtgggtttggtaggtataaatttcggtcgggatttcgattttagggttagagtaggattcgttttggcgtttatgagtgggcggggtttttttggggtatcgtttacgtcgggcgggatttgagggtcgttggaggggcggggcgtttatgaggtttcgtttatgcgggggcggggtttgcggcgcgcgggaagcggcgcgcgttgcgcgggaggtgacggtgtttttgattgttcgggtttttttaggtacggtttttttggttcgggtagtttcgcggtttttttggtcgcgtcggttcgggttagaggttttcgtcgagggcgggtttttgggtttcgggatagtttcggagcggcgcgcgttggggcggcggggtttcgtttattttcggtttcgcgcggttttttttcggcggttttagttttagtttttcgggtttagcgttcggtttttgggaaaggcggggtttttttttcgtttcgtcgtttcggtttt

SEQ ID NO: 37300 - DNA, 533 bp, Artificial Sequence
  chemically treated genomic DNA (Homo sapiens) CpG-island No: 37300
aaaaccgaaacgacgaaacgaaaaaaaaaccccgcctttcccaaaaaccgaacgctaaacccgaaaaactaaaactaaaaccgccgaaaaaaaaccgcgcgaaaccgaaaataaacgaaaccccgccgccccaacgcgcgccgctccgaaactatcccgaaacccaaaaacccgccctcgacgaaaacctctaacccgaaccgacgcgaccaaaaaaaccgcgaaactacccgaaccaaaaaaaccgtacctaaaaaaacccgaacaatcaaaaacaccgtcacctcccgcgcaacgcgcgccgcttcccgcgcgccgcaaaccccgcccccgcataaacgaaacctcataaacgccccgcccctccaacgaccctcaaatcccgcccgacgtaaacgataccccaaaaaaaccccgcccactcataaacgccaaaacgaatcctactctaaccctaaaatcgaaatcccgaccgaaatttatacctaccaaacccacgaccgaaaaaaaaataaattcattattatttatta

SEQ ID NO: 37301 - DNA, 595 bp, Artificial Sequence
  chemically treated genomic DNA (Homo sapiens) CpG-island No: 37301
gacgtcgaggtcgtcggcgtttttggacgcggaattcgtttttttttattacgacgtttagcggatagaagagggttaggggtttcgcggtttcgagagtagatcgatttttcgtcgaggtttcgttcgcggacgatagttgttgggagattaggagggagttgggaggaggagtcgcgattttggttcgtttcgaagtaaaatagaaatataatgtagaggcgacggaacgtagttcggttcgtagtcgagttgtttcgtcgacgggagcgagatggtcgtttttttttcgggtttcgtcgtagttttcgtcgtcgcgtcggttttataagtcgttatcgtttattgtcggttttttttcgtttgttcgttcgtttttttgggatacggttcgttttatttttcgcggttgtttatcgcgttgaggcgtatttcgcggggtggttgcgtcgttattttgagcgagttataaagttaggaacggttttcgtcgtaattcgattgggaggtggcggaacgattgtggagttttatgggtatcgtttattttcggggaggggcgtacgtttggttttttttatttattttcgttttt

SEQ ID NO: 37302 - DNA, 595 bp, Artificial Sequence
  chemically treated genomic DNA (Homo sapiens) CpG-island No: 37302
aaaaacgaaaataaataaaaaaaaccaaacgtacgcccctccccgaaaataaacgatacccataaaactccacaatcgttccgccacctcccaatcgaattacgacgaaaaccgttcctaactttataactcgctcaaaataacgacgcaaccaccccgcgaaatacgcctcaacgcgataaacaaccgcgaaaaataaaacgaaccgtatcccaaaaaaacgaacgaacaaacgaaaaaaaaccgacaataaacgataacgacttataaaaccgacgcgacgacgaaaactacgacgaaacccgaaaaaaaaacgaccatctcgctcccgtcgacgaaacaactcgactacgaaccgaactacgttccgtcgcctctacattatatttctattttacttcgaaacgaaccaaaatcgcgactcctcctcccaactccctcctaatctcccaacaactatcgtccgcgaacgaaacctcgacgaaaaatcgatctactctcgaaaccgcgaaacccctaaccctcttctatccgctaaacgtcgtaataaaaaaaaacgaattccgcgtccaaaaacgccgacgacctcgacgtc

SEQ ID NO: 37303 - DNA, 595 bp, Artificial Sequence
  chemically treated genomic DNA (Homo sapiens) CpG-island No: 37303
ggaggcggaagtgggtgggaggggttagacgtgcgttttttttcggaagtgggcggtatttatagggttttatagtcgtttcgttattttttagtcgggttgcggcggaggtcgtttttggttttgtagttcgtttaagatggcggcgtagttatttcgcgggatacgttttagcgcggtgagtagtcgcgaggggtggagcgggtcgtgttttaggagggcgggcgggtaagcgaaggggggtcggtagtgggcggtggcggtttgtggggtcgacgcggcggcgggggttgcggcggggttcggggagggggcggttatttcgttttcgtcggcggaatagttcggttgcgggtcgggttgcgtttcgtcgtttttgtattgtgtttttgttttgtttcggggcgggttagggtcgcggtttttttttttagtttttttttagttttttagtagttgtcgttcgcgggcgaggtttcggcgggagatcggtttgttttcggggtcgcggggtttttgatttttttttgttcgttgggcgtcgtggtgggagggagcgggtttcgcgtttagaaacgtcggcggtttcgacgtt

SEQ ID NO: 37304 - DNA, 595 bp, Artificial Sequence
  chemically treated genomic DNA (Homo sapiens) CpG-island No: 37304
aacgtcgaaaccgccgacgtttctaaacgcgaaacccgctccctcccaccacgacgcccaacgaacaaaaaaaaatcaaaaaccccgcgaccccgaaaacaaaccgatctcccgccgaaacctcgcccgcgaacgacaactactaaaaaactaaaaaaaaactaaaaaaaaaaaccgcgaccctaacccgccccgaaacaaaacaaaaacacaatacaaaaacgacgaaacgcaacccgacccgcaaccgaactattccgccgacgaaaacgaaataaccgccccctccccgaaccccgccgcaacccccgccgccgcgtcgaccccacaaaccgccaccgcccactaccgaccccccttcgcttacccgcccgccctcctaaaacacgacccgctccacccctcgcgactactcaccgcgctaaaacgtatcccgcgaaataactacgccgccatcttaaacgaactacaaaaccaaaaacgacctccgccgcaacccgactaaaaaataacgaaacgactataaaaccctataaataccgcccacttccgaaaaaaaacgcacgtctaacccctcccacccacttccgcctcc

SEQ ID NO: 37305 - DNA, 802 bp, Artificial Sequence
  chemically treated genomic DNA (Homo sapiens) CpG-island No: 37305
gtttcgggtttttcgtttggtttcgtatttgggcgttttttatttgcggtggcgtcgagtgagttttttagtcggcgaggagcgaggtttttgtagttttgttgtttcgtagataatgtagtttcgtagtcgtcgtagtttcgtagtttcgtagtttcgtagttttcgtagtttcgtagtttagcgttagagttgcgcggagattttttgtcgtcgtacgttttgggtcggtaagaagtattcgttttaaatttcgtagtcgggtaagcgtaaagcgagcggtttggggaaatgtcgaagggatcgggaaaaataaattttaagtcgagtttaatagtcgaaacgtttcgtgtttaggtcggcggataagaaggagatagaatagattttttggttttttcgtagcgatcgatttcgtttatcgattagagttattatttcgtttttagttcgttaatttatatttttcgtaagttattagttttaagggatgcggaagttaagtatttcgtggtttttagcgattaggtgattcgtacgtgtatttatcgtagtagggaatttgtaaggtcgcgttgtggtcgttgttgtttttttggagtttgaggttgtcgttcgggggcgttttgtaggcgtttcgttgtaagtaaagatgcggttgcgcgggcggttggggttgcggttgttgttgttgcggttgcggttgcggcgaagttggggttagaggtcgacgattggggttggaatttgttaaaggagtttcgcgttttagttttattttttaggggtgtcgttaggtttt

SEQ ID NO: 37306 - DNA, 802 bp, Artificial Sequence
  chemically treated genomic DNA (Homo sapiens) CpG-island No: 37306
aaaacctaacgacacccctaaaaaataaaactaaaacgcgaaactcctttaacaaattccaaccccaatcgtcgacctctaaccccaacttcgccgcaaccgcaaccgcaacaacaacaaccgcaaccccaaccgcccgcgcaaccgcatctttacttacaacgaaacgcctacaaaacgcccccgaacgacaacctcaaactccaaaaaaacaacaacgaccacaacgcgaccttacaaattccctactacgataaatacacgtacgaatcacctaatcgctaaaaaccacgaaatacttaacttccgcatcccttaaaactaataacttacgaaaaatataaattaacgaactaaaaacgaaataataactctaatcgataaacgaaatcgatcgctacgaaaaaaccaaaaaatctattctatctccttcttatccgccgacctaaacacgaaacgtttcgactattaaactcgacttaaaatttatttttcccgatcccttcgacatttccccaaaccgctcgctttacgcttacccgactacgaaatttaaaacgaatacttcttaccgacccaaaacgtacgacgacaaaaaatctccgcgcaactctaacgctaaactacgaaactacgaaaactacgaaactacgaaactacgaaactacgacgactacgaaactacattatctacgaaacaacaaaactacaaaaacctcgctcctcgccgactaaaaaactcactcgacgccaccgcaaataaaaaacgcccaaatacgaaaccaaacgaaaaacccgaaac

SEQ ID NO: 37307 - DNA, 802 bp, Artificial Sequence
  chemically treated genomic DNA (Homo sapiens) CpG-island No: 37307
aggatttggcgatatttttggagagtggagttggagcgcggggtttttttaataagttttagttttagtcgtcgatttttagttttagtttcgtcgtagtcgtagtcgtagtagtagtagtcgtagttttagtcgttcgcgtaatcgtatttttatttgtagcgaggcgtttgtaagacgttttcggacggtagttttaaattttaggaaggtagtagcggttataacgcggttttgtaggttttttgttacggtgagtgtacgtgcgggttatttggtcgttggggattacggggtgtttggttttcgtattttttgaaattggtggtttgcgggaggtatgagttggcgggttgggggcggggtggtgattttggtcggtaaacgggatcgatcgttgcgagggagttaagggatttgttttgttttttttttgttcgtcggtttaggtacggagcgtttcggttgttaaattcgatttggagtttgtttttttcggttttttcggtatttttttaaatcgttcgttttgcgtttgttcggttgcgggatttgaagcggatgttttttatcggtttagggcgtgcggcggtaaggagttttcgcgtagttttggcgttgggttgcggggttgcggaggttgcggggttgcggggttgcggggttgcggcggttgcggggttgtattgtttgcgggatagtaggattgtagaggtttcgtttttcgtcggttgggaggtttattcggcgttatcgtaggtgagagacgtttaggtgcggagttaggcgggaagttcggagt

SEQ ID NO: 37308 - DNA, 802 bp, Artificial Sequence
  chemically treated genomic DNA (Homo sapiens) CpG-island No: 37308
actccgaacttcccgcctaactccgcacctaaacgtctctcacctacgataacgccgaataaacctcccaaccgacgaaaaacgaaacctctacaatcctactatcccgcaaacaatacaaccccgcaaccgccgcaaccccgcaaccccgcaaccccgcaacctccgcaaccccgcaacccaacgccaaaactacgcgaaaactccttaccgccgcacgccctaaaccgataaaaaacatccgcttcaaatcccgcaaccgaacaaacgcaaaacgaacgatttaaaaaaataccgaaaaaaccgaaaaaaacaaactccaaatcgaatttaacaaccgaaacgctccgtacctaaaccgacgaacaaaaaaaaaacaaaacaaatcccttaactccctcgcaacgatcgatcccgtttaccgaccaaaatcaccaccccgcccccaacccgccaactcatacctcccgcaaaccaccaatttcaaaaaatacgaaaaccaaacaccccgtaatccccaacgaccaaataacccgcacgtacactcaccgtaacaaaaaacctacaaaaccgcgttataaccgctactaccttcctaaaatttaaaactaccgtccgaaaacgtcttacaaacgcctcgctacaaataaaaatacgattacgcgaacgactaaaactacgactactactactacgactacgactacgacgaaactaaaactaaaaatcgacgactaaaactaaaacttattaaaaaaaccccgcgctccaactccactctccaaaaatatcgccaaatcct

SEQ ID NO: 37309 - DNA, 787 bp, Artificial Sequence
  chemically treated genomic DNA (Homo sapiens) CpG-island No: 37309
ggaacgggcgtttcgcgtgggtgggtttcgtgagggacgggtttttagaataggtagttttttagtttttttcgttttgtacgggtgtttcgtatttcgtttcgttgggcggaacggggtagcgatggtaggagggttaacgtttgggacgttcgatcgtttagttgcgttcgtggtgttgggcgtttttattatttgtttcggggtgggtcgtcgttttttttttttcgcgggggtcgggtttgggtggcgtttggcgggcggggcgggtttagttgcgggggcgtagtcgtcgggtcgcgggcggcgggacggacgaggtcggggtttcgggtggtattcggtaggcgggtaggcgggcgttatggagttgttttcggcgttgagtttgggcgaattggcgtttagtttttcgcgggtgtcgttttttttcgttttcgattttagttattttatcgtttttattttttatttttaagtatgagttaggtgagtcggggcggggggttggaggggatcggtagcgggtggcgcgggtcggggtagttcgggggtcgtagagaggggaagttcgtgcgtggtggagggagcgagggataggtttaaggattgtatcgtgggagtaggtaggcgttagaatcgtggggtttttttacgtcggggtgagttcgggggagaagtttttaggacgatgaagttgggggaggggaaggagaggcgtgcgcgggtttagaggagggggaataggtgtttggggtcggggtttttggttgggttagagttgtag

SEQ ID NO: 37310 - DNA, 787 bp, Artificial Sequence
  chemically treated genomic DNA (Homo sapiens) CpG-island No: 37310
ctacaactctaacccaaccaaaaaccccgaccccaaacacctattccccctcctctaaacccgcgcacgcctctccttcccctcccccaacttcatcgtcctaaaaacttctcccccgaactcaccccgacgtaaaaaaaccccacgattctaacgcctacctactcccacgatacaatccttaaacctatccctcgctccctccaccacgcacgaacttcccctctctacgacccccgaactaccccgacccgcgccacccgctaccgatcccctccaaccccccgccccgactcacctaactcatacttaaaaataaaaaataaaaacgataaaataactaaaatcgaaaacgaaaaaaaacgacacccgcgaaaaactaaacgccaattcgcccaaactcaacgccgaaaacaactccataacgcccgcctacccgcctaccgaataccacccgaaaccccgacctcgtccgtcccgccgcccgcgacccgacgactacgcccccgcaactaaacccgccccgcccgccaaacgccacccaaacccgacccccgcgaaaaaaaaaaaacgacgacccaccccgaaacaaataataaaaacgcccaacaccacgaacgcaactaaacgatcgaacgtcccaaacgttaaccctcctaccatcgctaccccgttccgcccaacgaaacgaaatacgaaacacccgtacaaaacgaaaaaaactaaaaaactacctattctaaaaacccgtccctcacgaaacccacccacgcgaaacgcccgttcc

SEQ ID NO: 37311 - DNA, 787 bp, Artificial Sequence
  chemically treated genomic DNA (Homo sapiens) CpG-island No: 37311
ttgtagttttgatttaattaggagtttcgattttaagtatttgtttttttttttttaaattcgcgtacgtttttttttttttttttttagttttatcgttttgggggtttttttttcgggtttatttcggcgtgagagaattttacgattttagcgtttgtttatttttacgatgtaatttttgaatttgtttttcgttttttttattacgtacgggttttttttttttgcgattttcgagttgtttcggttcgcgttattcgttgtcggttttttttagtttttcgtttcggtttatttggtttatatttgagagtagaggatggagacgatgaagtaattgaggtcgaagacggggaagagcggtattcgcgagaagttgagcgttagttcgtttaggtttagcgtcgagagtagttttatggcgttcgtttgttcgtttgtcgggtgttattcggggtttcggtttcgttcgtttcgtcgttcgcggttcggcgattgcgttttcgtagttgggttcgtttcgttcgttaggcgttatttaggttcggttttcgcgggagaggaggggcgacggtttatttcgggataggtggtggggacgtttagtattacggacgtagttggacggtcgggcgttttaggcgttgatttttttgttatcgttatttcgtttcgtttagcgaggcggggtgcggggtattcgtgtaaggcgagggaggttggggagttgtttgttttgggggttcgttttttacggagtttatttacgcgggacgttcgtttt

SEQ ID NO: 37312 - DNA, 787 bp, Artificial Sequence
  chemically treated genomic DNA (Homo sapiens) CpG-island No: 37312
aaaacgaacgtcccgcgtaaataaactccgtaaaaaacgaacccccaaaacaaacaactccccaacctccctcgccttacacgaataccccgcaccccgcctcgctaaacgaaacgaaataacgataacaaaaaaatcaacgcctaaaacgcccgaccgtccaactacgtccgtaatactaaacgtccccaccacctatcccgaaataaaccgtcgcccctcctctcccgcgaaaaccgaacctaaataacgcctaacgaacgaaacgaacccaactacgaaaacgcaatcgccgaaccgcgaacgacgaaacgaacgaaaccgaaaccccgaataacacccgacaaacgaacaaacgaacgccataaaactactctcgacgctaaacctaaacgaactaacgctcaacttctcgcgaataccgctcttccccgtcttcgacctcaattacttcatcgtctccatcctctactctcaaatataaaccaaataaaccgaaacgaaaaactaaaaaaaaccgacaacgaataacgcgaaccgaaacaactcgaaaatcgcaaaaaaaaaaaacccgtacgtaataaaaaaaacgaaaaacaaattcaaaaattacatcgtaaaaataaacaaacgctaaaatcgtaaaattctctcacgccgaaataaacccgaaaaaaaaacccccaaaacgataaaactaaaaaaaaaaaaaaaaaaacgtacgcgaatttaaaaaaaaaaaaacaaatacttaaaatcgaaactcctaattaaatcaaaactacaa

SEQ ID NO: 37313 - DNA, 1223 bp, Artificial Sequence
  chemically treated genomic DNA (Homo sapiens) CpG-island No: 37313
ggttttacgtatcgagcgttgtcgggttgttcgatttgttttcggttcgggttcgagaagcgagaggtagggatggtagcggttttcgaggggaggtgggcgttagacgggtttttcgaagttcggtgggcgaggggtataggagagggggagggtttcgggtttatgcggttttcgttttagttcgcgcggcgggtatttacgttgttttgggggtcgatggtttgtagtagtcggtttttgatttgttgcggagacgtcggagtcgttgttattgtttgggcgaggcggggggttgcggtcgggttagcgggcgggcgggttgaggcgggggacgggggttatttattcgtcggttttcgggagtcggagtcgtatgtttttcgcggcgttcgggggttgggggcgcgcggggtggcggagaggggagtcggggtcgggtttcggtttcgggtcgtcgtcgttattaaaggaggaggaggagtcgtcggagtcgtcgtcgttcgttgtcgtcgtttcgagaattaaattttagtgagttgttttcgcgcggagtattttgggtagttcgcgtcgtacgtagcgtcggcgttacgttgaggaggttgggagatggggcgggcggagacgttaggtttgggcggggttgttcgtgtgttacgtttcgcgttttcgcgtaagcgcgcgtaggcgtattcgttcgttcgtgacgtttcgtttagtcgttcggtttaggtagtcgttgggaggaggttgggcggggtaacggttttcgtttaggttacggggcggggttttttgacggaagcgcgcgcgtaaagagtttttgaattcggacgttcgtagcggttatttcggggcggggagggcggcgggaaaattttttttttgggagagttttttcggcgcgtgattgggggacgggagtcgtaggttgagtagttgtcgagttttttgtgagggcgagggaattagacgtttacgttgtgattttgcgcgtagaagggttatcggagttcgggggtgtcgtcgcggttttttcgttttttagagggtgtgggaatgggtgtggtggtagggcgggggtttgtatcgttacgcgcgatttcgatcgcgaaaacgtgaggcggtaaagcgtttttggtagaagtcgttcgtcgtagttgggaaagtcggaggttgtaaatttgcgtttacgcggcggtttttttatttcggtatta

SEQ ID NO: 37314 - DNA, 1223 bp, Artificial Sequence
  chemically treated genomic DNA (Homo sapiens) CpG-island No: 37314
taataccgaaataaaaaaaccgccgcgtaaacgcaaatttacaacctccgactttcccaactacgacgaacgacttctaccaaaaacgctttaccgcctcacgttttcgcgatcgaaatcgcgcgtaacgatacaaacccccgccctaccaccacacccattcccacaccctctaaaaaacgaaaaaaccgcgacgacacccccgaactccgataacccttctacgcgcaaaatcacaacgtaaacgtctaattccctcgccctcacaaaaaactcgacaactactcaacctacgactcccgtcccccaatcacgcgccgaaaaaactctcccaaaaaaaaaattttcccgccgccctccccgccccgaaataaccgctacgaacgtccgaattcaaaaactctttacgcgcgcgcttccgtcaaaaaaccccgccccgtaacctaaacgaaaaccgttaccccgcccaacctcctcccaacgactacctaaaccgaacgactaaacgaaacgtcacgaacgaacgaatacgcctacgcgcgcttacgcgaaaacgcgaaacgtaacacacgaacaaccccgcccaaacctaacgtctccgcccgccccatctcccaacctcctcaacgtaacgccgacgctacgtacgacgcgaactacccaaaatactccgcgcgaaaacaactcactaaaatttaattctcgaaacgacgacaacgaacgacgacgactccgacgactcctcctcctcctttaataacgacgacgacccgaaaccgaaacccgaccccgactcccctctccgccaccccgcgcgcccccaacccccgaacgccgcgaaaaacatacgactccgactcccgaaaaccgacgaataaataacccccgtcccccgcctcaacccgcccgcccgctaacccgaccgcaaccccccgcctcgcccaaacaataacaacgactccgacgtctccgcaacaaatcaaaaaccgactactacaaaccatcgacccccaaaacaacgtaaatacccgccgcgcgaactaaaacgaaaaccgcataaacccgaaaccctccccctctcctatacccctcgcccaccgaacttcgaaaaacccgtctaacgcccacctcccctcgaaaaccgctaccatccctacctctcgcttctcgaacccgaaccgaaaacaaatcgaacaacccgacaacgctcgatacgtaaaacc

SEQ ID NO: 37315 - DNA, 1223 bp, Artificial Sequence
  chemically treated genomic DNA (Homo sapiens) CpG-island No: 37315
tggtgtcgaggtggagaagtcgtcgcgtagacgtagatttgtaattttcggtttttttagttacggcgggcggtttttgttagaggcgttttgtcgttttacgttttcgcgatcggggtcgcgcgtggcggtgtagattttcgttttgttattatatttatttttatattttttgaggggcgggggggtcgcggcgatattttcggatttcgatgatttttttgcgcgtagaattataacgtggacgtttggttttttcgtttttataaaaaattcggtagttgtttagtttgcgattttcgttttttagttacgcgtcgggaaggtttttttagaggaaggattttttcgtcgtttttttcgtttcgaggtagtcgttgcgagcgttcgggtttaaggattttttgcgcgcgcgttttcgttagaaagtttcgtttcgtgatttggacgggggtcgttgtttcgtttaatttttttttaacggttgtttaggtcgggcggttgggcggggcgttacgggcggacgagtgcgtttgcgcgcgtttgcgcggaggcgcggggcgtggtatacgggtagtttcgtttaggtttggcgttttcgttcgttttattttttaatttttttagcgtggcgtcgacgttgcgtgcggcgcggattatttagagtatttcgcgcgggggtagtttattggagtttggttttcgaggcggcggtagcgagcggcggcggtttcggcggttttttttttttttttggtggcggcggcggttcgggatcgagattcggtttcggttttttttttcgttatttcgcgcgtttttaattttcgggcgtcgcggggaatatgcggtttcggttttcggaggtcggcgagtgagtgattttcgtttttcgttttagttcgttcgttcgttggttcggtcgtaatttttcgtttcgtttaggtaatgatagcggtttcggcgttttcgtagtagattagggatcggttgttgtaggttatcgatttttagagtaacgtaagtattcgtcgcgcgagttgggacggaggtcgtatgggttcgggatttttttttttttttgtatttttcgtttatcgggtttcgggggattcgtttggcgtttattttttttcgagggtcgttgttatttttgtttttcgtttttcgggttcgggtcgggggtaggtcgggtagttcggtagcgttcggtacgtgaggtt

SEQ ID NO: 37316 - DNA, 1223 bp, Artificial Sequence
  chemically treated genomic DNA (Homo sapiens) CpG-island No: 37316
aacctcacgtaccgaacgctaccgaactacccgacctacccccgacccgaacccgaaaaacgaaaaacaaaaataacaacgaccctcgaaaaaaaataaacgccaaacgaatcccccgaaacccgataaacgaaaaatacaaaaaaaaaaaaaaatcccgaacccatacgacctccgtcccaactcgcgcgacgaatacttacgttactctaaaaatcgataacctacaacaaccgatccctaatctactacgaaaacgccgaaaccgctatcattacctaaacgaaacgaaaaattacgaccgaaccaacgaacgaacgaactaaaacgaaaaacgaaaatcactcactcgccgacctccgaaaaccgaaaccgcatattccccgcgacgcccgaaaattaaaaacgcgcgaaataacgaaaaaaaaaaccgaaaccgaatctcgatcccgaaccgccgccgccaccaaaaaaaaaaaaaaaaccgccgaaaccgccgccgctcgctaccgccgcctcgaaaaccaaactccaataaactacccccgcgcgaaatactctaaataatccgcgccgcacgcaacgtcgacgccacgctaaaaaaattaaaaaataaaacgaacgaaaacgccaaacctaaacgaaactacccgtataccacgccccgcgcctccgcgcaaacgcgcgcaaacgcactcgtccgcccgtaacgccccgcccaaccgcccgacctaaacaaccgttaaaaaaaaattaaacgaaacaacgacccccgtccaaatcacgaaacgaaactttctaacgaaaacgcgcgcgcaaaaaatccttaaacccgaacgctcgcaacgactacctcgaaacgaaaaaaacgacgaaaaaatccttcctctaaaaaaaccttcccgacgcgtaactaaaaaacgaaaatcgcaaactaaacaactaccgaattttttataaaaacgaaaaaaccaaacgtccacgttataattctacgcgcaaaaaaatcatcgaaatccgaaaatatcgccgcgacccccccgcccctcaaaaaatataaaaataaatataataacaaaacgaaaatctacaccgccacgcgcgaccccgatcgcgaaaacgtaaaacgacaaaacgcctctaacaaaaaccgcccgccgtaactaaaaaaaccgaaaattacaaatctacgtctacgcgacgacttctccacctcgacacca

SEQ ID NO: 37317 - DNA, 743 bp, Artificial Sequence
  chemically treated genomic DNA (Homo sapiens) CpG-island No: 37317
cgcgcgtttcggattattcgttgttttttttcgttcgttgtttttttttttcgcgttttacggggtttcgtattgattttaggcgttttcgggggcgtcgcgtcgcgatcggttcggggcggggtttcgtgtagggcgtttcggattggttgtggggagagggggcggggtcggtcgcggagaaaatagtcgggcgcgcgcgagtgtagtttgggtttggagtttgagttttgcggaatttcggcgttcggttttatttcgttcgtatttgtatttatttattgttgttattttttatcgcgggagtttcgtagtcgggttttttcgttcgttttcgcgtagcgttagtattttttagttttttagttttttttcgcggtgcgtcgtagtcgaggcgatgcgttttatttagaatatgtgtattatcgtcgagtatttcgcgtcggtaacgtcgcggttttcgattgttgtgtgggcgtcgcggcgtcgtttggttaagatcgtcgtggtggggttagcggcgtgggtaagatcggtgagtcgtcgcgtttagttttgggtttggttttggacgatttttgacgggagttgaggttgaataaggcgtggggagcggtgggagttgtagttcgatcgtttttcgttttcgcgtagggagtcgttgttttttgggagtgggtttagtcgttgtttacgttattcgtttgtttttatagacgggggaaataaggattaagaatggt

SEQ ID NO: 37318 - DNA, 743 bp, Artificial Sequence
  chemically treated genomic DNA (Homo sapiens) CpG-island No: 37318
accattcttaatccttatttcccccgtctataaaaacaaacgaataacgtaaacaacgactaaacccactcccaaaaaacaacgactccctacgcgaaaacgaaaaacgatcgaactacaactcccaccgctccccacgccttattcaacctcaactcccgtcaaaaatcgtccaaaaccaaacccaaaactaaacgcgacgactcaccgatcttacccacgccgctaaccccaccacgacgatcttaaccaaacgacgccgcgacgcccacacaacaatcgaaaaccgcgacgttaccgacgcgaaatactcgacgataatacacatattctaaataaaacgcatcgcctcgactacgacgcaccgcgaaaaaaaactaaaaaactaaaaaatactaacgctacgcgaaaacgaacgaaaaaacccgactacgaaactcccgcgataaaaaataacaacaataaataaatacaaatacgaacgaaataaaaccgaacgccgaaattccgcaaaactcaaactccaaacccaaactacactcgcgcgcgcccgactattttctccgcgaccgaccccgccccctctccccacaaccaatccgaaacgccctacacgaaaccccgccccgaaccgatcgcgacgcgacgcccccgaaaacgcctaaaatcaatacgaaaccccgtaaaacgcgaaaaaaaaaaacaacgaacgaaaaaaaacaacgaataatccgaaacgcgcg

SEQ ID NO: 37319 - DNA, 743 bp, Artificial Sequence
  chemically treated genomic DNA (Homo sapiens) CpG-island No: 37319
gttatttttgatttttgtttttttcgtttgtggaagtaggcgggtggcgtagataacggttaagtttatttttaaggggtagcggttttttgcgcggggacggagagcggtcgggttgtagtttttatcgttttttacgttttgtttagttttaattttcgttaggggtcgtttaagattagatttagggttaagcgcgacgatttatcggttttgtttacgtcgttggttttattacggcgattttgattaggcggcgtcgcggcgtttatatagtagtcggaggtcgcggcgttgtcggcgcggggtattcggcgatggtgtatatgttttgaatgaggcgtatcgtttcggttgcggcgtatcgcgggaagggattgagggattggagaatgttagcgttgcgcgggagcgggcgggaggattcgattgcggggttttcgcggtaagaaataataataataaataagtgtaggtacgggcggggtggggtcgagcgtcgaggtttcgtagggtttaggttttagatttagattgtattcgcgcgcgttcggttgtttttttcgcggtcggtttcgttttttttttttatagttaattcggggcgttttatacgaggtttcgtttcggatcggtcgcggcgcgacgttttcggaggcgtttggagttagtgcggagtttcgtgaggcgcggggagaagaggtagcgggcggaggggagtagcgggtggttcgaggcgcgcg

SEQ ID NO: 37320 - DNA, 743 bp, Artificial Sequence
  chemically treated genomic DNA (Homo sapiens) CpG-island No: 37320
cgcgcgcctcgaaccacccgctactcccctccgcccgctacctcttctccccgcgcctcacgaaactccgcactaactccaaacgcctccgaaaacgtcgcgccgcgaccgatccgaaacgaaacctcgtataaaacgccccgaattaactataaaaaaaaaaaacgaaaccgaccgcgaaaaaaacaaccgaacgcgcgcgaatacaatctaaatctaaaacctaaaccctacgaaacctcgacgctcgaccccaccccgcccgtacctacacttatttattattattatttcttaccgcgaaaaccccgcaatcgaatcctcccgcccgctcccgcgcaacgctaacattctccaatccctcaatcccttcccgcgatacgccgcaaccgaaacgatacgcctcattcaaaacatatacaccatcgccgaataccccgcgccgacaacgccgcgacctccgactactatataaacgccgcgacgccgcctaatcaaaatcgccgtaataaaaccaacgacgtaaacaaaaccgataaatcgtcgcgcttaaccctaaatctaatcttaaacgacccctaacgaaaattaaaactaaacaaaacgtaaaaaacgataaaaactacaacccgaccgctctccgtccccgcgcaaaaaaccgctaccccttaaaaataaacttaaccgttatctacgccacccgcctacttccacaaacgaaaaaaacaaaaatcaaaaataac

SEQ ID NO: 37321 - DNA, 500 bp, Artificial Sequence
  chemically treated genomic DNA (Homo sapiens) CpG-island No: 37321
agcggaataagttagatgacgttatttcgttcgttaaagtatattacgtggttttcgtagtacgtgattcgtgttttcgtcgtaggtaaaagaatgacgtacgttagttttagatcgtgcgttttatatttttttcggtaacgaagttcgttgtttgggtttaaatttttttagagtgtggtatcgtcggtgttggaagttatttgtttttagagtcggtttaacgtagtcgtacggggtcgttgtaggtcgaggttttcgatttttttaagtcgcgtatggttattggttgttgaggtgtttattcgacgtatttaatttttcgttttcgttttttatgtttgacgtatgcgtagtggtttcgtcggcgaggtttcgcgaatttaggagaatgtgcgcgcgtagggtggcgttgagggaagttttgagttttttatggggtttcgaattttatttcgggcgtgtgttttttcgggatttttattttgtttatttttttt

SEQ ID NO: 37322 - DNA, 500 bp, Artificial Sequence
  chemically treated genomic DNA (Homo sapiens) CpG-island No: 37322
aaaaaaaataaacaaaataaaaatcccgaaaaaacacacgcccgaaataaaattcgaaaccccataaaaaactcaaaacttccctcaacgccaccctacgcgcgcacattctcctaaattcgcgaaacctcgccgacgaaaccactacgcatacgtcaaacataaaaaacgaaaacgaaaaattaaatacgtcgaataaacacctcaacaaccaataaccatacgcgacttaaaaaaatcgaaaacctcgacctacaacgaccccgtacgactacgttaaaccgactctaaaaacaaataacttccaacaccgacgataccacactctaaaaaaatttaaacccaaacaacgaacttcgttaccgaaaaaaatataaaacgcacgatctaaaactaacgtacgtcattcttttacctacgacgaaaacacgaatcacgtactacgaaaaccacgtaatatactttaacgaacgaaataacgtcatctaacttattccgct

SEQ ID NO: 37323 - DNA, 500 bp, Artificial Sequence
  chemically treated genomic DNA (Homo sapiens) CpG-island No: 37323
gggaaaaataaataaaatgggggtttcggaggggtatacgttcgggatagggttcgaagttttatggagaatttaaagttttttttaacgttattttgcgcgcgtatatttttttgggttcgcgggatttcgtcggcgaggttattgcgtatgcgttaggtatggagagcggaagcggaaggttgaatgcgtcgggtgggtattttagtaattagtagttatgcgcggtttggaggagtcgggggtttcggtttatagcgatttcgtgcggttgcgttaagtcggttttggagataggtaatttttaatatcggcggtgttatattttggagaggtttaggtttaggtagcggatttcgttgtcgagaggggtgtaaaacgtacgatttggaattgacgtgcgttatttttttatttacggcgaaggtacgggttacgtgttgcggagattacgtgatgtgttttggcgagcgggatgacgttatttggtttgtttcgtt

SEQ ID NO: 37324 - DNA, 500 bp, Artificial Sequence
  chemically treated genomic DNA (Homo sapiens) CpG-island No: 37324
aacgaaacaaaccaaataacgtcatcccgctcgccaaaacacatcacgtaatctccgcaacacgtaacccgtaccttcgccgtaaataaaaaaataacgcacgtcaattccaaatcgtacgttttacacccctctcgacaacgaaatccgctacctaaacctaaacctctccaaaatataacaccgccgatattaaaaattacctatctccaaaaccgacttaacgcaaccgcacgaaatcgctataaaccgaaacccccgactcctccaaaccgcgcataactactaattactaaaatacccacccgacgcattcaaccttccgcttccgctctccatacctaacgcatacgcaataacctcgccgacgaaatcccgcgaacccaaaaaaatatacgcgcgcaaaataacgttaaaaaaaactttaaattctccataaaacttcgaaccctatcccgaacgtatacccctccgaaacccccattttatttatttttccc

SEQ ID NO: 37325 - DNA, 588 bp, Artificial Sequence
  chemically treated genomic DNA (Homo sapiens) CpG-island No: 37325
tcgagttcgggcgttgaggtttttcgagtcggtttttgaatttttcgggttttagtcgatcggggtgcggagggggtcgattcgggggatttttaagcgtttttttcgttttgacgttgtggggtttttatcgcgtcgttatagttgtttttatttggggaggtgcgttcgggtttcggggggcgggtagtcggggggcgggtagggaatcggtgtcgttttacgtttcgtggtttttttaaggaggggaagtcggcggagggaggagtcggttcggtgtgtgtaggggagcgtttcgttagcggttcgtagggttggagatttacgtcgtggagaggattagttttaggtcgtttcgtttgggttcgcgtttcgatttcgttgttttcgtttcgtttttttgttcgtggcgtttacggttattttggtttcgggggtagggtatgggcggttttcgttagatcgtttagcgttagtattaattgttttcgttttggttttcgagttcgaagttttttttgcgcgtataatttaggtagtaattttaaattagcgggtattatagattagttgtagttattttaattt

SEQ ID NO: 37326 - DNA, 588 bp, Artificial Sequence
  chemically treated genomic DNA (Homo sapiens) CpG-island No: 37326
aaattaaaataactacaactaatctataatacccgctaatttaaaattactacctaaattatacgcgcaaaaaaaacttcgaactcgaaaaccaaaacgaaaacaattaatactaacgctaaacgatctaacgaaaaccgcccataccctacccccgaaaccaaaataaccgtaaacgccacgaacaaaaaaacgaaacgaaaacaacgaaatcgaaacgcgaacccaaacgaaacgacctaaaactaatcctctccacgacgtaaatctccaaccctacgaaccgctaacgaaacgctcccctacacacaccgaaccgactcctccctccgccgacttcccctccttaaaaaaaccacgaaacgtaaaacgacaccgattccctacccgccccccgactacccgccccccgaaacccgaacgcacctccccaaataaaaacaactataacgacgcgataaaaaccccacaacgtcaaaacgaaaaaaacgcttaaaaatcccccgaatcgaccccctccgcaccccgatcgactaaaacccgaaaaattcaaaaaccgactcgaaaaacctcaacgcccgaactcga

SEQ ID NO: 37327 - DNA, 588 bp, Artificial Sequence
  chemically treated genomic DNA (Homo sapiens) CpG-island No: 37327
gggttggggtggttgtagttggtttgtggtgttcgttagtttaggattattgtttaggttgtgcgcgtagaagaggtttcgggttcgaaggttagagcgagggtagttagtattggcgttgggcgatttggcgggggtcgtttatgttttgttttcgaggttaaggtggtcgtaagcgttacgggtagagaggcgaggcgggggtagcgaggtcggggcgcgggtttaggcggggcgatttgaggttggttttttttacggcgtgggtttttagttttgcggatcgttggcgaggcgtttttttgtatatatcggatcggttttttttttcgtcggttttttttttttaaaggggttacgaagcgtggggcggtatcggttttttgttcgtttttcgattgttcgtttttcggggttcgggcgtatttttttaggtaggagtagttgtggcggcgcggtaggagttttatagcgttagggcggggagggcgtttggagatttttcgggtcggtttttttcgtatttcgatcgattgaggttcggagagtttaggaatcggttcgggagattttagcgttcgaattcgg

SEQ ID NO: 37328 - DNA, 588 bp, Artificial Sequence
  chemically treated genomic DNA (Homo sapiens) CpG-island No: 37328
ccgaattcgaacgctaaaatctcccgaaccgattcctaaactctccgaacctcaatcgatcgaaatacgaaaaaaaccgacccgaaaaatctccaaacgccctccccgccctaacgctataaaactcctaccgcgccgccacaactactcctacctaaaaaaatacgcccgaaccccgaaaaacgaacaatcgaaaaacgaacaaaaaaccgataccgccccacgcttcgtaacccctttaaaaaaaaaaaaccgacgaaaaaaaaaaccgatccgatatatacaaaaaaacgcctcgccaacgatccgcaaaactaaaaacccacgccgtaaaaaaaaccaacctcaaatcgccccgcctaaacccgcgccccgacctcgctacccccgcctcgcctctctacccgtaacgcttacgaccaccttaacctcgaaaacaaaacataaacgacccccgccaaatcgcccaacgccaatactaactaccctcgctctaaccttcgaacccgaaacctcttctacgcgcacaacctaaacaataatcctaaactaacgaacaccacaaaccaactacaaccaccccaaccc

SEQ ID NO: 37329 - DNA, 1711 bp, Artificial Sequence
  chemically treated genomic DNA (Homo sapiens) CpG-island No: 37329
tttcgatcgttcggtattagcgcgtaagggattttttagtcggagattagagtttagtttcggttacgaggttatcgtcgttgttcgtttcgagaagtattacgcgggttgagtcgtcggttagcgggttattttcgagtttttgtttgtatcgcgttagttttagattacggacgttgagtttttagcgcgtgttagtttgggtcgttgggttttcggggttagttcgcgacgattttttgagtttttcgtagaagggtcgagcgttcgtttcggggacgttaggttcgttttcgtttttcgatagtcgcggggatttagagttcgggggtgcgggacgttcgcgttatgattgtcgagagcgggtcgtcgtcgtcgtagtcggaggtgttggttatcgtgaaggaagagcgcggcgagacggtagtaggggtcggggttttaggggaggttacgggtcgcggggcgggcgggcggcgtcgtaagcgttttttgtagcgcgggaagtcgttttatagttatatcgcgtttatcgttatggttatcgcgtacgcgttcgagcgtcgttttacgttgggcggtatttataagtttattatcgagcgtttttttttttatcgcgataattttaaaaagtggtagaatagtattcgttataattttatatttaacgattgtttttttaagatttcgcgcgaggtcggtcgttcgggtaagggtaattattgggcgtttgattttaacgcggaggatatgttcgagagcggtagttttttgcgtcgtcgtaagcgttttaagcgttcggatttttttatttattcggtttatatgtacgacgcggcggttgtcgtagtcgtcgtcgtcgtcgtcgtcgtcgtcgtcgttatttttttaggcgcggtgttcgtcgcgcgttttttttattcgggcgtcgtttatgtaggttacgcgtcgtcgtcgttggtcgcgtcgtttttagtttattatttcgcggcgtcgttcggtttttgtcgcgttttcggtttggtttttgagcggtcgtttagtttagagttggggttcgtatcgtcggggttcggcggtttttgcgtttttgttttcgtcggcgttttcgttattattatcggttattagttcgtaggttgtatcggggttcggtcggttaattttttcgtttatgcggttgtttacgcgggtttcgacggcgcgtattcgtagggcgtcggtagtgcgatttttgtcgttgttggtcgtttggcgggattcgtttcgtttttagcgggcggtagtagtggcggcgtggagattacggtggatttttacgggcgtacgtcgttcggttagttcggagcgttgggagtttgttataattttggcgggtagttcggaggggttagtgtaggcgtttattatgttcgttatgttgtcgtttatttcggtgggatagatcggttcgtgttcgttatgtgagttagcgtagggacgaaaatttatagatatatcggttgtttatacgtttttcgtaatttgagaacgaataggaatggagagaggatttaattgggatttacgtggaaaagatcgagtaggttatagaggttcggttttttcgcgtatagcgtaggtattcggtgtattttgtaaacgggaggaggtggggcgaggtagttagagtttttggattggtatagggattttcgatggagcgaag

SEQ ID NO: 37330 - DNA, 1711 bp, Artificial Sequence
  chemically treated genomic DNA (Homo sapiens) CpG-island No: 37330
cttcgctccatcgaaaatccctataccaatccaaaaactctaactacctcgccccacctcctcccgtttacaaaatacaccgaatacctacgctatacgcgaaaaaaccgaacctctataacctactcgatcttttccacgtaaatcccaattaaatcctctctccattcctattcgttctcaaattacgaaaaacgtataaacaaccgatatatctataaattttcgtccctacgctaactcacataacgaacacgaaccgatctatcccaccgaaataaacgacaacataacgaacataataaacgcctacactaacccctccgaactacccgccaaaattataacaaactcccaacgctccgaactaaccgaacgacgtacgcccgtaaaaatccaccgtaatctccacgccgccactactaccgcccgctaaaaacgaaacgaatcccgccaaacgaccaacaacgacaaaaatcgcactaccgacgccctacgaatacgcgccgtcgaaacccgcgtaaacaaccgcataaacgaaaaaattaaccgaccgaaccccgatacaacctacgaactaataaccgataataataacgaaaacgccgacgaaaacaaaaacgcaaaaaccgccgaaccccgacgatacgaaccccaactctaaactaaacgaccgctcaaaaaccaaaccgaaaacgcgacaaaaaccgaacgacgccgcgaaataataaactaaaaacgacgcgaccaacgacgacgacgcgtaacctacataaacgacgcccgaataaaaaaaacgcgcgacgaacaccgcgcctaaaaaaataacgacgacgacgacgacgacgacgacgacgactacgacaaccgccgcgtcgtacatataaaccgaataaataaaaaaatccgaacgcttaaaacgcttacgacgacgcaaaaaactaccgctctcgaacatatcctccgcgttaaaatcaaacgcccaataattacccttacccgaacgaccgacctcgcgcgaaatcttaaaaaaacaatcgttaaatataaaattataacgaatactattctaccactttttaaaattatcgcgataaaaaaaaaaacgctcgataataaacttataaataccgcccaacgtaaaacgacgctcgaacgcgtacgcgataaccataacgataaacgcgatataactataaaacgacttcccgcgctacaaaaaacgcttacgacgccgcccgcccgccccgcgacccgtaacctcccctaaaaccccgacccctactaccgtctcgccgcgctcttccttcacgataaccaacacctccgactacgacgacgacgacccgctctcgacaatcataacgcgaacgtcccgcacccccgaactctaaatccccgcgactatcgaaaaacgaaaacgaacctaacgtccccgaaacgaacgctcgacccttctacgaaaaactcaaaaaatcgtcgcgaactaaccccgaaaacccaacgacccaaactaacacgcgctaaaaactcaacgtccgtaatctaaaactaacgcgatacaaacaaaaactcgaaaataacccgctaaccgacgactcaacccgcgtaatacttctcgaaacgaacaacgacgataacctcgtaaccgaaactaaactctaatctccgactaaaaaatcccttacgcgctaataccgaacgatcgaaa

SEQ ID NO: 37331 - DNA, 1711 bp, Artificial Sequence
  chemically treated genomic DNA (Homo sapiens) CpG-island No: 37331
tttcgttttatcgagggtttttgtgttagtttaagggttttggttgtttcgttttattttttttcgtttatagagtatatcgggtgtttacgttgtgcgcggggagatcgagtttttgtggtttgttcggttttttttacgtgggttttagttgagttttttttttatttttgttcgtttttagattgcggggaacgtgtgaatagtcgatgtgtttatgagttttcgtttttacgttggtttatatggcggatacgaatcgatttattttatcgggataagcggtagtatggcgagtatggtaggcgtttgtattggttttttcgagttgttcgttagggttgtagtaggtttttagcgtttcgaattggtcgggcgacgtgcgttcgtagaagtttatcgtggtttttacgtcgttattgttgtcgttcgttgggggcgaagcgggtttcgttaggcggttagtagcggtaaagatcgtattgtcggcgttttgcgggtacgcgtcgtcggggttcgcgtaggtagtcgtataggcggaggggttggtcggtcgggtttcggtgtagtttgcgggttggtagtcggtggtggtagcgggggcgtcggcggaggtaaaggcgtaagagtcgtcgggtttcgacggtgcgggttttagttttgggttgagcggtcgtttaggaattaggtcgaagacgcggtaagggtcgggcgacgtcgcggggtagtagattggaggcggcgcggttagcgacggcggcgcgtagtttgtatagacggcgttcgggtagggggggcgcgcggcgggtatcgcgtttgggaagatggcggcggcggcggcggcggcggcggcggcggttgcggtagtcgtcgcgtcgtgtatgtaagtcgggtaggtggagaggttcgagcgtttgaagcgtttgcggcggcgtaggaagttgtcgttttcgaatatgtttttcgcgttggggttaagcgtttagtagttgtttttattcgggcggtcggtttcgcgcgggattttgaggaagtagtcgttgagtgtgaggttgtggcggatgttgttttgttattttttggggttgtcgcggtagaaggggaagcgttcggtgatgaatttgtagatgtcgtttagcgtgaggcggcgttcgggcgcgtgcgcgatggttatggcgatgagcgcgatgtagttgtagggcggtttttcgcgttgtagggggcgtttgcggcgtcgttcgttcgtttcgcggttcgtggttttttttgggatttcggtttttgttgtcgtttcgtcgcgttttttttttacggtagttagtattttcggttgcggcggcggcggttcgttttcggtagttatggcgcgggcgtttcgtattttcgggttttggattttcgcggttgtcggggggcgggggcgggtttggcgttttcggaacggacgttcggtttttttgcggagagtttaggggatcgtcgcgggttggtttcgagagtttagcggtttaggttggtacgcgttggaggtttagcgttcgtggtttggggttggcgcggtgtagatagaggttcgggagtgattcgttagtcgacggtttagttcgcgtggtgtttttcgaggcgggtagcggcggtggtttcgtgatcgggattggattttggttttcggttgaagggttttttgcgcgttggtgtcgggcggtcgagg

SEQ ID NO: 37332 - DNA, 1711 bp, Artificial Sequence
  chemically treated genomic DNA (Homo sapiens) CpG-island No: 37332
cctcgaccgcccgacaccaacgcgcaaaaaacccttcaaccgaaaaccaaaatccaatcccgatcacgaaaccaccgccgctacccgcctcgaaaaacaccacgcgaactaaaccgtcgactaacgaatcactcccgaacctctatctacaccgcgccaaccccaaaccacgaacgctaaacctccaacgcgtaccaacctaaaccgctaaactctcgaaaccaacccgcgacgatcccctaaactctccgcaaaaaaaccgaacgtccgttccgaaaacgccaaacccgcccccgccccccgacaaccgcgaaaatccaaaacccgaaaatacgaaacgcccgcgccataactaccgaaaacgaaccgccgccgccgcaaccgaaaatactaactaccgtaaaaaaaaaacgcgacgaaacgacaacaaaaaccgaaatcccaaaaaaaaccacgaaccgcgaaacgaacgaacgacgccgcaaacgccccctacaacgcgaaaaaccgccctacaactacatcgcgctcatcgccataaccatcgcgcacgcgcccgaacgccgcctcacgctaaacgacatctacaaattcatcaccgaacgcttccccttctaccgcgacaaccccaaaaaataacaaaacaacatccgccacaacctcacactcaacgactacttcctcaaaatcccgcgcgaaaccgaccgcccgaataaaaacaactactaaacgcttaaccccaacgcgaaaaacatattcgaaaacgacaacttcctacgccgccgcaaacgcttcaaacgctcgaacctctccacctacccgacttacatacacgacgcgacgactaccgcaaccgccgccgccgccgccgccgccgccgccgccatcttcccaaacgcgatacccgccgcgcgccccccctacccgaacgccgtctatacaaactacgcgccgccgtcgctaaccgcgccgcctccaatctactaccccgcgacgtcgcccgacccttaccgcgtcttcgacctaattcctaaacgaccgctcaacccaaaactaaaacccgcaccgtcgaaacccgacgactcttacgcctttacctccgccgacgcccccgctaccaccaccgactaccaacccgcaaactacaccgaaacccgaccgaccaacccctccgcctatacgactacctacgcgaaccccgacgacgcgtacccgcaaaacgccgacaatacgatctttaccgctactaaccgcctaacgaaacccgcttcgcccccaacgaacgacaacaataacgacgtaaaaaccacgataaacttctacgaacgcacgtcgcccgaccaattcgaaacgctaaaaacctactacaaccctaacgaacaactcgaaaaaaccaatacaaacgcctaccatactcgccatactaccgcttatcccgataaaataaatcgattcgtatccgccatataaaccaacgtaaaaacgaaaactcataaacacatcgactattcacacgttccccgcaatctaaaaacgaacaaaaataaaaaaaaaactcaactaaaacccacgtaaaaaaaaccgaacaaaccacaaaaactcgatctccccgcgcacaacgtaaacacccgatatactctataaacgaaaaaaaataaaacgaaacaaccaaaacccttaaactaacacaaaaaccctcgataaaacgaaa

SEQ ID NO: 37333 - DNA, 624 bp, Artificial Sequence
  chemically treated genomic DNA (Homo sapiens) CpG-island No: 37333
cgtagggatcgggggttagtagtggtcgtaaatacgggtttcggcgtgttcggtcgtattcggtagttcgtatggttgtttagcggttagtatcgtatgtttgcgagtttaattcgcgtttagagggtatataatggggtgtaggttaacgcggggagtcggttaggttttcgcgcggcgtttattttggatattggtagtgggttacgtggtgttgcgtgcgtacggaggttagggcggttcggttattgagtgcgtaggcgtcgtgggtttcgttttgtttcgcggcgggaacgcggtcgtgagggtgtggggtgtaggttcgttaggtttgtaacggttgtcgagggtcgtgggatgcgttcgtcgcgtttttgtttaggcggagggagttcgttcgtcgttagggtttcgagttcgggtttaggtaggcgtggaggtggcgggaacggcgtattcgtcgggtgggcgttgttttaaggtcgtagggtttgggaggtttgtgttgagttaaaggtcggttcgtagattttcggaagcgtttttggttgttagtaggtgtcggcgagggtttttagtggttatttttttggtggtgatgttttcgtttttttttaataggag

SEQ ID NO: 37334 - DNA, 624 bp, Artificial Sequence
  chemically treated genomic DNA (Homo sapiens) CpG-island No: 37334
ctcctattaaaaaaaaacgaaaacatcaccaccaaaaaaataaccactaaaaaccctcgccgacacctactaacaaccaaaaacgcttccgaaaatctacgaaccgacctttaactcaacacaaacctcccaaaccctacgaccttaaaacaacgcccacccgacgaatacgccgttcccgccacctccacgcctacctaaacccgaactcgaaaccctaacgacgaacgaactccctccgcctaaacaaaaacgcgacgaacgcatcccacgaccctcgacaaccgttacaaacctaacgaacctacaccccacaccctcacgaccgcgttcccgccgcgaaacaaaacgaaacccacgacgcctacgcactcaataaccgaaccgccctaacctccgtacgcacgcaacaccacgtaacccactaccaatatccaaaataaacgccgcgcgaaaacctaaccgactccccgcgttaacctacaccccattatataccctctaaacgcgaattaaactcgcaaacatacgatactaaccgctaaacaaccatacgaactaccgaatacgaccgaacacgccgaaacccgtatttacgaccactactaacccccgatccctacg

SEQ ID NO: 37335 - DNA, 624 bp, Artificial Sequence
  chemically treated genomic DNA (Homo sapiens) CpG-island No: 37335
tttttgttggaaagaaacggaaatattattattaggagggtggttattgaagattttcgtcgatatttgttggtaattaaaggcgttttcggggatttacgggtcgatttttaatttaatataagttttttaagttttgcggttttaaaataacgtttattcggcgggtgcgtcgttttcgttatttttacgtttgtttggattcggattcgagattttggcggcgggcgggtttttttcgtttgagtagggacgcggcgagcgtattttacgattttcggtagtcgttgtaggtttggcggatttatattttatatttttacggtcgcgttttcgtcgcggggtagggcgaggtttacggcgtttgcgtatttagtgatcgggtcgttttggttttcgtgcgtacgtagtattacgtgatttattgttagtatttaagatggacgtcgcgcggaggtttggtcggtttttcgcgttagtttgtattttattgtatgttttttaagcgcgaattaggttcgtagatatgcggtgttgatcgttaggtagttatgcgggttatcgagtgcgatcggatacgtcggggttcgtgtttacggttattattggttttcggtttttgcg

SEQ ID NO: 37336 - DNA, 624 bp, Artificial Sequence
  chemically treated genomic DNA (Homo sapiens) CpG-island No: 37336
cgcaaaaaccgaaaaccaataataaccgtaaacacgaaccccgacgtatccgatcgcactcgataacccgcataactacctaacgatcaacaccgcatatctacgaacctaattcgcgcttaaaaaacatacaataaaatacaaactaacgcgaaaaaccgaccaaacctccgcgcgacgtccatcttaaatactaacaataaatcacgtaatactacgtacgcacgaaaaccaaaacgacccgatcactaaatacgcaaacgccgtaaacctcgccctaccccgcgacgaaaacgcgaccgtaaaaatataaaatataaatccgccaaacctacaacgactaccgaaaatcgtaaaatacgctcgccgcgtccctactcaaacgaaaaaaacccgcccgccgccaaaatctcgaatccgaatccaaacaaacgtaaaaataacgaaaacgacgcacccgccgaataaacgttattttaaaaccgcaaaacttaaaaaacttatattaaattaaaaatcgacccgtaaatccccgaaaacgcctttaattaccaacaaatatcgacgaaaatcttcaataaccaccctcctaataataatatttccgtttctttccaacaaaaa

SEQ ID NO: 37337 - DNA, 521 bp, Artificial Sequence
  chemically treated genomic DNA (Homo sapiens) CpG-island No: 37337
  misc_feature (28)..(31): n is either a, c, g or t
  misc_feature (49)..(50): n is either a, c, g or t
  misc_feature (363)..(364): n is either a, c, g or t
ttgcgtttattgtcgtcgtttaggtcgnnnnttagcgtgttgtgtgcgnntatggcgaagtgttcgttagcgcggtagtatgtttcgggcgcgcgtaggaaggtttcgagcgaggcgttgggtacgcgtcggaaggtcgggtagtattggttgtagtagttgaagagcgattcgaatatggcggtcggttcgcgtaggatggtgatatagacggtgttgggcggtatgaggcgttttagtttcgtacggtcgaagcgtaggtggttggttagtacgtgcggcggtcgcgtggtcgggtgtacgaagtgcgtcgagaagttgcgggggtagtagaattggtgttcgtagttcgggtgcggtagnnttatcgttaggttgtggcgttcggtaaagcgaaataggatgttttgtatcgtcgtgtttgtcgttttgtgagtttttaggaaggttatagttatgtgtttggggcgcggcggcgagtttcgtagaggagggtagtttaaggggaatagtttggggta

SEQ ID NO: 37338 - DNA, 521 bp, Artificial Sequence
  chemically treated genomic DNA (Homo sapiens) CpG-island No: 37338
  misc_feature (158)..(159): n is either a, c, g or t
  misc_feature (472)..(473): n is either a, c, g or t
  misc_feature (491)..(494): n is either a, c, g or t
taccccaaactattccccttaaactaccctcctctacgaaactcgccgccgcgccccaaacacataactataaccttcctaaaaactcacaaaacgacaaacacgacgatacaaaacatcctatttcgctttaccgaacgccacaacctaacgataannctaccgcacccgaactacgaacaccaattctactacccccgcaacttctcgacgcacttcgtacacccgaccacgcgaccgccgcacgtactaaccaaccacctacgcttcgaccgtacgaaactaaaacgcctcataccgcccaacaccgtctatatcaccatcctacgcgaaccgaccgccatattcgaatcgctcttcaactactacaaccaatactacccgaccttccgacgcgtacccaacgcctcgctcgaaaccttcctacgcgcgcccgaaacatactaccgcgctaacgaacacttcgccatanncgcacacaacacgctaannnncgacctaaacgacgacaataaacgcaa

SEQ ID NO: 37339 - DNA, 521 bp, Artificial Sequence
  chemically treated genomic DNA (Homo sapiens) CpG-island No: 37339
  misc_feature (158)..(159): n is either a, c, g or t
  misc_feature (472)..(473): n is either a, c, g or t
  misc_feature (491)..(494): n is either a, c, g or t
tattttaagttgttttttttgagttgtttttttttgcggaattcgtcgtcgcgttttaagtatatgattgtggtttttttgaagatttataagacggtaggtacgacggtgtagaatattttgtttcgttttgtcgagcgttataatttgacggtggnnttgtcgtattcgagttgcgagtattagttttgttattttcgtaatttttcggcgtatttcgtgtattcggttacgcggtcgtcgtacgtgttggttagttatttgcgtttcgatcgtgcggagttggagcgttttatgtcgtttagtatcgtttatgttattattttgcgcgagtcggtcgttatgttcgagtcgttttttagttattataattagtattgttcggtttttcggcgcgtgtttaacgtttcgttcgaggtttttttgcgcgcgttcgaggtatattatcgcgttggcgagtatttcgttatgnncgtatataatacgttggnnnncgatttgggcggcgataatgagcgtag

SEQ ID NO: 37340 - DNA, 521 bp, Artificial Sequence
  chemically treated genomic DNA (Homo sapiens) CpG-island No: 37340
  misc_feature (28)..(31): n is either a, c, g or t
  misc_feature (49)..(50): n is either a, c, g or t
  misc_feature (363)..(364): n is either a, c, g or t
ctacgctcattatcgccgcccaaatcgnnnnccaacgtattatatacgnncataacgaaatactcgccaacgcgataatatacctcgaacgcgcgcaaaaaaacctcgaacgaaacgttaaacacgcgccgaaaaaccgaacaatactaattataataactaaaaaacgactcgaacataacgaccgactcgcgcaaaataataacataaacgatactaaacgacataaaacgctccaactccgcacgatcgaaacgcaaataactaaccaacacgtacgacgaccgcgtaaccgaatacacgaaatacgccgaaaaattacgaaaataacaaaactaatactcgcaactcgaatacgacaannccaccgtcaaattataacgctcgacaaaacgaaacaaaatattctacaccgtcgtacctaccgtcttataaatcttcaaaaaaaccacaatcatatacttaaaacgcgacgacgaattccgcaaaaaaaaacaactcaaaaaaaacaacttaaaata

SEQ ID NO: 37341 - DNA, 528 bp, Artificial Sequence
  chemically treated genomic DNA (Homo sapiens) CpG-island No: 37341
tggtaggtcgcgttgtttttatatatagcgtatagtttttcgttggagggggagtttcgcgacggcggtgagggtatttgcgtgtcgagtagttgagacgcgtggtcgatttgtaggttcgggaagtttatggacgcgggtttgcgaatggggttgggtatagcgaaggtttgttcgtttattacgtggtggttgtcggcgggtttcgggtttatggggacgtgtaggggttcgtcgaagcgtatttggtaattagatatcggggtgttagggggcgattgtttaaaggagaagagggagaggcgggagattggcgtttttttttgttcgattatgtgcgtagtggttacgtagttttggtggaagttgtggagagatttcgggtcgttttatatggggttgtgttgtatttggaagttcggggtggtgggcgtcgggggcgaggagggtttgtagtaaatcgattcggagtgcggtattatttttttagattgggggggtaggtggttgtgttgttggtagttgtgt

SEQ ID NO: 37342 - DNA, 528 bp, Artificial Sequence
  chemically treated genomic DNA (Homo sapiens) CpG-island No: 37342
acacaactaccaacaacacaaccacctacccccccaatctaaaaaaataataccgcactccgaatcgatttactacaaaccctcctcgcccccgacgcccaccaccccgaacttccaaatacaacacaaccccatataaaacgacccgaaatctctccacaacttccaccaaaactacgtaaccactacgcacataatcgaacaaaaaaaaacgccaatctcccgcctctccctcttctcctttaaacaatcgccccctaacaccccgatatctaattaccaaatacgcttcgacgaacccctacacgtccccataaacccgaaacccgccgacaaccaccacgtaataaacgaacaaaccttcgctatacccaaccccattcgcaaacccgcgtccataaacttcccgaacctacaaatcgaccacgcgtctcaactactcgacacgcaaataccctcaccgccgtcgcgaaactccccctccaacgaaaaactatacgctatatataaaaacaacgcgacctacca

SEQ ID NO: 37343 - DNA, 528 bp, Artificial Sequence
  chemically treated genomic DNA (Homo sapiens) CpG-island No: 37343
gtataattattagtaatatagttatttgtttttttagtttgaggagatgatgtcgtatttcgggtcggtttattataagtttttttcgttttcgacgtttattatttcgggtttttaggtgtagtatagttttatgtgggacgattcgggatttttttataatttttattagaattacgtggttattacgtatatgatcgagtagaggaaaacgttagtttttcgtttttttttttttttttttaagtaatcgttttttggtatttcggtgtttagttgttagatgcgtttcgacgggtttttgtacgtttttatgaattcggagttcgtcggtagttattacgtggtggacgggtagattttcgttgtgtttaattttattcgtaagttcgcgtttatgggtttttcgggtttgtagatcggttacgcgttttagttgttcgatacgtaggtgtttttatcgtcgtcgcggggttttttttttaacgaggggttgtgcgttgtgtgtggggataacgcggtttgtta

SEQ ID NO: 37344 - DNA, 528 bp, Artificial Sequence
  chemically treated genomic DNA (Homo sapiens) CpG-island No: 37344
taacaaaccgcgttatccccacacacaacgcacaacccctcgttaaaaaaaaaaccccgcgacgacgataaaaacacctacgtatcgaacaactaaaacgcgtaaccgatctacaaacccgaaaaacccataaacgcgaacttacgaataaaattaaacacaacgaaaatctacccgtccaccacgtaataactaccgacgaactccgaattcataaaaacgtacaaaaacccgtcgaaacgcatctaacaactaaacaccgaaataccaaaaaacgattacttaaaaaaaaaaaaaaaaaaacgaaaaactaacgttttcctctactcgatcatatacgtaataaccacgtaattctaataaaaattataaaaaaatcccgaatcgtcccacataaaactatactacacctaaaaacccgaaataataaacgtcgaaaacgaaaaaaacttataataaaccgacccgaaatacgacatcatctcctcaaactaaaaaaacaaataactatattactaataattatac

SEQ ID NO: 37345 - DNA, 561 bp, Artificial Sequence
  chemically treated genomic DNA (Homo sapiens) CpG-island No: 37345
cgattttcgtattttaggaagtttttaaaattcgcgttagttttttttttcgtagggcgggggcgtttacggcgcgaattcgttagaggtgtagggggaagtgtggggggttggttcgtagttttcgaggggtggggcgataggagcgagcggtcgggggaggagaaaaaggcgggcggcgggagagggggtttttattatttcggtttttcgggaggagttttatttagttagttacgtagaagtttttttttcgtttttcgcgttatatatttagattggtttttagcgcgtaggcgagtggggcgaaggaggggggataggagtttcggaagggtcgttcggcgtttatatttatttttgtttcgtttttttcgttttaaataaagtttttcgattttaggtttaggatacgttatttgttcggcgttttcggtttttcggttatcgtatttttcgttgggcgcgtttggtacgggtttcgtttttcggggtttataaagtggtcgtttttggttgggcggttgggtagatgtttttttttggatatgttggggcggt

SEQ ID NO: 37346 - DNA, 561 bp, Artificial Sequence
  chemically treated genomic DNA (Homo sapiens) CpG-island No: 37346
accgccccaacatatccaaaaaaaaacatctacccaaccgcccaaccaaaaacgaccactttataaaccccgaaaaacgaaacccgtaccaaacgcgcccaacgaaaaatacgataaccgaaaaaccgaaaacgccgaacaaataacgtatcctaaacctaaaatcgaaaaactttatttaaaacgaaaaaaacgaaacaaaaataaatataaacgccgaacgacccttccgaaactcctatcccccctccttcgccccactcgcctacgcgctaaaaaccaatctaaatatataacgcgaaaaacgaaaaaaaaacttctacgtaactaactaaataaaactcctcccgaaaaaccgaaataataaaaaccccctctcccgccgcccgcctttttctcctcccccgaccgctcgctcctatcgccccacccctcgaaaactacgaaccaaccccccacacttccccctacacctctaacgaattcgcgccgtaaacgcccccgccctacgaaaaaaaaaactaacgcgaattttaaaaacttcctaaaatacgaaaatcg

SEQ ID NO: 37347 - DNA, 561 bp, Artificial Sequence
  chemically treated genomic DNA (Homo sapiens) CpG-island No: 37347
atcgttttaatatgtttagagaggggtatttatttagtcgtttagttaggggcgattattttgtgagtttcggggagcgggattcgtattaggcgcgtttagcgggggatgcggtgatcgaggggtcgggagcgtcgggtaggtaacgtattttggatttagagtcgggggattttgtttggggcgggaggagcggaataggggtgggtgtgaacgtcggacggttttttcgggatttttgttttttttttttcgttttattcgtttgcgcgttggaagttaatttgggtgtgtagcgcgaagagcgaaagagaaatttttgcgtgattgattagatgaggtttttttcgagaagtcgagataatagaggttttttttttcgtcgttcgttttttttttttttttcggtcgttcgtttttgtcgttttatttttcgaaggttgcggattagttttttatatttttttttatatttttggcgggttcgcgtcgtggacgttttcgttttgcgggaggaggggttggcgcggattttagggattttttgggatgcggagatcg

SEQ ID NO: 37348 - DNA, 561 bp, Artificial Sequence
  chemically treated genomic DNA (Homo sapiens) CpG-island No: 37348
cgatctccgcatcccaaaaaatccctaaaatccgcgccaacccctcctcccgcaaaacgaaaacgtccacgacgcgaacccgccaaaaatataaaaaaaaatataaaaaactaatccgcaaccttcgaaaaataaaacgacaaaaacgaacgaccgaaaaaaaaaaaaaaaacgaacgacgaaaaaaaaaacctctattatctcgacttctcgaaaaaaacctcatctaatcaatcacgcaaaaatttctctttcgctcttcgcgctacacacccaaattaacttccaacgcgcaaacgaataaaacgaaaaaaaaaaaacaaaaatcccgaaaaaaccgtccgacgttcacacccacccctattccgctcctcccgccccaaacaaaatcccccgactctaaatccaaaatacgttacctacccgacgctcccgacccctcgatcaccgcatcccccgctaaacgcgcctaatacgaatcccgctccccgaaactcacaaaataatcgcccctaactaaacgactaaataaatacccctctctaaacatattaaaacgat

SEQ ID NO: 37349 - DNA, 598 bp, Artificial Sequence
  chemically treated genomic DNA (Homo sapiens) CpG-island No: 37349
tcgcggtcgattaagaagggagtcggggagtcgttcgtttttttttttcggttttcggttttcggttttcggcggttgcggtagttgtatatagaagtttattgtcgtcggcgttcggcgcgtagtttcgcggattcggtttcgcggttaagcgcgttagcggtttcgttagtcgggtcgggtttcgtgacgcgcgcgtagttcgcgttataaataatttgtcgtcgggcggttcgggcggttttttagtgacgttggggcggaggcgcggtaggaggagggcgaaaggaaataataaaatcgttcggtagttttttaagttttttttttttttttttaggtcgttcgcggtttttcgcgtcgagttttttttttttcgtttcggttcgttttgcggggagcgcggttcgcgggtgggaaggagttcggcgtgttggcgttttcgagtgttgtcggggtttcggggcgggagggggtttttttcgtattttgggatggcgaggagggaatttggcgataagtttagtgaggggatcgttgtgtttttttttagtttagttaaaatgattcgagtttttttcgtttttttatatattta

SEQ ID NO: 37350 - DNA, 598 bp, Artificial Sequence
  chemically treated genomic DNA (Homo sapiens) CpG-island No: 37350
taaatatataaaaaaacgaaaaaaactcgaatcattttaactaaactaaaaaaaaacacaacgatcccctcactaaacttatcgccaaattccctcctcgccatcccaaaatacgaaaaaaaccccctcccgccccgaaaccccgacaacactcgaaaacgccaacacgccgaactccttcccacccgcgaaccgcgctccccgcaaaacgaaccgaaacgaaaaaaaaaaaactcgacgcgaaaaaccgcgaacgacctaaaaaaaaaaaaaaaaaacttaaaaaactaccgaacgattttattatttcctttcgccctcctcctaccgcgcctccgccccaacgtcactaaaaaaccgcccgaaccgcccgacgacaaattatttataacgcgaactacgcgcgcgtcacgaaacccgacccgactaacgaaaccgctaacgcgcttaaccgcgaaaccgaatccgcgaaactacgcgccgaacgccgacgacaataaacttctatatacaactaccgcaaccgccgaaaaccgaaaaccgaaaaccgaaaaaaaaaaacgaacgactccccgactcccttcttaatcgaccgcga

SEQ ID NO: 37351 - DNA, 598 bp, Artificial Sequence
  chemically treated genomic DNA (Homo sapiens) CpG-island No: 37351
taggtgtgtgagggagcgggaaaagttcgggttattttaattggattagaaaggaatatagcgatttttttattaaatttgtcgttaagtttttttttcgttattttagggtgcgggaaaaattttttttcgtttcggggtttcggtagtattcggggacgttagtacgtcgggtttttttttattcgcgaatcgcgtttttcgtagggcgggtcggggcggggaaaaaggagttcgacgcgaagggtcgcgggcggtttgggaagggaggagggagatttgggaggttgtcgggcggttttattgttttttttcgttttttttttatcgcgttttcgttttagcgttattggaaagtcgttcgagtcgttcggcggtaggttatttatagcgcgggttgcgcgcgcgttacggagttcggttcggttgacggggtcgttgacgcgtttggtcgcggggtcgagttcgcggggttgcgcgtcggacgtcggcgataatgggtttttgtgtgtagttgtcgtagtcgtcgggggtcgggggtcgggggtcgggggaggggggcgggcgatttttcggttttttttttggtcggtcgcga

SEQ ID NO: 37352 - DNA, 598 bp, Artificial Sequence
  chemically treated genomic DNA (Homo sapiens) CpG-island No: 37352
tcgcgaccgaccaaaaaaaaaaccgaaaaatcgcccgcccccctcccccgacccccgacccccgacccccgacgactacgacaactacacacaaaaacccattatcgccgacgtccgacgcgcaaccccgcgaactcgaccccgcgaccaaacgcgtcaacgaccccgtcaaccgaaccgaactccgtaacgcgcgcgcaacccgcgctataaataacctaccgccgaacgactcgaacgactttccaataacgctaaaacgaaaacgcgataaaaaaaaaacgaaaaaaaacaataaaaccgcccgacaacctcccaaatctccctcctcccttcccaaaccgcccgcgacccttcgcgtcgaactcctttttccccgccccgacccgccctacgaaaaacgcgattcgcgaataaaaaaaaacccgacgtactaacgtccccgaatactaccgaaaccccgaaacgaaaaaaaatttttcccgcaccctaaaataacgaaaaaaaaacttaacgacaaatttaataaaaaaatcgctatattcctttctaatccaattaaaataacccgaacttttcccgctccctcacacaccta

SEQ ID NO: 37353 - DNA, 979 bp, Artificial Sequence
  chemically treated genomic DNA (Homo sapiens) CpG-island No: 37353
  misc_feature (451)..(452): n is either a, c, g or t
ttggtaggcgtttaatttaggttgggtgatattttcgttcgttagtttttggtattagtgagtgtttcgttaatgtttgataaacggttgattttattgttttcgttgtgggcgtattagatttcgggggcgcgtttaggtttcgtttaattttttaggtttaggattcgcggcgtaagggaacgtcgggcggggtgttttgggggcggggtttggggtggggttgcggatcgaggggcggagtcggtcgtttcggggtttttagttcgtttcgggagagttagggtttcgagtcgagcgcgcggagtagttggggtcggggcgcggatgttggaagtttatatttcgtcggtggggtcgagtcgaggggtttagtagagttcggagaaaagttatatggtgagcgcggtttttggatggggaggggcgtcgggattcgtaggattttttnntcggcgtttagtggggatcggggtttcgggtttgggtgaacgagcgttgcgggttggatcgtcgggggaaattttgtcgagggtttgggggtcgtttggatttgttagttcgcggattatggttcgagtttttgagggattttagggtttcgaggggtaggttcgttagtcggtttttttaggtgtgcgggagcggagagttttcgggtagtcgcggcgtcgtaaggtcgttttgtgtttttgagagcgggagggtgggtacgtcgttaggcgtaggtgttgcggcgttttttcgcggggttttacgcgtagattcgttgttcgttcgcgtcgttaggtgtttcgagtggaggtgttgtgtagcgggcgtagatatacggtgttaaggcgttatagcgagttttacgcgttgtataagcgggtgaggcggcgtcgattttttatcggtttcggtttagtttttgtttagttttcgtttaggttttgtgaggcgggcgggcgagttttagttttcgttatttttatta

SEQ ID NO: 37354 - DNA, 979 bp, Artificial Sequence
  chemically treated genomic DNA (Homo sapiens) CpG-island No: 37354
  misc_feature (528)..(529): n is either a, c, g or t
taataaaaataacgaaaactaaaactcgcccgcccgcctcacaaaacctaaacgaaaactaaacaaaaactaaaccgaaaccgataaaaaatcgacgccgcctcacccgcttatacaacgcgtaaaactcgctataacgccttaacaccgtatatctacgcccgctacacaacacctccactcgaaacacctaacgacgcgaacgaacaacgaatctacgcgtaaaaccccgcgaaaaaacgccgcaacacctacgcctaacgacgtacccaccctcccgctctcaaaaacacaaaacgaccttacgacgccgcgactacccgaaaactctccgctcccgcacacctaaaaaaaccgactaacgaacctacccctcgaaaccctaaaatccctcaaaaactcgaaccataatccgcgaactaacaaatccaaacgacccccaaaccctcgacaaaatttcccccgacgatccaacccgcaacgctcgttcacccaaacccgaaaccccgatccccactaaacgccgannaaaaaatcctacgaatcccgacgcccctccccatccaaaaaccgcgctcaccatataacttttctccgaactctactaaacccctcgactcgaccccaccgacgaaatataaacttccaacatccgcgccccgaccccaactactccgcgcgctcgactcgaaaccctaactctcccgaaacgaactaaaaaccccgaaacgaccgactccgcccctcgatccgcaaccccaccccaaaccccgcccccaaaacaccccgcccgacgttcccttacgccgcgaatcctaaacctaaaaaattaaacgaaacctaaacgcgcccccgaaatctaatacgcccacaacgaaaacaataaaatcaaccgtttatcaaacattaacgaaacactcactaataccaaaaactaacgaacgaaaatatcacccaacctaaattaaacgcctaccaa

SEQ ID NO: 37355 - DNA, 979 bp, Artificial Sequence
  chemically treated genomic DNA (Homo sapiens) CpG-island No: 37355
  misc_feature (528)..(529): n is either a, c, g or t
taatgggggtggcggaggttggggttcgttcgttcgttttatagggtttgggcgggggttggatagaggttgggtcggggtcggtgggaggtcggcgtcgttttattcgtttgtgtagcgcgtggaattcgttgtagcgttttggtatcgtgtgtttgcgttcgttgtatagtatttttattcggaatatttggcggcgcgggcgggtagcgggtttgcgcgtgaggtttcgcgggaggacgtcgtagtatttgcgtttggcgacgtgtttattttttcgtttttaaaggtataaagcggttttgcggcgtcgcggttgttcggggatttttcgttttcgtatatttgggagaatcggttggcggatttgtttttcggagttttggggttttttaagagttcgaattatggttcgcgagttggtaaatttaagcggtttttaaattttcgataaggtttttttcgacggtttagttcgtagcgttcgtttatttaggttcggggtttcggtttttattgagcgtcggnngggaaattttgcgggtttcggcgtttttttttatttaggggtcgcgtttattatgtggttttttttcgggttttgttgggtttttcggttcggttttatcgacgggatgtgaatttttagtattcgcgtttcggttttagttgtttcgcgcgttcggttcggagttttaattttttcggagcggattgaggatttcggggcggtcggtttcgtttttcggttcgtagttttattttaggtttcgtttttagggtatttcgttcggcgtttttttgcgtcgcgggttttgagtttagaagattaggcgggatttggacgcgttttcgaagtttagtgcgtttatagcgggggtagtggagttaatcgtttgttaaatattgacggagtatttattgatgttaggaattggcgagcgaaaatgttatttaatttgagttaagcgtttattaa

SEQ ID NO: 37356 - DNA, 979 bp, Artificial Sequence
  chemically treated genomic DNA (Homo sapiens) CpG-island No: 37356
  misc_feature (451)..(452): n is either a, c, g or t
ttaataaacgcttaactcaaattaaataacattttcgctcgccaattcctaacatcaataaatactccgtcaatatttaacaaacgattaactccactacccccgctataaacgcactaaacttcgaaaacgcgtccaaatcccgcctaatcttctaaactcaaaacccgcgacgcaaaaaaacgccgaacgaaataccctaaaaacgaaacctaaaataaaactacgaaccgaaaaacgaaaccgaccgccccgaaatcctcaatccgctccgaaaaaattaaaactccgaaccgaacgcgcgaaacaactaaaaccgaaacgcgaatactaaaaattcacatcccgtcgataaaaccgaaccgaaaaacccaacaaaacccgaaaaaaaaccacataataaacgcgacccctaaataaaaaaaaacgccgaaacccgcaaaatttcccnnccgacgctcaataaaaaccgaaaccccgaacctaaataaacgaacgctacgaactaaaccgtcgaaaaaaaccttatcgaaaatttaaaaaccgcttaaatttaccaactcgcgaaccataattcgaactcttaaaaaaccccaaaactccgaaaaacaaatccgccaaccgattctcccaaatatacgaaaacgaaaaatccccgaacaaccgcgacgccgcaaaaccgctttatacctttaaaaacgaaaaaataaacacgtcgccaaacgcaaatactacgacgtcctcccgcgaaacctcacgcgcaaacccgctacccgcccgcgccgccaaatattccgaataaaaatactatacaacgaacgcaaacacacgataccaaaacgctacaacgaattccacgcgctacacaaacgaataaaacgacgccgacctcccaccgaccccgacccaacctctatccaacccccgcccaaaccctataaaacgaacgaacgaaccccaacctccgccacccccatta

SEQ ID NO: 37357 - DNA, 520 bp, Artificial Sequence
  chemically treated genomic DNA (Homo sapiens) CpG-island No: 37357
atttgttgcgtagttttagttggtcgggtgttttttcgtttttagcgtttaagtttcgtttttaggttttcgtttttcggattttacggggttttttgcggtttttttatttttcgtatcgttggatcgttttgtttacggcgttatttttcgataaagttgttgttgcggttttcgtcgcgggtggaagaagatggcgtcgggtggtggtggttgtagcgtttcggagagattgttttcgttttttttcggtttggagtcggagttcgagggggcggtcgggggattagaattcgaggttggggatagcgatatcgagggggaggatatttttatcggcgtcgcggtggtcgtgagtttgtatttttcggggtagtaggcgggagggtatttcgaaagggaagagaggttaagcgagaatcggggaggttgggtagagtgggttcggtgagattttgtttcggtgttagtagttcgggtttcggggattttggatgtgttcgaagcggtagagtttggt

SEQ ID NO: 37358 - DNA, 520 bp, Artificial Sequence
  chemically treated genomic DNA (Homo sapiens) CpG-island No: 37358
accaaactctaccgcttcgaacacatccaaaatccccgaaacccgaactactaacaccgaaacaaaatctcaccgaacccactctacccaacctccccgattctcgcttaacctctcttccctttcgaaataccctcccgcctactaccccgaaaaatacaaactcacgaccaccgcgacgccgataaaaatatcctccccctcgatatcgctatccccaacctcgaattctaatcccccgaccgccccctcgaactccgactccaaaccgaaaaaaaacgaaaacaatctctccgaaacgctacaaccaccaccacccgacgccatcttcttccacccgcgacgaaaaccgcaacaacaactttatcgaaaaataacgccgtaaacaaaacgatccaacgatacgaaaaataaaaaaaccgcaaaaaaccccgtaaaatccgaaaaacgaaaacctaaaaacgaaacttaaacgctaaaaacgaaaaaacacccgaccaactaaaactacgcaacaaat

SEQ ID NO: 37359 - DNA, 520 bp, Artificial Sequence
  chemically treated genomic DNA (Homo sapiens) CpG-island No: 37359
gttaagttttatcgtttcgagtatatttagggttttcggggttcggattgttgatatcgaggtaaggttttatcgggtttattttgtttaattttttcgattttcgtttagttttttttttttttcggggtgttttttcgtttgttatttcgaggggtgtaaatttacgattatcgcggcgtcggtgaaaatgttttttttttcggtgtcgttgtttttagtttcgggttttgatttttcggtcgttttttcggatttcggttttaggtcggggaagggcggaggtagttttttcgaagcgttatagttattattattcgacgttatttttttttattcgcggcggaagtcgtaataataattttatcgagagatagcgtcgtgagtaaagcgatttaacggtgcgaggagtgggagggtcgtaagggatttcgtgggattcgaggggcggagatttaggggcggggtttaggcgttgggggcgggggggtattcggttagttgaggttgcgtagtaaat

SEQ ID NO: 37360 - DNA, 520 bp, Artificial Sequence
  chemically treated genomic DNA (Homo sapiens) CpG-island No: 37360
atttactacgcaacctcaactaaccgaatacccccccgcccccaacgcctaaaccccgcccctaaatctccgcccctcgaatcccacgaaatcccttacgaccctcccactcctcgcaccgttaaatcgctttactcacgacgctatctctcgataaaattattattacgacttccgccgcgaataaaaaaaaataacgtcgaataataataactataacgcttcgaaaaaactacctccgcccttccccgacctaaaaccgaaatccgaaaaaacgaccgaaaaatcaaaacccgaaactaaaaacaacgacaccgaaaaaaaaaacattttcaccgacgccgcgataatcgtaaatttacacccctcgaaataacaaacgaaaaaacaccccgaaaaaaaaaaaaaactaaacgaaaatcgaaaaaattaaacaaaataaacccgataaaaccttacctcgatatcaacaatccgaaccccgaaaaccctaaatatactcgaaacgataaaacttaac

SEQ ID NO: 37361 - DNA, 616 bp, Artificial Sequence
  chemically treated genomic DNA (Homo sapiens) CpG-island No: 37361
  misc_feature (532)..(532): n is either a, c, g or t
  misc_feature (570)..(571): n is either a, c, g or t
tcggtatcgtaaatgtcgcggattttatcggattttgacggtgattttgggtttttttttttttttatcggtcgtagaaggtttcggtagtagtaggaagaagacggatttcgcgatgagggcggcggtaaggagtatttttatgttgcgttcggagaggcgtagtatttataggcggaggcgaaagtagttcggatagttgaggtcggaagagggtggggtcgcggtggttagggagtcggcgtttacgcgcgggtgggggggattggggttgttcgcgggtttcgggcgggcggcgggtcgtttttttttttcggttcggcgtcggatagtaggtttttttgcggggcgggtatcgacgcgggttcgtgggtggttgttacgttattgtttttttattgggttttcggtcgttttttttcgtttataggaaggttatcggcggaaggcggtttcgtagagtacgggttcgggtttcgagaagattataagtttcggtatgtttcgcggttcgtttcgttcggagcgttgntttattggtttgcggtagttggcgtttggggttagtannttcgtgggtttggataaggggtacgggaagtttgttattgttttg

SEQ ID NO: 37362 - DNA, 616 bp, Artificial Sequence
  chemically treated genomic DNA (Homo sapiens) CpG-island No: 37362
  misc_feature (46)..(47): n is either a, c, g or t
  misc_feature (85)..(85): n is either a, c, g or t
caaaacaataacaaacttcccgtaccccttatccaaacccacgaanntactaaccccaaacgccaactaccgcaaaccaataaancaacgctccgaacgaaacgaaccgcgaaacataccgaaacttataatcttctcgaaacccgaacccgtactctacgaaaccgccttccgccgataaccttcctataaacgaaaaaaaacgaccgaaaacccaataaaaaaacaataacgtaacaaccacccacgaacccgcgtcgatacccgccccgcaaaaaaacctactatccgacgccgaaccgaaaaaaaaaaacgacccgccgcccgcccgaaacccgcgaacaaccccaatcccccccacccgcgcgtaaacgccgactccctaaccaccgcgaccccaccctcttccgacctcaactatccgaactactttcgcctccgcctataaatactacgcctctccgaacgcaacataaaaatactccttaccgccgccctcatcgcgaaatccgtcttcttcctactactaccgaaaccttctacgaccgataaaaaaaaaaaaaaacccaaaatcaccgtcaaaatccgataaaatccgcgacatttacgataccga

SEQ ID NO: 37363 - DNA, 616 bp, Artificial Sequence
  chemically treated genomic DNA (Homo sapiens) CpG-island No: 37363
  misc_feature (46)..(47): n is either a, c, g or t
  misc_feature (85)..(85): n is either a, c, g or t
taaaatagtgataagtttttcgtgttttttgtttaggtttacgganntgttaattttaagcgttagttatcgtaggttagtggantagcgtttcgggcggggcgggtcgcggagtatgtcggggtttgtggttttttcggagttcgggttcgtgttttgcgaggtcgtttttcgtcggtggtttttttgtgggcgggagagggcggtcgggagtttaatgagggagtaataacgtggtaattatttacgagttcgcgtcggtgttcgtttcgtagggggatttattattcggcgtcgagtcggaggggggaaacggttcgtcgttcgttcggagttcgcgagtaattttagttttttttattcgcgcgtgggcgtcggttttttagttatcgcggttttattttttttcggttttagttgttcgggttgttttcgttttcgtttgtggatgttgcgttttttcgaacgtaatatgaaggtgttttttgtcgtcgtttttatcgcggggttcgttttttttttgttgttgtcgggattttttgcggtcgatgagaagaagaaggggtttaaagttatcgttaaggttcggtggagttcgcggtatttacggtgtcgg

SEQ ID NO: 37364 - DNA, 616 bp, Artificial Sequence
  chemically treated genomic DNA (Homo sapiens) CpG-island No: 37364
  misc_feature (532)..(532): n is either a, c, g or t
  misc_feature (570)..(571): n is either a, c, g or t
ccgacaccgtaaataccgcgaactccaccgaaccttaacgataactttaaaccccttcttcttctcatcgaccgcaaaaaatcccgacaacaacaaaaaaaaaacgaaccccgcgataaaaacgacgacaaaaaacaccttcatattacgttcgaaaaaacgcaacatccacaaacgaaaacgaaaacaacccgaacaactaaaaccgaaaaaaaataaaaccgcgataactaaaaaaccgacgcccacgcgcgaataaaaaaaactaaaattactcgcgaactccgaacgaacgacgaaccgtttcccccctccgactcgacgccgaataataaatccccctacgaaacgaacaccgacgcgaactcgtaaataattaccacgttattactccctcattaaactcccgaccgccctctcccgcccacaaaaaaaccaccgacgaaaaacgacctcgcaaaacacgaacccgaactccgaaaaaaccacaaaccccgacatactccgcgacccgccccgcccgaaacgctantccactaacctacgataactaacgcttaaaattaacanntccgtaaacctaaacaaaaaacacgaaaaacttatcactatttta

SEQ ID NO: 37365 - DNA, 603 bp, Artificial Sequence
  chemically treated genomic DNA (Homo sapiens) CpG-island No: 37365
gggcgaatattgcgtttgcgtatttttcgtagtcggatttatttatagcgtttgcgttacgtgatttcgatttattttcgaggttttagtggaataatttttttttgaaaaatggttttattcgtttcgtttttagaacgggtcgggtcgttattattgttcggttcggaggggaattgtttttttcggaagtgataatacgttgattaggaaaaggaggaggcggggtagtggggttttcggcggcgattatggaaggagtcggttatagggtaagtattgaggacgtattttttcgttttagtgtatgcgaaacgtttcgtttagtgattagttttttttttaggttttggttttcgagaattcggtacggttttggtaaatatcgattttttataaacgcgtcgttattttttcgtttatcgttttagggaagaattttttatggtttcgttttttcggtttaggcgattttttgagttttgttttttgtggaacgtacgttagtattcgaacgcgggttggattatttttttcgttttggtttcggggtaatggttttttcggtttcgttttttgagggtggtttttttttgggttcgt

SEQ ID NO: 37366 - DNA, 603 bp, Artificial Sequence
  chemically treated genomic DNA (Homo sapiens) CpG-island No: 37366
acgaacccaaaaaaaaaccaccctcaaaaaacgaaaccgaaaaaaccattaccccgaaaccaaaacgaaaaaaataatccaacccgcgttcgaatactaacgtacgttccacaaaaaacaaaactcaaaaaatcgcctaaaccgaaaaaacgaaaccataaaaaattcttccctaaaacgataaacgaaaaaataacgacgcgtttataaaaaatcgatatttaccaaaaccgtaccgaattctcgaaaaccaaaacctaaaaaaaaaactaatcactaaacgaaacgtttcgcatacactaaaacgaaaaaatacgtcctcaatacttaccctataaccgactccttccataatcgccgccgaaaaccccactaccccgcctcctccttttcctaatcaacgtattatcacttccgaaaaaaacaattcccctccgaaccgaacaataataacgacccgacccgttctaaaaacgaaacgaataaaaccatttttcaaaaaaaaattattccactaaaacctcgaaaataaatcgaaatcacgtaacgcaaacgctataaataaatccgactacgaaaaatacgcaaacgcaatattcgccc

SEQ ID NO: 37367 - DNA, 603 bp, Artificial Sequence
  chemically treated genomic DNA (Homo sapiens) CpG-island No: 37367
acgggtttagggaggagttatttttagggggcggggtcgggagggttattgtttcgggattaaggcggggagaatggtttagttcgcgttcggatgttgacgtgcgttttatagggggtagggtttaaggagtcgtttgagtcgggggggcggggttatgggaggtttttttttggggcggtggacgggagggtgacggcgcgtttataagagatcggtgtttgttaaggtcgtgtcggattttcgagagttaaggtttgagagaagagttgattattagacggggcgtttcgtatatattgaagcgagggaatgcgtttttagtgtttattttgtagtcggttttttttatagtcgtcgtcgaaggttttattgtttcgtttttttttttttttagttagcgtgttgttattttcggagaaaatagttttttttcgggtcggatagtggtagcggttcgattcgttttagagacggagcgggtgaaattattttttagaagggggttattttattggaatttcgagggtggatcggagttacgtggcgtagacgttgtaggtggattcggttacggagagtgcgtaggcgtagtgttcgttt

SEQ ID NO: 37368 - DNA, 603 bp, Artificial Sequence
  chemically treated genomic DNA (Homo sapiens) CpG-island No: 37368
aaacgaacactacgcctacgcactctccgtaaccgaatccacctacaacgtctacgccacgtaactccgatccaccctcgaaattccaataaaataacccccttctaaaaaataatttcacccgctccgtctctaaaacgaatcgaaccgctaccactatccgacccgaaaaaaaactattttctccgaaaataacaacacgctaactaaaaaaaaaaaaaaacgaaacaataaaaccttcgacgacgactataaaaaaaaccgactacaaaataaacactaaaaacgcattccctcgcttcaatatatacgaaacgccccgtctaataatcaactcttctctcaaaccttaactctcgaaaatccgacacgaccttaacaaacaccgatctcttataaacgcgccgtcaccctcccgtccaccgccccaaaaaaaaacctcccataaccccgcccccccgactcaaacgactccttaaaccctaccccctataaaacgcacgtcaacatccgaacgcgaactaaaccattctccccgccttaatcccgaaacaataaccctcccgaccccgccccctaaaaataactcctccctaaacccgt

SEQ ID NO: 37369 - DNA, 785 bp, Artificial Sequence
  chemically treated genomic DNA (Homo sapiens) CpG-island No: 37369
tcgcgcgcgttgttgagttcgttgttcgggtttgtgttgttgaacgcgttcgtggtggcgatgatttagggatcgtacgatgtgtacgtgtagatcgagatttttttttcggcgcggaatttgaaggtgttgaaggtcgacgtggtgttgttgacggcgagcggatcggcggtgaagcgtattattttttcgtcgtcgttgtttcgttatatgtaggaggcgttgcggaggttgtattacgtgtcggttattaaggtgtttttaagttttcgtaggtttttttggcgcgaggagtatattgaaggcggttatttaaatatcgatcgttcgtcgcgtatgattttttattcgtcgtcgcgcgagggcgcgttgttgttggtttcgtatacgtggtcggacgcggcggtagcgttcgtcggtttgagtcgggaagaggcgttgcgtttggcgttcgacgacgtggcggtattgtacgggtttgtcgtgcgttagttttgggacggtatcggcgtcgttaagcgttgggcggaggattagtatagttagggtggttttgtggtatagtcgtcggcgttttggtaaatcgaaaaggatgattggacggttttttatggtcgtatttattttgtcggcgagtatatcgtttattcgtacggttgggtggagacggcggttaagtcggcgttgcgcgtcgttattaagattaatagtcggaaggggtttgtatcggatacggttagtttcgaggggtacgtatttgatatggaggggtaggggtatgtgta

SEQ ID NO: 37370 - DNA, 785 bp, Artificial Sequence
  chemically treated genomic DNA (Homo sapiens) CpG-island No: 37370
tacacatacccctacccctccatatcaaatacgtacccctcgaaactaaccgtatccgatacaaaccccttccgactattaatcttaataacgacgcgcaacgccgacttaaccgccgtctccacccaaccgtacgaataaacgatatactcgccgacaaaataaatacgaccataaaaaaccgtccaatcatccttttcgatttaccaaaacgccgacgactataccacaaaaccaccctaactatactaatcctccgcccaacgcttaacgacgccgataccgtcccaaaactaacgcacgacaaacccgtacaataccgccacgtcgtcgaacgccaaacgcaacgcctcttcccgactcaaaccgacgaacgctaccgccgcgtccgaccacgtatacgaaaccaacaacaacgcgccctcgcgcgacgacgaataaaaaatcatacgcgacgaacgatcgatatttaaataaccgccttcaatatactcctcgcgccaaaaaaacctacgaaaacttaaaaacaccttaataaccgacacgtaatacaacctccgcaacgcctcctacatataacgaaacaacgacgacgaaaaaataatacgcttcaccgccgatccgctcgccgtcaacaacaccacgtcgaccttcaacaccttcaaattccgcgccgaaaaaaaaatctcgatctacacgtacacatcgtacgatccctaaatcatcgccaccacgaacgcgttcaacaacacaaacccgaacaacgaactcaacaacgcgcgcga

SEQ ID NO: 37371 - DNA, 785 bp, Artificial Sequence
  chemically treated genomic DNA (Homo sapiens) CpG-island No: 37371
tgtatatgtttttgtttttttatgttagatgcgtgtttttcggggttggtcgtgttcgatgtaggtttttttcggttgttgattttgatggcggcgcgtagcgtcgatttgatcgtcgtttttatttagtcgtgcgggtaggcggtgtgttcgtcggtaaagtagatgcggttataagggatcgtttagttatttttttcggtttgttagagcgtcggcggttgtattataaagttattttggttgtgttggtttttcgtttaacgtttgacgacgtcggtgtcgttttagagttggcgtacgataggttcgtgtaatgtcgttacgtcgtcgagcgttaagcgtaacgttttttttcggtttaagtcggcgaacgttgtcgtcgcgttcgattacgtgtacgaggttagtagtagcgcgttttcgcgcggcggcgggtagaaaattatgcgcgacgggcgatcggtgtttgagtggtcgtttttaatgtgtttttcgcgttagaagggtttgcggaagtttaggaatattttggtggtcggtacgtagtgtagttttcgtagcgttttttgtatgtggcggggtagcggcggcgagaaggtgatgcgttttatcgtcggttcgttcgtcgttagtagtattacgtcggtttttagtatttttagatttcgcgtcgggggagaggtttcgatttgtacgtgtatatcgtgcggtttttgggttatcgttattacgggcgcgtttaatagtataagttcggatagcgagtttagtagcgcgcgcgg

SEQ ID NO: 37372 - DNA, 785 bp, Artificial Sequence
  chemically treated genomic DNA (Homo sapiens) CpG-island No: 37372
ccgcgcgcgctactaaactcgctatccgaacttatactattaaacgcgcccgtaataacgataacccaaaaaccgcacgatatacacgtacaaatcgaaacctctcccccgacgcgaaatctaaaaatactaaaaaccgacgtaatactactaacgacgaacgaaccgacgataaaacgcatcaccttctcgccgccgctaccccgccacatacaaaaaacgctacgaaaactacactacgtaccgaccaccaaaatattcctaaacttccgcaaacccttctaacgcgaaaaacacattaaaaacgaccactcaaacaccgatcgcccgtcgcgcataattttctacccgccgccgcgcgaaaacgcgctactactaacctcgtacacgtaatcgaacgcgacgacaacgttcgccgacttaaaccgaaaaaaaacgttacgcttaacgctcgacgacgtaacgacattacacgaacctatcgtacgccaactctaaaacgacaccgacgtcgtcaaacgttaaacgaaaaaccaacacaaccaaaataactttataatacaaccgccgacgctctaacaaaccgaaaaaaataactaaacgatcccttataaccgcatctactttaccgacgaacacaccgcctacccgcacgactaaataaaaacgacgatcaaatcgacgctacgcgccgccatcaaaatcaacaaccgaaaaaaacctacatcgaacacgaccaaccccgaaaaacacgcatctaacataaaaaaacaaaaacatataca

SEQ ID NO: 37373 - DNA, 566 bp, Artificial Sequence
  chemically treated genomic DNA (Homo sapiens) CpG-island No: 37373
aggggggcggggagtgggcgcggacggttttacgcgtcgggggagggggcgtttcgcgggtcggggggcgggcgtttggttttgcgtggggcggggcggtttttatttgttcgcgcgttggttttcgtttttttcgcgcggttttagtttttcgtgcgttcgtttttttttttttttttttttttcgcggggtttcggcggcggcgtttagcgtaggtaggtttttttgttgtcgggttttatttgttgtcggttttgattcggggcggtcgcggcgcgcggagtttcggggagttaggcggagtagtcgcgtagttacgacggagtagtagcgggattggtcgtttcgcgtttttttcgtcgtcgtgttttttttcggcgcgtttatttcgttttcgggatgggattgtagcggcggcgcggattcggcggggatcgcggcggaggcggcggcgtcggcggcggcgtcggcggtcgagcggggttttatgtttttttttggttaggaggaatattgcgtttttaataaggagttagtgaaatacggggagttggtggtgttcggg

SEQ ID NO: 37374 - DNA, 566 bp, Artificial Sequence
  chemically treated genomic DNA (Homo sapiens) CpG-island No: 37374
cccgaacaccaccaactccccgtatttcactaactccttattaaaaacgcaatattcctcctaaccaaaaaaaaacataaaaccccgctcgaccgccgacgccgccgccgacgccgccgcctccgccgcgatccccgccgaatccgcgccgccgctacaatcccatcccgaaaacgaaataaacgcgccgaaaaaaaacacgacgacgaaaaaaacgcgaaacgaccaatcccgctactactccgtcgtaactacgcgactactccgcctaactccccgaaactccgcgcgccgcgaccgccccgaatcaaaaccgacaacaaataaaacccgacaacaaaaaaacctacctacgctaaacgccgccgccgaaaccccgcgaaaaaaaaaaaaaaaaaaaaaaacgaacgcacgaaaaactaaaaccgcgcgaaaaaaacgaaaaccaacgcgcgaacaaataaaaaccgccccgccccacgcaaaaccaaacgcccgccccccgacccgcgaaacgccccctcccccgacgcgtaaaaccgtccgcgcccactccccgcccccct

SEQ ID NO: 37375 - DNA, 566 bp, Artificial Sequence
  chemically treated genomic DNA (Homo sapiens) CpG-island No: 37375
ttcgagtattattagtttttcgtattttattggttttttattgggggcgtagtgttttttttggttaggggaaaatatggagtttcgttcggtcgtcgacgtcgtcgtcgacgtcgtcgttttcgtcgcgattttcgtcgagttcgcgtcgtcgttataattttatttcgagaacggggtgagcgcgtcggggaagggtacggcggcgaagggggcgcggggcggttagtttcgttgttgtttcgtcgtggttgcgcggttgtttcgtttgatttttcggagtttcgcgcgtcgcggtcgtttcgagttagagtcggtaataaatgggattcggtagtagggggatttgtttgcgttgagcgtcgtcgtcgaagtttcgcgggagggagggaaggaggagggagcgggcgtacgagaggttggggtcgcgcgggggaggcgggggttagcgcgcgggtaggtgggagtcgtttcgttttacgtagagttaggcgttcgtttttcggttcgcggggcgttttttttttcggcgcgtggggtcgttcgcgtttatttttcgttttttt

SEQ ID NO: 37376 - DNA, 566 bp, Artificial Sequence
  chemically treated genomic DNA (Homo sapiens) CpG-island No: 37376
aaaaaaacgaaaaataaacgcgaacgaccccacgcgccgaaaaaaaaaacgccccgcgaaccgaaaaacgaacgcctaactctacgtaaaacgaaacgactcccacctacccgcgcgctaacccccgcctcccccgcgcgaccccaacctctcgtacgcccgctccctcctccttccctccctcccgcgaaacttcgacgacgacgctcaacgcaaacaaatccccctactaccgaatcccatttattaccgactctaactcgaaacgaccgcgacgcgcgaaactccgaaaaatcaaacgaaacaaccgcgcaaccacgacgaaacaacaacgaaactaaccgccccgcgcccccttcgccgccgtacccttccccgacgcgctcaccccgttctcgaaataaaattataacgacgacgcgaactcgacgaaaatcgcgacgaaaacgacgacgtcgacgacgacgtcgacgaccgaacgaaactccatattttcccctaaccaaaaaaaacactacgcccccaataaaaaaccaataaaatacgaaaaactaataatactcgaa

SEQ ID NO: 37377 - DNA, 653 bp, Artificial Sequence
  chemically treated genomic DNA (Homo sapiens) CpG-island No: 37377
cgcgggcggggagcgttcgtattttggagcggggttggcggggtggttcggtgttttttggggatcgtcggggcgttcggggcggtaggagaggtttttagggttcggacggcggcgcgggggcgggatgcgttttatcggcgcgcgttcggggtgttgcggcggacgtcgggttgcgttgttcgcgcggaggacgcggcggaggaagtggttagaattcgggcgatttagcgggggtagcgtcgggtatcgggttcgcggtcgtatcgtgggggcgggggtaggggttttatttttcgcgcgtcgcgttcgggtcggggagggcgggtagggattttatgtgaggcgtcgcggtcgcgggcgtttcgcggggtcgtttttcgaagttgagaggtcggtcggcgcggagtttcgtttttttatttttttcgcggatcgtggtattcgcgttttcgaatttcgagcgcggcgtcgtgagtttgggtcgtcgcgggttgtgggattttcggttgcgttttgtaaattgtttcgatgatcgtcgcgggtcgtcgtagttcgagagtagtgaattgtgtgtgattcgggtcggtcggtttttcgttttttttcgtttggagtgttttggaggggagggataggatgcggttgttcgg

SEQ ID NO: 37378 - DNA, 653 bp, Artificial Sequence
  chemically treated genomic DNA (Homo sapiens) CpG-island No: 37378
ccgaacaaccgcatcctatccctcccctccaaaacactccaaacgaaaaaaaacgaaaaaccgaccgacccgaatcacacacaattcactactctcgaactacgacgacccgcgacgatcatcgaaacaatttacaaaacgcaaccgaaaatcccacaacccgcgacgacccaaactcacgacgccgcgctcgaaattcgaaaacgcgaataccacgatccgcgaaaaaaataaaaaaacgaaactccgcgccgaccgacctctcaacttcgaaaaacgaccccgcgaaacgcccgcgaccgcgacgcctcacataaaatccctacccgccctccccgacccgaacgcgacgcgcgaaaaataaaacccctacccccgcccccacgatacgaccgcgaacccgatacccgacgctacccccgctaaatcgcccgaattctaaccacttcctccgccgcgtcctccgcgcgaacaacgcaacccgacgtccgccgcaacaccccgaacgcgcgccgataaaacgcatcccgcccccgcgccgccgtccgaaccctaaaaacctctcctaccgccccgaacgccccgacgatccccaaaaaacaccgaaccaccccgccaaccccgctccaaaatacgaacgctccccgcccgcg

SEQ ID NO: 37379 - DNA, 653 bp, Artificial Sequence
  chemically treated genomic DNA (Homo sapiens) CpG-island No: 37379
tcgagtagtcgtattttgttttttttttttagagtattttaagcggggagaagcggagggtcggtcggttcgggttatatatagtttattgttttcgggttgcggcggttcgcggcggttatcggaataatttgtaaagcgtagtcggggattttatagttcgcggcggtttaagtttacggcgtcgcgttcggagttcgggggcgcgggtattacggttcgcgagggaggtgggaagacggggtttcgcgtcggtcggttttttagtttcgggaagcgatttcgcgaagcgttcgcgatcgcggcgttttatatggagtttttgttcgtttttttcggttcggacgcggcgcgcgggaagtggagtttttgttttcgtttttacgatacggtcgcggattcggtgttcggcgttgttttcgttgggtcgttcgagttttggttatttttttcgtcgcgtttttcgcgcggatagcgtagttcggcgttcgtcgtagtatttcgagcgcgcgtcgatggggcgtatttcgttttcgcgtcgtcgttcgggttttgagagttttttttgtcgtttcgagcgtttcggcggtttttaaagagtatcgagttatttcgttagtttcgttttaggatgcgggcgtttttcgttcgcg

SEQ ID NO: 37380 - DNA, 653 bp, Artificial Sequence
  chemically treated genomic DNA (Homo sapiens) CpG-island No: 37380
cgcgaacgaaaaacgcccgcatcctaaaacgaaactaacgaaataactcgatactctttaaaaaccgccgaaacgctcgaaacgacaaaaaaaactctcaaaacccgaacgacgacgcgaaaacgaaatacgccccatcgacgcgcgctcgaaatactacgacgaacgccgaactacgctatccgcgcgaaaaacgcgacgaaaaaaataaccaaaactcgaacgacccaacgaaaacaacgccgaacaccgaatccgcgaccgtatcgtaaaaacgaaaacaaaaactccacttcccgcgcgccgcgtccgaaccgaaaaaaacgaacaaaaactccatataaaacgccgcgatcgcgaacgcttcgcgaaatcgcttcccgaaactaaaaaaccgaccgacgcgaaaccccgtcttcccacctccctcgcgaaccgtaatacccgcgcccccgaactccgaacgcgacgccgtaaacttaaaccgccgcgaactataaaatccccgactacgctttacaaattattccgataaccgccgcgaaccgccgcaacccgaaaacaataaactatatataacccgaaccgaccgaccctccgcttctccccgcttaaaatactctaaaaaaaaaaaacaaaatacgactactcga

SEQ ID NO: 37381 - DNA, 519 bp, Artificial Sequence
  chemically treated genomic DNA (Homo sapiens) CpG-island No: 37381
tcggtagaaagatcgtttggagtttttagaaggttgcggttgtttcggacgttgttgttattgtcgtttttggtcgtcggtttttttttttttttttgttttgattcgagtgattacgttatttttagttataagattcggatttgtcggttttcgcgggcggcggcgtaatagattgtagcgtttggagattttagttgtttcgtttgtcgagtatgcgtatgtttagcgtttgttttgtgcgtttcgggaagtcgggcgggagtttgcggtttcggacgtttacgatacgttgtgcgtgggggcgcggagtgcgggggatgtagtttcggttgggaggggcgtggttgaggattgtgaagtaatcggggcgaggtcgggtgtttgtttaattttttcgcgtatcgtttgttttttcggcggcggatagtgttttgtaatgtgtttttcgttgttcgagttaaaggtttttttcgacggagtttttagaatatcgtggtagaggtagacgcggttata

SEQ ID NO: 37382 - DNA, 519 bp, Artificial Sequence
  chemically treated genomic DNA (Homo sapiens) CpG-island No: 37382
tataaccgcgtctacctctaccacgatattctaaaaactccgtcgaaaaaaacctttaactcgaacaacgaaaaacacattacaaaacactatccgccgccgaaaaaacaaacgatacgcgaaaaaattaaacaaacacccgacctcgccccgattacttcacaatcctcaaccacgcccctcccaaccgaaactacatcccccgcactccgcgcccccacgcacaacgtatcgtaaacgtccgaaaccgcaaactcccgcccgacttcccgaaacgcacaaaacaaacgctaaacatacgcatactcgacaaacgaaacaactaaaatctccaaacgctacaatctattacgccgccgcccgcgaaaaccgacaaatccgaatcttataactaaaaataacgtaatcactcgaatcaaaacaaaaaaaaaaaaaaaaaccgacgaccaaaaacgacaataacaacaacgtccgaaacaaccgcaaccttctaaaaactccaaacgatctttctaccga

SEQ ID NO: 37383 - DNA, 519 bp, Artificial Sequence
  chemically treated genomic DNA (Homo sapiens) CpG-island No: 37383
tgtaatcgcgtttatttttattacggtattttaaagatttcgtcgaggaaaatttttagttcgggtaacgggagatatattatagaatattgttcgtcgtcgaagaaatagacgatacgcgggagagttgaatagatattcggtttcgtttcgattgttttatagtttttagttacgttttttttaatcggaattatatttttcgtatttcgcgtttttacgtatagcgtgtcgtaggcgttcgaagtcgtaggttttcgttcggtttttcgggacgtatagggtaggcgttgggtatgcgtatgttcggtaggcggggtagttggagtttttaggcgttgtaatttgttgcgtcgtcgttcgcgggagtcggtagattcgggttttgtggttaagagtgacgtggttattcgaattaaaatagaggagggggaggaagtcggcggttagaaacggtagtggtagtagcgttcggagtagtcgtagttttttggaagttttaggcggtttttttgtcga

SEQ ID NO: 37384 - DNA, 519 bp, Artificial Sequence
  chemically treated genomic DNA (Homo sapiens) CpG-island No: 37384
tcgacaaaaaaaccgcctaaaacttccaaaaaactacgactactccgaacgctactaccactaccgtttctaaccgccgacttcctccccctcctctattttaattcgaataaccacgtcactcttaaccacaaaacccgaatctaccgactcccgcgaacgacgacgcaacaaattacaacgcctaaaaactccaactaccccgcctaccgaacatacgcatacccaacgcctaccctatacgtcccgaaaaaccgaacgaaaacctacgacttcgaacgcctacgacacgctatacgtaaaaacgcgaaatacgaaaaatataattccgattaaaaaaaacgtaactaaaaactataaaacaatcgaaacgaaaccgaatatctattcaactctcccgcgtatcgtctatttcttcgacgacgaacaatattctataatatatctcccgttacccgaactaaaaattttcctcgacgaaatctttaaaataccgtaataaaaataaacgcgattaca

SEQ ID NO: 37385 - DNA, 514 bp, Artificial Sequence
  chemically treated genomic DNA (Homo sapiens) CpG-island No: 37385
tcgatttgtagttagttttcgcgagagtttagggcgcgaggtgttgggattttttttaggtggagagatgttgttcgtagacgtgattttcggttggtttgtttcgggtaatattttgtatcgtttaaattatatgtgcgattcggttattggtcggagttgggcgattagttttttatttttgttattttagattttagtttagggatgagtttacgcgaaacgaaatcgttttttttgtttttttttttttttttttcgttttttttatttattatttttttgacgtagattttaagttaaattttcggtttggaggacgattttcggagcgaggtatgaaggcgttcgttgggaggtagaggggtgcgtgaagcggggtttcgtggtttttttgtttcggtgtcggagggagacggagaaaaaatgggaggaaggcggattcggggtcgttgagcggtgggttttgtcgtagtgttttttcgttttttgttttagtagtttttgttttatg

SEQ ID NO: 37386 - DNA, 514 bp, Artificial Sequence
  chemically treated genomic DNA (Homo sapiens) CpG-island No: 37386
cataaaacaaaaactactaaaacaaaaaacgaaaaaacactacgacaaaacccaccgctcaacgaccccgaatccgccttcctcccattttttctccgtctccctccgacaccgaaacaaaaaaaccacgaaaccccgcttcacgcacccctctacctcccaacgaacgccttcatacctcgctccgaaaatcgtcctccaaaccgaaaatttaacttaaaatctacgtcaaaaaaataataaataaaaaaaacgaaaaaaaaaaaaaaaaaaacaaaaaaaacgatttcgtttcgcgtaaactcatccctaaactaaaatctaaaataacaaaaataaaaaactaatcgcccaactccgaccaataaccgaatcgcacatataatttaaacgatacaaaatattacccgaaacaaaccaaccgaaaatcacgtctacgaacaacatctctccacctaaaaaaaatcccaacacctcgcgccctaaactctcgcgaaaactaactacaaatcga

SEQ ID NO: 37387 - DNA, 514 bp, Artificial Sequence
  chemically treated genomic DNA (Homo sapiens) CpG-island No: 37387
tatggggtagaggttgttggagtaggaggcgagagaatattgcggtagaatttatcgtttagcggtttcggattcgttttttttttatttttttttcgttttttttcggtatcggagtaggaggattacggggtttcgttttacgtatttttttgttttttaacgggcgtttttatgtttcgtttcgggaatcgttttttaagtcgaggatttggtttggggtttgcgttagggagatagtgggtgaggggggcgggggggaggagggaggaggtagggagagcgatttcgtttcgcgtgagtttatttttgggttgaggtttgaagtggtaggagtggaaagttgatcgtttagtttcggttagtggtcggatcgtatatgtaatttagacggtgtaaaatattgttcggagtaaattaatcgggggttacgtttgcgggtagtatttttttatttgaggaaggttttagtatttcgcgttttgggttttcgcggaggttggttataggtcgg

SEQ ID NO: 37388 - DNA, 514 bp, Artificial Sequence
  chemically treated genomic DNA (Homo sapiens) CpG-island No: 37388
ccgacctataaccaacctccgcgaaaacccaaaacgcgaaatactaaaaccttcctcaaataaaaaaatactacccgcaaacgtaacccccgattaatttactccgaacaatattttacaccgtctaaattacatatacgatccgaccactaaccgaaactaaacgatcaactttccactcctaccacttcaaacctcaacccaaaaataaactcacgcgaaacgaaatcgctctccctacctcctccctcctcccccccgcccccctcacccactatctccctaacgcaaaccccaaaccaaatcctcgacttaaaaaacgattcccgaaacgaaacataaaaacgcccgttaaaaaacaaaaaaatacgtaaaacgaaaccccgtaatcctcctactccgataccgaaaaaaaacgaaaaaaaaataaaaaaaaaacgaatccgaaaccgctaaacgataaattctaccgcaatattctctcgcctcctactccaacaacctctaccccata

SEQ ID NO: 37389 - DNA, 560 bp, Artificial Sequence
  chemically treated genomic DNA (Homo sapiens) CpG-island No: 37389
  misc_feature (421)..(421): n is either a, c, g or t
aggttgtcggatgcggcgtaaacgttttattcggtttacggagggtgcgggaatttgtaggtttgataagacgcgtttttttcgtattaggtagtcggtattattgtcggatgcggcgtaaacgttttattcggtttacggagggtgcgggaatttgtaggtttgataagacgcgtaagcgtcgtattaggtagtcggtatcgttgtcggatgcggcgtaaacgttttattcggtttacggatggtgcgggaatttgtaggtttgataagacgcgtaagcgtcgtattaggtagttggtattgttgtcggatgcggcgtaaacgttttattcggtttacggagggtgcgggaatttgtaggtttgataagacgcgtaagcgtcgtattaggtagtcggtatcgttgtcggatgcggcgtanacgttttattcggtttacggagggtgcgggaatttgtaggtttgataagacgcgtaagcgtcgtattaggtatttggtatcgttgtcggatgcggcgcgagcgtttttattcgtttatcgattataatataattagttt

SEQ ID NO: 37390 - DNA, 560 bp, Artificial Sequence
  chemically treated genomic DNA (Homo sapiens) CpG-island No: 37390
  misc_feature (140)..(140): n is either a, c, g or t
aaactaattatattataatcgataaacgaataaaaacgctcgcgccgcatccgacaacgataccaaatacctaatacgacgcttacgcgtcttatcaaacctacaaattcccgcaccctccgtaaaccgaataaaacgtntacgccgcatccgacaacgataccgactacctaatacgacgcttacgcgtcttatcaaacctacaaattcccgcaccctccgtaaaccgaataaaacgtttacgccgcatccgacaacaataccaactacctaatacgacgcttacgcgtcttatcaaacctacaaattcccgcaccatccgtaaaccgaataaaacgtttacgccgcatccgacaacgataccgactacctaatacgacgcttacgcgtcttatcaaacctacaaattcccgcaccctccgtaaaccgaataaaacgtttacgccgcatccgacaataataccgactacctaatacgaaaaaaacgcgtcttatcaaacctacaaattcccgcaccctccgtaaaccgaataaaacgtttacgccgcatccgacaacct

SEQ ID NO: 37391 - DNA, 560 bp, Artificial Sequence
  chemically treated genomic DNA (Homo sapiens) CpG-island No: 37391
  misc_feature (140)..(140): n is either a, c, g or t
gaattgattgtattgtgatcggtaagcggataaaggcgttcgcgtcgtattcggtaacggtgttagatgtttgatgcgacgtttgcgcgttttattaggtttataaattttcgtatttttcgtaggtcggataaggcgtntacgtcgtattcggtaacggtgtcgattgtttgatgcgacgtttgcgcgttttattaggtttataaattttcgtatttttcgtaggtcggataaggcgtttacgtcgtattcggtaatagtgttaattgtttgatgcgacgtttgcgcgttttattaggtttataaattttcgtattattcgtaggtcggataaggcgtttacgtcgtattcggtaacggtgtcgattgtttgatgcgacgtttgcgcgttttattaggtttataaattttcgtatttttcgtaggtcggataaggcgtttacgtcgtattcggtaatggtgtcgattgtttgatgcgaagaaagcgcgttttattaggtttataaattttcgtatttttcgtaggtcggataaggcgtttacgtcgtattcggtaattt

SEQ ID NO: 37392 - DNA, 560 bp, Artificial Sequence
  chemically treated genomic DNA (Homo sapiens) CpG-island No: 37392
  misc_feature (421)..(421): n is either a, c, g or t
aaattaccgaatacgacgtaaacgccttatccgacctacgaaaaatacgaaaatttataaacctaataaaacgcgctttcttcgcatcaaacaatcgacaccattaccgaatacgacgtaaacgccttatccgacctacgaaaaatacgaaaatttataaacctaataaaacgcgcaaacgtcgcatcaaacaatcgacaccgttaccgaatacgacgtaaacgccttatccgacctacgaataatacgaaaatttataaacctaataaaacgcgcaaacgtcgcatcaaacaattaacactattaccgaatacgacgtaaacgccttatccgacctacgaaaaatacgaaaatttataaacctaataaaacgcgcaaacgtcgcatcaaacaatcgacaccgttaccgaatacgacgtanacgccttatccgacctacgaaaaatacgaaaatttataaacctaataaaacgcgcaaacgtcgcatcaaacatctaacaccgttaccgaatacgacgcgaacgcctttatccgcttaccgatcacaatacaatcaattc

SEQ ID NO: 37393 - DNA, 617 bp, Artificial Sequence
  chemically treated genomic DNA (Homo sapiens) CpG-island No: 37393
gtcgtatttagggtatggaaaaatggttggcgaattttgagttgttggaagtcgatgtagatgcggaatacgcggtagtgatcgatatcgatttggcggatattaaagagttaattttgtgtgtttcgaacgattcggatgtacgcgcgttcgttgtttgcggtataggtgagaagatcgacgaagtgttatcggtttttgtatgattaatatcggttattttcgtgttgcgggtaaattgttggatgcgtataaaggttagttgtcgattcgtttgtgggtggtatcgttaattcgtatggacgtcgtatagttgatcgaagaaggttattatagcgttttcggtaagagtggtgcgcgtatcgagatttttggttgttttttgtgtatgggtaattaggcgcgtgtggcggacggtgtaacggtggtttttatttttattcgtaatttttcgaatcgtttgggtattggcgcgaatgtttttttggtttttgcggaattggcggttgttgcggcgttgattggtaaattgtcgacgtcggaagagtattagatttacgtggcgtaggtagataaaatagtcgttgatatttatcgttatttgaattttaattagt

SEQ ID NO: 37394 - DNA, 617 bp, Artificial Sequence
  chemically treated genomic DNA (Homo sapiens) CpG-island No: 37394
actaattaaaattcaaataacgataaatatcaacgactattttatctacctacgccacgtaaatctaatactcttccgacgtcgacaatttaccaatcaacgccgcaacaaccgccaattccgcaaaaaccaaaaaaacattcgcgccaatacccaaacgattcgaaaaattacgaataaaaataaaaaccaccgttacaccgtccgccacacgcgcctaattacccatacacaaaaaacaaccaaaaatctcgatacgcgcaccactcttaccgaaaacgctataataaccttcttcgatcaactatacgacgtccatacgaattaacgataccacccacaaacgaatcgacaactaacctttatacgcatccaacaatttacccgcaacacgaaaataaccgatattaatcatacaaaaaccgataacacttcgtcgatcttctcacctataccgcaaacaacgaacgcgcgtacatccgaatcgttcgaaacacacaaaattaactctttaatatccgccaaatcgatatcgatcactaccgcgtattccgcatctacatcgacttccaacaactcaaaattcgccaaccatttttccataccctaaatacgac

SEQ ID NO: 37395 - DNA, 617 bp, Artificial Sequence
  chemically treated genomic DNA (Homo sapiens) CpG-island No: 37395
gttggttgaagtttagataacggtaagtattaacggttgttttatttatttgcgttacgtaggtttggtattttttcggcgtcggtagtttgttaattagcgtcgtaatagtcgttagtttcgtagaagttaggaagatattcgcgttagtatttagacggttcgggaagttacgggtagaggtggaaattatcgttgtatcgttcgttatacgcgtttggttatttatatatagggaatagttagggatttcgatacgcgtattatttttatcgaagacgttgtagtagtttttttcggttaattgtgcggcgtttatacgggttggcggtgttatttataggcgggtcggtaattgatttttatgcgtatttagtagtttattcgtagtacggaagtgatcgatgttggttatgtaggaatcgataatatttcgtcgatttttttatttgtatcgtagatagcggacgcgcgtatattcgggtcgttcggagtatataggattggttttttaatattcgttagatcgatgtcgattattgtcgcgtatttcgtatttgtatcggtttttagtagtttaggattcgttagttatttttttatgttttgaatacgat

SEQ ID NO: 37396 - DNA, 617 bp, Artificial Sequence
  chemically treated genomic DNA (Homo sapiens) CpG-island No: 37396
atcgtattcaaaacataaaaaaataactaacgaatcctaaactactaaaaaccgatacaaatacgaaatacgcgacaataatcgacatcgatctaacgaatattaaaaaaccaatcctatatactccgaacgacccgaatatacgcgcgtccgctatctacgatacaaataaaaaaatcgacgaaatattatcgattcctacataaccaacatcgatcacttccgtactacgaataaactactaaatacgcataaaaatcaattaccgacccgcctataaataacaccgccaacccgtataaacgccgcacaattaaccgaaaaaaactactacaacgtcttcgataaaaataatacgcgtatcgaaatccctaactattccctatatataaataaccaaacgcgtataacgaacgatacaacgataatttccacctctacccgtaacttcccgaaccgtctaaatactaacgcgaatatcttcctaacttctacgaaactaacgactattacgacgctaattaacaaactaccgacgccgaaaaaataccaaacctacgtaacgcaaataaataaaacaaccgttaatacttaccgttatctaaacttcaaccaac

SEQ ID NO: 37397 - DNA, 828 bp, Artificial Sequence
  chemically treated genomic DNA (Homo sapiens) CpG-island No: 37397
  misc_feature (825)..(825): n is either a, c, g or t
attattcgcgatcgtttgatagattcggtaaggtattgtcgcgcggtgtaatcggagcgtttttattgcgtatcgttttcgtttgcggcgttagttggattattgttttttttagtattatttgtttaacgtttagttgatgatttagtagtggtaaaagcgttacgtttagacgtatgttgtcggcgcgaattagtggttggtttgcgttttgggcggtgagagatattcgttcggagaggatattaagttgcggttagacgtgttaacgtagtggttcgtcgagttgtaattgataatcgttacgtgtagtaatttgtttgattatatagtcgcggaaattattcggatttattagtaatattaacgtagatattcggttattagtacgattaggagtattattagcgtcgttagaaatcgttttatggtatttttaatgggtttgaattagtttttatcgattcggttggttatcgcgttttgttggttgcgatatttcgtatttttacggcggttgtaaggtcgtatcgtcgggtcggaaagcggtttaaagtttagcgtattaattaatatgttcggacgtagcgttagcggtagtttatcggagttgtagaattttagtataatgtaattagattagttcggatcgatgcggtgcgcggtgacgtgtattattagttttagacgcgttagtgaggaacgttcgtttagttagtttattagatcggttggtagcgttatcgattttagcgttatcgttagcgttagtttttttggggtgaagatagaacgtttttgtttcgtcgagaacgattttatcgntta

SEQ ID NO: 37398 - DNA, 828 bp, Artificial Sequence
  chemically treated genomic DNA (Homo sapiens) CpG-island No: 37398
  misc_feature (4)..(4): n is either a, c, g or t
taancgataaaatcgttctcgacgaaacaaaaacgttctatcttcaccccaaaaaaactaacgctaacgataacgctaaaatcgataacgctaccaaccgatctaataaactaactaaacgaacgttcctcactaacgcgtctaaaactaataatacacgtcaccgcgcaccgcatcgatccgaactaatctaattacattatactaaaattctacaactccgataaactaccgctaacgctacgtccgaacatattaattaatacgctaaactttaaaccgctttccgacccgacgatacgaccttacaaccgccgtaaaaatacgaaatatcgcaaccaacaaaacgcgataaccaaccgaatcgataaaaactaattcaaacccattaaaaataccataaaacgatttctaacgacgctaataatactcctaatcgtactaataaccgaatatctacgttaatattactaataaatccgaataatttccgcgactatataatcaaacaaattactacacgtaacgattatcaattacaactcgacgaaccactacgttaacacgtctaaccgcaacttaatatcctctccgaacgaatatctctcaccgcccaaaacgcaaaccaaccactaattcgcgccgacaacatacgtctaaacgtaacgcttttaccactactaaatcatcaactaaacgttaaacaaataatactaaaaaaaacaataatccaactaacgccgcaaacgaaaacgatacgcaataaaaacgctccgattacaccgcgcgacaataccttaccgaatctatcaaacgatcgcgaataat

SEQ ID NO: 37399 - DNA, 828 bp, Artificial Sequence
  chemically treated genomic DNA (Homo sapiens) CpG-island No: 37399
  misc_feature (4)..(4): n is either a, c, g or t
tgancgatgagatcgttttcgacgaggtagaggcgttttatttttattttaggagagttggcgttggcggtgacgttggagtcggtgacgttgttagtcgatttggtgggttggttggacgggcgttttttattggcgcgtttggggttgatggtgtacgttatcgcgtatcgtatcgattcgggttggtttggttgtattgtgttggagttttataatttcggtaagttgtcgttggcgttgcgttcgggtatgttaattggtgcgttgagttttgagtcgtttttcggttcggcggtgcgattttataatcgtcgtgaagatgcgaaatatcgtaattagtagggcgcggtagttagtcgaatcgataaagattaatttaggtttattgaggatattatgagacgatttttgacgacgttgatgatatttttggtcgtgttggtggtcgggtatttgcgttagtgttgttggtgaattcgaatgattttcgcgattatatggttaagtaagttgttgtacgtagcggttattaattgtagttcgacgggttattgcgttggtacgtttggtcgtagtttagtatttttttcgggcgaatgttttttatcgtttagggcgtaagttagttattggttcgcgtcgataatatgcgtttggacgtggcgtttttattattattgagttattaattgagcgttaagtaggtgatgttaaaaggggtagtgatttaattgacgtcgtagacggaagcggtgcgtagtgaagacgtttcggttgtatcgcgcgataatattttgtcggatttgttagacgatcgcggatggt

SEQ ID NO: 37400 - DNA, 828 bp, Artificial Sequence
  chemically treated genomic DNA (Homo sapiens) CpG-island No: 37400
  misc_feature (825)..(825): n is either a, c, g or t
accatccgcgatcgtctaacaaatccgacaaaatattatcgcgcgatacaaccgaaacgtcttcactacgcaccgcttccgtctacgacgtcaattaaatcactaccccttttaacatcacctacttaacgctcaattaataactcaataataataaaaacgccacgtccaaacgcatattatcgacgcgaaccaataactaacttacgccctaaacgataaaaaacattcgcccgaaaaaaatactaaactacgaccaaacgtaccaacgcaataacccgtcgaactacaattaataaccgctacgtacaacaacttacttaaccatataatcgcgaaaatcattcgaattcaccaacaacactaacgcaaatacccgaccaccaacacgaccaaaaatatcatcaacgtcgtcaaaaatcgtctcataatatcctcaataaacctaaattaatctttatcgattcgactaactaccgcgccctactaattacgatatttcgcatcttcacgacgattataaaatcgcaccgccgaaccgaaaaacgactcaaaactcaacgcaccaattaacatacccgaacgcaacgccaacgacaacttaccgaaattataaaactccaacacaatacaaccaaaccaacccgaatcgatacgatacgcgataacgtacaccatcaaccccaaacgcgccaataaaaaacgcccgtccaaccaacccaccaaatcgactaacaacgtcaccgactccaacgtcaccgccaacgccaactctcctaaaataaaaataaaacgcctctacctcgtcgaaaacgatctcatcgntca

SEQ ID NO: 37401 - DNA, 629 bp, Artificial Sequence
  chemically treated genomic DNA (Homo sapiens) CpG-island No: 37401
ggcggcgcggaataaacgatataatttaggaaattagagaagttagtatacggaatatgttttttatcgaagaaggcgtaaatttcgttagatggcggtagttacggaagtcgagttttagaatatttagtagattttttagcggtttatttttcgggtagttgttttgttagagcgtttatgtattcgtacgggtaaacgtatattgtataaaatcgatatgttgttgggtggtgagcggtattaattttagtttaattttattatttattacgcgcgttatttgggtcgggaagacgtatttttgttgatcgcgtttaagtaatagatttattttttggttttttagaatttgcgtttgatcgttgattttgatttttacgatagcgtcggagaaatttgaacggtatcgagaagaggtggtttttcgggggtaatgtcggggtattgtattttaaggggggaacgggaatcgtgggttaacgatacggatggtgcgtaaaaaagggtgttatttttttttgtgttcgggaattatattggggtcgaaagtgtagttacgagttttattatgagaaattgtcgatataagattttattcgggggaaatgtgttagtttaggtaatat

SEQ ID NO: 37402 - DNA, 629 bp, Artificial Sequence
  chemically treated genomic DNA (Homo sapiens) CpG-island No: 37402
atattacctaaactaacacatttcccccgaataaaatcttatatcgacaatttctcataataaaactcgtaactacactttcgaccccaatataattcccgaacacaaaaaaaaataacacccttttttacgcaccatccgtatcgttaacccacgattcccgttccccccttaaaatacaataccccgacattacccccgaaaaaccacctcttctcgataccgttcaaatttctccgacgctatcgtaaaaatcaaaatcaacgatcaaacgcaaattctaaaaaaccaaaaaataaatctattacttaaacgcgatcaacaaaaatacgtcttcccgacccaaataacgcgcgtaataaataataaaattaaactaaaattaataccgctcaccacccaacaacatatcgattttatacaatatacgtttacccgtacgaatacataaacgctctaacaaaacaactacccgaaaaataaaccgctaaaaaatctactaaatattctaaaactcgacttccgtaactaccgccatctaacgaaatttacgccttcttcgataaaaaacatattccgtatactaacttctctaatttcctaaattatatcgtttattccgcgccgcc

SEQ ID NO: 37403 - DNA, 629 bp, Artificial Sequence
  chemically treated genomic DNA (Homo sapiens) CpG-island No: 37403
gtgttatttgggttaatatatttttttcgggtgaaattttgtgtcggtaattttttataatggggttcgtaattgtattttcggttttagtatggttttcgggtataaggaggggtgatatttttttttgcgtattattcgtatcgttaatttacggttttcgttttttttttgaaatataatgtttcggtattgttttcgagaggttattttttttcggtatcgtttagattttttcgacgttgtcgtggggattaagattaacggttaggcgtagattttgaaaggttagaaagtgaatttgttgtttaaacgcggttagtaggaatacgttttttcgatttaggtggcgcgcgtgatgggtaatgaagttgggttgaaattaatgtcgtttattatttagtaatatatcgattttgtgtagtgtacgtttgttcgtgcggatatatgggcgttttggtaggatagttattcggaagataagtcgttggaaagtttgttggatattttgaagttcggttttcgtggttatcgttatttggcggagtttgcgtttttttcggtgaagggtatatttcgtgtgttgatttttttggttttttgggttgtatcgtttatttcgcgtcgtt

SEQ ID NO: 37404 - DNA, 629 bp, Artificial Sequence
  chemically treated genomic DNA (Homo sapiens) CpG-island No: 37404
aacgacgcgaaataaacgatacaacccaaaaaaccaaaaaaatcaacacacgaaatatacccttcaccgaaaaaaacgcaaactccgccaaataacgataaccacgaaaaccgaacttcaaaatatccaacaaactttccaacgacttatcttccgaataactatcctaccaaaacgcccatatatccgcacgaacaaacgtacactacacaaaatcgatatattactaaataataaacgacattaatttcaacccaacttcattacccatcacgcgcgccacctaaatcgaaaaaacgtattcctactaaccgcgtttaaacaacaaattcactttctaacctttcaaaatctacgcctaaccgttaatcttaatccccacgacaacgtcgaaaaaatctaaacgataccgaaaaaaaataacctctcgaaaacaataccgaaacattatatttcaaaaaaaaaacgaaaaccgtaaattaacgatacgaataatacgcaaaaaaaaatatcacccctccttatacccgaaaaccatactaaaaccgaaaatacaattacgaaccccattataaaaaattaccgacacaaaatttcacccgaaaaaaatatattaacccaaataacac

SEQ ID NO: 37405 - DNA, 581 bp, Artificial Sequence
  chemically treated genomic DNA (Homo sapiens) CpG-island No: 37405
  misc_feature (274)..(274): n is either a, c, g or t
  misc_feature (374)..(374): n is either a, c, g or t
  misc_feature (389)..(389): n is either a, c, g or t
tagaacgggcgtggagtaattgggttagacgttatgggttagcgtcggaagaggtgttggtttttatttacggtaaataggcgattatttttttgcgttattttatggcgggtaaattcgaggttgatattgtcgtcgagtttacgcgtttggagtatatcgaggttacggaaatcgaaggtattatcgcgttttcgggggtaatcgttttatttagttatttgaataaagtaggtatttcgtgggttattgtgatttttggttttatgtcggntgcgcgagcgcgttataaaatagttgggtttttcgtattagaggtgtttgtaatcgttgagcgagtgaagcgcggaaaattagaatttgatgcgtatttnttaggcgcgtagttnttggggtttgcgtcgtaggagtgtgtggtggtggaagatgttttcgttggcgtgttttttggtttggcggcgggttgttatgttattgcggttaacgtttcggtagatatttcgcgtttgaatgaggtcgatttggttttttatagtttggagtaaattattgtgattaaatagttaatggcgaatttttat

SEQ ID NO: 37406 - DNA, 581 bp, Artificial Sequence
  chemically treated genomic DNA (Homo sapiens) CpG-island No: 37406
  misc_feature (193)..(193): n is either a, c, g or t
  misc_feature (208)..(208): n is either a, c, g or t
  misc_feature (308)..(308): n is either a, c, g or t
ataaaaattcgccattaactatttaatcacaataatttactccaaactataaaaaaccaaatcgacctcattcaaacgcgaaatatctaccgaaacgttaaccgcaataacataacaacccgccgccaaaccaaaaaacacgccaacgaaaacatcttccaccaccacacactcctacgacgcaaaccccaanaactacgcgcctaanaaatacgcatcaaattctaattttccgcgcttcactcgctcaacgattacaaacacctctaatacgaaaaacccaactattttataacgcgctcgcgcanccgacataaaaccaaaaatcacaataacccacgaaatacctactttattcaaataactaaataaaacgattacccccgaaaacgcgataataccttcgatttccgtaacctcgatatactccaaacgcgtaaactcgacgacaatatcaacctcgaatttacccgccataaaataacgcaaaaaaataatcgcctatttaccgtaaataaaaaccaacacctcttccgacgctaacccataacgtctaacccaattactccacgcccgttcta

SEQ ID NO: 37407 - DNA, 581 bp, Artificial Sequence
  chemically treated genomic DNA (Homo sapiens) CpG-island No: 37407
  misc_feature (193)..(193): n is either a, c, g or t
  misc_feature (208)..(208): n is either a, c, g or t
  misc_feature (308)..(308): n is either a, c, g or t
ataaaaattcgttattggttgtttggttatagtaatttgttttagattgtggaggattaaatcgattttatttaggcgcggggtatttgtcggagcgttaatcgtaatgatatgataattcgtcgttaggttagaaagtacgttagcgggagtattttttattattatatatttttgcggcgtaagttttagnagttgcgcgtttaanagatacgtattaggttttggtttttcgcgttttattcgtttagcggttataaatatttttggtgcgggaagtttagttattttatggcgcgttcgcgtantcggtatggagttagaagttataatggtttacggaatatttgttttatttaaatgattgagtaaggcgattgttttcggaagcgcggtaatattttcggttttcgtggtttcgatgtgttttagacgcgtaaattcggcggtaatattagtttcggatttgttcgttataaaatggcgtagagaggtgatcgtttgtttatcgtgaatgaaagttagtatttttttcggcgttaatttatgacgtttggtttagttgttttacgttcgtttta

SEQ ID NO: 37408 - DNA, 581 bp, Artificial Sequence
  chemically treated genomic DNA (Homo sapiens) CpG-island No: 37408
  misc_feature (274)..(274): n is either a, c, g or t
  misc_feature (374)..(374): n is either a, c, g or t
  misc_feature (389)..(389): n is either a, c, g or t
taaaacgaacgtaaaacaactaaaccaaacgtcataaattaacgccgaaaaaaatactaactttcattcacgataaacaaacgatcacctctctacgccattttataacgaacaaatccgaaactaatattaccgccgaatttacgcgtctaaaacacatcgaaaccacgaaaaccgaaaatattaccgcgcttccgaaaacaatcgccttactcaatcatttaaataaaacaaatattccgtaaaccattataacttctaactccataccgantacgcgaacgcgccataaaataactaaacttcccgcaccaaaaatatttataaccgctaaacgaataaaacgcgaaaaaccaaaacctaatacgtatctnttaaacgcgcaactnctaaaacttacgccgcaaaaatatataataataaaaaatactcccgctaacgtactttctaacctaacgacgaattatcatatcattacgattaacgctccgacaaataccccgcgcctaaataaaatcgatttaatcctccacaatctaaaacaaattactataaccaaacaaccaataacgaatttttat

SEQ ID NO: 37409 - DNA, 533 bp, Artificial Sequence
  chemically treated genomic DNA (Homo sapiens) CpG-island No: 37409
  misc_feature (232)..(232): n is either a, c, g or t
gcgtcgttacgcgtatcgttaggtagacgtttataggttttatgtgttttttgtatttgtttttagtttagttttacgtttagatcgggcgtattaggaacggtaattttttcgtttttaatttttagcggattttggggttaggcgataatcgtttttttgttaaatttagtgggtatcgatagcggtaggattattcggtgtcgtcgcgtttatatgggttaatatcgtncgagagatatcgaaatggttattagaatggtagttttaggttagtttttagtcgtcgtaaagttgcgttatacggattgtatcggaaagcgtttagaagtgcggatcggtaagtggaatatttatcgtattgagtattatcgtatgatttatttcgcgttagttggtggcgattatgttagtcgcgacgggtaagtcggtcgttcgtcgaaatttcgttattattttacgttcggagaagttttgttttgcgtcgtatggattttcggtatatgttagaatatttatttagttttttgtat

SEQ ID NO: 37410 - DNA, 533 bp, Artificial Sequence
  chemically treated genomic DNA (Homo sapiens) CpG-island No: 37410
  misc_feature (302)..(302): n is either a, c, g or t
atacaaaaaactaaataaatattctaacatataccgaaaatccatacgacgcaaaacaaaacttctccgaacgtaaaataataacgaaatttcgacgaacgaccgacttacccgtcgcgactaacataatcgccaccaactaacgcgaaataaatcatacgataatactcaatacgataaatattccacttaccgatccgcacttctaaacgctttccgatacaatccgtataacgcaactttacgacgactaaaaactaacctaaaactaccattctaataaccatttcgatatctctcgnacgatattaacccatataaacgcgacgacaccgaataatcctaccgctatcgatacccactaaatttaacaaaaaaacgattatcgcctaaccccaaaatccgctaaaaattaaaaacgaaaaaattaccgttcctaatacgcccgatctaaacgtaaaactaaactaaaaacaaatacaaaaaacacataaaacctataaacgtctacctaacgatacgcgtaacgacgc

SEQ ID NO: 37411 - DNA, 533 bp, Artificial Sequence
  chemically treated genomic DNA (Homo sapiens) CpG-island No: 37411
  misc_feature (302)..(302): n is either a, c, g or t
atgtaaagggttgaatagatgttttaatatatgtcgaagatttatgcggcgtagaatagggttttttcggacgtgaagtgatggcggaatttcgacgggcgatcggtttgttcgtcgcgattaatatgatcgttattaattggcgcgaaatgggttatgcggtgatgtttaatgcggtagatattttatttgtcgattcgtatttttggacgtttttcggtgtagttcgtgtggcgtagttttgcgacgattgggggttgatttggggttgttattttaataattatttcgatatttttcgngcgatgttaatttatgtgggcgcggcggtatcgggtaattttatcgttatcgatatttattggatttggtaggagggcgattgtcgtttgattttaaaattcgttggagattaaaaacggaaaaattgtcgtttttgatgcgttcggtttgggcgtggaattggattgggaataggtataaaaggtatatgaggtttataaacgtttgtttggcggtgcgcgtaacgacgt

SEQ ID NO: 37412 - DNA, 533 bp, Artificial Sequence
  chemically treated genomic DNA (Homo sapiens) CpG-island No: 37412
  misc_feature (232)..(232): n is either a, c, g or t
acgtcgttacgcgcaccgccaaacaaacgtttataaacctcatataccttttatacctattcccaatccaattccacgcccaaaccgaacgcatcaaaaacgacaatttttccgtttttaatctccaacgaattttaaaatcaaacgacaatcgccctcctaccaaatccaataaatatcgataacgataaaattacccgataccgccgcgcccacataaattaacatcgcncgaaaaatatcgaaataattattaaaataacaaccccaaatcaacccccaatcgtcgcaaaactacgccacacgaactacaccgaaaaacgtccaaaaatacgaatcgacaaataaaatatctaccgcattaaacatcaccgcataacccatttcgcgccaattaataacgatcatattaatcgcgacgaacaaaccgatcgcccgtcgaaattccgccatcacttcacgtccgaaaaaaccctattctacgccgcataaatcttcgacatatattaaaacatctattcaaccctttacat

SEQ ID NO: 37413 - DNA, 642 bp, Artificial Sequence
  chemically treated genomic DNA (Homo sapiens) CpG-island No: 37413
aacgtcgtttttgtttatcgaaaacgacgattttttagttttgattttgtcgattaagatgtagcggttggtagacgtcgcgtattttttttttagatatcgggcgatggtgtgttgtattaagttttgtgtttattatatattgttcgtcgcgggttattataaattcggttatcgattttagcgttttcgttagcgtcgtcgacgcgtcgttatgtagtaaatcgaacggttgatgagtacgggtattaatcggtatttcggtttttagtatattatcgtttagacgggtatatataatttttagatgcgttattattgtgttatcgttggtggcgtttagttcgtcgagcgttaaatggcgtttttagattatgtttatgtttttagcgttgagtcgttatcgattataatattttgtagggtaatatggttggcgaggttagaggcgaggaataaaatcgtgttggcgattttttgtggacgggcgattttttttagcggaatgtcgagtttaaattgttcgttaaagtcgcgaatacgttgtttttcggcgttatcgtttatttatagcgtgcgttgtatatcggtgtcggtggagttaggcgaaatatattatagcgtacgtcgtatcggtcgttt

SEQ ID NO: 37414 - DNA, 642 bp, Artificial Sequence
  chemically treated genomic DNA (Homo sapiens) CpG-island No: 37414
aaacgaccgatacgacgtacgctataatatatttcgcctaactccaccgacaccgatatacaacgcacgctataaataaacgataacgccgaaaaacaacgtattcgcgactttaacgaacaatttaaactcgacattccgctaaaaaaaatcgcccgtccacaaaaaatcgccaacacgattttattcctcgcctctaacctcgccaaccatattaccctacaaaatattataatcgataacgactcaacgctaaaaacataaacataatctaaaaacgccatttaacgctcgacgaactaaacgccaccaacgataacacaataataacgcatctaaaaattatatatacccgtctaaacgataatatactaaaaaccgaaataccgattaatacccgtactcatcaaccgttcgatttactacataacgacgcgtcgacgacgctaacgaaaacgctaaaatcgataaccgaatttataataacccgcgacgaacaatatataataaacacaaaacttaatacaacacaccatcgcccgatatctaaaaaaaaaatacgcgacgtctaccaaccgctacatcttaatcgacaaaatcaaaactaaaaaatcgtcgttttcgataaacaaaaacgacgtt

SEQ ID NO: 37415 - DNA, 642 bp, Artificial Sequence
  chemically treated genomic DNA (Homo sapiens) CpG-island No: 37415
gaacggtcggtacggcgtgcgttgtaatgtgtttcgtttggttttatcgatatcgatatgtaacgtacgttgtgggtgagcgatgacgtcgaagaatagcgtattcgcggttttggcgagtagtttaaattcggtatttcgttggggaaaatcgttcgtttataagagatcgttaatacgattttgtttttcgtttttgatttcgttagttatattattttataggatattgtggtcgatggcggtttaacgttgggggtataagtatgatttggaaacgttatttaacgttcgacgaattgaacgttattagcgataatataatggtggcgtatttgggaattgtgtatattcgtttgggcgatgatgtgttggaagtcgaaatgtcggttgatattcgtatttattagtcgttcggtttattatatggcggcgcgtcggcggcgttggcggaaacgttgggatcgatggtcggatttatgatgattcgcgacggatagtgtgtggtaggtatagaatttaatgtaatatattatcgttcggtgtttgagggaaaggtacgcggcgtttgttagtcgttgtattttggtcggtaaaattagagttgggaaatcgtcgttttcgatgaataggggcggcgtt

SEQ ID NO: 37416 - DNA, 642 bp, Artificial Sequence
  chemically treated genomic DNA (Homo sapiens) CpG-island No: 37416
aacgccgcccctattcatcgaaaacgacgatttcccaactctaattttaccgaccaaaatacaacgactaacaaacgccgcgtacctttccctcaaacaccgaacgataatatattacattaaattctatacctaccacacactatccgtcgcgaatcatcataaatccgaccatcgatcccaacgtttccgccaacgccgccgacgcgccgccatataataaaccgaacgactaataaatacgaatatcaaccgacatttcgacttccaacacatcatcgcccaaacgaatatacacaattcccaaatacgccaccattatattatcgctaataacgttcaattcgtcgaacgttaaataacgtttccaaatcatacttatacccccaacgttaaaccgccatcgaccacaatatcctataaaataatataactaacgaaatcaaaaacgaaaaacaaaatcgtattaacgatctcttataaacgaacgattttccccaacgaaataccgaatttaaactactcgccaaaaccgcgaatacgctattcttcgacgtcatcgctcacccacaacgtacgttacatatcgatatcgataaaaccaaacgaaacacattacaacgcacgccgtaccgaccgttc

SEQ ID NO: 37417 - DNA, 1113 bp, Artificial Sequence
  chemically treated genomic DNA (Homo sapiens) CpG-island No: 37417
gcgttggcgcgattcgtatgattattaattcgcgcgaattgtttattgttcgtagcgttgcggatgtgattgttaattttggttattttaaagaaggtttttttatgtaaatcggtatcggcggcgtatcgttggcggtaattcgttttttggaagataaaatgcgtagtcgcgatattcgcgtcgatttcgtttttggcggtattatcgcgacgatggttgatttgtacgaaaaaggtttgattcgtaaattgttggatgtgtagagttttgatagttatgttgcgtaatcgttggttcgtaattttaattatatcgaaattagcgttaattagtacgttattggggttcgaaaggcgtatcggttgatcgtttcgacgtggtggtattgagcgcgttggaaattgatatttagtttaacgttaacgtgttgatcggttttgacggcgtattgcgtggtgttttcggtggttattgcgatatcgcgattgtttttgcgttttttattatcgtcgcgtcgttggtacgcggtcgtatttcgattttggtggatacgtattgatttgtattattttaggttttagtgtcgatattttggttatagattacggtatcgtagttaattcggtacgttcggaattggtagaacgtttgtaggaagcgggtattaaagtggtttttattgagtggttgcgcgaacgtgcgcgtttgttgatcggtgaattatagtcgattgaatttatagatcgcgtcgttgtcgttgtgcgttatcgcgatggttcggtgatcgatgttgtgtattaggtgaaggaataagttatgtatttgttttttgaattcgttagttattatgcggtattaattttcgagttgttcgttagtcgggatgaaaggtaagtacggtaatacgtttggtttaagcgttattttgttttattggttttttttatcgtggttgcgtttgggtcgattaaagatagcgaggttatacgtcgaatttttaattatggcgtgatagttttgcgtgttttagtcgtaaaatagggttggtaaatttaggagtaggttgtattggttttcgttagcgggtcggagggtatgttgagtattggt

SEQ ID NO: 37418 - DNA, 1113 bp, Artificial Sequence
  chemically treated genomic DNA (Homo sapiens) CpG-island No: 37418
accaatactcaacataccctccgacccgctaacgaaaaccaatacaacctactcctaaatttaccaaccctattttacgactaaaacacgcaaaactatcacgccataattaaaaattcgacgtataacctcgctatctttaatcgacccaaacgcaaccacgataaaaaaaaccaataaaacaaaataacgcttaaaccaaacgtattaccgtacttacctttcatcccgactaacgaacaactcgaaaattaataccgcataataactaacgaattcaaaaaacaaatacataacttattccttcacctaatacacaacatcgatcaccgaaccatcgcgataacgcacaacgacaacgacgcgatctataaattcaatcgactataattcaccgatcaacaaacgcgcacgttcgcgcaaccactcaataaaaaccactttaatacccgcttcctacaaacgttctaccaattccgaacgtaccgaattaactacgataccgtaatctataaccaaaatatcgacactaaaacctaaaataatacaaatcaatacgtatccaccaaaatcgaaatacgaccgcgtaccaacgacgcgacgataataaaaaacgcaaaaacaatcgcgatatcgcaataaccaccgaaaacaccacgcaatacgccgtcaaaaccgatcaacacgttaacgttaaactaaatatcaatttccaacgcgctcaataccaccacgtcgaaacgatcaaccgatacgcctttcgaaccccaataacgtactaattaacgctaatttcgatataattaaaattacgaaccaacgattacgcaacataactatcaaaactctacacatccaacaatttacgaatcaaacctttttcgtacaaatcaaccatcgtcgcgataataccgccaaaaacgaaatcgacgcgaatatcgcgactacgcattttatcttccaaaaaacgaattaccgccaacgatacgccgccgataccgatttacataaaaaaaccttctttaaaataaccaaaattaacaatcacatccgcaacgctacgaacaataaacaattcgcgcgaattaataatcatacgaatcgcgccaacgc

SEQ ID NO: 37419 - DNA, 1113 bp, Artificial Sequence
  chemically treated genomic DNA (Homo sapiens) CpG-island No: 37419
gttaatgtttaatatgtttttcggttcgttggcggaaattagtgtagtttgtttttgaatttgttagttttgttttgcggttaaggtacgtaaggttgttacgttatgattaaaaattcggcgtgtgatttcgttgtttttaatcggtttaggcgtaattacggtaaaggagattagtggaataggatggcgtttgagttagacgtgttgtcgtgtttgttttttatttcggttgacgagtagttcgggaattgatatcgtatggtggttggcgagtttaggaagtaggtgtatggtttatttttttatttgatgtataatatcgattatcgagttatcgcggtaacgtataacggtaacgacgcggtttgtgaatttaatcggttgtggtttatcggttagtagacgcgtacgttcgcgtagttatttaatggaaattattttaatgttcgttttttgtagacgttttgttagtttcggacgtgtcgggttaattgcgatatcgtggtttgtgattagaatatcgatattggagtttggggtgatgtaggttagtacgtatttattagagtcggaatacgatcgcgtattagcggcgcgacgatgatggaaagcgtagaggtaatcgcggtatcgtagtgattatcggaagtattacgtagtacgtcgttagagtcggttagtacgttaacgttgaattgggtgttaatttttagcgcgtttagtattattacgtcgagacgattaatcgatgcgtttttcgaattttagtagcgtattggttggcgttgatttcgatgtgattggggttacgggttagcgattgcgtagtatggttgttaaagttttgtatatttagtagtttgcggattagatttttttcgtgtaggttaattatcgtcgcggtaatatcgttaagggcgaagtcggcgcgaatatcgcggttacgtattttgttttttaggaaacgggttatcgttagcgatgcgtcgtcggtgtcggtttgtatggagaaattttttttgaagtagttagagttgataattatattcgtagcgttacgggtaataagtagttcgcgcgggttagtggttatacgggtcgcgttagcgt

SEQ ID NO: 37420 - DNA, 1113 bp, Artificial Sequence
  chemically treated genomic DNA (Homo sapiens) CpG-island No: 37420
acgctaacgcgacccgtataaccactaacccgcgcgaactacttattacccgtaacgctacgaatataattatcaactctaactacttcaaaaaaaatttctccatacaaaccgacaccgacgacgcatcgctaacgataacccgtttcctaaaaaacaaaatacgtaaccgcgatattcgcgccgacttcgcccttaacgatattaccgcgacgataattaacctacacgaaaaaaatctaatccgcaaactactaaatatacaaaactttaacaaccatactacgcaatcgctaacccgtaaccccaatcacatcgaaatcaacgccaaccaatacgctactaaaattcgaaaaacgcatcgattaatcgtctcgacgtaataatactaaacgcgctaaaaattaacacccaattcaacgttaacgtactaaccgactctaacgacgtactacgtaatacttccgataatcactacgataccgcgattacctctacgctttccatcatcgtcgcgccgctaatacgcgatcgtattccgactctaataaatacgtactaacctacatcaccccaaactccaatatcgatattctaatcacaaaccacgatatcgcaattaacccgacacgtccgaaactaacaaaacgtctacaaaaaacgaacattaaaataatttccattaaataactacgcgaacgtacgcgtctactaaccgataaaccacaaccgattaaattcacaaaccgcgtcgttaccgttatacgttaccgcgataactcgataatcgatattatacatcaaataaaaaaataaaccatacacctacttcctaaactcgccaaccaccatacgatatcaattcccgaactactcgtcaaccgaaataaaaaacaaacacgacaacacgtctaactcaaacgccatcctattccactaatctcctttaccgtaattacgcctaaaccgattaaaaacaacgaaatcacacgccgaatttttaatcataacgtaacaaccttacgtaccttaaccgcaaaacaaaactaacaaattcaaaaacaaactacactaatttccgccaacgaaccgaaaaacatattaaacattaac

SEQ ID NO: 37421 - DNA, 749 bp, Artificial Sequence
  chemically treated genomic DNA (Homo sapiens) CpG-island No: 37421
attagtatcggaggttagtacgcgtttaatgcgcgtggaattttgattcggcgtgtagttatagcgtagttgtaggtcgatttcgttgttagaaatcggttgtaaagtacgggcgtgaagaacgggagtcgttaggcgcgttagttcgttggttttatttagacgtagtaacggtagtaggtaggtattttttattttacgcgggtcggtattgtatatttcggcgacgtcgttttagatggttacgcgagaaatattcgttagcgtatcgatttgtgtcgcggaatagtcggaatcgttacgttttagtagtatcgttttatcggcgttgttgcggttgataaattcggttattattagacgtttgttcggatgttgtattagtagttgttgtagtaacgggtaagaaagttttttattaatttgcggttgtgcggcgcgtttagcgcgtaaaaattcgcgggtattaagttaggtcgttggtagtttttgttgattaagtatcgtagatattagacgtgtcgattatattttttcgtggtttattattttcgtatatattgcgtcgttaatatcgttgtcgagtagcgtcgttaggcgtttaaggtcgttgataaaagcgttaatgaggttatcggtttttttagcgggtagtagatcgttaattagatcgtattgatagcgacgtagcgtttgttgaatttgatgcgtagagagacgatcggtttggtttagttttaattagttaa

SEQ ID NO: 37422 - DNA, 749 bp, Artificial Sequence
  chemically treated genomic DNA (Homo sapiens) CpG-island No: 37422
ttaactaattaaaactaaaccaaaccgatcgtctctctacgcatcaaattcaacaaacgctacgtcgctatcaatacgatctaattaacgatctactacccgctaaaaaaaccgataacctcattaacgcttttatcaacgaccttaaacgcctaacgacgctactcgacaacgatattaacgacgcaatatatacgaaaataataaaccacgaaaaaatataatcgacacgtctaatatctacgatacttaatcaacaaaaactaccaacgacctaacttaatacccgcgaatttttacgcgctaaacgcgccgcacaaccgcaaattaataaaaaactttcttacccgttactacaacaactactaatacaacatccgaacaaacgtctaataataaccgaatttatcaaccgcaacaacgccgataaaacgatactactaaaacgtaacgattccgactattccgcgacacaaatcgatacgctaacgaatatttctcgcgtaaccatctaaaacgacgtcgccgaaatatacaataccgacccgcgtaaaataaaaaatacctacctactaccgttactacgtctaaataaaaccaacgaactaacgcgcctaacgactcccgttcttcacgcccgtactttacaaccgatttctaacaacgaaatcgacctacaactacgctataactacacgccgaatcaaaattccacgcgcattaaacgcgtactaacctccgatactaat

SEQ ID NO: 37423 - DNA, 749 bp, Artificial Sequence
  chemically treated genomic DNA (Homo sapiens) CpG-island No: 37423
ttaattggttgaaattaagttagatcgatcgtttttttgcgtattaggtttaataaacgttgcgtcgttattagtgcgatttgattagcggtttgttattcgttgaagaagtcgatagttttattagcgtttttgttagcgattttgagcgtttggcggcgttgttcgatagcggtattaacgacgtagtgtatgcggaagtggtgggttacggggaagtatggtcggtacgtttgatgtttgcggtatttaattaataagggttgttagcggtttggtttgatgttcgcgagtttttacgcgttgaacgcgtcgtataatcgtaggttgatgaagggtttttttattcgttgttgtaatagttgttggtgtaatattcgggtaaacgtttggtggtgatcggatttattagtcgtaataacgtcggtgaaacggtgttgttggggcgtaacggtttcgattatttcgcgatataaatcggtgcgttggcgggtgtttttcgcgtaattatttggagcgacgtcgtcggggtatatagtgtcgattcgcgtaaagtgaaagatgtttgtttgttgtcgttgttgcgtttggatgaggttagcgaattggcgcgtttggcggttttcgttttttacgttcgtattttatagtcggtttttggtagcgaaatcgatttgtaattgcgttgtagttatacgtcggattaaggttttacgcgtattgaacgcgtgttggttttcggtattggt

SEQ ID NO: 37424 - DNA, 749 bp, Artificial Sequence
  chemically treated genomic DNA (Homo sapiens) CpG-island No: 37424
accaataccgaaaaccaacacgcgttcaatacgcgtaaaaccttaatccgacgtataactacaacgcaattacaaatcgatttcgctaccaaaaaccgactataaaatacgaacgtaaaaaacgaaaaccgccaaacgcgccaattcgctaacctcatccaaacgcaacaacgacaacaaacaaacatctttcactttacgcgaatcgacactatataccccgacgacgtcgctccaaataattacgcgaaaaacacccgccaacgcaccgatttatatcgcgaaataatcgaaaccgttacgccccaacaacaccgtttcaccgacgttattacgactaataaatccgatcaccaccaaacgtttacccgaatattacaccaacaactattacaacaacgaataaaaaaacccttcatcaacctacgattatacgacgcgttcaacgcgtaaaaactcgcgaacatcaaaccaaaccgctaacaacccttattaattaaataccgcaaacatcaaacgtaccgaccatacttccccgtaacccaccacttccgcatacactacgtcgttaataccgctatcgaacaacgccgccaaacgctcaaaatcgctaacaaaaacgctaataaaactatcgacttcttcaacgaataacaaaccgctaatcaaatcgcactaataacgacgcaacgtttattaaacctaatacgcaaaaaaacgatcgatctaacttaatttcaaccaattaa

SEQ ID NO: 37425 - DNA, 558 bp, Artificial Sequence
  chemically treated genomic DNA (Homo sapiens) CpG-island No: 37425
  misc_feature (315)..(315): n is either a, c, g or t
tattattattcgtaaagtgtagtaggtcgcgtagtaggcggtacgtaataacgtgttggattacgatatgcgttacggttatcgcggttcggtaaatgtgttgtggaaagtgggcgagtcggcgtgggataataataagattatcgatacgttgaaggcgttgttaatttatggttcgttgttgtttgtcgtagttattagcgttaatttttagtaagcgacggcgatgttgcggacgggtcgatcgtcgtattgagtatggaaggcgttcgttgggcgcgtttttatcgttcggatatttagtaaggacgacgntcgcgtaaagtgatcgatgttttgtaaacggggttagtaaatttggggttcgttaggttggcgatgtatggtggttggtattagtgtcggaagtgaattcgggcgttgggtgtcgattaattcgtaaaacggtgtcgttatggcgttggtcggtggttttgatttttattagagtagttaatcggcgttattaggtattgcgtttaggttgttttattattatcggtttttttaacgggggat

SEQ ID NO: 37426 - DNA, 558 bp, Artificial Sequence
  chemically treated genomic DNA (Homo sapiens) CpG-island No: 37426
  misc_feature (244)..(244): n is either a, c, g or t
atcccccgttaaaaaaaccgataataataaaacaacctaaacgcaatacctaataacgccgattaactactctaataaaaatcaaaaccaccgaccaacgccataacgacaccgttttacgaattaatcgacacccaacgcccgaattcacttccgacactaataccaaccaccatacatcgccaacctaacgaaccccaaatttactaaccccgtttacaaaacatcgatcactttacgcgancgtcgtccttactaaatatccgaacgataaaaacgcgcccaacgaacgccttccatactcaatacgacgatcgacccgtccgcaacatcgccgtcgcttactaaaaattaacgctaataactacgacaaacaacaacgaaccataaattaacaacgccttcaacgtatcgataatcttattattatcccacgccgactcgcccactttccacaacacatttaccgaaccgcgataaccgtaacgcatatcgtaatccaacacgttattacgtaccgcctactacgcgacctactacactttacgaataataata

SEQ ID NO: 37427 - DNA, 558 bp, Artificial Sequence
  chemically treated genomic DNA (Homo sapiens) CpG-island No: 37427
  misc_feature (244)..(244): n is either a, c, g or t
atttttcgttaagaggatcggtaatggtggaataatttggacgtagtgtttggtggcgtcggttaattgttttgatggaaattaaagttatcgattagcgttataacggtatcgttttgcggattgatcgatatttagcgttcgagtttattttcggtattggtgttagttattatgtatcgttaatttgacgaattttagatttgttgatttcgtttgtagaatatcggttattttacgcggncgtcgtttttgttgagtattcgaacggtaaggacgcgtttagcgaacgttttttatatttaatgcgacggtcgattcgttcgtagtatcgtcgtcgtttgttgaggattggcgttggtgattgcggtaggtagtagcggattataggttggtagcgtttttagcgtatcggtaattttgttgttattttacgtcgattcgtttattttttatagtatatttgtcgggtcgcgatagtcgtggcgtatgtcgtagtttagtacgttattacgtatcgtttgttgcgcggtttgttgtattttgcgggtgatggtg

SEQ ID NO: 37428 - DNA, 558 bp, Artificial Sequence
  chemically treated genomic DNA (Homo sapiens) CpG-island No: 37428
  misc_feature (315)..(315): n is either a, c, g or t
caccatcacccgcaaaatacaacaaaccgcgcaacaaacgatacgtaataacgtactaaactacgacatacgccacgactatcgcgacccgacaaatatactataaaaaataaacgaatcgacgtaaaataacaacaaaattaccgatacgctaaaaacgctaccaacctataatccgctactacctaccgcaatcaccaacgccaatcctcaacaaacgacgacgatactacgaacgaatcgaccgtcgcattaaatataaaaaacgttcgctaaacgcgtccttaccgttcgaatactcaacaaaaacgacgnccgcgtaaaataaccgatattctacaaacgaaatcaacaaatctaaaattcgtcaaattaacgatacataataactaacaccaataccgaaaataaactcgaacgctaaatatcgatcaatccgcaaaacgataccgttataacgctaatcgataactttaatttccatcaaaacaattaaccgacgccaccaaacactacgtccaaattattccaccattaccgatcctcttaacgaaaaat

SEQ ID NO: 37429 - DNA, 805 bp, Artificial Sequence
  chemically treated genomic DNA (Homo sapiens) CpG-island No: 37429
  misc_feature (264)..(264): n is either a, c, g or t
acgtaggtcgtagcggttggttgttgtatgttcgtgggttggataaataacgtttgatttaatattagagtaaattgggtgcggcgatggtgattgttgtcgtttggtgcgtggaagattattaggtgattcgtttggtaggtttatttatcgtacgggttatacgtttggtttacgaagcgtagttggatgtcgtttcgttggggaaaatttcgtatttgcgtacgtcgggtttgttggtgatggatatggattttatcgtantttagattgaatgtattgatgaaattgttaaattggtcggaacgggcgagatggtggcggaagtaatcgaacgggcgatgcgcggcgaattcgattttatcgttagtttgcgtagtcgtgtggcgacgttgaaaggcgttgacgttaatattttgtaataggtgcgtgaaaatttgtcgttgatgttaggtttaacgtaattggtgtttaagttggaaacgttgggttggaaagtggcgattgttttcggcggttttattttttttgttgaatatttgcgcgataagttgcgtttgatcgtcgtggtagttaatgaattggagattatggacggtaaatttatcggtaatgtgatcggcgatatcgtagacgcgtagtataaagcgaaaattttgattcgtttcgcgtaggagtatgaaatttcgttggcgtagatcgtggcgattggcgatggagttaatgatttgtcgatgattaaagcggtagggttggggattgtttattatgttaagttaaaagtgaatgaaaaggcggaagttat

SEQ ID NO: 37430 - DNA, 805 bp, Artificial Sequence
  chemically treated genomic DNA (Homo sapiens) CpG-island No: 37430
  misc_feature (542)..(542): n is either a, c, g or t
ataacttccgccttttcattcacttttaacttaacataataaacaatccccaaccctaccgctttaatcatcgacaaatcattaactccatcgccaatcgccacgatctacgccaacgaaatttcatactcctacgcgaaacgaatcaaaattttcgctttatactacgcgtctacgatatcgccgatcacattaccgataaatttaccgtccataatctccaattcattaactaccacgacgatcaaacgcaacttatcgcgcaaatattcaacaaaaaaaataaaaccgccgaaaacaatcgccactttccaacccaacgtttccaacttaaacaccaattacgttaaacctaacatcaacgacaaattttcacgcacctattacaaaatattaacgtcaacgcctttcaacgtcgccacacgactacgcaaactaacgataaaatcgaattcgccgcgcatcgcccgttcgattacttccgccaccatctcgcccgttccgaccaatttaacaatttcatcaatacattcaatctaaantacgataaaatccatatccatcaccaacaaacccgacgtacgcaaatacgaaattttccccaacgaaacgacatccaactacgcttcgtaaaccaaacgtataacccgtacgataaataaacctaccaaacgaatcacctaataatcttccacgcaccaaacgacaacaatcaccatcgccgcacccaatttactctaatattaaatcaaacgttatttatccaacccacgaacatacaacaaccaaccgctacgacctacgt

SEQ ID NO: 37431 - DNA, 805 bp, Artificial Sequence
  chemically treated genomic DNA (Homo sapiens) CpG-island No: 37431
  misc_feature (542)..(542): n is either a, c, g or t
gtgattttcgtttttttatttatttttggtttggtatggtaggtaatttttagttttgtcgttttgattatcggtaggttattggttttatcgttaatcgttacggtttgcgttagcgggattttatatttttgcgcgaggcgagttagagttttcgttttgtattgcgcgtttacgatgtcgtcgattatattgtcggtaaatttatcgtttatgatttttagtttattggttattacggcggttaggcgtagtttgtcgcgtaggtatttagtaaagaaagtaaagtcgtcggaggtaatcgttattttttagtttagcgtttttagtttgagtattagttgcgttaagtttggtattagcggtagatttttacgtatttgttgtagaatattggcgttagcgttttttagcgtcgttatacggttgcgtaggttggcggtaaaatcgagttcgtcgcgtatcgttcgttcggttattttcgttattatttcgttcgtttcggttagtttggtaattttattaatatatttaatttggantgcggtggagtttatatttattattagtaaattcggcgtgcgtaggtgcgggattttttttagcggggcgatatttagttgcgtttcgtgggttaggcgtgtagttcgtgcggtgagtgaatttgttagacgaattatttgataattttttacgtattaggcggtaataattattatcgtcgtatttagtttgttttggtattgggttagacgttgtttatttagtttacgaatatatagtagttagtcgttacgatttgcgt

SEQ ID NO: 37432 - DNA, 805 bp, Artificial Sequence
  chemically treated genomic DNA (Homo sapiens) CpG-island No: 37432
  misc_feature (264)..(264): n is either a, c, g or t
acgcaaatcgtaacgactaactactatatattcgtaaactaaataaacaacgtctaacccaataccaaaacaaactaaatacgacgataataattattaccgcctaatacgtaaaaaattatcaaataattcgtctaacaaattcactcaccgcacgaactacacgcctaacccacgaaacgcaactaaatatcgccccgctaaaaaaaatcccgcacctacgcacgccgaatttactaataataaatataaactccaccgcantccaaattaaatatattaataaaattaccaaactaaccgaaacgaacgaaataataacgaaaataaccgaacgaacgatacgcgacgaactcgattttaccgccaacctacgcaaccgtataacgacgctaaaaaacgctaacgccaatattctacaacaaatacgtaaaaatctaccgctaataccaaacttaacgcaactaatactcaaactaaaaacgctaaactaaaaaataacgattacctccgacgactttactttctttactaaatacctacgcgacaaactacgcctaaccgccgtaataaccaataaactaaaaatcataaacgataaatttaccgacaatataatcgacgacatcgtaaacgcgcaatacaaaacgaaaactctaactcgcctcgcgcaaaaatataaaatcccgctaacgcaaaccgtaacgattaacgataaaaccaataacctaccgataatcaaaacgacaaaactaaaaattacctaccataccaaaccaaaaataaataaaaaaacgaaaatcac

SEQ ID NO: 37433 - DNA, 757 bp, Artificial Sequence
  chemically treated genomic DNA (Homo sapiens) CpG-island No: 37433
gcgtatttttgaaggcgagttaatgtaggagtttagcgatcgcgttaatgcggtattggaattttgtcgggatttatcgtagggaagtcgatcgttgttggtgagttatggtattgtattgggatgtttggtgagtacgattttcggattattagtatgggtagagcgtcgtttacgtttgcgtaattgttttatttcgcgcgtggattattaggaaagtttgtggttggcgtttggttgggtcgttgaaatcgtaggggatatttcgtatttggacgtttttgtattagattgagttgtagcgttacgacggatcggaattagtagtttatagcggtaattaattgggcgatttttcgttttggtattttttgtcgggtagtatcgtttaatattttgatttttacggcgcgttaggttgagtattggtatgtacgtttcgtatatcgttaggataaatttttgtacgtcggtttttagatttttataggtaaatattatatattcgtcgttttgtagtattatcggatgtttcgttagtatatagttatttgtttgattttgggttaacgcggtggtatagaatattttttgttcgtcgtttttattttgattcggacgcgttttatttaggtcgtagagtatcggcggaatggtcggcgcgttgtcgagaaaatcgtgttagaattgataacgtattttatggcggaaattagagatttgttttagcgaataggagtagttttgggtaatatta

SEQ ID NO: 37434 - DNA, 757 bp, Artificial Sequence
  chemically treated genomic DNA (Homo sapiens) CpG-island No: 37434
taatattacccaaaactactcctattcgctaaaacaaatctctaatttccgccataaaatacgttatcaattctaacacgattttctcgacaacgcgccgaccattccgccgatactctacgacctaaataaaacgcgtccgaatcaaaataaaaacgacgaacaaaaaatattctataccaccgcgttaacccaaaatcaaacaaataactatatactaacgaaacatccgataatactacaaaacgacgaatatataatatttacctataaaaatctaaaaaccgacgtacaaaaatttatcctaacgatatacgaaacgtacataccaatactcaacctaacgcgccgtaaaaatcaaaatattaaacgatactacccgacaaaaaataccaaaacgaaaaatcgcccaattaattaccgctataaactactaattccgatccgtcgtaacgctacaactcaatctaatacaaaaacgtccaaatacgaaatatcccctacgatttcaacgacccaaccaaacgccaaccacaaactttcctaataatccacgcgcgaaataaaacaattacgcaaacgtaaacgacgctctacccatactaataatccgaaaatcgtactcaccaaacatcccaatacaataccataactcaccaacaacgatcgacttccctacgataaatcccgacaaaattccaataccgcattaacgcgatcgctaaactcctacattaactcgccttcaaaaatacgc

SEQ ID NO: 37435 - DNA, 757 bp, Artificial Sequence
  chemically treated genomic DNA (Homo sapiens) CpG-island No: 37435
tggtgttatttagagttatttttgttcgttggagtaaatttttgattttcgttatgaaatgcgttattagttttggtacgattttttcggtaacgcgtcgattatttcgtcggtgttttacggtttgaatgaaacgcgttcgagttaggataaagacgacgagtaagaggtattttatattatcgcgttagtttaggattaggtagatggttatgtattgacggggtattcggtgatgttgtagggcggcgaatatgtgatgtttatttatgaaggtttgggaatcggcgtgtaggagtttattttgacggtatacggaacgtgtatgttaatgtttaatttgacgcgtcgtaaaggttaggatattgagcgatattattcggtagaagatgttaaagcgggagatcgtttaattaattatcgttgtgaattgttgatttcgattcgtcgtaacgttgtagtttaatttaatgtaggggcgtttagatgcgagatgttttttgcggttttaacgatttagttagacgttagttataggtttttttgataatttacgcgcgaaatagaatagttacgtagacgtaagcggcgttttgtttatgttggtaattcgagaatcgtatttattaggtattttagtgtaatattatgatttattagtagcggtcggtttttttgcggtaagtttcggtaagattttagtgtcgtattgacgcgatcgttgagtttttgtattgattcgtttttaggaatacgt

SEQ ID NO: 37436 - DNA, 757 bp, Artificial Sequence
  chemically treated genomic DNA (Homo sapiens) CpG-island No: 37436
acgtattcctaaaaacgaatcaatacaaaaactcaacgatcgcgtcaatacgacactaaaatcttaccgaaacttaccgcaaaaaaaccgaccgctactaataaatcataatattacactaaaatacctaataaatacgattctcgaattaccaacataaacaaaacgccgcttacgtctacgtaactattctatttcgcgcgtaaattatcaaaaaaacctataactaacgtctaactaaatcgttaaaaccgcaaaaaacatctcgcatctaaacgcccctacattaaattaaactacaacgttacgacgaatcgaaatcaacaattcacaacgataattaattaaacgatctcccgctttaacatcttctaccgaataatatcgctcaatatcctaacctttacgacgcgtcaaattaaacattaacatacacgttccgtataccgtcaaaataaactcctacacgccgattcccaaaccttcataaataaacatcacatattcgccgccctacaacatcaccgaataccccgtcaatacataaccatctacctaatcctaaactaacgcgataatataaaatacctcttactcgtcgtctttatcctaactcgaacgcgtttcattcaaaccgtaaaacaccgacgaaataatcgacgcgttaccgaaaaaatcgtaccaaaactaataacgcatttcataacgaaaatcaaaaatttactccaacgaacaaaaataactctaaataacacca

SEQ ID NO: 37437 - DNA, 646 bp, Artificial Sequence
  chemically treated genomic DNA (Homo sapiens) CpG-island No: 37437
  misc_feature (624)..(624): n is either a, c, g or t
aattgtcggacgcgtattttttgttcgacgggttaggcgtagtaggcggtattttttttgttggacgttgtataacgtttttagcgcgggcgttgcggagttaagaataatcgggatttgttcgttgtgcgtacgatatatcgttaggtcgcgggtatgatagcgttagtttttttgttgtttgtaggagttgtcgtgttttttattaatgataattacgtcgagatttttaaacggcgtaaatagcgcggagcgggtgtcgattataatcgtcgttttattatttttcgtttttagttacgtcgaaagacgttcgttgtcgtttaggtcggaatgtagaatttttacgggggtattaaaacgtttacgaaaacgggcgatagtttgcggtgttaggtcgattttcggtattattattagcgtttgtttgttttgagcgagtacgttttttagtacgttgagataaattttcgttttatcggaatcggtaacgttcgttagtagttaggtagaaaaagtatttgtcgcgttatgaattgcgttaacggcggtggtttgttcggtatttaatcgtaatcgtttattagaaacggtatagttcgttcgttagtcgttaaattttgngtgttttatttggttaaattat

SEQ ID NO: 37438 - DNA, 646 bp, Artificial Sequence
  chemically treated genomic DNA (Homo sapiens) CpG-island No: 37438
  misc_feature (23)..(23): n is either a, c, g or t
ataatttaaccaaataaaacacncaaaatttaacgactaacgaacgaactataccgtttctaataaacgattacgattaaataccgaacaaaccaccgccgttaacgcaattcataacgcgacaaatactttttctacctaactactaacgaacgttaccgattccgataaaacgaaaatttatctcaacgtactaaaaaacgtactcgctcaaaacaaacaaacgctaataataataccgaaaatcgacctaacaccgcaaactatcgcccgttttcgtaaacgttttaatacccccgtaaaaattctacattccgacctaaacgacaacgaacgtctttcgacgtaactaaaaacgaaaaataataaaacgacgattataatcgacacccgctccgcgctatttacgccgtttaaaaatctcgacgtaattatcattaataaaaaacacgacaactcctacaaacaacaaaaaaactaacgctatcatacccgcgacctaacgatatatcgtacgcacaacgaacaaatcccgattattcttaactccgcaacgcccgcgctaaaaacgttatacaacgtccaacaaaaaaaataccgcctactacgcctaacccgtcgaacaaaaaatacgcgtccgacaatt

SEQ ID NO: 37439 - DNA, 646 bp, Artificial Sequence
  chemically treated genomic DNA (Homo sapiens) CpG-island No: 37439
  misc_feature (23)..(23): n is either a, c, g or t
gtgatttagttaagtgaaatatntagagtttagcgattggcgaacgaattatgtcgtttttggtgagcggttgcgattgaatatcgaataggttatcgtcgttggcgtaatttatagcgcggtagatattttttttgtttggttgttggcgggcgttatcggtttcggtaaaacggaggtttattttagcgtattggaaaacgtgttcgtttagggtaaataggcgttggtgatggtgtcggaaatcggtttgatatcgtaaattatcgttcgttttcgtgaacgttttaatgttttcgtggaagttttgtatttcggtttgaacgatagcgagcgtttttcggcgtggttgaaagcgaaaaatggtgaggcggcgattgtgatcggtattcgtttcgcgttgtttacgtcgtttaaaaatttcggcgtgattgttattgatgaagagtacgatagtttttataagtagtaggaaggttggcgttattatgttcgcgatttggcggtgtatcgtgcgtatagcgagtaaatttcgattatttttggtttcgtaacgttcgcgttggaaacgttatgtaacgtttagtagaaaaaatatcgtttgttgcgtttgattcgtcgggtagggaatgcgcgttcggtaatt

SEQ ID NO: 37440 - DNA, 646 bp, Artificial Sequence
  chemically treated genomic DNA (Homo sapiens) CpG-island No: 37440
  misc_feature (624)..(624): n is either a, c, g or t
aattaccgaacgcgcattccctacccgacgaatcaaacgcaacaaacgatattttttctactaaacgttacataacgtttccaacgcgaacgttacgaaaccaaaaataatcgaaatttactcgctatacgcacgatacaccgccaaatcgcgaacataataacgccaaccttcctactacttataaaaactatcgtactcttcatcaataacaatcacgccgaaatttttaaacgacgtaaacaacgcgaaacgaataccgatcacaatcgccgcctcaccatttttcgctttcaaccacgccgaaaaacgctcgctatcgttcaaaccgaaatacaaaacttccacgaaaacattaaaacgttcacgaaaacgaacgataatttacgatatcaaaccgatttccgacaccatcaccaacgcctatttaccctaaacgaacacgttttccaatacgctaaaataaacctccgttttaccgaaaccgataacgcccgccaacaaccaaacaaaaaaaatatctaccgcgctataaattacgccaacgacgataacctattcgatattcaatcgcaaccgctcaccaaaaacgacataattcgttcgccaatcgctaaactctanatatttcacttaactaaatcac

SEQ ID NO: 37441 - DNA, 537 bp, Artificial Sequence
  chemically treated genomic DNA (Homo sapiens) CpG-island No: 37441
  misc_feature (365)..(365): n is either a, c, g or t
tggcgaacggtagcgttagtttggagtaaagtggtggcgaagtgtagaatttattgaattagatgtagtaggcgagtattaagtatattgagtttcgtgacgatcgttttgtggcggcggttgtcgttgatgaatattaatcggtaacgttggtgtatttggcgcgggcggtgacgtcgggaacgtattaggtatcgtaatcgatggtggaattaatgtatgttttttaatggcgggcgatcggcgcggttgaagatttgttgattgttagatcgtaaatgtttcgtttgttaattaaacgcggttgttggataacgttggtagtcgcgttttttttttttttttttgtagcgtggggagtagantaattttggtttttatcgttgtatgaagttaatttcgtacgagtggtcgtggcgtagatggtacgtcgttttggcgtttcgtcgatgttgacggtatttggcgttattcggtaataatcgaagatgttttttttacgttattttgaagcgttgattaattatgaagatcgtt

SEQ ID NO: 37442 - DNA, 537 bp, Artificial Sequence
  chemically treated genomic DNA (Homo sapiens) CpG-island No: 37442
  misc_feature (173)..(173): n is either a, c, g or t
aacgatcttcataattaatcaacgcttcaaaataacgtaaaaaaaacatcttcgattattaccgaataacgccaaataccgtcaacatcgacgaaacgccaaaacgacgtaccatctacgccacgaccactcgtacgaaattaacttcatacaacgataaaaaccaaaattantctactccccacgctacaaaaaaaaaaaaaaaaaacgcgactaccaacgttatccaacaaccgcgtttaattaacaaacgaaacatttacgatctaacaatcaacaaatcttcaaccgcgccgatcgcccgccattaaaaaacatacattaattccaccatcgattacgatacctaatacgttcccgacgtcaccgcccgcgccaaatacaccaacgttaccgattaatattcatcaacgacaaccgccgccacaaaacgatcgtcacgaaactcaatatacttaatactcgcctactacatctaattcaataaattctacacttcgccaccactttactccaaactaacgctaccgttcgcca

SEQ ID NO: 37443 - DNA, 537 bp, Artificial Sequence
  chemically treated genomic DNA (Homo sapiens) CpG-island No: 37443
  misc_feature (173)..(173): n is either a, c, g or t
agcgatttttataattgattagcgttttaaggtaacgtgggagaaatattttcgattgttatcggataacgttagatgtcgttagtatcggcgaagcgttagagcggcgtattatttgcgttacgattattcgtgcgggattgattttatgtagcggtagaggttagagttantttgttttttacgttgtaagaaaaaggagaaagggcgcggttgttaacgttatttagtagtcgcgtttggttaataagcgaggtatttacggtttgataattagtagatttttagtcgcgtcggtcgttcgttattggggaatatatattgattttattatcggttgcggtatttgatacgttttcggcgttatcgttcgcgttagatatattagcgttatcggttggtatttattaacggtaatcgtcgttataaagcgatcgttacggaatttaatgtgtttaatgttcgtttgttgtatttggtttagtaagttttgtatttcgttattattttgttttaggttggcgttatcgttcgtta

SEQ ID NO: 37444 - DNA, 537 bp, Artificial Sequence
  chemically treated genomic DNA (Homo sapiens) CpG-island No: 37444
  misc_feature (365)..(365): n is either a, c, g or t
taacgaacgataacgccaacctaaaacaaaataataacgaaatacaaaacttactaaaccaaatacaacaaacgaacattaaacacattaaattccgtaacgatcgctttataacgacgattaccgttaataaataccaaccgataacgctaatatatctaacgcgaacgataacgccgaaaacgtatcaaataccgcaaccgataataaaatcaatatatattccccaataacgaacgaccgacgcgactaaaaatctactaattatcaaaccgtaaatacctcgcttattaaccaaacgcgactactaaataacgttaacaaccgcgccctttctcctttttcttacaacgtaaaaaacaaantaactctaacctctaccgctacataaaatcaatcccgcacgaataatcgtaacgcaaataatacgccgctctaacgcttcgccgatactaacgacatctaacgttatccgataacaatcgaaaatatttctcccacgttaccttaaaacgctaatcaattataaaaatcgct

SEQ ID NO: 37445 - DNA, 754 bp, Artificial Sequence
  chemically treated genomic DNA (Homo sapiens) CpG-island No: 37445
cgtcgtcgtattggcggtaggtaatagcgtgttggtaaaatcggtagaataaacgtcgttgattgtcgcgtaagggatcgttattttgttggaagcgggtgtatcgttaggcgtggtgtaattgttgttaggtcggggtgaaatcgtgggcgcgtaattgacgggtgatgatcgcgtgcgcggggtgatgtttatcggtttaatcgaagtcgttacgttattgtagcgtaatatcgttagtcgtttggacgtttagggtcgttttatttcgtttatcgttgaaatcggcggtatgaacgcgatgattgtcgattttttagtattgatcgaataggtcgtcgtggatgtattggtttcggcgttcgatagtgcgggttagcgttgttcggcgttgcgcgtgttgtgtttgtaagatgagattgtcgattatacgttgaaaatgttgcgcggcgtaatggtcgaatgtcggatgggtaattcgggtcgtttgatatcgatatcggtttagtgattgatagcgaagcgaaagttaatattgagcgttatatttagattatgcgtagtaaaggtcgttcggtgttttaggcggtgcgggaaaatagcgaagatgttcgtgaatggtaaagcggtatttttgtcgtttcgacgttgatcgaattggatgattttgtcgaattgtaaaaagaggtttttggttcggtgttgtatgtggtgcgttataatcgtaattagttattagagttgatcgagtaga

SEQ ID NO: 37446 - DNA, 754 bp, Artificial Sequence
  chemically treated genomic DNA (Homo sapiens) CpG-island No: 37446
tctactcgatcaactctaataactaattacgattataacgcaccacatacaacaccgaaccaaaaacctctttttacaattcgacaaaatcatccaattcgatcaacgtcgaaacgacaaaaataccgctttaccattcacgaacatcttcgctattttcccgcaccgcctaaaacaccgaacgacctttactacgcataatctaaatataacgctcaatattaactttcgcttcgctatcaatcactaaaccgatatcgatatcaaacgacccgaattacccatccgacattcgaccattacgccgcgcaacattttcaacgtataatcgacaatctcatcttacaaacacaacacgcgcaacgccgaacaacgctaacccgcactatcgaacgccgaaaccaatacatccacgacgacctattcgatcaatactaaaaaatcgacaatcatcgcgttcataccgccgatttcaacgataaacgaaataaaacgaccctaaacgtccaaacgactaacgatattacgctacaataacgtaacgacttcgattaaaccgataaacatcaccccgcgcacgcgatcatcacccgtcaattacgcgcccacgatttcaccccgacctaacaacaattacaccacgcctaacgatacacccgcttccaacaaaataacgatcccttacgcgacaatcaacgacgtttattctaccgattttaccaacacgctattacctaccgccaatacgacgacg

SEQ ID NO: 37447 - DNA, 754 bp, Artificial Sequence
  chemically treated genomic DNA (Homo sapiens) CpG-island No: 37447
tttgttcgattagttttggtagttggttacggttgtaacgtattatatgtagtatcggattaaagatttttttttgtaattcggtaaagttatttagttcgattagcgtcggggcgataaaggtgtcgttttgttatttacgggtattttcgttgttttttcgtatcgtttggaatatcggacggtttttgttacgtatggtttgaatatggcgtttaatattggttttcgtttcgttattaattattggatcgatatcggtgttaggcgattcggattatttattcggtattcggttattgcgtcgcgtagtatttttaacgtgtggtcggtaattttattttgtaggtatagtacgcgtagcgtcgaataacgttgattcgtattgtcgaacgtcgaggttagtatatttacgacgatttgttcggttagtgttgaagaatcgataattatcgcgtttatgtcgtcggttttagcgatgagcggaatagggcgattttgagcgtttaggcggttggcgatattgcgttgtagtaacgtagcgatttcggttgaatcggtaaatattatttcgcgtacgcgattattattcgttagttgcgcgtttacggttttatttcgatttggtagtaattgtattacgtttggcggtatattcgtttttagtaaaatggcgattttttgcgcggtaattagcggcgtttgttttgtcggttttgttagtacgttgttatttgtcgttagtgcggcggcg

SEQ ID NO: 37448 - DNA, 754 bp, Artificial Sequence
  chemically treated genomic DNA (Homo sapiens) CpG-island No: 37448
cgccgccgcactaacgacaaataacaacgtactaacaaaaccgacaaaacaaacgccgctaattaccgcgcaaaaaatcgccattttactaaaaacgaatataccgccaaacgtaatacaattactaccaaatcgaaataaaaccgtaaacgcgcaactaacgaataataatcgcgtacgcgaaataatatttaccgattcaaccgaaatcgctacgttactacaacgcaatatcgccaaccgcctaaacgctcaaaatcgccctattccgctcatcgctaaaaccgacgacataaacgcgataattatcgattcttcaacactaaccgaacaaatcgtcgtaaatatactaacctcgacgttcgacaatacgaatcaacgttattcgacgctacgcgtactatacctacaaaataaaattaccgaccacacgttaaaaatactacgcgacgcaataaccgaataccgaataaataatccgaatcgcctaacaccgatatcgatccaataattaataacgaaacgaaaaccaatattaaacgccatattcaaaccatacgtaacaaaaaccgtccgatattccaaacgatacgaaaaaacaacgaaaatacccgtaaataacaaaacgacacctttatcgccccgacgctaatcgaactaaataactttaccgaattacaaaaaaaaatctttaatccgatactacatataatacgttacaaccgtaaccaactaccaaaactaatcgaacaaa

SEQ ID NO: 37449 - DNA, 797 bp, Artificial Sequence
  chemically treated genomic DNA (Homo sapiens) CpG-island No: 37449
cgtggtcgtaatcgtatatttaggtcgtatcgcgggaacgcgatggtaaacgatcgtttttgtaaatcgttataatgatgaatggtagtagcgggtaggtaattagtagtaacgtgattatcggttgagaaacggtggtgttagtaggttttagcggtagaggtatagtagtagagagtatcggtagtagttacggcgtagtaatatcgttaattacgtagtaaatcgttagtgttattacgtttacgtttattaggagcggcgtataggtggcgttttcggtttttttggtgcgcggcgcgtcgaggaacgtgacgttatagattttcgttatatatattatcgttagcgtatcggtaattgttagttttatagcgagtagcggttttagtagacgggtaataaacgcgttattattgtttagtttgaaaaatgattgatagataatttatttttcggtaaaattatttagcggcggtagcgtagttattgttattagttcgattaatatggcgatggagataatcggtatttttttgttaatattatcgagtttttcgatatcgcgatgatcggtacggaattagacgtttttcgtttcgaggaatagtacgtttttgaataggttatggttaagtagatggtatagattatcgattaggttaagagtaattagcgtcggttgttcgagcgcgatattcgttacgttagcgtttagttttagtaggatgatgtcgatattttttagggtgtggtaagttagtaggcgttggatgttgtgttttattagcgtatat

SEQ ID NO: 37450 - DNA, 797 bp, Artificial Sequence
  chemically treated genomic DNA (Homo sapiens) CpG-island No: 37450
atatacgctaataaaacacaacatccaacgcctactaacttaccacaccctaaaaaatatcgacatcatcctactaaaactaaacgctaacgtaacgaatatcgcgctcgaacaaccgacgctaattactcttaacctaatcgataatctataccatctacttaaccataacctattcaaaaacgtactattcctcgaaacgaaaaacgtctaattccgtaccgatcatcgcgatatcgaaaaactcgataatattaacaaaaaaataccgattatctccatcgccatattaatcgaactaataacaataactacgctaccgccgctaaataattttaccgaaaaataaattatctatcaatcatttttcaaactaaacaataataacgcgtttattacccgtctactaaaaccgctactcgctataaaactaacaattaccgatacgctaacgataatatatataacgaaaatctataacgtcacgttcctcgacgcgccgcgcaccaaaaaaaccgaaaacgccacctatacgccgctcctaataaacgtaaacgtaataacactaacgatttactacgtaattaacgatattactacgccgtaactactaccgatactctctactactatacctctaccgctaaaacctactaacaccaccgtttctcaaccgataatcacgttactactaattacctacccgctactaccattcatcattataacgatttacaaaaacgatcgtttaccatcgcgttcccgcgatacgacctaaatatacgattacgaccacg

SEQ ID NO: 37451 - DNA, 797 bp, Artificial Sequence
  chemically treated genomic DNA (Homo sapiens) CpG-island No: 37451
gtatgcgttggtggagtataatatttagcgtttgttggtttattatattttggaaaatatcggtattattttgttggggttgggcgttggcgtaacgggtatcgcgttcgaataatcggcgttgattgtttttggtttggtcggtggtttgtattatttgtttaattatagtttgtttaaaagcgtattgtttttcggggcggggagcgtttggtttcgtatcggttatcgcgatatcgaaaaattcggtggtattggtaagaaaatgtcggttatttttatcgttatgttagtcgggttgatggtaatggttgcgttgtcgtcgttgaatggttttgtcggggaatgggttatttattaattattttttaaattgagtaatagtggcgcgtttgttgttcgtttgttggggtcgttgttcgttgtggggttggtaattatcggtgcgttggcggtgatgtgtatggcgaaagtttatggcgttacgtttttcggcgcgtcgcgtattaaagaagtcgaaaacgttatttgtgcgtcgtttttgatgagcgtaagcgtagtggtattggcgatttgttgcgtaattggcggtgttgttgcgtcgtggttattgtcgatgttttttgttgttgtatttttgtcgttggagtttgttaatattatcgttttttaatcgatgattacgttgttgttgattgtttgttcgttgttgttatttattattatggcgatttgtaaaggcgatcgtttgttatcgcgttttcgcggtgcggtttgggtgtgcggttacgattacg

SEQ ID NO: 37452 - DNA, 797 bp, Artificial Sequence
  chemically treated genomic DNA (Homo sapiens) CpG-island No: 37452
cgtaatcgtaaccgcacacccaaaccgcaccgcgaaaacgcgataacaaacgatcgcctttacaaatcgccataataataaataacaacaacgaacaaacaatcaacaacaacgtaatcatcgattaaaaaacgataatattaacaaactccaacgacaaaaatacaacaacaaaaaacatcgacaataaccacgacgcaacaacaccgccaattacgcaacaaatcgccaataccactacgcttacgctcatcaaaaacgacgcacaaataacgttttcgacttctttaatacgcgacgcgccgaaaaacgtaacgccataaactttcgccatacacatcaccgccaacgcaccgataattaccaaccccacaacgaacaacgaccccaacaaacgaacaacaaacgcgccactattactcaatttaaaaaataattaataaataacccattccccgacaaaaccattcaacgacgacaacgcaaccattaccatcaacccgactaacataacgataaaaataaccgacattttcttaccaataccaccgaatttttcgatatcgcgataaccgatacgaaaccaaacgctccccgccccgaaaaacaatacgcttttaaacaaactataattaaacaaataatacaaaccaccgaccaaaccaaaaacaatcaacgccgattattcgaacgcgatacccgttacgccaacgcccaaccccaacaaaataataccgatattttccaaaatataataaaccaacaaacgctaaatattatactccaccaacgcatac

SEQ ID NO: 37453 - DNA, 674 bp, Artificial Sequence
  chemically treated genomic DNA (Homo sapiens) CpG-island No: 37453
ggggcgatggcgaaattgaaagttatttgatgggcgtttttaacgttagtaatttgttgttcgcgttggcgatattgttggtattcggttatttattggttgatttgttgaaaatcgtcgcgcgtttgtaatcggtttgcggacgtatggaagtgtttattgcgttaggtaaatcgacggtggtggtggattacgcgtatacgtcggatgtattggaaaaagttttataggtagcgcgtttgtattgtgcgggtaagttgtggtgtgtttttggttgtggtggcgatcgcgataaaggtaagcgtttattgatgggcgtaattgtcgaagagtttgttgacgtggcggtggtgacggacgataattcgcgtatcgaagaatcgcgtgttattattaacgatattttggcgggaatgttagatgtcggatatgttaaagtgatggaaggtcgtgttgaagcggtgatttgcgtcgttatgtaggttaaagagaatgatgtggtattggtcgcgggtaaaggttatgaagattattagattgttggtaattagcgtttggattatttcgatcgcgttacggtggcgcgtttgttgggggtgattgtatgattagcgtaatttttagttaatttatcgatatttttaacggtgaattgtaaggtgtagatttatttt

SEQ ID NO: 37454 - DNA, 674 bp, Artificial Sequence
  chemically treated genomic DNA (Homo sapiens) CpG-island No: 37454
aaaataaatctacaccttacaattcaccgttaaaaatatcgataaattaactaaaaattacgctaatcatacaatcacccccaacaaacgcgccaccgtaacgcgatcgaaataatccaaacgctaattaccaacaatctaataatcttcataacctttacccgcgaccaataccacatcattctctttaacctacataacgacgcaaatcaccgcttcaacacgaccttccatcactttaacatatccgacatctaacattcccgccaaaatatcgttaataataacacgcgattcttcgatacgcgaattatcgtccgtcaccaccgccacgtcaacaaactcttcgacaattacgcccatcaataaacgcttacctttatcgcgatcgccaccacaaccaaaaacacaccacaacttacccgcacaatacaaacgcgctacctataaaactttttccaatacatccgacgtatacgcgtaatccaccaccaccgtcgatttacctaacgcaataaacacttccatacgtccgcaaaccgattacaaacgcgcgacgattttcaacaaatcaaccaataaataaccgaataccaacaatatcgccaacgcgaacaacaaattactaacgttaaaaacgcccatcaaataactttcaatttcgccatcgcccc

SEQ ID NO: 37455 - DNA, 674 bp, Artificial Sequence
  chemically treated genomic DNA (Homo sapiens) CpG-island No: 37455
agggtgaatttgtattttgtagtttatcgttgagaatgtcggtaagttggttaagggttacgttaattatgtaattatttttagtagacgcgttatcgtgacgcgatcggagtagtttagacgttgattgttaataatttggtaatttttatggtttttgttcgcgattagtattatattattttttttagtttgtataacggcgtaagttatcgttttagtacggttttttattattttggtatgttcggtatttaatattttcgttagaatatcgttgatgatggtacgcggtttttcggtacgcgggttatcgttcgttattatcgttacgttagtaaatttttcggtaattgcgtttattagtggacgtttatttttatcgcgatcgttattatagttaaagatatattatagtttgttcgtatagtgtagacgcgttgtttgtaaggttttttttagtgtattcggcgtatgcgcgtaatttattattatcgtcggtttgtttggcgtagtgaatatttttatacgttcgtaaatcggttgtagacgcgcggcggtttttagtagattagttagtggatagtcgagtgttaatagtgtcgttagcgcgagtagtaggttgttgacgttaaaagcgtttattagatggtttttaatttcgttatcgtttt

SEQ ID NO: 37456 - DNA, 674 bp, Artificial Sequence
  chemically treated genomic DNA (Homo sapiens) CpG-island No: 37456
aaaacgataacgaaattaaaaaccatctaataaacgcttttaacgtcaacaacctactactcgcgctaacgacactattaacactcgactatccactaactaatctactaaaaaccgccgcgcgtctacaaccgatttacgaacgtataaaaatattcactacgccaaacaaaccgacgataataataaattacgcgcatacgccgaatacactaaaaaaaaccttacaaacaacgcgtctacactatacgaacaaactataatatatctttaactataataacgatcgcgataaaaataaacgtccactaataaacgcaattaccgaaaaatttactaacgtaacgataataacgaacgataacccgcgtaccgaaaaaccgcgtaccatcatcaacgatattctaacgaaaatattaaataccgaacataccaaaataataaaaaaccgtactaaaacgataacttacgccgttatacaaactaaaaaaaataatataatactaatcgcgaacaaaaaccataaaaattaccaaattattaacaatcaacgtctaaactactccgatcgcgtcacgataacgcgtctactaaaaataattacataattaacgtaacccttaaccaacttaccgacattctcaacgataaactacaaaatacaaattcaccct

SEQ ID NO: 37457 - DNA, 766 bp, Artificial Sequence
  chemically treated genomic DNA (Homo sapiens) CpG-island No: 37457
taagcgcgtatttatatcggacgcgttagtgaaacggtaaatatcgtgttatttttattgaggatcgtgtttggttttatcgcgcgcgttaatagcgtgttattagacggggttattaacgttgagttttgtaaatttaatttcgtttgcgttagttgcgtttgcgtttgttcgaggttggttttcgtttgagcgatgttttgtttacggttatcggaacggtattgacgtaatttattttgtgttgattttagcgttgtttgcgtttggtcgcgcgaggagcgggtattttttaggttatttgtcgaaatagtgcggtttttttataatttttgttggcggttatagaagttttgcgtatagttataggcggtttgcgtttgttttatcgttgcggcggtttgagcgatttttttattgcgatattcggtaagtattaggttatattgcgtttgtgttatcgaaatattcgttttcgtttgtattagggtaattttatacggtttgtgatttagttcgtttagtatttggttcgttttgatagtattattttcgtttatcgttagcgatttaacgcgttttttaatacggaaattaagatttatcgtacgaatatttacgttgttatatagcgttaggtcgttattttggcggttttgatattattagtagttttcggtaattacggcggtaagtattattatcgttaattcgattacgataggtttttttattattataaatttttttgcgataatttttgtaa

SEQ ID NO: 37458 - DNA, 766 bp, Artificial Sequence
  chemically treated genomic DNA (Homo sapiens) CpG-island No: 37458
ttacaaaaattatcgcaaaaaaatttataataataaaaaaacctatcgtaatcgaattaacgataataatacttaccgccgtaattaccgaaaactactaataatatcaaaaccgccaaaataacgacctaacgctatataacaacgtaaatattcgtacgataaatcttaatttccgtattaaaaaacgcgttaaatcgctaacgataaacgaaaataatactatcaaaacgaaccaaatactaaacgaactaaatcacaaaccgtataaaattaccctaatacaaacgaaaacgaatatttcgataacacaaacgcaatataacctaatacttaccgaatatcgcaataaaaaaatcgctcaaaccgccgcaacgataaaacaaacgcaaaccgcctataactatacgcaaaacttctataaccgccaacaaaaattataaaaaaaccgcactatttcgacaaataacctaaaaaatacccgctcctcgcgcgaccaaacgcaaacaacgctaaaatcaacacaaaataaattacgtcaataccgttccgataaccgtaaacaaaacatcgctcaaacgaaaaccaacctcgaacaaacgcaaacgcaactaacgcaaacgaaattaaatttacaaaactcaacgttaataaccccgtctaataacacgctattaacgcgcgcgataaaaccaaacacgatcctcaataaaaataacacgatatttaccgtttcactaacgcgtccgatataaatacgcgctta

SEQ ID NO: 37459 - DNA, 766 bp, Artificial Sequence
  chemically treated genomic DNA (Homo sapiens) CpG-island No: 37459
ttgtaaggattatcgtaaaggagtttgtagtgatgaaaaaatttgtcgtgatcggattggcggtagtggtatttgtcgtcgtggttgtcggaggttattggtggtattaaagtcgttaggataacggtttgacgttgtatggtaacgtggatattcgtacggtaaattttagttttcgtgttggggggcgcgttgaatcgttggcggtggacgaaggtgatgttattaaagcgggttaggtgttgggcgaattggattataagtcgtatgagattgttttgatgtaggcgaaagcgggtgtttcggtggtataggcgtagtatgatttgatgtttgtcgggtatcgtaatgaagaaatcgtttaggtcgtcgtagcggtgaaataggcgtaagtcgtttatgattatgcgtagaatttttataatcgttagtaagggttgtggaaaagtcgtattatttcggtaaatgatttggaaaatgttcgtttttcgcgcgattaggcgtaggtaacgttgaaattagtataggataaattgcgttagtatcgtttcggtaatcgtgaataggatatcgtttaggcgaaagttagtttcgaataggcgtaggcgtaattggcgtaggcggagttgaatttataggatttaacgttgatagtttcgtttgatggtacgttgttaacgcgcgcggtggagttaggtacggtttttaatgaaggtggtacggtgtttatcgttttattaacgcgttcggtgtgggtgcgcgttta

SEQ ID NO: 37460 - DNA, 766 bp, Artificial Sequence
  chemically treated genomic DNA (Homo sapiens) CpG-island No: 37460
taaacgcgcacccacaccgaacgcgttaataaaacgataaacaccgtaccaccttcattaaaaaccgtacctaactccaccgcgcgcgttaacaacgtaccatcaaacgaaactatcaacgttaaatcctataaattcaactccgcctacgccaattacgcctacgcctattcgaaactaactttcgcctaaacgatatcctattcacgattaccgaaacgatactaacgcaatttatcctatactaatttcaacgttacctacgcctaatcgcgcgaaaaacgaacattttccaaatcatttaccgaaataatacgacttttccacaacccttactaacgattataaaaattctacgcataatcataaacgacttacgcctatttcaccgctacgacgacctaaacgatttcttcattacgatacccgacaaacatcaaatcatactacgcctataccaccgaaacacccgctttcgcctacatcaaaacaatctcatacgacttataatccaattcgcccaacacctaacccgctttaataacatcaccttcgtccaccgccaacgattcaacgcgccccccaacacgaaaactaaaatttaccgtacgaatatccacgttaccatacaacgtcaaaccgttatcctaacgactttaataccaccaataacctccgacaaccacgacgacaaataccactaccgccaatccgatcacgacaaattttttcatcactacaaactcctttacgataatccttacaa

SEQ ID NO: 37461 - DNA, 781 bp, Artificial Sequence
  chemically treated genomic DNA (Homo sapiens) CpG-island No: 37461
agaatagttttagtaggtcgtcgtaaattattatttgtaatgcgttatagtcgaatattgtcgtacgtagtttttatagtttttgtggatcgagttcgaggtcgataataaatagtattagtattattttaatttcggtaaagtgtagaatagattcggtatcggttattagtcgtagtttttacgggttaataatgtagtcggcgattaggtagttaagtatcgattttagattaagacgtatcgtaatgggtataattagcgttgtcgaatcgagataaattagcgtttgaattagcgtatggttatttatgatgggttttttgttattttagtagacgttgtttatagtgacgcgtttgtttttcgagggtttcgtcgttataaataaaggtgtagtgtatggtaaacggtggtagttagtttagttcgtagtagattgtcgtcgtttgtagcggttgcgatagtatattaaagttcggatgcgtattaattttaaaatggtttttttcgtcgtcggtcgttatcgtttatagtaaatgtttgttatgtagcgtcgtgtcgttatgatcgtaagtttagtcgtgggagaaaattttatcgatttaaagtttgaggagcggaggaatgttgtattattgtatcggatgttgttagacgattagatcggcgcgagatagcgttttttgttcggcggtatatcgatttgaagttaggatagagttgataagagagcgaatttcgacgttttttagcgtttttgtttgtttaagtattcgtt

SEQ ID NO: 37462 - DNA, 781 bp, Artificial Sequence
  chemically treated genomic DNA (Homo sapiens) CpG-island No: 37462
aacgaatacttaaacaaacaaaaacgctaaaaaacgtcgaaattcgctctcttatcaactctatcctaacttcaaatcgatataccgccgaacaaaaaacgctatctcgcgccgatctaatcgtctaacaacatccgatacaataatacaacattcctccgctcctcaaactttaaatcgataaaattttctcccacgactaaacttacgatcataacgacacgacgctacataacaaacatttactataaacgataacgaccgacgacgaaaaaaaccattttaaaattaatacgcatccgaactttaatatactatcgcaaccgctacaaacgacgacaatctactacgaactaaactaactaccaccgtttaccatacactacacctttatttataacgacgaaaccctcgaaaaacaaacgcgtcactataaacaacgtctactaaaataacaaaaaacccatcataaataaccatacgctaattcaaacgctaatttatctcgattcgacaacgctaattatacccattacgatacgtcttaatctaaaatcgatacttaactacctaatcgccgactacattattaacccgtaaaaactacgactaataaccgataccgaatctattctacactttaccgaaattaaaataatactaatactatttattatcgacctcgaactcgatccacaaaaactataaaaactacgtacgacaatattcgactataacgcattacaaataataatttacgacgacctactaaaactattct

SEQ ID NO: 37463 - DNA, 781 bp, Artificial Sequence
  chemically treated genomic DNA (Homo sapiens) CpG-island No: 37463
aacggatgtttgaataggtaaggacgttggaaggcgtcgaaattcgtttttttattaattttattttgattttaaatcgatatgtcgtcgagtaggaggcgttgtttcgcgtcgatttgatcgtttggtagtattcgatgtagtggtatagtattttttcgttttttaaattttggatcgataaagtttttttttacggttgggtttacggttatggcggtacggcgttgtatggtaaatatttgttgtgggcggtgacgatcggcggcggggaaagttattttgaaattggtgcgtattcgggttttgatgtgttgtcgtagtcgttataggcgacggtaatttattgcgggttgaattggttgttatcgtttgttatgtattgtatttttatttgtgacgacgaaattttcgaagggtaggcgcgttattataagtaacgtttgttggaatggtaggaggtttattatggatagttatacgttgatttaggcgttgatttatttcggttcggtagcgttgattgtatttattgcggtacgttttggtttgggatcggtatttggttatttgatcgtcggttgtattattggttcgtgggggttgcgattggtgatcgatgtcgaatttattttgtattttgtcgagattggggtggtgttgatgttgtttattatcggtttcgaattcgatttataaaggttgtggaagttgcgtgcggtagtgttcggttgtggcgtattgtagatggtgatttgcggcggtttgttggggttgtttt

SEQ ID NO: 37464 - DNA, 781 bp, Artificial Sequence
  chemically treated genomic DNA (Homo sapiens) CpG-island No: 37464
aaaacaaccccaacaaaccgccgcaaatcaccatctacaatacgccacaaccgaacactaccgcacgcaacttccacaacctttataaatcgaattcgaaaccgataataaacaacatcaacaccaccccaatctcgacaaaatacaaaataaattcgacatcgatcaccaatcgcaacccccacgaaccaataatacaaccgacgatcaaataaccaaataccgatcccaaaccaaaacgtaccgcaataaatacaatcaacgctaccgaaccgaaataaatcaacgcctaaatcaacgtataactatccataataaacctcctaccattccaacaaacgttacttataataacgcgcctacccttcgaaaatttcgtcgtcacaaataaaaatacaatacataacaaacgataacaaccaattcaacccgcaataaattaccgtcgcctataacgactacgacaacacatcaaaacccgaatacgcaccaatttcaaaataactttccccgccgccgatcgtcaccgcccacaacaaatatttaccatacaacgccgtaccgccataaccgtaaacccaaccgtaaaaaaaaactttatcgatccaaaatttaaaaaacgaaaaaatactataccactacatcgaatactaccaaacgatcaaatcgacgcgaaacaacgcctcctactcgacgacatatcgatttaaaatcaaaataaaattaataaaaaaacgaatttcgacgccttccaacgtccttacctattcaaacatccgtt

SEQ ID NO: 37465 - DNA, 563 bp, Artificial Sequence
  chemically treated genomic DNA (Homo sapiens) CpG-island No: 37465
ttagtggtagacgcggtgcggcgtcggtaattatttgtgcgttaagatggtagtttttatcggtgtttatttgaatcgttggtgtgtcggtagcgcgaatgcgtgcggtatcgtttacggtttgttggtcgtttttaataattgcgtacggaacgttgttttttaggcgtattagggttttcgttagtagggtggttttatcggaattagggttggaaattaggttgagtattagttgtttgcgggtagtaaagcgcgcgcggttgcgtttagttagacggttatttttgtttagtacgttaatttcgatttttagtattcgacgttggtttatgttcggtgcgtgagtgttcgtttcgttatgatcgtaatgtaggtcgttttttttagtttggttgggggtaaatttaggcgttttaatgtcggtgatttttattttcgggcgtgtcgtcggggtaaatggcgcgttacgaaacgcggaatgagggttatgtttattattttcgatatataggttgtttttatcgtaatcgtatgttgtatatatcgtttatttttggttt

SEQ ID NO: 37466 - DNA, 563 bp, Artificial Sequence
  chemically treated genomic DNA (Homo sapiens) CpG-island No: 37466
aaaccaaaaataaacgatatatacaacatacgattacgataaaaacaacctatatatcgaaaataataaacataaccctcattccgcgtttcgtaacgcgccatttaccccgacgacacgcccgaaaataaaaatcaccgacattaaaacgcctaaatttacccccaaccaaactaaaaaaaacgacctacattacgatcataacgaaacgaacactcacgcaccgaacataaaccaacgtcgaatactaaaaatcgaaattaacgtactaaacaaaaataaccgtctaactaaacgcaaccgcgcgcgctttactacccgcaaacaactaatactcaacctaatttccaaccctaattccgataaaaccaccctactaacgaaaaccctaatacgcctaaaaaacaacgttccgtacgcaattattaaaaacgaccaacaaaccgtaaacgataccgcacgcattcgcgctaccgacacaccaacgattcaaataaacaccgataaaaactaccatcttaacgcacaaataattaccgacgccgcaccgcgtctaccactaa

SEQ ID NO: 37467 - DNA, 563 bp, Artificial Sequence
  chemically treated genomic DNA (Homo sapiens) CpG-island No: 37467
agattaggagtgagcgatgtgtataatatgcggttgcggtgaaggtaatttgtatatcgagggtgatgaatataatttttatttcgcgtttcgtagcgcgttatttgtttcggcggtacgttcgaagatgaaaattatcggtattaaagcgtttgaatttatttttagttagattgaagaaggcgatttgtattacggttatggcgaagcgggtatttacgtatcgggtatgagttagcgtcggatgttggaagtcgaaattgacgtgttggataaaaataatcgtttggttgaacgtaatcgcgcgcgttttgttgttcgtaagtaattggtgtttaatttggtttttagttttggtttcggtaaaattattttgttgacggaaattttaatgcgtttgaaagatagcgtttcgtgcgtagttattgaaggcgattagtaaatcgtgaacgatgtcgtacgtattcgcgttatcggtatattagcgatttaggtgaatatcggtaaaggttgttattttgacgtatagatgattgtcgacgtcgtatcgcgtttgttattgg

SEQ ID NO: 37468 - DNA, 563 bp, Artificial Sequence
  chemically treated genomic DNA (Homo sapiens) CpG-island No: 37468
ccaataacaaacgcgatacgacgtcgacaatcatctatacgtcaaaataacaacctttaccgatattcacctaaatcgctaatataccgataacgcgaatacgtacgacatcgttcacgatttactaatcgccttcaataactacgcacgaaacgctatctttcaaacgcattaaaatttccgtcaacaaaataattttaccgaaaccaaaactaaaaaccaaattaaacaccaattacttacgaacaacaaaacgcgcgcgattacgttcaaccaaacgattatttttatccaacacgtcaatttcgacttccaacatccgacgctaactcatacccgatacgtaaatacccgcttcgccataaccgtaatacaaatcgccttcttcaatctaactaaaaataaattcaaacgctttaataccgataattttcatcttcgaacgtaccgccgaaacaaataacgcgctacgaaacgcgaaataaaaattatattcatcaccctcgatatacaaattaccttcaccgcaaccgcatattatacacatcgctcactcctaatct

SEQ ID NO: 37469 - DNA, 587 bp, Artificial Sequence
  chemically treated genomic DNA (Homo sapiens) CpG-island No: 37469
cgatttacggtgttttcgttgttggtgtttcgtttggtttgttgatttatagttattacggttttgtcgtattggcgattattataatggtattattcgtattggcgtgggtttgtaacggtatagtgcgtaaagtatcggttttggcgggagaacgtttatcgttgtggagcgttgtcgggtttatttggaaattagggttaggtttggtattataaggcgttggttttgttgttatcgggattttcgtttcgttttattttgttagtaaaggatgggcgatggcgggttttatttttatcgcgtttggcggcgtatttgtcgtgatgcgcgttatgtttggttggatgtcggatcgttttggcggcgtgaaagtggcgattgtttttttgtttgtagaaacggtgggtttgttgttgttttggtaagttttaggtgtatgggtcgtattagcgggcgcggcgtttatcggagtcggatgttcgtttattttttttgcgttgggcgtggaggtggttaacgggttttttacgagaattagattttttgagtggaattcggattagaaattgttttgtgtatagagt

SEQ ID NO: 37470 - DNA, 587 bp, Artificial Sequence
  chemically treated genomic DNA (Homo sapiens) CpG-island No: 37470
actctatacacaaaacaatttctaatccgaattccactcaaaaaatctaattctcgtaaaaaacccgttaaccacctccacgcccaacgcaaaaaaaataaacgaacatccgactccgataaacgccgcgcccgctaatacgacccatacacctaaaacttaccaaaacaacaacaaacccaccgtttctacaaacaaaaaaacaatcgccactttcacgccgccaaaacgatccgacatccaaccaaacataacgcgcatcacgacaaatacgccgccaaacgcgataaaaataaaacccgccatcgcccatcctttactaacaaaataaaacgaaacgaaaatcccgataacaacaaaaccaacgccttataataccaaacctaaccctaatttccaaataaacccgacaacgctccacaacgataaacgttctcccgccaaaaccgatactttacgcactataccgttacaaacccacgccaatacgaataataccattataataatcgccaatacgacaaaaccgtaataactataaatcaacaaaccaaacgaaacaccaacaacgaaaacaccgtaaatcg

SEQ ID NO: 37471 - DNA, 587 bp, Artificial Sequence
  chemically treated genomic DNA (Homo sapiens) CpG-island No: 37471
gttttatatatagggtaatttttaattcgggttttatttagggggtttggttttcgtgagggattcgttaattatttttacgtttagcgtaggaaagataagcgaatattcggtttcggtaaacgtcgcgttcgttaatgcgatttatgtatttggggtttgttagagtagtaataagtttatcgtttttataagtagagagataatcgttatttttacgtcgttaaaacggttcggtatttagttaaatatgacgcgtattacgataaatgcgtcgttaaacgcggtaagagtaaagttcgttatcgtttattttttgttggtaaagtagagcgaaacgaaagtttcgataatagtaaaattaacgttttgtagtgttagatttaattttggtttttagataagttcgataacgttttatagcgatggacgttttttcgttagggtcggtattttgcgtattgtgtcgttataggtttacgttagtacgggtaatattattgtggtgatcgttagtgcggtaaaatcgtaatggttatgaattaataggttaagcggagtattaatagcgagggtatcgtaaatcg

SEQ ID NO: 37472 - DNA, 587 bp, Artificial Sequence
  chemically treated genomic DNA (Homo sapiens) CpG-island No: 37472
cgatttacgataccctcgctattaatactccgcttaacctattaattcataaccattacgattttaccgcactaacgatcaccacaataatattacccgtactaacgtaaacctataacgacacaatacgcaaaataccgaccctaacgaaaaaacgtccatcgctataaaacgttatcgaacttatctaaaaaccaaaattaaatctaacactacaaaacgttaattttactattatcgaaactttcgtttcgctctactttaccaacaaaaaataaacgataacgaactttactcttaccgcgtttaacgacgcatttatcgtaatacgcgtcatatttaactaaataccgaaccgttttaacgacgtaaaaataacgattatctctctacttataaaaacgataaacttattactactctaacaaaccccaaatacataaatcgcattaacgaacgcgacgtttaccgaaaccgaatattcgcttatctttcctacgctaaacgtaaaaataattaacgaatccctcacgaaaaccaaaccccctaaataaaacccgaattaaaaattaccctatatataaaac

SEQ ID NO: 37473 - DNA, 678 bp, Artificial Sequence
  chemically treated genomic DNA (Homo sapiens) CpG-island No: 37473
aatgaacgaagttattgaattgtcgtgggttttagcgcgttcgtgggtttgagcgcgtttcggcgtttcgtttttttttcgtttcgtcgagttaatttcgaggttcgagtagagttttgttcgtttatcgtcgtttattttcggcgtagggcggcggataaagagttttttcgtttttttcgtttataaattatcgtttcgtgaagtttgggtagtttagtagtacgaatcgatattttaattttcgtagtatttataaatgggtcgttataatcgtcgtttttgtcggagtttcgttttcgtttcgaggttttgtgggaagtgaggattttattcgcgcgtttgcgttaaagcgtaggtatcgttgagtttagtgaaattataatttttagtgacgttatagcgacgggcgttgttcggcgggggatggattgcgcgtcgtttttcgattagtagcgggttagtggtcgacgtaggcgggcggcgtggcggggcggaaaatcgttttcgggagagatttttcgtggtggacgtcgttttaggtttttatatttagaaaattaaagggaacgtttaacggagcgatggattttcgtgtttttagtaaagtagggagtacggagagttaaagttaatatagagtttaatcgacgtttaaaggaggtgttttgggttttg

SEQ ID NO: 37474 - DNA, 678 bp, Artificial Sequence
  chemically treated genomic DNA (Homo sapiens) CpG-island No: 37474
caaaacccaaaacacctcctttaaacgtcgattaaactctatattaactttaactctccgtactccctactttactaaaaacacgaaaatccatcgctccgttaaacgttccctttaattttctaaatataaaaacctaaaacgacgtccaccacgaaaaatctctcccgaaaacgattttccgccccgccacgccgcccgcctacgtcgaccactaacccgctactaatcgaaaaacgacgcgcaatccatcccccgccgaacaacgcccgtcgctataacgtcactaaaaattataatttcactaaactcaacgatacctacgctttaacgcaaacgcgcgaataaaatcctcacttcccacaaaacctcgaaacgaaaacgaaactccgacaaaaacgacgattataacgacccatttataaatactacgaaaattaaaatatcgattcgtactactaaactacccaaacttcacgaaacgataatttataaacgaaaaaaacgaaaaaactctttatccgccgccctacgccgaaaataaacgacgataaacgaacaaaactctactcgaacctcgaaattaactcgacgaaacgaaaaaaaaacgaaacgccgaaacgcgctcaaacccacgaacgcgctaaaacccacgacaattcaataacttcgttcatt

SEQ ID NO: 37475 - DNA, 678 bp, Artificial Sequence
  chemically treated genomic DNA (Homo sapiens) CpG-island No: 37475
taaaatttaaaatattttttttaagcgtcggttgggttttatgttagttttgatttttcgtgttttttgttttgttgggaatacggagatttatcgtttcgttaggcgttttttttagttttttaagtgtgggagtttggggcgacgtttattacggaaggtttttttcggaaacggtttttcgtttcgttacgtcgttcgtttacgtcgattattggttcgttgttggtcggaaggcggcgcgtagtttatttttcgtcgggtaacgttcgtcgttgtggcgttattgggagttgtagttttattgggtttagcggtgtttgcgttttagcgtagacgcgcgggtgagatttttattttttataggatttcgggacgggggcggggtttcgatagaggcggcgattgtggcggtttatttgtaaatgttgcggagattgaggtgtcggttcgtgttgttgagttgtttaggttttacggagcggtaatttgtgggcgaaaagagcggaggagttttttgttcgtcgttttgcgtcggagatggacggcggtgggcgggtaggattttgttcggatttcggggttggttcggcggggcgaggagggagcggggcgtcgggacgcgtttaggtttacgggcgcgttgaggtttacggtagtttagtggtttcgtttatt

SEQ ID NO: 37476 - DNA, 678 bp, Artificial Sequence
  chemically treated genomic DNA (Homo sapiens) CpG-island No: 37476
aataaacgaaaccactaaactaccgtaaacctcaacgcgcccgtaaacctaaacgcgtcccgacgccccgctccctcctcgccccgccgaaccaaccccgaaatccgaacaaaatcctacccgcccaccgccgtccatctccgacgcaaaacgacgaacaaaaaactcctccgctcttttcgcccacaaattaccgctccgtaaaacctaaacaactcaacaacacgaaccgacacctcaatctccgcaacatttacaaataaaccgccacaatcgccgcctctatcgaaaccccgcccccgtcccgaaatcctataaaaaataaaaatctcacccgcgcgtctacgctaaaacgcaaacaccgctaaacccaataaaactacaactcccaataacgccacaacgacgaacgttacccgacgaaaaataaactacgcgccgccttccgaccaacaacgaaccaataatcgacgtaaacgaacgacgtaacgaaacgaaaaaccgtttccgaaaaaaaccttccgtaataaacgtcgccccaaactcccacacttaaaaaactaaaaaaaacgcctaacgaaacgataaatctccgtattcccaacaaaacaaaaaacacgaaaaatcaaaactaacataaaacccaaccgacgcttaaaaaaaatattttaaatttta

SEQ ID NO: 37477 - DNA, 610 bp, Artificial Sequence
  chemically treated genomic DNA (Homo sapiens) CpG-island No: 37477
acgttatcgtttcggtggatgaggtagtgattcgattttaatttcggagagttttttggtaatatataattttagtaattataattggaattcgcgtgcgatttttcggcgtgtgttattatgttcgttattagcgaggtattatgggaaatttgttaatattcggtcggtagatgggggcggggcggggcggaattggcgtaggcgcgggagagcgtatttcggtgggcggttttgcgggggaggaataagagtcgcggagatgaagggaaatcgtaattttttagtttgcggagggttttggtttcgaggcggcgttgttgagttatttttgttttcggtcgttcggagtagtgggtttttttgtcgggttaggagggtgatggagggatcgcggcggcggttttattttaattcggcgttggtcggtgttcgttcgtgacggttataagggttgtacgtaatagatagttttgtatttaggatttcgaggttcgatcggcggttgttgcgcgtttagcggagcgttttagtttaagttagggttggagttcggagtttagaaatagtaacgggagaggcggggattcgtaaatttaaaaatgtagat

SEQ ID NO: 37478 - DNA, 610 bp, Artificial Sequence
  chemically treated genomic DNA (Homo sapiens) CpG-island No: 37478
atctacatttttaaatttacgaatccccgcctctcccgttactatttctaaactccgaactccaaccctaacttaaactaaaacgctccgctaaacgcgcaacaaccgccgatcgaacctcgaaatcctaaatacaaaactatctattacgtacaacccttataaccgtcacgaacgaacaccgaccaacgccgaattaaaataaaaccgccgccgcgatccctccatcaccctcctaacccgacaaaaaaacccactactccgaacgaccgaaaacaaaaataactcaacaacgccgcctcgaaaccaaaaccctccgcaaactaaaaaattacgatttcccttcatctccgcgactcttattcctcccccgcaaaaccgcccaccgaaatacgctctcccgcgcctacgccaattccgccccgccccgcccccatctaccgaccgaatattaacaaatttcccataatacctcgctaataacgaacataataacacacgccgaaaaatcgcacgcgaattccaattataattactaaaattatatattaccaaaaaactctccgaaattaaaatcgaatcactacctcatccaccgaaacgataacgt

SEQ ID NO: 37479 - DNA, 610 bp, Artificial Sequence
  chemically treated genomic DNA (Homo sapiens) CpG-island No: 37479
atttgtatttttaggtttgcgaattttcgtttttttcgttattatttttgaatttcgagttttagttttggtttgaattgagacgtttcgttgggcgcgtagtagtcgtcgatcggatttcggggttttggatgtaggattgtttgttacgtatagtttttgtgatcgttacgggcggatatcggttaacgtcgggttggggtgaggtcgtcgtcgcggtttttttattatttttttggttcggtagaggaatttattgtttcgggcggtcggggatagaggtggtttaatagcgtcgtttcgaagttagagtttttcgtaggttagaggattgcggtttttttttattttcgcggtttttatttttttttcgtaaggtcgtttatcggggtacgttttttcgcgtttgcgttaatttcgtttcgtttcgtttttatttatcgatcggatgttagtagattttttatagtgtttcgttagtggcgggtatgataatatacgtcggagggtcgtacgcgggttttagttgtgattgttggagttgtgtattgttaggaggtttttcgagattggggtcgggttattgttttatttatcggagcgatggcgt

SEQ ID NO: 37480 - DNA, 610 bp, Artificial Sequence
  chemically treated genomic DNA (Homo sapiens) CpG-island No: 37480
acgccatcgctccgataaataaaacaataacccgaccccaatctcgaaaaacctcctaacaatacacaactccaacaatcacaactaaaacccgcgtacgaccctccgacgtatattatcatacccgccactaacgaaacactataaaaaatctactaacatccgatcgataaataaaaacgaaacgaaacgaaattaacgcaaacgcgaaaaaacgtaccccgataaacgaccttacgaaaaaaaaataaaaaccgcgaaaataaaaaaaaaccgcaatcctctaacctacgaaaaactctaacttcgaaacgacgctattaaaccacctctatccccgaccgcccgaaacaataaattcctctaccgaaccaaaaaaataataaaaaaaccgcgacgacgacctcaccccaacccgacgttaaccgatatccgcccgtaacgatcacaaaaactatacgtaacaaacaatcctacatccaaaaccccgaaatccgatcgacgactactacgcgcccaacgaaacgtctcaattcaaaccaaaactaaaactcgaaattcaaaaataataacgaaaaaaacgaaaattcgcaaacctaaaaatacaaat

SEQ ID NO: 37481 - DNA, 741 bp, Artificial Sequence
  chemically treated genomic DNA (Homo sapiens) CpG-island No: 37481
tttttttcgggtttagatttttttttggtcgtttttagttttttatttcgatttcggtttttttcgtaagtcgagcgtttttttttttcgtattttattcggaagttttggcgttttttttcgggggcggcggtcggtgaggggtgcgcgggattcgggtcgcgttttggtcggttatttcgtatattcggggcgcgttcggcgggttgggcgcgcgaggtttgttttggagcgtaggagttgaggggttgaagatcgggtcgttttcgtcgtcggggcgggaatttattttttttgaggtaggggcgggcgtttataattattgtttttcgtttcgttaacgtcgttagttaggggataagtcgcggtggaggtggcggagaggtaggaataatcgttgtcgttatcgtcgttttcgtcgtcgagtaggttggatgggaggaggaggcggagattcggttttttgaggggaagtcgtcgttattatcggtttatgattggatagtatagacgttatggcggcgagacgcgttattgcgtttgcgcggttagtttagcgtttaggaagttttttgagtttcgttttgttgtttgtttcgttcgtttggtttggtagttttcggcgcggttttaatgttttgttggcgcgattggttttgattttgttcgtttgtttttttttttggggtaaggaaaagttcgtgggggtcgttcgttcgtttgggagaatgaatataaagt

SEQ ID NO: 37482 - DNA, 741 bp, Artificial Sequence
  chemically treated genomic DNA (Homo sapiens) CpG-island No: 37482
actttatattcattctcccaaacgaacgaacgacccccacgaacttttccttaccccaaaaaaaaaaacaaacgaacaaaatcaaaaccaatcgcgccaacaaaacattaaaaccgcgccgaaaactaccaaaccaaacgaacgaaacaaacaacaaaacgaaactcaaaaaacttcctaaacgctaaactaaccgcgcaaacgcaataacgcgtctcgccgccataacgtctatactatccaatcataaaccgataataacgacgacttcccctcaaaaaaccgaatctccgcctcctcctcccatccaacctactcgacgacgaaaacgacgataacgacaacgattattcctacctctccgccacctccaccgcgacttatcccctaactaacgacgttaacgaaacgaaaaacaataattataaacgcccgcccctacctcaaaaaaaataaattcccgccccgacgacgaaaacgacccgatcttcaacccctcaactcctacgctccaaaacaaacctcgcgcgcccaacccgccgaacgcgccccgaatatacgaaataaccgaccaaaacgcgacccgaatcccgcgcacccctcaccgaccgccgcccccgaaaaaaaacgccaaaacttccgaataaaatacgaaaaaaaaaaacgctcgacttacgaaaaaaaccgaaatcgaaataaaaaactaaaaacgaccaaaaaaaaatctaaacccgaaaaaaa

SEQ ID NO: 37483 - DNA, 741 bp, Artificial Sequence
  chemically treated genomic DNA (Homo sapiens) CpG-island No: 37483
gttttatatttatttttttaggcgagcgagcgatttttacgaatttttttttgttttaaaaaggagggtagacggataggattaaaattagtcgcgttagtaagatattagagtcgcgtcgggaattgttaggttaagcgggcgaagtaagtagtaaggcggggtttaagaggttttttgggcgttgggttggtcgcgtaagcgtagtagcgcgtttcgtcgttatggcgtttgtgttgtttagttataagtcggtagtggcggcgatttttttttaggaagtcgggttttcgttttttttttttatttagtttgttcggcggcggaggcggcggtggcggtagcggttgtttttgttttttcgttatttttatcgcggtttattttttggttggcggcgttggcggggcgggggatagtagttgtagacgttcgtttttgttttagagaaggtgagttttcgtttcggcggcgggggcggttcggtttttagttttttaatttttgcgttttaggataggtttcgcgcgtttagttcgtcgggcgcgtttcgagtgtgcgaaatggtcgattagggcgcggttcgagtttcgcgtattttttatcggtcgtcgttttcggaaagagacgttagggttttcgagtggagtgcggagggaaggggcgttcggtttgcggaggaagtcgaggtcggagtgggaaattaggggcgattaagaggaaatttagattcggaggaaa

SEQ ID NO: 37484 - DNA, 741 bp, Artificial Sequence
  chemically treated genomic DNA (Homo sapiens) CpG-island No: 37484
tttcctccgaatctaaatttcctcttaatcgcccctaatttcccactccgacctcgacttcctccgcaaaccgaacgccccttccctccgcactccactcgaaaaccctaacgtctctttccgaaaacgacgaccgataaaaaatacgcgaaactcgaaccgcgccctaatcgaccatttcgcacactcgaaacgcgcccgacgaactaaacgcgcgaaacctatcctaaaacgcaaaaattaaaaaactaaaaaccgaaccgcccccgccgccgaaacgaaaactcaccttctctaaaacaaaaacgaacgtctacaactactatcccccgccccgccaacgccgccaaccaaaaaataaaccgcgataaaaataacgaaaaaacaaaaacaaccgctaccgccaccgccgcctccgccgccgaacaaactaaataaaaaaaaaaaacgaaaacccgacttcctaaaaaaaaatcgccgccactaccgacttataactaaacaacacaaacgccataacgacgaaacgcgctactacgcttacgcgaccaacccaacgcccaaaaaacctcttaaaccccgccttactacttacttcgcccgcttaacctaacaattcccgacgcgactctaatatcttactaacgcgactaattttaatcctatccgtctaccctcctttttaaaacaaaaaaaaattcgtaaaaatcgctcgctcgcctaaaaaaataaatataaaac

SEQ ID NO: 37485 - DNA, 1716 bp, Artificial Sequence
  chemically treated genomic DNA (Homo sapiens) CpG-island No: 37485
acgattttcgtatttatatacgattttcgtatttatatacgattttcgtatttatatacgatttttcgtatttatatacgatttttatatttatatacgatatttatattaatatacgattttcgtatttatatacgatttttttatttatatacgattttttatatttatatatgatttttcgtatttatatacgattttcgtatttatatataatttttgtatttatatacgatatttatatttatatacgatattttatttatatacgattttttatatttatatacgatttttttatttatatataattttcgtattcgtatatgatttttcgtattcgtatacgatttttatatttatatacgattttttttatttatatacgattttcgtatttatatatgattttttttatttatatatgatttttcgtatttatatacgattttcgtatttatatacgattttcgtatttatatacgattttcgtatttttatatgattttttatattcgtatatgatttttttattcgtatataatttttcgtatttatatacgattttcgtatttttatatgattttttatattcgtatatgatttttttattcgtatataatttttcgtatttatatacgatattcgtatttatatacgaattttttatttatatataattttcgtattcgtatatgatttttatattcgtatatgattttttatattcgtatacgatttttttatttatatacgattttcgtatttatatacgatttttttatttatatataattttcgtattcgtatatgattttttaaatttatatacgatttttatattcgtatatgattttcgtattcgtatacgatttttcgtatttatatatgattttatatttatatatgattttttatatttatatttaatttcgtatttatttatgattttttatatttatatacgattttttgtatttatatacgattattttatttatatacgattttttatatttatatatgattttttgtatttatatatgatttttcgtatttatatacgattttatatttatatacgattttttatatttatatacgatttatttatatacgatttttcgtatttatatacgatttttgtatttatatacgattttttgtatttaaatacgattttttgtttttatatataatttttttatttatatacgattttagtattcgtatatgattttttatatttatatacgatttttttatttatacgcgatttttcgtatttatatacgattttcgtatttatatacgattttcgtatttatatacgatttttttatttatatacgatttttgtatttatatatgattttttatatttgtatacgatatttatatttatatacgatttttcgtatttatatataatttttcgtatttaaatacgatttttcgtatttatatacgatttttcgtatttatatacgatttttttatttatatatgatttttcgtatttatatacgatttttatatttatatatgatgtttttatttatatataattttcgtatttatatataattttcggtttaaatatgatttttttatttatatacggatttttatagtaatatataatttttttatttatatataaattttatatttatatatgattttcgtatttatatatgattttttttaatttat

SEQ ID NO: 37486 - DNA, 1716 bp, Artificial Sequence
  chemically treated genomic DNA (Homo sapiens) CpG-island No: 37486
ataaattaaaaaaaatcatatataaatacgaaaatcatatataaatataaaatttatatataaataaaaaaattatatattactataaaaatccgtatataaataaaaaaatcatatttaaaccgaaaattatatataaatacgaaaattatatataaataaaaacatcatatataaatataaaaatcgtatataaatacgaaaaatcatatataaataaaaaaatcgtatataaatacgaaaaatcgtatataaatacgaaaaatcgtatttaaatacgaaaaattatatataaatacgaaaaatcgtatataaatataaatatcgtatacaaatataaaaaatcatatataaatacaaaaatcgtatataaataaaaaaatcgtatataaatacgaaaatcgtatataaatacgaaaatcgtatataaatacgaaaaatcgcgtataaataaaaaaatcgtatataaatataaaaaatcatatacgaatactaaaatcgtatataaataaaaaaattatatataaaaacaaaaaatcgtatttaaatacaaaaaatcgtatataaatacaaaaatcgtatataaatacgaaaaatcgtatataaataaatcgtatataaatataaaaaatcgtatataaatataaaatcgtatataaatacgaaaaatcatatataaatacaaaaaatcatatataaatataaaaaatcgtatataaataaaataatcgtatataaatacaaaaaatcgtatataaatataaaaaatcataaataaatacgaaattaaatataaatataaaaaatcatatataaatataaaatcatatataaatacgaaaaatcgtatacgaatacgaaaatcatatacgaatataaaaatcgtatataaatttaaaaaatcatatacgaatacgaaaattatatataaataaaaaaatcgtatataaatacgaaaatcgtatataaataaaaaaatcgtatacgaatataaaaaatcatatacgaatataaaaatcatatacgaatacgaaaattatatataaataaaaaattcgtatataaatacgaatatcgtatataaatacgaaaaattatatacgaataaaaaaatcatatacgaatataaaaaatcatataaaaatacgaaaatcgtatataaatacgaaaaattatatacgaataaaaaaatcatatacgaatataaaaaatcatataaaaatacgaaaatcgtatataaatacgaaaatcgtatataaatacgaaaatcgtatataaatacgaaaaatcatatataaataaaaaaaatcatatataaatacgaaaatcgtatataaataaaaaaaatcgtatataaatataaaaatcgtatacgaatacgaaaaatcatatacgaatacgaaaattatatataaataaaaaaatcgtatataaatataaaaaatcgtatataaataaaatatcgtatataaatataaatatcgtatataaatacaaaaattatatataaatacgaaaatcgtatataaatacgaaaaatcatatataaatataaaaaatcgtatataaataaaaaaatcgtatataaatacgaaaatcgtatattaatataaatatcgtatataaatataaaaatcgtatataaatacgaaaaatcgtatataaatacgaaaatcgtatataaatacgaaaatcgtatataaatacgaaaatcgt

SEQ ID NO: 37487 - DNA, 1716 bp, Artificial Sequence
  chemically treated genomic DNA (Homo sapiens) CpG-island No: 37487
atgagttggggggggttatgtatgagtgcggggattatgtatgagtgtggggtttgtgtatgagtgggggggttatgtattattgtgggggttcgtgtatgagtaggggggttatgtttgagtcgggggttgtgtatgagtgcggggattgtgtataagtgggggtattatgtatgagtgtgggggtcgtgtatgagtgcggggggttatgtgtgggtggggggatcgtgtgtgggtgcggggggtcgtgtgtgggtgcggggggtcgtgtttgagtgcggggagttgtgtatgagtgcggggggtcgtgtatgagtgtgggtatcgtgtataagtgtggggggttatgtatgagtgtagagatcgtgtatgagtgggggggtcgtgtatgagtgcgggggtcgtgtatgagtgcgggggtcgtgtatgagtgcgggggatcgcgtatgagtggggggatcgtgtatgagtgtggggggttatgtacgagtgttggggtcgtgtgtgggtgggggggttgtgtgtgggggtaggggatcgtgtttgagtgtaggggatcgtgtatgagtgtaggggtcgtgtatgagtgcgaggggtcgtgtatgagtgggtcgtgtatgagtgtgaggggtcgtgtatgagtgtggggtcgtgtatgagtgcgaggggttatgtatgagtgtagggggttatgtatgagtgtgaggggtcgtgtatgagtggggtggtcgtgtatgagtgtagggggtcgtgtatgagtgtgaggggttatgaatgagtgcggggttgggtatgagtgtgaggggttatgtgtgagtgtggggttatgtatgagtgcgaggggtcgtgtacgagtgcggggattatgtacgagtgtggggatcgtgtatgagtttggggggttatgtacgagtgcggagattgtgtatgagtgggggggtcgtgtatgagtgcgggggtcgtgtatgagtggggggatcgtgtacgagtgtggggagttatgtacgagtgtaggggttatgtacgagtgcggagattgtgtatgagtggggggttcgtgtatgagtgcgggtatcgtgtatgagtgcgggggattgtgtacgagtgaggagattatgtacgagtgtgggggattatgtaagagtgcgggggtcgtgtgtgagtgcgggggattgtgtacgagtgaggagattatgtacgagtgtgagggattatgtaagagtgcgggggtcgtgtatgagtgcggagatcgtgtatgagtgcggagatcgtgtatgagtacgggggattatgtatgagtggggggggttatgtatgagtgcggggatcgtgtatgagtgggggggatcgtgtatgagtgtggggatcgtgtacgagtgcggggggttatgtacgagtgcggagattgtgtatgagtgggggggtcgtgtatgagtgtgggggatcgtgtatgagtggggtgtcgtgtatgagtgtgggtatcgtgtatgagtatagggattgtgtatgagtgcggggatcgtgtatgagtgcggggggttatgtatgagtgtgggggatcgtgtatgagtaggggggtcgtgtatgagtgcgggggtcgtgtattagtgtgggtgtcgtgtatgagtgtggagatcgtgtatgagtgcggggggtcgtgtataagtgcgggggtcgtgtatgagtgcgggggtcgtgtgtgagtgcggaggtcgt

SEQ ID NO: 37488 - DNA, 1716 bp, Artificial Sequence
  chemically treated genomic DNA (Homo sapiens) CpG-island No: 37488
acgacctccgcactcacacacgacccccgcactcatacacgacccccgcacttatacacgaccccccgcactcatacacgatctccacactcatacacgacacccacactaatacacgacccccgcactcatacacgacccccctactcatacacgatcccccacactcatacataaccccccgcactcatacacgatccccgcactcatacacaatccctatactcatacacgatacccacactcatacacgacaccccactcatacacgatcccccacactcatacacgacccccccactcatacacaatctccgcactcgtacataaccccccgcactcgtacacgatccccacactcatacacgatcccccccactcatacacgatccccgcactcatacataaccccccccactcatacataatcccccgtactcatacacgatctccgcactcatacacgatctccgcactcatacacgacccccgcactcttacataatccctcacactcgtacataatctcctcactcgtacacaatcccccgcactcacacacgacccccgcactcttacataatcccccacactcgtacataatctcctcactcgtacacaatcccccgcactcatacacgatacccgcactcatacacgaaccccccactcatacacaatctccgcactcgtacataacccctacactcgtacataactccccacactcgtacacgatccccccactcatacacgacccccgcactcatacacgacccccccactcatacacaatctccgcactcgtacataaccccccaaactcatacacgatccccacactcgtacataatccccgcactcgtacacgacccctcgcactcatacataaccccacactcacacataacccctcacactcatacccaaccccgcactcattcataacccctcacactcatacacgaccccctacactcatacacgaccaccccactcatacacgacccctcacactcatacataaccccctacactcatacataacccctcgcactcatacacgaccccacactcatacacgacccctcacactcatacacgacccactcatacacgacccctcgcactcatacacgacccctacactcatacacgatcccctacactcaaacacgatcccctacccccacacacaacccccccacccacacacgaccccaacactcgtacataaccccccacactcatacacgatccccccactcatacgcgatcccccgcactcatacacgacccccgcactcatacacgacccccgcactcatacacgacccccccactcatacacgatctctacactcatacataaccccccacacttatacacgatacccacactcatacacgaccccccgcactcatacacaactccccgcactcaaacacgaccccccgcacccacacacgaccccccgcacccacacacgatccccccacccacacataaccccccgcactcatacacgacccccacactcatacataatacccccacttatacacaatccccgcactcatacacaacccccgactcaaacataacccccctactcatacacgaacccccacaataatacataacccccccactcatacacaaaccccacactcatacataatccccgcactcatacataaccccccccaactcat

SEQ ID NO: 37489 - DNA, 646 bp, Artificial Sequence
  chemically treated genomic DNA (Homo sapiens) CpG-island No: 37489
gatcgtttcgggtttttagcgaatttcgatttggttcgtagaagtcgcgcgtcgtttatttttcggtttttttttaggcgaggttttttagtattcgaggtttttttttttcgagttcgtagcggtagcgtttttagcgggttttcgggaaggagatagttcgggtattgagggcgggaaagtaaggaagaggttagatttttatgttttgtttttgcgtcgtcgtcgtcgtcgtcgtcgtcgggaagttcggggttcggatgtaggtaattttattagtcgttagaggcgaaagttcgatatttagtttcggttagagaaatgagagggaaagtaaaaatgcgtcgagttttgaggagagttttcgtttttattcgcgttttttttcggtagtcgaattttaaatagttattcgttaggatgtcgtttttttatttatttattcgttatcgtttgcgttttcgtcgtcgcgggcgtaggtatcgtaatcgtagtttcgtttcgggttcgttttcgggttcgtttcgattacgtttcggtttcggtttcggtttttagcgcgcgatttttgagttttagagtttgttataggttgcggttgtttttttttttgtttttttttggttaatttttattaggttttttt

SEQ ID NO: 37490 - DNA, 646 bp, Artificial Sequence
  chemically treated genomic DNA (Homo sapiens) CpG-island No: 37490
aaaaaaacctaataaaaattaaccaaaaaaaaacaaaaaaaaaaacaaccgcaacctataacaaactctaaaactcaaaaatcgcgcgctaaaaaccgaaaccgaaaccgaaacgtaatcgaaacgaacccgaaaacgaacccgaaacgaaactacgattacgatacctacgcccgcgacgacgaaaacgcaaacgataacgaataaataaataaaaaaacgacatcctaacgaataactatttaaaattcgactaccgaaaaaaaacgcgaataaaaacgaaaactctcctcaaaactcgacgcatttttactttccctctcatttctctaaccgaaactaaatatcgaactttcgcctctaacgactaataaaattacctacatccgaaccccgaacttcccgacgacgacgacgacgacgacgacgcaaaaacaaaacataaaaatctaacctcttccttactttcccgccctcaatacccgaactatctccttcccgaaaacccgctaaaaacgctaccgctacgaactcgaaaaaaaaaaacctcgaatactaaaaaacctcgcctaaaaaaaaaccgaaaaataaacgacgcgcgacttctacgaaccaaatcgaaattcgctaaaaacccgaaacgatc

SEQ ID NO: 37491 - DNA, 646 bp, Artificial Sequence
  chemically treated genomic DNA (Homo sapiens) CpG-island No: 37491
gaaaagatttgataaagattaattagaagaaaataaggagggaaataatcgtagtttgtagtaagttttggaatttaggagtcgcgcgttaggggtcggggtcggggtcggggcgtggtcggggcgggttcgggggcgggttcggggcggggttgcggttgcggtgtttgcgttcgcggcggcggaggcgtaggcggtggcgagtgggtgagtgaggaggcggtattttggcgggtggttgtttggggttcggttgtcgggaagaggcgcgggtagaagcgggggttttttttagagttcgacgtatttttatttttttttttatttttttgatcgaagttgggtgtcgggttttcgtttttagcgattggtggaattgtttgtattcgggtttcgggtttttcggcggcggcggcggcggcggcggcgtagggataaggtatggggatttggttttttttttgttttttcgtttttagtattcgagttgtttttttttcggggattcgttgggagcgttgtcgttgcgggttcgagaaaagggagtttcgggtattgagaggtttcgtttgggggaaggtcggagggtgggcggcgcgcggtttttgcggattaagtcggggttcgttaggaattcgagacggtt

SEQ ID NO: 37492 - DNA, 646 bp, Artificial Sequence
  chemically treated genomic DNA (Homo sapiens) CpG-island No: 37492
aaccgtctcgaattcctaacgaaccccgacttaatccgcaaaaaccgcgcgccgcccaccctccgaccttcccccaaacgaaacctctcaatacccgaaactcccttttctcgaacccgcaacgacaacgctcccaacgaatccccgaaaaaaaaacaactcgaatactaaaaacgaaaaaacaaaaaaaaaaccaaatccccataccttatccctacgccgccgccgccgccgccgccgccgaaaaacccgaaacccgaatacaaacaattccaccaatcgctaaaaacgaaaacccgacacccaacttcgatcaaaaaaataaaaaaaaaaataaaaatacgtcgaactctaaaaaaaacccccgcttctacccgcgcctcttcccgacaaccgaaccccaaacaaccacccgccaaaataccgcctcctcactcacccactcgccaccgcctacgcctccgccgccgcgaacgcaaacaccgcaaccgcaaccccgccccgaacccgcccccgaacccgccccgaccacgccccgaccccgaccccgacccctaacgcgcgactcctaaattccaaaacttactacaaactacgattatttccctccttattttcttctaattaatctttatcaaatcttttc

SEQ ID NO: 37493 - DNA, 1179 bp, Artificial Sequence
  chemically treated genomic DNA (Homo sapiens) CpG-island No: 37493
gcgatgttgtttttgttggcgttagatgtttgtttttgcggcgtggaaggacgagtttcgtttttttcggttgtagatttatcgtcgattatcgttttgtaatcggttttaggttgcgggtagttggaggtagtagcggtcgtggcgttgttttcggtgttgaaatcgtgtataaattagcggaagttgaatatttgtatcgatagagagtcgagtattacgaagaagagcgtgagttcgaattattagcgttggtcgcgtaggtagtagtttacggcgagttagacgtttgtgtttacgttcgcgaagtatacggttacggcggttaggatttagaggtagttttatagtgagtagcgtcgttgttttttgtttaggcgtaggtatagcgtagtcgagttcgtttcgtcgtcgttcgggtcggcgacgtcgtcggagtcgttcgagttcgcggagtcgttattttcggcgtagtagtagtagtagcgcgagtagtcgtcgtcgttcgggtagtagtcgttttcggtcgttttttcgttttcggttttcgatttcgacggtaagtttggagttaatttttgtatcgagttcgagtggttcgagttttgtagcggggtgaacgttacgtcgttgtttttttttatttttagtttttcgtttgatttagcggttatgatgtttttatatcggaggagagtttttttttatttgatattttttttcgttgtttttttttttcgttattttttcgtttcgtttcggttttttttttaggcggtgcggttttttttttttttgtttttgcgtcggttcgtttgtcgttcgtcgtcgttcgtcgttcgtcgggttgggcgttgggtcgggttagcggcgcgtttggggtcggtaggagcgtcgtttggttgtttgcgcggagttaagttgttcgcggcgtttcgcgcgcgtttttgttcgtcgttcgcgtttttcgtcgtttcggtttcgttgttgtcgttcgagtcgtcgtcgtcgttagtagtaggagtagtagcggtcgtcgcggcgtttttcggatttgtatatttttttttttttttcgcgcgcgtttttttttttcgtttttttttttttattagttgatttcgagggagaggatgattttatttttttttttttagttgtcgtcgtttttattttggt

SEQ ID NO: 37494 - DNA, 1179 bp, Artificial Sequence
  chemically treated genomic DNA (Homo sapiens) CpG-island No: 37494
accaaaataaaaacgacgacaactaaaaaaaaaaaaataaaatcatcctctccctcgaaatcaactaataaaaaaaaaaaaacgaaaaaaaaaaacgcgcgcgaaaaaaaaaaaaaaatatacaaatccgaaaaacgccgcgacgaccgctactactcctactactaacgacgacgacgactcgaacgacaacaacgaaaccgaaacgacgaaaaacgcgaacgacgaacaaaaacgcgcgcgaaacgccgcgaacaacttaactccgcgcaaacaaccaaacgacgctcctaccgaccccaaacgcgccgctaacccgacccaacgcccaacccgacgaacgacgaacgacgacgaacgacaaacgaaccgacgcaaaaacaaaaaaaaaaaaaaccgcaccgcctaaaaaaaaaaccgaaacgaaacgaaaaaataacgaaaaaaaaaaacaacgaaaaaaaatatcaaataaaaaaaaactctcctccgatataaaaacatcataaccgctaaatcaaacgaaaaactaaaaataaaaaaaaacaacgacgtaacgttcaccccgctacaaaactcgaaccactcgaactcgatacaaaaattaactccaaacttaccgtcgaaatcgaaaaccgaaaacgaaaaaacgaccgaaaacgactactacccgaacgacgacgactactcgcgctactactactactacgccgaaaataacgactccgcgaactcgaacgactccgacgacgtcgccgacccgaacgacgacgaaacgaactcgactacgctatacctacgcctaaacaaaaaacaacgacgctactcactataaaactacctctaaatcctaaccgccgtaaccgtatacttcgcgaacgtaaacacaaacgtctaactcgccgtaaactactacctacgcgaccaacgctaataattcgaactcacgctcttcttcgtaatactcgactctctatcgatacaaatattcaacttccgctaatttatacacgatttcaacaccgaaaacaacgccacgaccgctactacctccaactacccgcaacctaaaaccgattacaaaacgataatcgacgataaatctacaaccgaaaaaaacgaaactcgtccttccacgccgcaaaaacaaacatctaacgccaacaaaaacaacatcgc

SEQ ID NO: 37495 - DNA, 1179 bp, Artificial Sequence
  chemically treated genomic DNA (Homo sapiens) CpG-island No: 37495
gttagggtgggagcgacggtagttggaagagaagggatgaggttattttttttttcggagttagttggtggaggagaggaagcgggaggagggagcgcgcgcgaggggaggagaggaatgtgtaggttcgaggagcgtcgcggcggtcgttgttgtttttgttgttggcggcggcggcggttcgggcggtagtagcgaagtcgggacggcgaggagcgcgggcggcgggtaggggcgcgcgcggggcgtcgcgagtagtttggtttcgcgtaggtagttaggcggcgtttttgtcggttttaggcgcgtcgttagttcggtttagcgtttagttcggcgggcggcgggcggcggcggacggtaggcgagtcgacgtaggagtaggaggagggggagtcgtatcgtttgggagggaagtcggggcgaggcgaggaggtggcgggaggaggagatagcggggaaaggtgttagataaaggagggttttttttcggtgtggaggtattatggtcgttaaattagacgggaggttgaaaatgaagaaaagtagcgacgtggcgtttatttcgttgtagaattcggattattcgggttcggtgtagggattggttttaggtttgtcgtcggggtcgggagtcgaggacgaggaggcggtcgggggcggttgttgttcggacggcggcggttgttcgcgttgttgttgttgttgcgtcgggagtggcggtttcgcgggttcgggcggtttcggcggcgtcgtcggttcgggcggcggcggggcgggttcggttgcgttgtgtttgcgtttgggtagggagtagcggcgttatttattgtgggattgtttttggattttggtcgtcgtggtcgtgtatttcgcggacgtgggtatagacgtttggttcgtcgtggattattatttgcgcggttagcgttggtggttcgggtttacgttttttttcgtggtgttcggttttttgtcggtgtaagtgtttagttttcgttggtttgtgtacgattttagtatcgaggatagcgttacggtcgttgttgtttttagttgttcgtagtttggagtcgattgtaagacggtggtcggcggtgggtttgtagtcggggaaggcgaggttcgtttttttacgtcgtaaaggtaagtatttaacgttagtaagagtaatatcgt

SEQ ID NO: 37496 - DNA, 1179 bp, Artificial Sequence
  chemically treated genomic DNA (Homo sapiens) CpG-island No: 37496
acgatattactcttactaacgttaaatacttacctttacgacgtaaaaaaacgaacctcgccttccccgactacaaacccaccgccgaccaccgtcttacaatcgactccaaactacgaacaactaaaaacaacaacgaccgtaacgctatcctcgatactaaaatcgtacacaaaccaacgaaaactaaacacttacaccgacaaaaaaccgaacaccacgaaaaaaaacgtaaacccgaaccaccaacgctaaccgcgcaaataataatccacgacgaaccaaacgtctatacccacgtccgcgaaatacacgaccacgacgaccaaaatccaaaaacaatcccacaataaataacgccgctactccctacccaaacgcaaacacaacgcaaccgaacccgccccgccgccgcccgaaccgacgacgccgccgaaaccgcccgaacccgcgaaaccgccactcccgacgcaacaacaacaacaacgcgaacaaccgccgccgtccgaacaacaaccgcccccgaccgcctcctcgtcctcgactcccgaccccgacgacaaacctaaaaccaatccctacaccgaacccgaataatccgaattctacaacgaaataaacgccacgtcgctacttttcttcattttcaacctcccgtctaatttaacgaccataatacctccacaccgaaaaaaaaccctcctttatctaacacctttccccgctatctcctcctcccgccacctcctcgcctcgccccgacttccctcccaaacgatacgactccccctcctcctactcctacgtcgactcgcctaccgtccgccgccgcccgccgcccgccgaactaaacgctaaaccgaactaacgacgcgcctaaaaccgacaaaaacgccgcctaactacctacgcgaaaccaaactactcgcgacgccccgcgcgcgcccctacccgccgcccgcgctcctcgccgtcccgacttcgctactaccgcccgaaccgccgccgccgccaacaacaaaaacaacaacgaccgccgcgacgctcctcgaacctacacattcctctcctcccctcgcgcgcgctccctcctcccgcttcctctcctccaccaactaactccgaaaaaaaaaataacctcatcccttctcttccaactaccgtcgctcccaccctaac

SEQ ID NO: 37497 - DNA, 836 bp, Artificial Sequence
  chemically treated genomic DNA (Homo sapiens) CpG-island No: 37497
tagcgtaaattttttcgtttcggaaatcgtggtttgtaagtttaagaggtcggtttttgattcggtcgaatttatttgggagattttggaggtaatgaaggcgagtacgaaggtaaggggcgttcgggtcggaaatcgtgtaattttagatattttttagattcggtttatcgttttcgttcgtagtttgggttagggtgtttgtttatttgggttatgcgtttgcgaatttgcgttatttttttttgaaattcgatatttttttgcggattaagcgataggattggtttagtcgggttagaaaaagtcgttatgttaaaagtcgtcgacgttaattacgcggcgttttcggaaacgtcgggtttttagttttttcgaggcggaagtagaggtaggataggggcggggcgaagcgttaaggcgaggcgaggcgtggcgaggggcggggagggttatgagtcgggcgcggggttggagtaggagttgttcggagaagcgggggcggggtacggggtgtggcgaggcgcggggcggggtataaattgcgttaggggcgagggcggggtacgaggtcgtgtcgagagattgggagaggcgtgagtcgcgcggaggcgcgatatggggcgtgacgaggagcggagggcggggcgtgagtagcgtcgaggcgcggaggcggggcgtaggggcgtgtcgaggcgcggtagcggggtttggggttggggttgggtcgtggggagttttcgtattttcggttgtcggggcgtcggttggtttcgtttaagagtgtttgaaataattacgtttacgtttatttttaaaaaaggtttaaaataaat

SEQ ID NO: 37498 - DNA, 836 bp, Artificial Sequence
  chemically treated genomic DNA (Homo sapiens) CpG-island No: 37498
atttattttaaaccttttttaaaaataaacgtaaacgtaattatttcaaacactcttaaacgaaaccaaccgacgccccgacaaccgaaaatacgaaaactccccacgacccaaccccaaccccaaaccccgctaccgcgcctcgacacgcccctacgccccgcctccgcgcctcgacgctactcacgccccgccctccgctcctcgtcacgccccatatcgcgcctccgcgcgactcacgcctctcccaatctctcgacacgacctcgtaccccgccctcgcccctaacgcaatttataccccgccccgcgcctcgccacaccccgtaccccgcccccgcttctccgaacaactcctactccaaccccgcgcccgactcataaccctccccgcccctcgccacgcctcgcctcgccttaacgcttcgccccgcccctatcctacctctacttccgcctcgaaaaaactaaaaacccgacgtttccgaaaacgccgcgtaattaacgtcgacgacttttaacataacgactttttctaacccgactaaaccaatcctatcgcttaatccgcaaaaaaatatcgaatttcaaaaaaaaataacgcaaattcgcaaacgcataacccaaataaacaaacaccctaacccaaactacgaacgaaaacgataaaccgaatctaaaaaatatctaaaattacacgatttccgacccgaacgccccttaccttcgtactcgccttcattacctccaaaatctcccaaataaattcgaccgaatcaaaaaccgacctcttaaacttacaaaccacgatttccgaaacgaaaaaatttacgcta

SEQ ID NO: 37499 - DNA, 836 bp, Artificial Sequence
  chemically treated genomic DNA (Homo sapiens) CpG-island No: 37499
atttattttagattttttttgaaagtaggcgtgaacgtaattgttttaggtatttttaagcgaagttagtcggcgtttcgatagtcgagggtgcgggagttttttacggtttagttttagttttagatttcgttgtcgcgtttcggtacgtttttgcgtttcgttttcgcgtttcggcgttatttacgtttcgtttttcgtttttcgttacgttttatgtcgcgttttcgcgcgatttacgttttttttagtttttcggtacgatttcgtgtttcgttttcgtttttggcgtaatttatgtttcgtttcgcgtttcgttatatttcgtgtttcgttttcgttttttcgggtaatttttgttttaatttcgcgttcgatttatggtttttttcgtttttcgttacgtttcgtttcgttttagcgtttcgtttcgtttttgttttgtttttattttcgtttcgggggagttgggagttcgacgttttcgggagcgtcgcgtggttagcgtcggcggtttttggtatggcgattttttttggttcggttgggttaattttgtcgtttaattcgtaggaagatgtcgagttttaaaaggaggtggcgtaggttcgtaagcgtataatttaggtgagtaggtattttggtttaggttgcgagcgggggcgatggatcgggtttagagggtatttggggttgtacggttttcggttcgggcgttttttgttttcgtgttcgtttttattatttttagggttttttaagtggattcgatcgaattagggatcgattttttaagtttgtaggttacggttttcgagacgaaagggtttacgttg

SEQ ID NO: 37500 - DNA, 836 bp, Artificial Sequence
  chemically treated genomic DNA (Homo sapiens) CpG-island No: 37500
caacgtaaaccctttcgtctcgaaaaccgtaacctacaaacttaaaaaatcgatccctaattcgatcgaatccacttaaaaaaccctaaaaataataaaaacgaacacgaaaacaaaaaacgcccgaaccgaaaaccgtacaaccccaaataccctctaaacccgatccatcgcccccgctcgcaacctaaaccaaaatacctactcacctaaattatacgcttacgaacctacgccacctccttttaaaactcgacatcttcctacgaattaaacgacaaaattaacccaaccgaaccaaaaaaaatcgccataccaaaaaccgccgacgctaaccacgcgacgctcccgaaaacgtcgaactcccaactcccccgaaacgaaaataaaaacaaaacaaaaacgaaacgaaacgctaaaacgaaacgaaacgtaacgaaaaacgaaaaaaaccataaatcgaacgcgaaattaaaacaaaaattacccgaaaaaacgaaaacgaaacacgaaatataacgaaacgcgaaacgaaacataaattacgccaaaaacgaaaacgaaacacgaaatcgtaccgaaaaactaaaaaaaacgtaaatcgcgcgaaaacgcgacataaaacgtaacgaaaaacgaaaaacgaaacgtaaataacgccgaaacgcgaaaacgaaacgcaaaaacgtaccgaaacgcgacaacgaaatctaaaactaaaactaaaccgtaaaaaactcccgcaccctcgactatcgaaacgccgactaacttcgcttaaaaatacctaaaacaattacgttcacgcctactttcaaaaaaaatctaaaataaat

SEQ ID NO: 37501 - DNA, 642 bp, Artificial Sequence
  chemically treated genomic DNA (Homo sapiens) CpG-island No: 37501
  misc_feature (428)..(428): n is either a, c, g or t
tcggaacgattataggttttcggggcgcgtttttttcgttacgcgtttcgttttttacgtttacgtatgcggtttttttaggtttggaaagcgtttagagttaaagagtttaggggtttgttcgcgtagaggtcgacgtggggttagggacgcgttttcggggtttttttcgtcgagttcgtagtttagtattcggagcgatttttcgagttcgaggggcgtgggaattacgcgcgtaagtcggttgtttttttagtttcgggacgtttttttattaggttagtgttaggcgggcggtcgggattcggggatcgtagttttcggagcgtttatttgggtggcgtaggttaaggacgtttatggatagcgcgatttttttttattttatatacgcgtttacgattaaagtgcgtatgttcgatatttgngattaataggaatttcggttcgagggtagttggggttaattatagcgcgtttggcgtgtgggcggtgttttttcgtgttacgcgtgcgcggaggggttgcgttattcggttttgggttttttatcggggagtgggagtggattgaaggtttggcgtttcgttttattgagtcggtttagttagcgtagttgtttttggaacgttagttttttag

SEQ ID NO: 37502 - DNA, 642 bp, Artificial Sequence
  chemically treated genomic DNA (Homo sapiens) CpG-island No: 37502
  misc_feature (215)..(215): n is either a, c, g or t
ctaaaaaactaacgttccaaaaacaactacgctaactaaaccgactcaataaaacgaaacgccaaaccttcaatccactcccactccccgataaaaaacccaaaaccgaataacgcaacccctccgcgcacgcgtaacacgaaaaaacaccgcccacacgccaaacgcgctataattaaccccaactaccctcgaaccgaaattcctattaatcncaaatatcgaacatacgcactttaatcgtaaacgcgtatataaaataaaaaaaaatcgcgctatccataaacgtccttaacctacgccacccaaataaacgctccgaaaactacgatccccgaatcccgaccgcccgcctaacactaacctaataaaaaaacgtcccgaaactaaaaaaacaaccgacttacgcgcgtaattcccacgcccctcgaactcgaaaaatcgctccgaatactaaactacgaactcgacgaaaaaaaccccgaaaacgcgtccctaaccccacgtcgacctctacgcgaacaaacccctaaactctttaactctaaacgctttccaaacctaaaaaaaccgcatacgtaaacgtaaaaaacgaaacgcgtaacgaaaaaaacgcgccccgaaaacctataatcgttccga

SEQ ID NO: 37503 - DNA, 642 bp, Artificial Sequence
  chemically treated genomic DNA (Homo sapiens) CpG-island No: 37503
  misc_feature (215)..(215): n is either a, c, g or t
ttaagggattggcgttttaggaatagttgcgttggttgagtcggtttagtgaggcggagcgttaagtttttagtttatttttatttttcgatgaaaaatttaagatcgggtagcgtagttttttcgcgtacgcgtaatacgaggagatatcgtttatacgttagacgcgttgtgattggttttagttattttcggatcgagatttttattggttntaggtgtcgagtatgcgtattttggtcgtgggcgcgtgtgtggaatgggaggaggtcgcgttgtttatgggcgtttttggtttgcgttatttaggtgagcgtttcggaggttgcgattttcgggtttcgatcgttcgtttagtattggtttgatggggaagcgtttcgggattggaagggtagtcggtttgcgcgcgtggtttttacgtttttcgggttcgggggatcgtttcgggtgttgggttgcgggttcggcggggaggatttcgggagcgcgtttttggttttacgtcggtttttgcgcgggtaagtttttgggttttttggttttagacgttttttaggtttggggaaatcgtatgcgtggacgtgggaaacggggcgcgtgacggggagggcgcgtttcgggggtttgtggtcgtttcga

SEQ ID NO: 37504 - DNA, 642 bp, Artificial Sequence
  chemically treated genomic DNA (Homo sapiens) CpG-island No: 37504
  misc_feature (428)..(428): n is either a, c, g or t
tcgaaacgaccacaaacccccgaaacgcgccctccccgtcacgcgccccgtttcccacgtccacgcatacgatttccccaaacctaaaaaacgtctaaaaccaaaaaacccaaaaacttacccgcgcaaaaaccgacgtaaaaccaaaaacgcgctcccgaaatcctccccgccgaacccgcaacccaacacccgaaacgatcccccgaacccgaaaaacgtaaaaaccacgcgcgcaaaccgactacccttccaatcccgaaacgcttccccatcaaaccaatactaaacgaacgatcgaaacccgaaaatcgcaacctccgaaacgctcacctaaataacgcaaaccaaaaacgcccataaacaacgcgacctcctcccattccacacacgcgcccacgaccaaaatacgcatactcgacacctanaaccaataaaaatctcgatccgaaaataactaaaaccaatcacaacgcgtctaacgtataaacgatatctcctcgtattacgcgtacgcgaaaaaactacgctacccgatcttaaatttttcatcgaaaaataaaaataaactaaaaacttaacgctccgcctcactaaaccgactcaaccaacgcaactattcctaaaacgccaatcccttaa

SEQ ID NO: 37505 - DNA, 737 bp, Artificial Sequence
  chemically treated genomic DNA (Homo sapiens) CpG-island No: 37505
ttacgcgagggattttcgtcgtgggatgtcgtcgtaggagtgggttatttatacgggtcgcgtggatgtcgttcgttttatgtagaggttgttggagcgtttttgttcggagtagttttgggagaagtatcggttcgagtttcgttttttgaagcgggcggatcgcgggttttaagaattgtttgtagaggtttatagattgcgtgttgttcgtgttgacgtcgcgtcgtgcgggttcggaggacgggggcgttttggattatatggtcggatgattacgagtttttatatttcgtcgtggttatcgtgtgttagatcgtgtgttttgagagtttttcgagcgtggggaagaggcggttggcggtgtaggagattttggcggcgcgggttgtacggggttttaggcgtaggaggaggatgaggtggggggcgcggggtagtcgggcggatcggataggaggacgcggattttcgggaggtttttcgagagtcggtttttttttcgttttggggtttcggggtttcgtagcgttcgtttcgcgaaaggttagttttttgtttttgtagcgtttgcggaagaagcgtgcggttcggtgtggtgtgttcgggttcgagttagtaacgttcgttattttttagttcgagcggtcggcgcggaagggtagtattaaggatagcggttatttgtagatttttaagtggcggtataaggaggttaaggaggagaagaggaaggt

SEQ ID NO: 37506 - DNA, 737 bp, Artificial Sequence
  chemically treated genomic DNA (Homo sapiens) CpG-island No: 37506
accttcctcttctcctccttaacctccttataccgccacttaaaaatctacaaataaccgctatccttaatactacccttccgcgccgaccgctcgaactaaaaaataacgaacgttactaactcgaacccgaacacaccacaccgaaccgcacgcttcttccgcaaacgctacaaaaacaaaaaactaacctttcgcgaaacgaacgctacgaaaccccgaaaccccaaaacgaaaaaaaaaccgactctcgaaaaacctcccgaaaatccgcgtcctcctatccgatccgcccgactaccccgcgccccccacctcatcctcctcctacgcctaaaaccccgtacaacccgcgccgccaaaatctcctacaccgccaaccgcctcttccccacgctcgaaaaactctcaaaacacacgatctaacacacgataaccacgacgaaatataaaaactcgtaatcatccgaccatataatccaaaacgcccccgtcctccgaacccgcacgacgcgacgtcaacacgaacaacacgcaatctataaacctctacaaacaattcttaaaacccgcgatccgcccgcttcaaaaaacgaaactcgaaccgatacttctcccaaaactactccgaacaaaaacgctccaacaacctctacataaaacgaacgacatccacgcgacccgtataaataacccactcctacgacgacatcccacgacgaaaatccctcgcgtaa

SEQ ID NO: 37507 - DNA, 737 bp, Artificial Sequence
  chemically treated genomic DNA (Homo sapiens) CpG-island No: 37507
gtttttttttttttttttttggtttttttgtatcgttatttggggatttgtaggtggtcgttgtttttggtgttgttttttcgcgtcggtcgttcgggttggaaggtggcgggcgttgttgattcggattcgggtatattatatcgggtcgtacgtttttttcgtaggcgttgtaggggtaggaggttggtttttcgcggggcgggcgttgcggggtttcgggattttagggcgggagggaggtcggttttcggggagtttttcgggagttcgcgtttttttgttcggttcgttcggttgtttcgcgttttttattttattttttttttgcgtttggggtttcgtgtagttcgcgtcgttaggattttttgtatcgttagtcgttttttttttacgttcggagggtttttagggtatacggtttggtatacgatggttacggcggggtgtagaggttcgtggttattcgattatgtggtttaggacgttttcgtttttcgggttcgtacgacgcggcgttagtacggatagtacgtagtttgtgagtttttgtaggtagtttttggagttcgcggttcgttcgttttagggggcggagttcgggtcggtattttttttagaattgtttcgggtaggggcgttttagtagtttttgtatgagacggacggtatttacgcggttcgtgtaagtggtttatttttgcggcgatattttacggcgggggtttttcgcgtgg

SEQ ID NO: 37508 - DNA, 737 bp, Artificial Sequence
  chemically treated genomic DNA (Homo sapiens) CpG-island No: 37508
ccacgcgaaaaacccccgccgtaaaatatcgccgcaaaaataaaccacttacacgaaccgcgtaaataccgtccgtctcatacaaaaactactaaaacgcccctacccgaaacaattctaaaaaaaataccgacccgaactccgccccctaaaacgaacgaaccgcgaactccaaaaactacctacaaaaactcacaaactacgtactatccgtactaacgccgcgtcgtacgaacccgaaaaacgaaaacgtcctaaaccacataatcgaataaccacgaacctctacaccccgccgtaaccatcgtataccaaaccgtataccctaaaaaccctccgaacgtaaaaaaaaaacgactaacgatacaaaaaatcctaacgacgcgaactacacgaaaccccaaacgcaaaaaaaaaataaaataaaaaacgcgaaacaaccgaacgaaccgaacaaaaaaacgcgaactcccgaaaaactccccgaaaaccgacctccctcccgccctaaaatcccgaaaccccgcaacgcccgccccgcgaaaaaccaacctcctacccctacaacgcctacgaaaaaaacgtacgacccgatataatatacccgaatccgaatcaacaacgcccgccaccttccaacccgaacgaccgacgcgaaaaaacaacaccaaaaacaacgaccacctacaaatccccaaataacgatacaaaaaaaccaaaaaaaaaaaaaaaaaaac

SEQ ID NO: 37509 - DNA, 620 bp, Artificial Sequence
  chemically treated genomic DNA (Homo sapiens) CpG-island No: 37509
ttagtgcgtatgtcgtcggtgggttcggttgcgttacgtcggcgcgcggcggtcgcgtttttttaacggtagtggtattgattcggttcgcgcggtttcggcgttttacgcgcgcgcgtcgttttttcgttcgttcgtttttcggcgtttatatttgagtttattcgcgtacgttcgttcggttcgagaatcgcgtcgcgtttcggtttcgcggaagtttcgtcgcgttatgttttcgtttttcgaagggaaattagagattaaagttggatattcgttcgtcggtattgattttttttttttttttttacgcgcgggtgtcgggggcgggttcgaattcgggggcgtcgggcggggtttcgcggggagggtttcggcgagcgttgagacgggtttcggttttgatgcgttcgaggggtcgggtcgcggagaggtcgggcgtttaggttcgggacgagttcgtcggagtttcggtttcgttttcggcggcggcgaagcgtttttttttgaggatcgcgggcggtcggtatttgtgcgattgcgcgtaggtttcggtgttttgggcgaatttagttgtataatttataataaagttttggcggataatatttatttagagg

SEQ ID NO: 37510 - DNA, 620 bp, Artificial Sequence
  chemically treated genomic DNA (Homo sapiens) CpG-island No: 37510
cctctaaataaatattatccgccaaaactttattataaattatacaactaaattcgcccaaaacaccgaaacctacgcgcaatcgcacaaataccgaccgcccgcgatcctcaaaaaaaaacgcttcgccgccgccgaaaacgaaaccgaaactccgacgaactcgtcccgaacctaaacgcccgacctctccgcgacccgacccctcgaacgcatcaaaaccgaaacccgtctcaacgctcgccgaaaccctccccgcgaaaccccgcccgacgcccccgaattcgaacccgcccccgacacccgcgcgtaaaaaaaaaaaaaaaaaatcaataccgacgaacgaatatccaactttaatctctaatttcccttcgaaaaacgaaaacataacgcgacgaaacttccgcgaaaccgaaacgcgacgcgattctcgaaccgaacgaacgtacgcgaataaactcaaatataaacgccgaaaaacgaacgaacgaaaaaacgacgcgcgcgcgtaaaacgccgaaaccgcgcgaaccgaatcaataccactaccgttaaaaaaacgcgaccgccgcgcgccgacgtaacgcaaccgaacccaccgacgacatacgcactaa

SEQ ID NO: 37511 - DNA, 620 bp, Artificial Sequence
  chemically treated genomic DNA (Homo sapiens) CpG-island No: 37511
tttttaagtaaatattattcgttaaaattttgttataagttgtgtaattgggttcgtttaaggtatcggagtttgcgcgtaatcgtataggtatcggtcgttcgcggtttttaggaagaaacgtttcgtcgtcgtcggaagcggggtcgaagtttcggcgggttcgtttcgggtttgggcgttcgattttttcgcggttcggtttttcgggcgtattaaggtcggaattcgttttagcgttcgtcggggtttttttcgcggagtttcgttcggcgttttcgggttcgagttcgttttcggtattcgcgcgtggagagagaggaaaagagttagtatcggcgggcgggtgtttagttttagtttttagttttttttcgggaggcgaagatatggcgcggcggggttttcgcggggtcgaggcgcggcgcggttttcgggtcgggcgggcgtgcgcgagtgagtttaggtgtgagcgtcggggagcgagcgggcgggagaacgacgcgcgcgcgtggggcgtcggggtcgcgcgagtcgggttagtgttattgtcgttaagggggcgcggtcgtcgcgcgtcgacgtggcgtagtcgagtttatcgacggtatgcgtattga

SEQ ID NO: 37512 - DNA, 620 bp, Artificial Sequence
  chemically treated genomic DNA (Homo sapiens) CpG-island No: 37512
tcaatacgcataccgtcgataaactcgactacgccacgtcgacgcgcgacgaccgcgcccccttaacgacaataacactaacccgactcgcgcgaccccgacgccccacgcgcgcgcgtcgttctcccgcccgctcgctccccgacgctcacacctaaactcactcgcgcacgcccgcccgacccgaaaaccgcgccgcgcctcgaccccgcgaaaaccccgccgcgccatatcttcgcctcccgaaaaaaaactaaaaactaaaactaaacacccgcccgccgatactaactcttttcctctctctccacgcgcgaataccgaaaacgaactcgaacccgaaaacgccgaacgaaactccgcgaaaaaaaccccgacgaacgctaaaacgaattccgaccttaatacgcccgaaaaaccgaaccgcgaaaaaatcgaacgcccaaacccgaaacgaacccgccgaaacttcgaccccgcttccgacgacgacgaaacgtttcttcctaaaaaccgcgaacgaccgatacctatacgattacgcgcaaactccgataccttaaacgaacccaattacacaacttataacaaaattttaacgaataatatttacttaaaaa

SEQ ID NO: 37513 - DNA, 909 bp, Artificial Sequence
  chemically treated genomic DNA (Homo sapiens) CpG-island No: 37513
gtttttgagagtagatagcgcgggttgggagcgtcggtaagggcggttttcgcgtatttggttgttagttcgtagggggttcgtacgtagatttgtttttgttattttagcgttcgggtgcgggttgggggcggtggagttacgaaaggtggtgtcgagagcggagcgtaggatagcgtaggagtttcggcgtatcgcggcgcgtatagatttaggtgagtgttgttttcgtagcgattgttggtcgggcgcggtttttttttttagggtttcgagttgagaagaggggggcgaggggtgttttcgcgggttatcgcgaagagtttagaggttaagttttagcgcgagttggggcgagaggcgtgtgtcgggttcgtagtacggttcgcggcgcggcgcgtttaaagtttattcgtttttcggtttttttcggattttttgtttttcgttaattattcgtttttatttttttggttcggacgtttttattttcggcgggagacgtttgtcgttttcggggcgtttggtacgtcggtgagaggagttggggggttcgtcggcgtagtttgtcgggtagtcgtcgtttttttcgttagatttgcgttcgcgggagaagagagtcgttttttcgcgttgttttttcgttggtttttttgggttttcgcgtgtagatagtttggttcgtttagggaaagaatgagtgtgggacgtgattcgtagtgtgtggttgtgtatttacgtaggtaaacgttttttggtagattcgttattattttatataattagtttagttttcgcgtatatagatacgtttcgtatcgtttacggttttaaatattttttttagcgatttttatatagtttaggcgtttttaatttttggattaatatataggtttgtttaacggg

SEQ ID NO: 37514 - DNA, 909 bp, Artificial Sequence
  chemically treated genomic DNA (Homo sapiens) CpG-island No: 37514
cccgttaaacaaacctatatattaatccaaaaattaaaaacgcctaaactatataaaaatcgctaaaaaaaatatttaaaaccgtaaacgatacgaaacgtatctatatacgcgaaaactaaactaattatataaaataataacgaatctaccaaaaaacgtttacctacgtaaatacacaaccacacactacgaatcacgtcccacactcattctttccctaaacgaaccaaactatctacacgcgaaaacccaaaaaaaccaacgaaaaaacaacgcgaaaaaacgactctcttctcccgcgaacgcaaatctaacgaaaaaaacgacgactacccgacaaactacgccgacgaaccccccaactcctctcaccgacgtaccaaacgccccgaaaacgacaaacgtctcccgccgaaaataaaaacgtccgaaccaaaaaaataaaaacgaataattaacgaaaaacaaaaaatccgaaaaaaaccgaaaaacgaataaactttaaacgcgccgcgccgcgaaccgtactacgaacccgacacacgcctctcgccccaactcgcgctaaaacttaacctctaaactcttcgcgataacccgcgaaaacacccctcgcccccctcttctcaactcgaaaccctaaaaaaaaaaaccgcgcccgaccaacaatcgctacgaaaacaacactcacctaaatctatacgcgccgcgatacgccgaaactcctacgctatcctacgctccgctctcgacaccacctttcgtaactccaccgcccccaacccgcacccgaacgctaaaataacaaaaacaaatctacgtacgaaccccctacgaactaacaaccaaatacgcgaaaaccgcccttaccgacgctcccaacccgcgctatctactctcaaaaac

SEQ ID NO: 37515 - DNA, 909 bp, Artificial Sequence
  chemically treated genomic DNA (Homo sapiens) CpG-island No: 37515
ttcgttgggtaggtttgtgtgttggtttaagggttgggagcgtttgagttgtgtgagggtcgttgggaagggtgtttgaggtcgtgggcggtgcggagcgtgtttgtgtgcgcggaggttgagttggttgtgtgaagtggtagcgggtttgttagagagcgtttatttgcgtgaatgtataattatatattacgggttacgttttatatttattttttttttaggcgggttaggttgtttgtacgcggagatttagagaggttagcggaagggtagcgcgggaaggcggtttttttttttcgcgagcgtagatttggcggaggaggcggcgattgttcggtaggttgcgtcggcgagttttttagttttttttatcgacgtgttaggcgtttcgaaggcgataggcgtttttcgtcgaaaatgaaggcgttcgagttaggaaggtgggggcgggtagttagcgggagataaggagttcggagaaaatcgagaggcgggtaggttttgaacgcgtcgcgtcgcgggtcgtgttgcgagttcggtatacgtttttcgttttagttcgcgttggggtttggtttttaggtttttcgcgatgattcgcgaaaatatttttcgtttttttttttttaattcggaattttggagggagaggtcgcgttcggttagtagtcgttgcgagagtagtatttatttgggtttgtgcgcgtcgcgatgcgtcggggtttttgcgttgttttgcgtttcgttttcggtattatttttcgtggttttatcgtttttagttcgtattcgagcgttgaggtggtaagggtaggtttgcgtgcgagttttttgcgggttggtagttaggtgcgcgagggtcgtttttgtcggcgtttttagttcgcgttgtttgtttttaggaat

SEQ ID NO: 37516 - DNA, 909 bp, Artificial Sequence
  chemically treated genomic DNA (Homo sapiens) CpG-island No: 37516
attcctaaaaacaaacaacgcgaactaaaaacgccgacaaaaacgaccctcgcgcacctaactaccaacccgcaaaaaactcgcacgcaaacctacccttaccacctcaacgctcgaatacgaactaaaaacgataaaaccacgaaaaataataccgaaaacgaaacgcaaaacaacgcaaaaaccccgacgcatcgcgacgcgcacaaacccaaataaatactactctcgcaacgactactaaccgaacgcgacctctccctccaaaattccgaattaaaaaaaaaaaaacgaaaaatattttcgcgaatcatcgcgaaaaacctaaaaaccaaaccccaacgcgaactaaaacgaaaaacgtataccgaactcgcaacacgacccgcgacgcgacgcgttcaaaacctacccgcctctcgattttctccgaactccttatctcccgctaactacccgcccccaccttcctaactcgaacgccttcattttcgacgaaaaacgcctatcgccttcgaaacgcctaacacgtcgataaaaaaaactaaaaaactcgccgacgcaacctaccgaacaatcgccgcctcctccgccaaatctacgctcgcgaaaaaaaaaaaccgccttcccgcgctacccttccgctaacctctctaaatctccgcgtacaaacaacctaacccgcctaaaaaaaaaataaatataaaacgtaacccgtaatatataattatacattcacgcaaataaacgctctctaacaaacccgctaccacttcacacaaccaactcaacctccgcgcacacaaacacgctccgcaccgcccacgacctcaaacacccttcccaacgaccctcacacaactcaaacgctcccaacccttaaaccaacacacaaacctacccaacgaa

SEQ ID NO: 37517 - DNA, 1427 bp, Artificial Sequence
  chemically treated genomic DNA (Homo sapiens) CpG-island No: 37517
tcggacggtatgatatcgttgcgcgaatatgtcggttattacggcggtggtagcggatttggagggtagttgcggtcgtggaatttatcgagtgaaagtgtggatgtagttttgttgtttaattttattcgtggtaatgttcgcgtagacgatttggtacgtaataacggttatgtcgttaacgttatttagttgtattaggattatatcgtcgggtttttttttcggtttagttatcgtttaagttggcgttatttgggtatcggggaggaagaagttcgtgttttttttcgcgaggttgaagcggtatggaaagagtttgtcgaggatgattgttgttgtattgacgttgagcgaaaacgtacgtttattatgatgattcgggaaggtgtggttatgtacgtttttaacggtgaattgttcgtttaggttatttgggatattagttcgtcgcggttttttcggatatagtttcggatggttagttcgaagcgtattagtaattcgaataatatcggcgatagtcggaattgtcgtgtcggtgtgtagattaatgatagcggtgcggcgttgggatattacgttagcgaggacgggtattttggttatatgtcgtagaaatggatatggatatttcgtgagttattcggcgggcgcgtttcgtttatttacgtttttgaattcgtggaggacgggtagattcgcggtgtaaatgtgttttatagcgtgatggagtagataaagatgttcgatacgttgtagaatacgtagttgtagagcgttattgtgaaggcgatgtatgtcgttattattgagagtgagttggatacgtagttagcgatggattttattttgggcgcgaatagttaggagtagcgggaaaggttgatcggttggattggtgaaattgtcgcgtattacgtcgtagcgtcggttcggttgggaggcgtaaaagtatcgtatttgatgtcgggtgatttattgaatttgtagacggtttaggatacggataacggttatttcgtgtttgagtagttattgttgcggtatatcgttgtcgggttgggtgtttcgtatgagtagttttttcggaattacgtttagatgagttattttacggtacgggttagtgcgaacgagtcgtgggcgtattttatggggcggcgaaaattcgtcgtatttcgttaggcgagttagatgtttttgtgttggttggaagaggttatcgttcgtcgcgtggtgacgttatttttaaaagcgcgttttagtttttaggaagttcgtagtgtttgggggaattgcgattggataggtttcggtcgtatggttatcgatggtttgaaagaagtttaggaagcggtgatgttgatagaagtcggattgagtatttacgagaaagagtgcgtaaaacgcggtgacgattatta

SEQ ID NO: 37518 - DNA, 1427 bp, Artificial Sequence
  chemically treated genomic DNA (Homo sapiens) CpG-island No: 37518
taataatcgtcaccgcgttttacgcactctttctcgtaaatactcaatccgacttctatcaacatcaccgcttcctaaacttctttcaaaccatcgataaccatacgaccgaaacctatccaatcgcaattcccccaaacactacgaacttcctaaaaactaaaacgcgcttttaaaaataacgtcaccacgcgacgaacgataacctcttccaaccaacacaaaaacatctaactcgcctaacgaaatacgacgaattttcgccgccccataaaatacgcccacgactcgttcgcactaacccgtaccgtaaaataactcatctaaacgtaattccgaaaaaactactcatacgaaacacccaacccgacaacgatataccgcaacaataactactcaaacacgaaataaccgttatccgtatcctaaaccgtctacaaattcaataaatcacccgacatcaaatacgatacttttacgcctcccaaccgaaccgacgctacgacgtaatacgcgacaatttcaccaatccaaccgatcaacctttcccgctactcctaactattcgcgcccaaaataaaatccatcgctaactacgtatccaactcactctcaataataacgacatacatcgccttcacaataacgctctacaactacgtattctacaacgtatcgaacatctttatctactccatcacgctataaaacacatttacaccgcgaatctacccgtcctccacgaattcaaaaacgtaaataaacgaaacgcgcccgccgaataactcacgaaatatccatatccatttctacgacatataaccaaaatacccgtcctcgctaacgtaatatcccaacgccgcaccgctatcattaatctacacaccgacacgacaattccgactatcgccgatattattcgaattactaatacgcttcgaactaaccatccgaaactatatccgaaaaaaccgcgacgaactaatatcccaaataacctaaacgaacaattcaccgttaaaaacgtacataaccacaccttcccgaatcatcataataaacgtacgttttcgctcaacgtcaatacaacaacaatcatcctcgacaaactctttccataccgcttcaacctcgcgaaaaaaaacacgaacttcttcctccccgatacccaaataacgccaacttaaacgataactaaaccgaaaaaaaaacccgacgatataatcctaatacaactaaataacgttaacgacataaccgttattacgtaccaaatcgtctacgcgaacattaccacgaataaaattaaacaacaaaactacatccacactttcactcgataaattccacgaccgcaactaccctccaaatccgctaccaccgccgtaataaccgacatattcgcgcaacgatatcataccgtccga

SEQ ID NO: 37519 - DNA, 1427 bp, Artificial Sequence
  chemically treated genomic DNA (Homo sapiens) CpG-island No: 37519
tgatagtcgttatcgcgttttgcgtattttttttcgtaggtatttagttcggtttttattagtattatcgttttttgaattttttttagattatcgatggttatacgatcggagtttatttagtcgtagtttttttaggtattgcgggttttttgaaaattgaagcgcgtttttgaaggtaacgttattacgcggcgaacgatggttttttttagttagtatagaaatatttggttcgtttgacgggatgcgacgaattttcgtcgttttataaagtacgtttacgattcgttcgtattggttcgtgtcgtggagtagtttatttgggcgtaatttcgggaaagttgtttatacgagatatttagttcggtagcgatatatcgtagtagtgattgtttaaatacggagtagtcgttattcgtattttgagtcgtttgtaggtttagtgagttattcggtattaggtgcggtatttttgcgttttttagtcggatcggcgttgcggcgtaatacgcggtaattttattaatttagtcggttagtttttttcgttgtttttgattgttcgcgtttagaataaaatttatcgttgattgcgtatttagtttatttttaatggtggcggtatatatcgtttttataatggcgttttgtagttgcgtgttttgtagcgtgtcgagtatttttatttgttttattacgttgtaaaatatatttgtatcgcgagtttgttcgttttttacgggtttaaaaacgtgaatgaacgaggcgcgttcgtcgggtaatttacggggtatttatgtttatttttgcggtatatagttaggatattcgttttcgttgacgtaatattttagcgtcgtatcgttgttattaatttgtatatcggtacggtagtttcggttgtcgtcggtattgttcgggttgttgatgcgtttcgggttgattattcggaattgtgttcggaaaagtcgcgacgaattggtattttaggtggtttgaacgaatagtttatcgttaaaggcgtgtatggttatattttttcgaattattatggtaaacgtgcgttttcgtttaacgttaatgtagtagtagttattttcggtaaattttttttatgtcgttttaatttcgcgggaaaaggtacgggttttttttttttcgatgtttagatagcgttagtttgggcgatgattgagtcggaaaaaagattcgacgatatgattttgatgtagttggatggcgttggcggtatagtcgttattgcgtattagatcgtttgcgcgggtattgttacgggtaaagttgggtaatagggttgtatttatatttttattcggtgggttttacgatcgtaattgttttttaaattcgttgttatcgtcgtgataatcggtatattcgcgtagcgatgttatgtcgttcgg

SEQ ID NO: 37520 - DNA, 1427 bp, Artificial Sequence
  chemically treated genomic DNA (Homo sapiens) CpG-island No: 37520
ccgaacgacataacatcgctacgcgaatataccgattatcacgacgataacaacgaatttaaaaaacaattacgatcgtaaaacccaccgaataaaaatataaatacaaccctattacccaactttacccgtaacaatacccgcgcaaacgatctaatacgcaataacgactataccgccaacgccatccaactacatcaaaatcatatcgtcgaatcttttttccgactcaatcatcgcccaaactaacgctatctaaacatcgaaaaaaaaaaaacccgtaccttttcccgcgaaattaaaacgacataaaaaaaatttaccgaaaataactactactacattaacgttaaacgaaaacgcacgtttaccataataattcgaaaaaatataaccatacacgcctttaacgataaactattcgttcaaaccacctaaaataccaattcgtcgcgacttttccgaacacaattccgaataatcaacccgaaacgcatcaacaacccgaacaataccgacgacaaccgaaactaccgtaccgatatacaaattaataacaacgatacgacgctaaaatattacgtcaacgaaaacgaatatcctaactatataccgcaaaaataaacataaataccccgtaaattacccgacgaacgcgcctcgttcattcacgtttttaaacccgtaaaaaacgaacaaactcgcgatacaaatatattttacaacgtaataaaacaaataaaaatactcgacacgctacaaaacacgcaactacaaaacgccattataaaaacgatatataccgccaccattaaaaataaactaaatacgcaatcaacgataaattttattctaaacgcgaacaatcaaaaacaacgaaaaaaactaaccgactaaattaataaaattaccgcgtattacgccgcaacgccgatccgactaaaaaacgcaaaaataccgcacctaataccgaataactcactaaacctacaaacgactcaaaatacgaataacgactactccgtatttaaacaatcactactacgatatatcgctaccgaactaaatatctcgtataaacaactttcccgaaattacgcccaaataaactactccacgacacgaaccaatacgaacgaatcgtaaacgtactttataaaacgacgaaaattcgtcgcatcccgtcaaacgaaccaaatatttctatactaactaaaaaaaaccatcgttcgccgcgtaataacgttaccttcaaaaacgcgcttcaattttcaaaaaacccgcaatacctaaaaaaactacgactaaataaactccgatcgtataaccatcgataatctaaaaaaaattcaaaaaacgataatactaataaaaaccgaactaaatacctacgaaaaaaaatacgcaaaacgcgataacgactatca

SEQ ID NO: 37521 - DNA, 778 bp, Artificial Sequence
  chemically treated genomic DNA (Homo sapiens) CpG-island No: 37521
tagtaggttcgtgaaacgatggagcgtcgtgtagtcggttttaaatcgttcgtttgggcggttgtagtatttgaattcgggttgcgataattaatagaggaggagaagagtgatagtagagttgcgtaatttttcgtatattgttagtatggtttttaatgagtcgttgatgtttgaattcgtttatgcgcgggtttttttttgtgcgtttgtaggttagtttgggattagtagtttgacggatgcggtgttcggcgatagtttgattgtttaggaggtattcgcgacgttggtattattcggtgatgatgacggattacgataggttcgtagttattaggttatgaacggtatcgtcgtgttgtcggtgttcggtacgttggttagtcggacgcgggcgttgtagtcgtattcggggatgatcggttataacggtattatcgttcgtttgtaataggttgttagcgattcgatggtggacggtattttgttcgatatggatacgttcggcgggatggtggcgggggtatttgattgcgttgatattatcgttcgtgtgcgtgatataaaatcggtatgggcgtttgttaacgatatgaattgtagtgtaggttagttgtttgttagtgtcgtttttcggcgtttggttacgtagatcgttcggataggttttatcggcgttatgatggtttatagtaattacggtgttgcgttggagaaatagggtgtggaaattacgttgatttatagcggtagttataaggtggatggtaatttt

SEQ ID NO: 37522 - DNA, 778 bp, Artificial Sequence
  chemically treated genomic DNA (Homo sapiens) CpG-island No: 37522
aaaattaccatccaccttataactaccgctataaatcaacgtaatttccacaccctatttctccaacgcaacaccgtaattactataaaccatcataacgccgataaaacctatccgaacgatctacgtaaccaaacgccgaaaaacgacactaacaaacaactaacctacactacaattcatatcgttaacaaacgcccataccgattttatatcacgcacacgaacgataatatcaacgcaatcaaatacccccgccaccatcccgccgaacgtatccatatcgaacaaaataccgtccaccatcgaatcgctaacaacctattacaaacgaacgataataccgttataaccgatcatccccgaatacgactacaacgcccgcgtccgactaaccaacgtaccgaacaccgacaacacgacgataccgttcataacctaataactacgaacctatcgtaatccgtcatcatcaccgaataataccaacgtcgcgaatacctcctaaacaatcaaactatcgccgaacaccgcatccgtcaaactactaatcccaaactaacctacaaacgcacaaaaaaaaacccgcgcataaacgaattcaaacatcaacgactcattaaaaaccatactaacaatatacgaaaaattacgcaactctactatcactcttctcctcctctattaattatcgcaacccgaattcaaatactacaaccgcccaaacgaacgatttaaaaccgactacacgacgctccatcgtttcacgaacctacta

SEQ ID NO: 37523 - DNA, 778 bp, Artificial Sequence
  chemically treated genomic DNA (Homo sapiens) CpG-island No: 37523
ggggttgttatttattttatggttgtcgttgtaaattagcgtgatttttatattttgtttttttagcgtagtatcgtaattattgtgagttattatgacgtcgatggagtttgttcgggcggtttgcgtgattagacgtcgggaggcggtattggtaagtaattgatttgtattgtagtttatgtcgttggtaagcgtttatatcggttttatgttacgtatacgggcgatgatgttagcgtagttaaatgttttcgttattatttcgtcgggcgtgtttatatcgagtagaatgtcgtttattatcggatcgttggtagtttgttgtagacgggcgataatgtcgttgtaatcggttattttcgagtacggttgtagcgttcgcgttcggttgattagcgtgtcggatatcggtagtacggcgatgtcgtttatgatttgataattgcgggtttgtcgtggttcgttattattatcggataatgttagcgtcgcgagtgttttttgggtagttaggttgtcgtcggatatcgtattcgttaggttgttgattttaagttggtttgtaagcgtataaaagaaaattcgcgtataggcgggtttaagtattagcggtttattaaaggttatgttggtaatatgcgggagattacgtagttttgttgttatttttttttttttttgttgattgtcgtagttcggatttaaatgttgtagtcgtttaggcgggcggtttaagatcggttgtacggcgttttatcgttttacggatttgttg

SEQ ID NO: 37524 - DNA, 778 bp, Artificial Sequence
  chemically treated genomic DNA (Homo sapiens) CpG-island No: 37524
caacaaatccgtaaaacgataaaacgccgtacaaccgatcttaaaccgcccgcctaaacgactacaacatttaaatccgaactacgacaatcaacaaaaaaaaaaaaaaataacaacaaaactacgtaatctcccgcatattaccaacataacctttaataaaccgctaatacttaaacccgcctatacgcgaattttcttttatacgcttacaaaccaacttaaaatcaacaacctaacgaatacgatatccgacgacaacctaactacccaaaaaacactcgcgacgctaacattatccgataataataacgaaccacgacaaacccgcaattatcaaatcataaacgacatcgccgtactaccgatatccgacacgctaatcaaccgaacgcgaacgctacaaccgtactcgaaaataaccgattacaacgacattatcgcccgtctacaacaaactaccaacgatccgataataaacgacattctactcgatataaacacgcccgacgaaataataacgaaaacatttaactacgctaacatcatcgcccgtatacgtaacataaaaccgatataaacgcttaccaacgacataaactacaatacaaatcaattacttaccaataccgcctcccgacgtctaatcacgcaaaccgcccgaacaaactccatcgacgtcataataactcacaataattacgatactacgctaaaaaaacaaaatataaaaatcacgctaatttacaacgacaaccataaaataaataacaacccc

SEQ ID NO: 37525 - DNA, 674 bp, Artificial Sequence
  chemically treated genomic DNA (Homo sapiens) CpG-island No: 37525
atttttcggatgacgttcgggagatattgtagtttcggatggacgtaattcgttagatgtttgcgtagaaggtgtcggtatatatcggtttgttcgtgtaggttgtgttggatatcgaggttgtagtgtatagcggttaggaggttattgatgtcggattggttgatgaatttgttaatagtatcgatgcgattatcgttatgcgtgatgtattggatgtacgtaaatttcgttttttaggagggcgaatgattaaagagatttaattaataattgttttagttattgtttcgtaggttgacgttattgacgtggtgttagcgacggagggcgagaacgttagcgcggcgtagtcggacgtgaacgcgtagattatcgtagcggttgcggtagaaaatagtcgtattatggggatatttaattgtgaggaggtttacggacgcgaagaataggtacgcgtgttggtagaaattttcggtatgatcgtgaaaacggttcgtcgtattttggtcgtagtattatagagtgtataggcgcgtagtgatattgcgttggatcgtttgatgtagggggtatcggtatcgttggttgtaggtaattcggtatttgatgtcgttaacgatttgttgaatatattagtgtaagggatgtttatgacgagtaaagaaattttt

SEQ ID NO: 37526 - DNA, 674 bp, Artificial Sequence
  chemically treated genomic DNA (Homo sapiens) CpG-island No: 37526
aaaaatttctttactcgtcataaacatcccttacactaatatattcaacaaatcgttaacgacatcaaataccgaattacctacaaccaacgataccgataccccctacatcaaacgatccaacgcaatatcactacgcgcctatacactctataatactacgaccaaaatacgacgaaccgttttcacgatcataccgaaaatttctaccaacacgcgtacctattcttcgcgtccgtaaacctcctcacaattaaatatccccataatacgactattttctaccgcaaccgctacgataatctacgcgttcacgtccgactacgccgcgctaacgttctcgccctccgtcgctaacaccacgtcaataacgtcaacctacgaaacaataactaaaacaattattaattaaatctctttaatcattcgccctcctaaaaaacgaaatttacgtacatccaatacatcacgcataacgataatcgcatcgatactattaacaaattcatcaaccaatccgacatcaataacctcctaaccgctatacactacaacctcgatatccaacacaacctacacgaacaaaccgatatataccgacaccttctacgcaaacatctaacgaattacgtccatccgaaactacaatatctcccgaacgtcatccgaaaaat

SEQ ID NO: 37527 - DNA, 674 bp, Artificial Sequence
  chemically treated genomic DNA (Homo sapiens) CpG-island No: 37527
aaaggtttttttgttcgttataaatattttttatattggtgtgtttagtaaatcgttaacggtattagatgtcgggttatttgtagttagcggtgtcggtgttttttgtattagacgatttagcgtagtgttattgcgcgtttgtgtattttgtggtgttgcggttagaatgcggcgggtcgtttttacggttatatcgggggtttttgttagtacgcgtgtttgtttttcgcgttcgtgagtttttttatagttgagtatttttataatgcggttgttttttgtcgtaatcgttgcggtgatttgcgcgtttacgttcggttgcgtcgcgttggcgttttcgtttttcgtcgttggtattacgttagtaacgttagtttgcgaagtagtggttgaaatagttgttgattgagtttttttggttattcgtttttttgagagacgggatttacgtgtatttagtgtattacgtatgacggtgatcgtatcggtgttgttaataagtttattagttagttcggtattaatggttttttgatcgttgtatattgtagtttcggtatttagtataatttgtacggataggtcggtatatgtcgatattttttgcgtaaatatttggcgggttgcgtttattcgggattgtagtgtttttcggacgttattcggaagat

SEQ ID NO: 37528 - DNA, 674 bp, Artificial Sequence
  chemically treated genomic DNA (Homo sapiens) CpG-island No: 37528
atcttccgaataacgtccgaaaaacactacaatcccgaataaacgcaacccgccaaatatttacgcaaaaaatatcgacatataccgacctatccgtacaaattatactaaataccgaaactacaatatacaacgatcaaaaaaccattaataccgaactaactaataaacttattaacaacaccgatacgatcaccgtcatacgtaatacactaaatacacgtaaatcccgtctctcaaaaaaacgaataaccaaaaaaactcaatcaacaactatttcaaccactacttcgcaaactaacgttactaacgtaataccaacgacgaaaaacgaaaacgccaacgcgacgcaaccgaacgtaaacgcgcaaatcaccgcaacgattacgacaaaaaacaaccgcattataaaaatactcaactataaaaaaactcacgaacgcgaaaaacaaacacgcgtactaacaaaaacccccgatataaccgtaaaaacgacccgccgcattctaaccgcaacaccacaaaatacacaaacgcgcaataacactacgctaaatcgtctaatacaaaaaacaccgacaccgctaactacaaataacccgacatctaataccgttaacgatttactaaacacaccaatataaaaaatatttataacgaacaaaaaaaccttt

SEQ ID NO: 37529 - DNA, 1074 bp, Artificial Sequence
  chemically treated genomic DNA (Homo sapiens) CpG-island No: 37529
ttcgttttcgtggcggttttatttttgaatttacgtcgggatatgttaagtcgaagtatgaagtgaattcgtagatgattttgcgtcgtttgtcggatgaagattcgtagaatttggcggattcggtttatcgtcgtcgtcgtattattatgtagaatatgcgtgacgaagagttggttattgtttaggtcgaagagatgtaggtagtttttgtcgtgtttaagggtaaatatattatgatcggtgaagttttcgattcggttgaggtggatatgggtcgtagtgaggagaataatattacgtagttcggcggtacggagtggagtaagcgtgataagtttacgtatgattcgatcgacgatatcgaagtttacgcgttgaacgttagcggtgtggtgaatattatcgtgttcgattcgaaaggttgggcgttgtttcgtttttttaaagtcgttaaggagaagttggatattcgtcgtggttttaatttcgagttggagatagcggtgaaagatttgggtaaagcggtgttttataaggggatgtatggcgatgtggttatcgtcgtgtatttcggatagtacgtggaaaacggcgttaaaaagaattttttgtcggataatacgatggtgttggggaatatttaggtacgcggtttgcgtatttatggttgtatttaggatgcggacgtatagcgcgaaggtattaacgtttttgttcgttattcgaaaaattgggtgattatcggcgattcggcgcgtgagtttattatgatttagttagtatcgttgatgttgttggttgattttgatgagttcgtgttcgtataattggcgtaattatggtttttcggggttattgtttttttgtggaggagtttatgacgaaagatgaattgattgttcgttttcgttcgttgggtgaataattgaatcgtgatgttagtttgacggggacgaaagaagaattggcgtttcgtgtggtagagttgaaagaggagtttgatgatacggatgaaattgtcggttaggatattttttttagtcgggaaaatgtgttgatcggatatgaaaa

SEQ ID NO: 37530 - DNA, 1074 bp, Artificial Sequence
  chemically treated genomic DNA (Homo sapiens) CpG-island No: 37530
ttttcatatccgatcaacacattttcccgactaaaaaaaatatcctaaccgacaatttcatccgtatcatcaaactcctctttcaactctaccacacgaaacgccaattcttctttcgtccccgtcaaactaacatcacgattcaattattcacccaacgaacgaaaacgaacaatcaattcatctttcgtcataaactcctccacaaaaaaacaataaccccgaaaaaccataattacgccaattatacgaacacgaactcatcaaaatcaaccaacaacatcaacgatactaactaaatcataataaactcacgcgccgaatcgccgataatcacccaatttttcgaataacgaacaaaaacgttaataccttcgcgctatacgtccgcatcctaaatacaaccataaatacgcaaaccgcgtacctaaatattccccaacaccatcgtattatccgacaaaaaattctttttaacgccgttttccacgtactatccgaaatacacgacgataaccacatcgccatacatccccttataaaacaccgctttacccaaatctttcaccgctatctccaactcgaaattaaaaccacgacgaatatccaacttctccttaacgactttaaaaaaacgaaacaacgcccaacctttcgaatcgaacacgataatattcaccacaccgctaacgttcaacgcgtaaacttcgatatcgtcgatcgaatcatacgtaaacttatcacgcttactccactccgtaccgccgaactacgtaatattattctcctcactacgacccatatccacctcaaccgaatcgaaaacttcaccgatcataatatatttacccttaaacacgacaaaaactacctacatctcttcgacctaaacaataaccaactcttcgtcacgcatattctacataataatacgacgacgacgataaaccgaatccgccaaattctacgaatcttcatccgacaaacgacgcaaaatcatctacgaattcacttcatacttcgacttaacatatcccgacgtaaattcaaaaataaaaccgccacgaaaacgaa

SEQ ID NO: 37531 - DNA, 1074 bp, Artificial Sequence
  chemically treated genomic DNA (Homo sapiens) CpG-island No: 37531
tttttatgttcggttagtatattttttcggttgagaggggtgttttgatcggtagttttattcgtgttattaagttttttttttagttttgttatacggagcgttagtttttttttcgttttcgttaggttgatattacggtttagttgtttatttagcgagcggagacgggtaattagtttatttttcgttatggatttttttatagagaaataatggtttcgaagggttatgattacgttagttgtacggatacgaatttattagggttagttagtagtattagcggtgttgattgaattatggtgaatttacgcgtcggatcgtcggtggttatttagtttttcgggtaacgggtagaggcgttaatgttttcgcgttgtgcgttcgtattttgaatgtagttataggtgcgtagatcgcgtgtttgagtgttttttagtattatcgtgttgttcggtaggaagttttttttgacgtcgttttttacgtattgttcggaatatacgacgatggttatatcgttatatatttttttataggatatcgttttgtttaggttttttatcgttgtttttagttcggaattagagttacgacgggtatttagtttttttttgacggttttgaaggaacggaatagcgtttagtttttcggatcgaatacgatgatatttattatatcgttggcgtttagcgcgtaggtttcgatatcgtcggtcgggttatacgtggatttgttacgtttgttttatttcgtgtcgtcggattgcgtgatgttattttttttattgcggtttatatttattttaatcggatcgaaggttttatcggttatggtgtatttgtttttaagtacggtagaaattgtttgtattttttcgatttgagtaatggttagtttttcgttacgtatgttttgtatgatgatgcgacggcggcggtaagtcgggttcgttagattttgcggatttttattcggtaggcgacgtagggttatttgcggatttattttatgtttcggtttgatatatttcggcgtaaatttagaggtggagtcgttacgggaacgga

SEQ ID NO: 37532 - DNA, 1074 bp, Artificial Sequence
  chemically treated genomic DNA (Homo sapiens) CpG-island No: 37532
tccgttcccgtaacgactccacctctaaatttacgccgaaatatatcaaaccgaaacataaaataaatccgcaaataaccctacgtcgcctaccgaataaaaatccgcaaaatctaacgaacccgacttaccgccgccgtcgcatcatcatacaaaacatacgtaacgaaaaactaaccattactcaaatcgaaaaaatacaaacaatttctaccgtacttaaaaacaaatacaccataaccgataaaaccttcgatccgattaaaataaatataaaccgcaataaaaaaaataacatcacgcaatccgacgacacgaaataaaacaaacgtaacaaatccacgtataacccgaccgacgatatcgaaacctacgcgctaaacgccaacgatataataaatatcatcgtattcgatccgaaaaactaaacgctattccgttccttcaaaaccgtcaaaaaaaaactaaatacccgtcgtaactctaattccgaactaaaaacaacgataaaaaacctaaacaaaacgatatcctataaaaaaatatataacgatataaccatcgtcgtatattccgaacaatacgtaaaaaacgacgtcaaaaaaaacttcctaccgaacaacacgataatactaaaaaacactcaaacacgcgatctacgcacctataactacattcaaaatacgaacgcacaacgcgaaaacattaacgcctctacccgttacccgaaaaactaaataaccaccgacgatccgacgcgtaaattcaccataattcaatcaacaccgctaatactactaactaaccctaataaattcgtatccgtacaactaacgtaatcataacccttcgaaaccattatttctctataaaaaaatccataacgaaaaataaactaattacccgtctccgctcgctaaataaacaactaaaccgtaatatcaacctaacgaaaacgaaaaaaaaactaacgctccgtataacaaaactaaaaaaaaaacttaataacacgaataaaactaccgatcaaaacacccctctcaaccgaaaaaatatactaaccgaacataaaaa

SEQ ID NO: 37533 - DNA, 1140 bp, Artificial Sequence
  chemically treated genomic DNA (Homo sapiens) CpG-island No: 37533
gattagcgtagtcggatatcgtgattttggatacgtttgaattggttacggtcgtggtattggtgaagttgtatattgatgtattttacgttacgcgggatgaatttgtggtatttgtgttgtcgggaacggcgtttcgtgtttttgtcggtgtggtagtcgaaatgatagagcgcggtttggttagaatgtaataacgggaggcgttgtggttgatttcgataatttgttcgatgttgttattgttcgcgtcgatgaaacgatacgcgggtatatgggaacgttagttattattatattcggtgagtagttaggtgcggtgatacgtggtgtttttgatgattttgaaaatattagttatgtcggatagggcgtgcgcgttgaaggttttagttcgtttttgtttgttcggattgatgaggtgcggtagttgcggcgtggagatacgttgattatcggtgaggaaaatttttgggtagatcgggtttcgtcggatgatggcggaagttgttatttttggtttggacggggcgtatcgtttgtcgttaatcgtcgtcgttgaaagggggatgtatggttataaaaggttttgagtaggtcgttgaaaattttagtcgtattagtaaaacggcggtgtttggtgtcgtcgtaatggttattaatcgcgttgttttattcgcgatatcgtagtcggcgttataggttgttcgtgagataaaggtacgtcggaaattggtaaaggaaagggttaggttgaaaagggttacggttaaaaattcgtaggttagaattaaagttaatcggggggatttgttcgtaattaagttgggtaatgcgcgggttgttttttcgcgtcgtaggcgtcgtaaaaaggggtagcgtttatttttgaaaggtggcggtagcgtgtttgtggtgggtaatcgtcgtattttcggcgcgtttatttagtaattgaaaaatggtcggtggtatgttatgtagcgtgtggttgggaaaaatcgttattttattgatgtggtgaaaatttcgatggcggtgtcgttgattacggcgtttaaataaaatattgagcggatacggcgtgaacgtttttcgaaagagttgggttatgcgttgtagtattaattgaggatggta

SEQ ID NO: 37534 - DNA, 1140 bp, Artificial Sequence
  chemically treated genomic DNA (Homo sapiens) CpG-island No: 37534
taccatcctcaattaatactacaacgcataacccaactctttcgaaaaacgttcacgccgtatccgctcaatattttatttaaacgccgtaatcaacgacaccgccatcgaaattttcaccacatcaataaaataacgatttttcccaaccacacgctacataacataccaccgaccatttttcaattactaaataaacgcgccgaaaatacgacgattacccaccacaaacacgctaccgccacctttcaaaaataaacgctacccctttttacgacgcctacgacgcgaaaaaacaacccgcgcattacccaacttaattacgaacaaatccccccgattaactttaattctaacctacgaatttttaaccgtaacccttttcaacctaaccctttcctttaccaatttccgacgtacctttatctcacgaacaacctataacgccgactacgatatcgcgaataaaacaacgcgattaataaccattacgacgacaccaaacaccgccgttttactaatacgactaaaattttcaacgacctactcaaaaccttttataaccatacatccccctttcaacgacgacgattaacgacaaacgatacgccccgtccaaaccaaaaataacaacttccgccatcatccgacgaaacccgatctacccaaaaattttcctcaccgataatcaacgtatctccacgccgcaactaccgcacctcatcaatccgaacaaacaaaaacgaactaaaaccttcaacgcgcacgccctatccgacataactaatattttcaaaatcatcaaaaacaccacgtatcaccgcacctaactactcaccgaatataataataactaacgttcccatatacccgcgtatcgtttcatcgacgcgaacaataacaacatcgaacaaattatcgaaatcaaccacaacgcctcccgttattacattctaaccaaaccgcgctctatcatttcgactaccacaccgacaaaaacacgaaacgccgttcccgacaacacaaataccacaaattcatcccgcgtaacgtaaaatacatcaatatacaacttcaccaataccacgaccgtaaccaattcaaacgtatccaaaatcacgatatccgactacgctaatc

SEQ ID NO: 37535 - DNA, 1140 bp, Artificial Sequence
  chemically treated genomic DNA (Homo sapiens) CpG-island No: 37535
tattatttttagttgatgttgtagcgtatagtttagttttttcggaagacgtttacgtcgtattcgtttaatattttgtttaaacgtcgtggttagcggtatcgttatcgggatttttattatattaatggggtaacggttttttttagttatacgttgtatgatatgttatcggttattttttagttgttgaataaacgcgtcgggaatacgacggttatttattataagtacgttgtcgttattttttagggatgaacgttgtttttttttacgacgtttgcggcgcgaaaggataattcgcgtattatttagtttgattacgggtaaattttttcggttaattttgattttggtttgcggatttttgatcgtggttttttttagtttggtttttttttttattagttttcggcgtatttttgttttacgggtaatttgtgacgtcgattgcgatatcgcggatgaagtaacgcggttaatggttattgcggcggtattaggtatcgtcgttttgttgatacggttgaggtttttaacggtttgtttaagattttttatggttatatattttttttttagcggcgacggttaacggtaggcggtacgtttcgtttaagttagagatgataattttcgttattattcggcgaaattcgatttatttagaaattttttttatcgatggttagcgtgtttttacgtcgtagttgtcgtattttattagttcggataaatagggacgggttggagtttttaacgcgtacgttttgttcggtatagttgatatttttagggttattaaaaatattacgtattatcgtatttgattgtttatcggatgtaatggtggttgacgtttttatgtattcgcgtatcgttttatcggcgcgggtaatggtagtatcgaataggttatcgaaattagttatagcgtttttcgttattgtattttggttaggtcgcgttttgttatttcggttgttatatcggtagagatacgaaacgtcgttttcggtagtataaatgttataggtttatttcgcgtggcgtgaagtgtattagtatgtagttttattagtgttacgatcgtgattagtttagacgtatttagaattacggtattcggttgcgttgatt

SEQ ID NO: 37536 - DNA, 1140 bp, Artificial Sequence
  chemically treated genomic DNA (Homo sapiens) CpG-island No: 37536
aatcaacgcaaccgaataccgtaattctaaatacgtctaaactaatcacgatcgtaacactaataaaactacatactaatacacttcacgccacgcgaaataaacctataacatttatactaccgaaaacgacgtttcgtatctctaccgatataacaaccgaaataacaaaacgcgacctaaccaaaatacaataacgaaaaacgctataactaatttcgataacctattcgatactaccattacccgcgccgataaaacgatacgcgaatacataaaaacgtcaaccaccattacatccgataaacaatcaaatacgataatacgtaatatttttaataaccctaaaaatatcaactataccgaacaaaacgtacgcgttaaaaactccaacccgtccctatttatccgaactaataaaatacgacaactacgacgtaaaaacacgctaaccatcgataaaaaaaatttctaaataaatcgaatttcgccgaataataacgaaaattatcatctctaacttaaacgaaacgtaccgcctaccgttaaccgtcgccgctaaaaaaaaaatatataaccataaaaaatcttaaacaaaccgttaaaaacctcaaccgtatcaacaaaacgacgatacctaataccgccgcaataaccattaaccgcgttacttcatccgcgatatcgcaatcgacgtcacaaattacccgtaaaacaaaaatacgccgaaaactaataaaaaaaaaaaccaaactaaaaaaaaccacgatcaaaaatccgcaaaccaaaatcaaaattaaccgaaaaaatttacccgtaatcaaactaaataatacgcgaattatcctttcgcgccgcaaacgtcgtaaaaaaaaacaacgttcatccctaaaaaataacgacaacgtacttataataaataaccgtcgtattcccgacgcgtttattcaacaactaaaaaataaccgataacatatcatacaacgtataactaaaaaaaaccgttaccccattaatataataaaaatcccgataacgataccgctaaccacgacgtttaaacaaaatattaaacgaatacgacgtaaacgtcttccgaaaaaactaaactatacgctacaacatcaactaaaaataata

SEQ ID NO: 37537 - DNA, 691 bp, Artificial Sequence
  chemically treated genomic DNA (Homo sapiens) CpG-island No: 37537
atttttacgcgaattcgtttttagacgttgattggtcgcgtttggtaaaagttaaagatttgacgttcggcgaattgatcgttgagttttatgacgatagttatttcgatgatgaagatgtagattggattgcgatcgggtaggggtagaaatttgtcggagatattagttttacgttggcgtggatgttcggagagtaggggtagtaggcgttgttggcgtggtttaatgaaggcgatattcgtgtttataaaattcgtttttcgaacggtacggtcgatgtgtttcgtggttgggttagtagtatcggtaaggcggtgacggcgaaggaagtgattattcgtacggtgaaagttattaatgtgggacgttcgtcgatggtagaagatcgtagtacggtaatagcggtaatcggtatgatcgtgacgtttgttagtatttcggtggtgaaagggtagagtattacgttgatcgtggttttttagtcggagggcgtaatcgataagagttttcgtgcggtgtttgcggataaaataaaagttatcgtgtcggttagtggtatgattattatcgtgaacggcgttgttgtaggtaaggttaatatttcggttgtattcggtaatggtgagtttgttgcggttgtagaaattatcgttatcgttagttaattcggagagttagcgatgttttt

SEQ ID NO: 37538 - DNA, 691 bp, Artificial Sequence
  chemically treated genomic DNA (Homo sapiens) CpG-island No: 37538
aaaaacatcgctaactctccgaattaactaacgataacgataatttctacaaccgcaacaaactcaccattaccgaatacaaccgaaatattaaccttacctacaacaacgccgttcacgataataatcataccactaaccgacacgataacttttattttatccgcaaacaccgcacgaaaactcttatcgattacgccctccgactaaaaaaccacgatcaacgtaatactctaccctttcaccaccgaaatactaacaaacgtcacgatcataccgattaccgctattaccgtactacgatcttctaccatcgacgaacgtcccacattaataactttcaccgtacgaataatcacttccttcgccgtcaccgccttaccgatactactaacccaaccacgaaacacatcgaccgtaccgttcgaaaaacgaattttataaacacgaatatcgccttcattaaaccacgccaacaacgcctactacccctactctccgaacatccacgccaacgtaaaactaatatctccgacaaatttctacccctacccgatcgcaatccaatctacatcttcatcatcgaaataactatcgtcataaaactcaacgatcaattcgccgaacgtcaaatctttaacttttaccaaacgcgaccaatcaacgtctaaaaacgaattcgcgtaaaaat

SEQ ID NO: 37539 - DNA, 691 bp, Artificial Sequence
  chemically treated genomic DNA (Homo sapiens) CpG-island No: 37539
aggaatatcgttgatttttcggattaattggcggtgacggtaatttttgtaatcgtagtaaatttattattatcggatataatcggaatgttgattttgtttgtagtaacgtcgtttacggtgatggttatattattgatcgatacggtggtttttgttttattcgtagatatcgtacgaaagtttttgtcggttacgtttttcggttggaaggttacggttagcgtggtgttttgtttttttattatcgaggtgttggtaggcgttacggttatgtcggttgtcgttgttatcgtgttgcgattttttgttatcgacggacgttttatattggtgatttttatcgtgcgggtgattatttttttcgtcgttatcgttttatcgatattgttgatttagttacggaatatatcgatcgtgtcgttcgggaagcggattttataggtacgggtatcgtttttattaaattacgttagtagcgtttgttgtttttgtttttcgggtatttacgttagcgtgaagttggtattttcggtagatttttgtttttgttcggtcgtagtttagtttgtatttttattatcgagatagttgtcgttataggatttagcggttagttcgtcgggcgttaggtttttaatttttgttagacgcgattagttaacgtttgaaagcggattcgcgtaagggt

SEQ ID NO: 37540 - DNA, 691 bp, Artificial Sequence
  chemically treated genomic DNA (Homo sapiens) CpG-island No: 37540
acccttacgcgaatccgctttcaaacgttaactaatcgcgtctaacaaaaattaaaaacctaacgcccgacgaactaaccgctaaatcctataacgacaactatctcgataataaaaatacaaactaaactacgaccgaacaaaaacaaaaatctaccgaaaataccaacttcacgctaacgtaaatacccgaaaaacaaaaacaacaaacgctactaacgtaatttaataaaaacgatacccgtacctataaaatccgcttcccgaacgacacgatcgatatattccgtaactaaatcaacaatatcgataaaacgataacgacgaaaaaaataatcacccgcacgataaaaatcaccaatataaaacgtccgtcgataacaaaaaatcgcaacacgataacaacgacaaccgacataaccgtaacgcctaccaacacctcgataataaaaaaacaaaacaccacgctaaccgtaaccttccaaccgaaaaacgtaaccgacaaaaactttcgtacgatatctacgaataaaacaaaaaccaccgtatcgatcaataatataaccatcaccgtaaacgacgttactacaaacaaaatcaacattccgattatatccgataataataaatttactacgattacaaaaattaccgtcaccgccaattaatccgaaaaatcaacgatattcct

SEQ ID NO: 37541 - DNA, 648 bp, Artificial Sequence
  chemically treated genomic DNA (Homo sapiens) CpG-island No: 37541
gcggtggcgatcggtgcgttggcgtatgtttggtattagggtaatttaattttgttcgattttaataaaacgttggtttttttcggtaattaggcgggattgacggtagatcgtatgttggttttgtttagagtcgggtaggcggtagggttgacgtttaattagattagcgagttatttagcgtattggttaaggcgggggtaagcggtgaggtttagattgcgtttattagttagagtgtggcgcgttttttttttgtattcggcgtggaggtggataaggtcgttgaagttttcgggaagttgattatagattcgacgtcggggttgacggcgatggttcgttagttttataacgtgtcggcggagtagattgcgtatgttgtttagttgtagcgtttcggcgatgaagtcggggtattgtaggcggcgaacgaggtcgtaacgaaagggtttgatgattagattcgtcgtttgaaagagaatatgggtacgttggagatttgggtagataggattgcgcgggtatttaaatttatgtgggatgcggtgttggatattggtcgttttgatatcgcgtaggagatgttgattaaggtagaggttgcgtataagaaagtagacgatatttggaatttgcgtaaggat

SEQ ID NO: 37542 - DNA, 648 bp, Artificial Sequence
  chemically treated genomic DNA (Homo sapiens) CpG-island No: 37542
atccttacgcaaattccaaatatcgtctactttcttatacgcaacctctaccttaatcaacatctcctacgcgatatcaaaacgaccaatatccaacaccgcatcccacataaatttaaatacccgcgcaatcctatctacccaaatctccaacgtacccatattctctttcaaacgacgaatctaatcatcaaaccctttcgttacgacctcgttcgccgcctacaataccccgacttcatcgccgaaacgctacaactaaacaacatacgcaatctactccgccgacacgttataaaactaacgaaccatcgccgtcaaccccgacgtcgaatctataatcaacttcccgaaaacttcaacgaccttatccacctccacgccgaatacaaaaaaaaaacgcgccacactctaactaataaacgcaatctaaacctcaccgcttacccccgccttaaccaatacgctaaataactcgctaatctaattaaacgtcaaccctaccgcctacccgactctaaacaaaaccaacatacgatctaccgtcaatcccgcctaattaccgaaaaaaaccaacgttttattaaaatcgaacaaaattaaattaccctaataccaaacatacgccaacgcaccgatcgccaccgc

SEQ ID NO: 37543 - DNA, 648 bp, Artificial Sequence
  chemically treated genomic DNA (Homo sapiens) CpG-island No: 37543
atttttgcgtagattttagatgtcgtttgtttttttatacgtagtttttgttttaattagtattttttgcgcggtattaggacgattaatatttagtatcgtattttatatggatttgaatgttcgcgtagttttgtttgtttaggtttttagcgtgtttatgtttttttttaggcggcgggtttggttattaaattttttcgttgcggtttcgttcgtcgtttgtaatgtttcggttttatcgtcggaacgttgtaattgagtaatatacgtaatttgtttcgtcgatacgttatggaattggcgagttatcgtcgttagtttcgacgtcgggtttgtggttagtttttcgaaggttttagcgattttgtttatttttacgtcggatgtagaggagaaacgcgttatattttggttgatggacgtaatttgagttttatcgtttattttcgttttaattagtgcgttgagtgattcgttggtttggttaaacgttagttttgtcgtttgttcggttttggataggattagtatacgatttgtcgttagtttcgtttgattgtcggaaaggattagcgttttgttgaaatcggatagggttgagttgttttgatattaggtatacgttagcgtatcggtcgttatcgt

SEQ ID NO: 37544 - DNA, 648 bp, Artificial Sequence
  chemically treated genomic DNA (Homo sapiens) CpG-island No: 37544
acgataacgaccgatacgctaacgtatacctaatatcaaaacaactcaaccctatccgatttcaacaaaacgctaatcctttccgacaatcaaacgaaactaacgacaaatcgtatactaatcctatccaaaaccgaacaaacgacaaaactaacgtttaaccaaaccaacgaatcactcaacgcactaattaaaacgaaaataaacgataaaactcaaattacgtccatcaaccaaaatataacgcgtttctcctctacatccgacgtaaaaataaacaaaatcgctaaaaccttcgaaaaactaaccacaaacccgacgtcgaaactaacgacgataactcgccaattccataacgtatcgacgaaacaaattacgtatattactcaattacaacgttccgacgataaaaccgaaacattacaaacgacgaacgaaaccgcaacgaaaaaatttaataaccaaacccgccgcctaaaaaaaaacataaacacgctaaaaacctaaacaaacaaaactacgcgaacattcaaatccatataaaatacgatactaaatattaatcgtcctaataccgcgcaaaaaatactaattaaaacaaaaactacgtataaaaaaacaaacgacatctaaaatctacgcaaaaat

SEQ ID NO: 37545 - DNA, 2451 bp, Artificial Sequence
  chemically treated genomic DNA (Homo sapiens) CpG-island No: 37545
tgcgtttgaagtcgttcgaaagaaggttgagtagtagatttaataggataaaaatgcgtagtagtagagcgatatcgaagcgttacggttgaaatatatcgaagaggcgtagaaggtttacgaacggttgtagacgtcgttggagaaatatatcgttcgttaggaagaattgaataaggtattgaaagacgggaaaattttgtaggcggattataatacgttgatggcggcggcgaaaaaggattatgaagcgacgttgaaaaagtcgaaatagtttagcgtgaaggtgtttgcgggcgatcgttaggaagatagtgtttatgttgttttgttgacgttttaggtagaatttcggacgttggagaagtatgtcggagtaaatgagaaaattagttagtagcgtcgggatttgtggaaggcggagagttagttcgcggtattggaggaggcggcgtaacgtcgttagttgtttgtataggagaaatttttgttggcgtataaagatgagacgttggagtataaacgttagttggttgtatttggcgataaggttacgtattaggagcgtttgaacgcgttggcgtagtaggcggataaattcgtatagtagtaacgggtaaaacgggtcgttattgatgcgaaaagtcgggggttgattgatcggtaggtagaacgggaagttacggaatagcgtttgaaggaatagtatggcgataattcgttggcgttgaataacgttatgttagagtagaaaaagatttgggcggttgaagattagtttcgcgggaattggatggtaggtttgaagttcggttggagtgagtgggaagagagcgttacggatagtatgtcgtaggtaaaaagtgtagttacgtagatttttgatggtattgtatagaatatggcggcgatgttgatcggtagtgagtagaattggcgtagttttattcgtttcgtgttgtttatgatgatagaaattttgtttaagtaggtaatggtggggattgtcgggagtatcggtagcgttattggcggggttgttggtggcggcgtattcgcgttaggcggtatagttatttaggtcgttgcggcgaaattttattttgtaatcggaggatttacgggaatcggcggtaaatatgagttagcggggattgtttatcgtggtgagtttgtttttacgaaggaggtaattagtcggattggcgtggggaatttttatcggttgatgcgcggttatgttatcggcggttatgtcggtatatcgggtagtatggtagatagtcggtcgtaggcgttcgggacgtttgagtagaataattatgtggtgattaataacgacggtacgaacgggtagataggttcggttgttttgaaggcggtgtatgatatggttcgtaagggtgttcgtgatgaaatttagatatagatgcgtgatggtggtttgtttttcggaggtggacgatgaagatttttcgttggaaagtgaaattcggtatggatgtggtttcggttttttttgtaagaaaggtgcgttttggtgatggttatttttagcgagcgtttgtcgggttgaatgttaatttgaaaacgtatagcgtgacgttttttgtttttcgtgaggaggttacggtattggagtcgtttttggaagagtacgggggttggaaattttttttgtggacgtcgttttatgagtggcggtagataaaggtgatttgcgtaaaatggtcgtcgcgggttagtatgttgcgtgttgagtttagcgtagagtttgaataggtggtgaattgatgtaggatattcggtaggaaatattgaatgaatgtattcgtgcggagtagtcggttagcgtggtgttttgggaaatcgatttgatagaggtcggtggagaacgttattttttttgtaatgagtagaacgaaaaaggtgagtcggttatttggtaggggcgatagtattagtcgtattttatttaggggagcggttttgaattgaatggtaaaggtattagtacgcgttttacgttgacggtttttaatttgtacggtatggttatcgggatggcggaagatatgtagagtttggtcggcggaacggtggttcggcgtaaggtttacgttcgttttttggatgcggtgaatttcgttaacggaaatagttacgtcgattcggagtaggaggtgattagtcgttggcgtattgagtagtgtagcgaattgagcgcggtgagtgttttttttgtattgtttacgtcgacggaaacggatggcgttgttttttcgggacgtattatgttggttaatatttgtatttggatttatcgcggtgacgagtgcggttatagcggttcggttgtcgcggatgaatatgattagttaacgttcgatattacgaaggataaatgtagtaaatgtttgagcggttgtaagtttcgtaataacgtcggta

SEQ ID NO: 37546 - DNA, 2451 bp, Artificial Sequence
  chemically treated genomic DNA (Homo sapiens) CpG-island No: 37546
taccgacgttattacgaaacttacaaccgctcaaacatttactacatttatccttcgtaatatcgaacgttaactaatcatattcatccgcgacaaccgaaccgctataaccgcactcgtcaccgcgataaatccaaatacaaatattaaccaacataatacgtcccgaaaaaacaacgccatccgtttccgtcgacgtaaacaatacaaaaaaaacactcaccgcgctcaattcgctacactactcaatacgccaacgactaatcacctcctactccgaatcgacgtaactatttccgttaacgaaattcaccgcatccaaaaaacgaacgtaaaccttacgccgaaccaccgttccgccgaccaaactctacatatcttccgccatcccgataaccataccgtacaaattaaaaaccgtcaacgtaaaacgcgtactaatacctttaccattcaattcaaaaccgctcccctaaataaaatacgactaatactatcgcccctaccaaataaccgactcacctttttcgttctactcattacaaaaaaaataacgttctccaccgacctctatcaaatcgatttcccaaaacaccacgctaaccgactactccgcacgaatacattcattcaatatttcctaccgaatatcctacatcaattcaccacctattcaaactctacgctaaactcaacacgcaacatactaacccgcgacgaccattttacgcaaatcacctttatctaccgccactcataaaacgacgtccacaaaaaaaatttccaacccccgtactcttccaaaaacgactccaataccgtaacctcctcacgaaaaacaaaaaacgtcacgctatacgttttcaaattaacattcaacccgacaaacgctcgctaaaaataaccatcaccaaaacgcacctttcttacaaaaaaaaccgaaaccacatccataccgaatttcactttccaacgaaaaatcttcatcgtccacctccgaaaaacaaaccaccatcacgcatctatatctaaatttcatcacgaacacccttacgaaccatatcatacaccgccttcaaaacaaccgaacctatctacccgttcgtaccgtcgttattaatcaccacataattattctactcaaacgtcccgaacgcctacgaccgactatctaccatactacccgatataccgacataaccgccgataacataaccgcgcatcaaccgataaaaattccccacgccaatccgactaattacctccttcgtaaaaacaaactcaccacgataaacaatccccgctaactcatatttaccgccgattcccgtaaatcctccgattacaaaataaaatttcgccgcaacgacctaaataactataccgcctaacgcgaatacgccgccaccaacaaccccgccaataacgctaccgatactcccgacaatccccaccattacctacttaaacaaaatttctatcatcataaacaacacgaaacgaataaaactacgccaattctactcactaccgatcaacatcgccgccatattctatacaataccatcaaaaatctacgtaactacactttttacctacgacatactatccgtaacgctctcttcccactcactccaaccgaacttcaaacctaccatccaattcccgcgaaactaatcttcaaccgcccaaatctttttctactctaacataacgttattcaacgccaacgaattatcgccatactattccttcaaacgctattccgtaacttcccgttctacctaccgatcaatcaacccccgacttttcgcatcaataacgacccgttttacccgttactactatacgaatttatccgcctactacgccaacgcgttcaaacgctcctaatacgtaaccttatcgccaaatacaaccaactaacgtttatactccaacgtctcatctttatacgccaacaaaaatttctcctatacaaacaactaacgacgttacgccgcctcctccaataccgcgaactaactctccgccttccacaaatcccgacgctactaactaattttctcatttactccgacatacttctccaacgtccgaaattctacctaaaacgtcaacaaaacaacataaacactatcttcctaacgatcgcccgcaaacaccttcacgctaaactatttcgactttttcaacgtcgcttcataatcctttttcgccgccgccatcaacgtattataatccgcctacaaaattttcccgtctttcaataccttattcaattcttcctaacgaacgatatatttctccaacgacgtctacaaccgttcgtaaaccttctacgcctcttcgatatatttcaaccgtaacgcttcgatatcgctctactactacgcatttttatcctattaaatctactactcaaccttctttcgaacgacttcaaacgca

SEQ ID NO: 37547 - DNA, 2451 bp, Artificial Sequence
  chemically treated genomic DNA (Homo sapiens) CpG-island No: 37547
tgtcgacgttattgcggaatttataatcgtttaggtatttgttgtatttatttttcgtgatatcggacgttggttggttatatttattcgcgatagtcggatcgttataatcgtattcgttatcgcgataggtttaggtgtaggtgttggttagtatgatacgtttcggaaaaatagcgttattcgttttcgtcggcgtggatagtataaaggaggtatttatcgcgtttagttcgttgtattgtttaatgcgttagcggttgattattttttgtttcggatcggcgtaattgttttcgttgacgaagtttatcgtatttagaaaacgggcgtaaattttacgtcggattatcgtttcgtcgattagattttgtatatttttcgttatttcggtgattatatcgtataggttagaaatcgttagcgtggggcgcgtattggtgtttttgttatttagtttaaaatcgtttttttgaatgggatacggttgatattgtcgtttttgttaggtgatcggtttatttttttcgttttgtttattatagaaaaaataacgttttttatcgatttttgttaggtcgattttttagagtattacgttggtcgattgtttcgtacgggtgtatttatttagtgttttttgtcggatattttgtattagtttattatttgtttaaattttgcgttgaatttaatacgtagtatattgattcgcgacgattattttgcgtaggttatttttatttgtcgttatttataaggcggcgtttatagaaaggatttttagttttcgtgtttttttagaaacgattttagtatcgtggtttttttacgggggatagaaagcgttacgttgtacgtttttaggttggtatttagttcggtaggcgttcgttgagaatagttattattaaagcgtattttttttatagaagggatcgaagttatatttatatcgggttttattttttagcggaaggtttttatcgtttattttcggagaataggttattattacgtatttgtgtttgaattttattacgggtatttttgcgggttatgttatatatcgtttttagagtagtcggatttatttgttcgttcgtgtcgtcgttgttaattattatatggttattttgtttaaacgtttcggacgtttgcgatcggttgtttgttatgttgttcggtgtatcgatataatcgtcggtggtatagtcgcgtattagtcggtaaagattttttacgttaattcggttggttgtttttttcgtgaagataaatttattacggtgaataattttcgttggtttatatttgtcgtcggttttcgtaaatttttcggttgtaaaatggaatttcgtcgtagcggtttgaatggttgtatcgtttgacgcggatgcgtcgttattaatagtttcgttaatggcgttgtcgatattttcgataatttttattattgtttgtttaagtagaatttttgttattatggatagtacggaacgggtgaagttgcgttagttttgtttattgtcggttagtatcgtcgttatattttgtgtaatattattaaaggtttgcgtggttgtattttttatttgcgatatattgttcgtggcgttttttttttatttattttagtcggattttaggtttgttatttagttttcgcgaagttggtttttagtcgtttaggtttttttttgttttgatatgacgttatttagcgttagcggattatcgttatattgtttttttaggcgttgtttcgtggtttttcgttttgtttgtcggttagttagttttcggtttttcgtattaatggcggttcgttttgttcgttgttgttgtgcgaatttattcgtttgttgcgttagcgcgtttaggcgtttttgatacgtaattttgtcgttaagtgtagttagttggcgtttgtattttagcgttttatttttatgcgttagtagggattttttttgtgtagatagttggcgacgttgcgtcgttttttttagtatcgcgaattgatttttcgttttttataaatttcggcgttgttggttgatttttttatttgtttcggtatgtttttttagcgttcggagttttgtttgaagcgttagtagggtagtatgagtattgtttttttgacgatcgttcgtagatatttttacgttggattgtttcggtttttttagcgtcgttttataattttttttcgtcgtcgttattagcgtgttgtaattcgtttgtaggattttttcgttttttagtgttttgtttagttttttttgacgggcggtatatttttttagcggcgtttgtagtcgttcgtaagttttttgcgttttttcggtatattttagtcgtgacgtttcggtatcgttttgttgttgcgtatttttgttttgttgagtttgttgtttagttttttttcgggcggttttaagcgta

SEQ ID NO: 37548 - DNA, 2451 bp, Artificial Sequence
  chemically treated genomic DNA (Homo sapiens) CpG-island No: 37548
tacgcttaaaaccgcccgaaaaaaaactaaacaacaaactcaacaaaacaaaaatacgcaacaacaaaacgataccgaaacgtcacgactaaaatataccgaaaaaacgcaaaaaacttacgaacgactacaaacgccgctaaaaaaatataccgcccgtcaaaaaaaactaaacaaaacactaaaaaacgaaaaaatcctacaaacgaattacaacacgctaataacgacgacgaaaaaaaattataaaacgacgctaaaaaaaccgaaacaatccaacgtaaaaatatctacgaacgatcgtcaaaaaaacaatactcatactaccctactaacgcttcaaacaaaactccgaacgctaaaaaaacataccgaaacaaataaaaaaatcaaccaacaacgccgaaatttataaaaaacgaaaaatcaattcgcgatactaaaaaaaacgacgcaacgtcgccaactatctacacaaaaaaaatccctactaacgcataaaaataaaacgctaaaatacaaacgccaactaactacacttaacgacaaaattacgtatcaaaaacgcctaaacgcgctaacgcaacaaacgaataaattcgcacaacaacaacgaacaaaacgaaccgccattaatacgaaaaaccgaaaactaactaaccgacaaacaaaacgaaaaaccacgaaacaacgcctaaaaaaacaatataacgataatccgctaacgctaaataacgtcatatcaaaacaaaaaaaaacctaaacgactaaaaaccaacttcgcgaaaactaaataacaaacctaaaatccgactaaaataaataaaaaaaaaacgccacgaacaatatatcgcaaataaaaaatacaaccacgcaaacctttaataatattacacaaaatataacgacgatactaaccgacaataaacaaaactaacgcaacttcacccgttccgtactatccataataacaaaaattctacttaaacaaacaataataaaaattatcgaaaatatcgacaacgccattaacgaaactattaataacgacgcatccgcgtcaaacgatacaaccattcaaaccgctacgacgaaattccattttacaaccgaaaaatttacgaaaaccgacgacaaatataaaccaacgaaaattattcaccgtaataaatttatcttcacgaaaaaaacaaccaaccgaattaacgtaaaaaatctttaccgactaatacgcgactataccaccgacgattatatcgatacaccgaacaacataacaaacaaccgatcgcaaacgtccgaaacgtttaaacaaaataaccatataataattaacaacgacgacacgaacgaacaaataaatccgactactctaaaaacgatatataacataacccgcaaaaatacccgtaataaaattcaaacacaaatacgtaataataacctattctccgaaaataaacgataaaaaccttccgctaaaaaataaaacccgatataaatataacttcgatcccttctataaaaaaaatacgctttaataataactattctcaacgaacgcctaccgaactaaataccaacctaaaaacgtacaacgtaacgctttctatcccccgtaaaaaaaccacgatactaaaatcgtttctaaaaaaacacgaaaactaaaaatcctttctataaacgccgccttataaataacgacaaataaaaataacctacgcaaaataatcgtcgcgaatcaatatactacgtattaaattcaacgcaaaatttaaacaaataataaactaatacaaaatatccgacaaaaaacactaaataaatacacccgtacgaaacaatcgaccaacgtaatactctaaaaaatcgacctaacaaaaatcgataaaaaacgttattttttctataataaacaaaacgaaaaaaataaaccgatcacctaacaaaaacgacaatatcaaccgtatcccattcaaaaaaacgattttaaactaaataacaaaaacaccaatacgcgccccacgctaacgatttctaacctatacgatataatcaccgaaataacgaaaaatatacaaaatctaatcgacgaaacgataatccgacgtaaaatttacgcccgttttctaaatacgataaacttcgtcaacgaaaacaattacgccgatccgaaacaaaaaataatcaaccgctaacgcattaaacaatacaacgaactaaacgcgataaatacctcctttatactatccacgccgacgaaaacgaataacgctatttttccgaaacgtatcatactaaccaacacctacacctaaacctatcgcgataacgaatacgattataacgatccgactatcgcgaataaatataaccaaccaacgtccgatatcacgaaaaataaatacaacaaatacctaaacgattataaattccgcaataacgtcgaca

SEQ ID NO: 37549 - DNA, 671 bp, Artificial Sequence
  chemically treated genomic DNA (Homo sapiens) CpG-island No: 37549
gatttataagtttcgttgtgtgtcgtattttatcgggcggcgttttgagtacggtgtgacggattgttatatattgtttcgggatgtttattatttggcggggattgagatgtcggatttttatcgtgaggatgattggtggcgtaacggttagaatttttatttggataatttggaggcgacggggttgtattaggtgtcgttgttagcggtatagtcgggcgatgtgttgttgtgttgttttggtttattagtgtcgaattacgtcgtaatttattgcggcgacggcgagttgttgtattatatttttgaataattgagtaaacgagagaggtatatcgataaatggtagcgacgtatatattttttttggcgttatcgggtatggcgcgtatttgtttttacggggatttataacgatttggtcgtcgtatcgattttcgtgtgaaaacgggggttgaagttattcgggtattggttatatagttttcggcgtttcgttagaaattgagcgacggttggtattaggtacggattgtcgggcgggacgttagtacgttcgggttaacggcgtagttatatgagattttgtttgatggcgttgtaatttatattgtttttagagtcgtcggggttaagttaggtggcgtattttagattgttttgggggt

SEQ ID NO: 37550 - DNA, 671 bp, Artificial Sequence
  chemically treated genomic DNA (Homo sapiens) CpG-island No: 37550
acccccaaaacaatctaaaatacgccacctaacttaaccccgacgactctaaaaacaatataaattacaacgccatcaaacaaaatctcatataactacgccgttaacccgaacgtactaacgtcccgcccgacaatccgtacctaataccaaccgtcgctcaatttctaacgaaacgccgaaaactatataaccaatacccgaataacttcaacccccgttttcacacgaaaatcgatacgacgaccaaatcgttataaatccccgtaaaaacaaatacgcgccatacccgataacgccaaaaaaaatatatacgtcgctaccatttatcgatatacctctctcgtttactcaattattcaaaaatataatacaacaactcgccgtcgccgcaataaattacgacgtaattcgacactaataaaccaaaacaacacaacaacacatcgcccgactataccgctaacaacgacacctaatacaaccccgtcgcctccaaattatccaaataaaaattctaaccgttacgccaccaatcatcctcacgataaaaatccgacatctcaatccccgccaaataataaacatcccgaaacaatatataacaatccgtcacaccgtactcaaaacgccgcccgataaaatacgacacacaacgaaacttataaatc

SEQ ID NO: 37551 - DNA, 671 bp, Artificial Sequence
  chemically treated genomic DNA (Homo sapiens) CpG-island No: 37551
gtttttaggataatttggaatacgttatttgatttggtttcggcgattttgggaataatatgaattatagcgttattaggtagagttttatgtaattgcgtcgttaattcggacgtgttgacgtttcgttcggtaattcgtatttgatattagtcgtcgtttagtttttgacgaaacgtcgggagttgtgtggttagtgttcggatggttttagttttcgtttttatacgaaggtcgatgcggcgattaaatcgttgtaaattttcgtaaaggtagatgcgcgttatgttcggtgacgttagagggagtgtgtgcgtcgttgttatttgtcggtgtatttttttcgtttgtttagttgtttaggaatatggtgtagtagttcgtcgtcgtcgtagtaaattgcggcgtgattcggtattgatgaattaaaatagtatagtagtatatcgttcggttgtgtcgttgataacggtatttgatatagtttcgtcgtttttagattatttagatagagattttggtcgttacgttattagttatttttacgatgaaagttcggtattttaattttcgttagatgataagtatttcggaatagtgtgtaatagttcgttatatcgtgtttaaagcgtcgttcggtgagatgcggtatatagcggaatttatgaatt

SEQ ID NO: 37552 - DNA, 671 bp, Artificial Sequence
  chemically treated genomic DNA (Homo sapiens) CpG-island No: 37552
aattcataaattccgctatataccgcatctcaccgaacgacgctttaaacacgatataacgaactattacacactattccgaaatacttatcatctaacgaaaattaaaataccgaactttcatcgtaaaaataactaataacgtaacgaccaaaatctctatctaaataatctaaaaacgacgaaactatatcaaataccgttatcaacgacacaaccgaacgatatactactatactattttaattcatcaataccgaatcacgccgcaatttactacgacgacgacgaactactacaccatattcctaaacaactaaacaaacgaaaaaaatacaccgacaaataacaacgacgcacacactccctctaacgtcaccgaacataacgcgcatctacctttacgaaaatttacaacgatttaatcgccgcatcgaccttcgtataaaaacgaaaactaaaaccatccgaacactaaccacacaactcccgacgtttcgtcaaaaactaaacgacgactaatatcaaatacgaattaccgaacgaaacgtcaacacgtccgaattaacgacgcaattacataaaactctacctaataacgctataattcatattattcccaaaatcgccgaaaccaaatcaaataacgtattccaaattatcctaaaaac

SEQ ID NO: 37553 - DNA, 2251 bp, Artificial Sequence
  chemically treated genomic DNA (Homo sapiens) CpG-island No: 37553
ttcgcgcgaagcgaaggataatttgaagtttacgtagttgttgagtgtgatcgatgttattagcgaagggtcgattgaaggttcggtggatggtttaaaaagcgtgttgttgaatagtacgtcggtgttggatattgaggggaatattaatatattcggtgttacggtggtgtttcgggttggtgagtaggagtagatttcgtcggagggatttgaatttttcggtttcgagacggtgttgggtacggaagtgaaatatgatacgtcgattattcgtattattacgtttgtaaatatcgatcgtttgcgttttattttcggtgtataggtattggtggaaattattttaaagggtgataggaattcgtcggaagttcgtttgttggtttagatataacgtaacggtggttgggtgacggaaaaagatattattattaagggtaaaattatttcgtagtatttggtttcggtggtgatgggtaatttgtcgtcgcgttcgtttaatattcggatgcgtaggatgacgtcggatagtattatagattagttgtagaataaaacgttttggtcgttatatattgaaattatcgatgtgaaatagtgttattcgaatacggtattggtcggcgtgtaggtggattcggagtagttcggtagttagtaggtgagtcgtaattattatttgcgcgggcgtattttgtaggtgtcgtcgaattataattcgtagacgcggtaatatagcggtatttgggacggaacgtttaaatcggtatatagtaataatatggtttggtgtttgtgggatatgttgatttattcgcgttacggtatggggaaacgttttggtgcggcggatgtggataaatgggcgttgtatgttatcggttagtattgcgattagttagtgtcggacggttttggcggtacggagtcgcgtattatttgtaatgcgtatttgattatatagcgtaaggcgtgggatgtgtttagcgatttttgttcggcgatgcgttgtatgtcggtatggaacgggtagacgttgacgttcgtgtaggatcgatcgtcggataagacgtggatttataatcgtagtaatgtggtgatgtcggatgatggcgcgtcgtttcgttatagttttagcgttttgaaggatcgttataatgtcgttgaggtgaattggattgattcgaataacggttgggagacggcgatagagtttgttgaagatacgtaggttattgttcgttacggtcgtaatgttacgaagatggatgtttttggttgtattagtcgggggtaggtatatcgcgtcgggttgtggttgattaaaatagaattgttggaaacgtagatcgtggattttagcgtcggcgtagaagggtttcgttatgtatcgggcgatgttattgaaatttgcgatgatgattatgtcggtattagtatcggtggtcgtgtgttggcggtgaatagttagattcggacgttgacgttcgatcgtgaaattacgttgttatttttcggtattggaggaagtatcgcgttgataagtttggttgacggaagtggtaattcggttagcgtggaggtttagttcgttatcgacggcgtgaaggtaaaagtgagtcgtgtttttgacggtgttgttgaatatagcgtatgggagttgaagttgtcgacgttgcgttagcgattgtttcgttgcgtgagtattcgtgagaacgacgacggtacgtatgttattatcgtcgtgtagtatgtgtcggaaaaagaggttatcgtggataacggggcgtattttgacggcgaatagagtggtacggtgaatggtgttacgtcgttagcggtgtagtatttgatcgtagaagttattgtagatagcggggaatattaggtgttggcgcgatgggatatatcgaaggtggtgaagggcgtgagttttttgtttcgtttgatcgtaatagcggacgacggtagtgagcggttggttagtacggttcggacgacggaaattatatatcgttttacgtaattggcgttggggaattataggttgatagttcgggcggtaaatgcgtgggggtagtagggcgattcggcgtcggtatcgtttcggattgtcgtatcggtagtatcgtcgaggattgagttgacgtcgggttatttttagataatcgttacgtcgtattttgtcgtttatgattcgacggtatagtttgagttttggttttcggaaaagtagattgcggatatt

SEQ ID NO: 37554 - DNA, 2251 bp, Artificial Sequence
  chemically treated genomic DNA (Homo sapiens) CpG-island No: 37554
aatatccgcaatctacttttccgaaaaccaaaactcaaactataccgtcgaatcataaacgacaaaatacgacgtaacgattatctaaaaataacccgacgtcaactcaatcctcgacgatactaccgatacgacaatccgaaacgataccgacgccgaatcgccctactacccccacgcatttaccgcccgaactatcaacctataattccccaacgccaattacgtaaaacgatatataatttccgtcgtccgaaccgtactaaccaaccgctcactaccgtcgtccgctattacgatcaaacgaaacaaaaaactcacgcccttcaccaccttcgatatatcccatcgcgccaacacctaatattccccgctatctacaataacttctacgatcaaatactacaccgctaacgacgtaacaccattcaccgtaccactctattcgccgtcaaaatacgccccgttatccacgataacctctttttccgacacatactacacgacgataataacatacgtaccgtcgtcgttctcacgaatactcacgcaacgaaacaatcgctaacgcaacgtcgacaacttcaactcccatacgctatattcaacaacaccgtcaaaaacacgactcacttttaccttcacgccgtcgataacgaactaaacctccacgctaaccgaattaccacttccgtcaaccaaacttatcaacgcgatacttcctccaataccgaaaaataacaacgtaatttcacgatcgaacgtcaacgtccgaatctaactattcaccgccaacacacgaccaccgatactaataccgacataatcatcatcgcaaatttcaataacatcgcccgatacataacgaaacccttctacgccgacgctaaaatccacgatctacgtttccaacaattctattttaatcaaccacaacccgacgcgatatacctacccccgactaatacaaccaaaaacatccatcttcgtaacattacgaccgtaacgaacaataacctacgtatcttcaacaaactctatcgccgtctcccaaccgttattcgaatcaatccaattcacctcaacgacattataacgatccttcaaaacgctaaaactataacgaaacgacgcgccatcatccgacatcaccacattactacgattataaatccacgtcttatccgacgatcgatcctacacgaacgtcaacgtctacccgttccataccgacatacaacgcatcgccgaacaaaaatcgctaaacacatcccacgccttacgctatataatcaaatacgcattacaaataatacgcgactccgtaccgccaaaaccgtccgacactaactaatcgcaatactaaccgataacatacaacgcccatttatccacatccgccgcaccaaaacgtttccccataccgtaacgcgaataaatcaacatatcccacaaacaccaaaccatattattactatataccgatttaaacgttccgtcccaaataccgctatattaccgcgtctacgaattataattcgacgacacctacaaaatacgcccgcgcaaataataattacgactcacctactaactaccgaactactccgaatccacctacacgccgaccaataccgtattcgaataacactatttcacatcgataatttcaatatataacgaccaaaacgttttattctacaactaatctataatactatccgacgtcatcctacgcatccgaatattaaacgaacgcgacgacaaattacccatcaccaccgaaaccaaatactacgaaataattttacccttaataataatatctttttccgtcacccaaccaccgttacgttatatctaaaccaacaaacgaacttccgacgaattcctatcaccctttaaaataatttccaccaatacctatacaccgaaaataaaacgcaaacgatcgatatttacaaacgtaataatacgaataatcgacgtatcatatttcacttccgtacccaacaccgtctcgaaaccgaaaaattcaaatccctccgacgaaatctactcctactcaccaacccgaaacaccaccgtaacaccgaatatattaatattcccctcaatatccaacaccgacgtactattcaacaacacgctttttaaaccatccaccgaaccttcaatcgacccttcgctaataacatcgatcacactcaacaactacgtaaacttcaaattatccttcgcttcgcgcgaa

SEQ ID NO: 37555 - DNA, 2251 bp, Artificial Sequence
  chemically treated genomic DNA (Homo sapiens) CpG-island No: 37555
gatattcgtaatttgttttttcgagaattagaatttaaattgtatcgtcgggttataaacggtaagatgcggcgtggcggttatttgaaaatagttcggcgttagtttaattttcgacggtgttgtcggtgcggtaattcggaacgatatcgacgtcggatcgttttgttgtttttacgtatttatcgttcggattgttagtttgtagttttttagcgttagttgcgtgaagcggtatgtggttttcgtcgttcgggtcgtgttgattagtcgtttattgtcgtcgttcgttgttacggttagacggagtaggaaatttacgttttttattattttcggtgtgttttatcgcgttagtatttgatatttttcgttgtttgtagtgatttttgcggttaggtgttgtatcgttggcggcgtgatattatttatcgtgttattttgttcgtcgttaaagtgcgtttcgttatttacgatggttttttttttcggtatatgttgtacggcggtgatggtatacgtgtcgtcgtcgtttttacggatatttacgtagcggaatagtcgttggcgtagcgtcggtagttttagtttttatacgttgtatttagtaatatcgttaggaatacggtttatttttatttttacgtcgtcggtgacggattgaatttttacgttgatcggattgttattttcgttaattaggtttattagcgcggtattttttttagtatcggaggatggtagcgtgattttacggtcgagcgttagcgttcgggtttggttgtttatcgttagtatacgattatcggtgttgatatcggtatagttattatcgtagattttaataatatcgttcggtatatggcgaagtttttttgcgtcgacgttgaaatttacggtttgcgtttttagtagttttgttttaattagttatagttcggcgcggtgtgtttgttttcggttggtatagttaaaggtatttattttcgtaatattacgatcgtaacgggtaatggtttgcgtatttttaataagttttgtcgtcgttttttagtcgttgttcgggttaatttagtttattttaacggtattatggcggttttttagggcgttgaagttgtagcggaacggcgcgttattattcggtattattatattattgcggttataggtttacgttttattcgacggtcggttttgtacgaacgttagcgtttgttcgttttatatcggtatatagcgtatcgtcgagtagaaatcgttgagtatattttacgttttacgttgtgtggttaggtacgtattataggtgatgcgcggtttcgtgtcgttaaagtcgttcggtattgattggtcgtagtattggtcgatgatatatagcgtttatttatttatattcgtcgtattaagacgtttttttatgtcgtagcgcggatgggttagtatattttatagatattaggttatgttgttgttgtatgtcggtttaaacgtttcgttttagatatcgttgtattgtcgcgtttgcgggttatagttcgacggtatttgtagaatacgttcgcgtagatgataattacggtttatttgttggttgtcgaattgtttcgagtttatttgtacgtcgattagtgtcgtgttcgggtagtattgttttatatcgatgattttagtgtatgacgattagagcgttttgttttgtagttggtttgtggtgttgttcggcgttattttgcgtattcggatattaaacgggcgcggcggtaggttatttattattatcgaggttagatattgcgaggtggttttgtttttaatggtgatgttttttttcgttatttagttatcgttacgttgtatttgaattagtaggcggattttcgacggatttttgttattttttgaggtggtttttattagtgtttgtatatcgaaggtaaagcgtagacggtcgatgtttgtagacgtaatggtgcgggtgatcggcgtgttatattttattttcgtatttagtatcgtttcggagtcggaggatttaaattttttcggcggagtttgtttttgtttattagttcggaatattatcgtgatatcggatatgttggtattttttttagtgtttagtatcggcgtattgtttagtagtacgttttttaagttatttatcggatttttaatcggtttttcgttgatggtatcgattatatttagtaattgcgtggattttaggttgtttttcgtttcgcgcggg

SEQ ID NO: 37556 - DNA, 2251 bp, Artificial Sequence
  chemically treated genomic DNA (Homo sapiens) CpG-island No: 37556
cccgcgcgaaacgaaaaacaacctaaaatccacgcaattactaaatataatcgataccatcaacgaaaaaccgattaaaaatccgataaataacttaaaaaacgtactactaaacaatacgccgatactaaacactaaaaaaaataccaacatatccgatatcacgataatattccgaactaataaacaaaaacaaactccgccgaaaaaatttaaatcctccgactccgaaacgatactaaatacgaaaataaaatataacacgccgatcacccgcaccattacgtctacaaacatcgaccgtctacgctttaccttcgatatacaaacactaataaaaaccacctcaaaaaataacaaaaatccgtcgaaaatccgcctactaattcaaatacaacgtaacgataactaaataacgaaaaaaaacatcaccattaaaaacaaaaccacctcgcaatatctaacctcgataataataaataacctaccgccgcgcccgtttaatatccgaatacgcaaaataacgccgaacaacaccacaaaccaactacaaaacaaaacgctctaatcgtcatacactaaaatcatcgatataaaacaatactacccgaacacgacactaatcgacgtacaaataaactcgaaacaattcgacaaccaacaaataaaccgtaattatcatctacgcgaacgtattctacaaataccgtcgaactataacccgcaaacgcgacaatacaacgatatctaaaacgaaacgtttaaaccgacatacaacaacaacataacctaatatctataaaatatactaacccatccgcgctacgacataaaaaaacgtcttaatacgacgaatataaataaataaacgctatatatcatcgaccaatactacgaccaatcaataccgaacgactttaacgacacgaaaccgcgcatcacctataatacgtacctaaccacacaacgtaaaacgtaaaatatactcaacgatttctactcgacgatacgctatataccgatataaaacgaacaaacgctaacgttcgtacaaaaccgaccgtcgaataaaacgtaaacctataaccgcaataatataataataccgaataataacgcgccgttccgctacaacttcaacgccctaaaaaaccgccataataccgttaaaataaactaaattaacccgaacaacgactaaaaaacgacgacaaaacttattaaaaatacgcaaaccattacccgttacgatcgtaatattacgaaaataaatacctttaactataccaaccgaaaacaaacacaccgcgccgaactataactaattaaaacaaaactactaaaaacgcaaaccgtaaatttcaacgtcgacgcaaaaaaacttcgccatataccgaacgatattattaaaatctacgataataactataccgatatcaacaccgataatcgtatactaacgataaacaaccaaacccgaacgctaacgctcgaccgtaaaatcacgctaccatcctccgatactaaaaaaaataccgcgctaataaacctaattaacgaaaataacaatccgatcaacgtaaaaattcaatccgtcaccgacgacgtaaaaataaaaataaaccgtattcctaacgatattactaaatacaacgtataaaaactaaaactaccgacgctacgccaacgactattccgctacgtaaatatccgtaaaaacgacgacgacacgtataccatcaccgccgtacaacatataccgaaaaaaaaaaccatcgtaaataacgaaacgcactttaacgacgaacaaaataacacgataaataatatcacgccgccaacgatacaacacctaaccgcaaaaatcactacaaacaacgaaaaatatcaaatactaacgcgataaaacacaccgaaaataataaaaaacgtaaatttcctactccgtctaaccgtaacaacgaacgacgacaataaacgactaatcaacacgacccgaacgacgaaaaccacataccgcttcacgcaactaacgctaaaaaactacaaactaacaatccgaacgataaatacgtaaaaacaacaaaacgatccgacgtcgatatcgttccgaattaccgcaccgacaacaccgtcgaaaattaaactaacgccgaactattttcaaataaccgccacgccgcatcttaccgtttataacccgacgatacaatttaaattctaattctcgaaaaaacaaattacgaatatc

SEQ ID NO: 37557 - DNA, 562 bp, Artificial Sequence
  chemically treated genomic DNA (Homo sapiens) CpG-island No: 37557
tgtcggaatagtacgacgaaaagtcgtaggtatagtaggtagcgtagattattaacggtgtgtttagttagttattggtaattttttcggcgagtttggttaatcgtgattagaacgaagtgaacgaaattcgtcgttagtgggttttggtttttcgggaaaacgggattattacgatggaataggttaacgtaggaatgcgcgtagttcgtcggtagaatcgattatttttgttattatttgggtagtttgttgtatggtgtcgggaagaagtattcgttatcgtcggattgttaaacgttagcgagttggtggatatggtttacgagtattgtcggaagcgaggtttgtattcggatgcggagttttattcgtggaaattaaacgcgtattattggttggttattaatttgtattagaatatgcgggttaatgcgtttattgatgcggaattacgtcgtaaggtcgtagatgagtttgtttatatgattgcgagaattaatcgtggtgaggcgatttttgaattagtaaaataattttttgttatgggcggtagattttt

SEQ ID NO: 37558 - DNA, 562 bp, Artificial Sequence
  chemically treated genomic DNA (Homo sapiens) CpG-island No: 37558
aaaaatctaccgcccataacaaaaaattattttactaattcaaaaatcgcctcaccacgattaattctcgcaatcatataaacaaactcatctacgaccttacgacgtaattccgcatcaataaacgcattaacccgcatattctaatacaaattaataaccaaccaataatacgcgtttaatttccacgaataaaactccgcatccgaatacaaacctcgcttccgacaatactcgtaaaccatatccaccaactcgctaacgtttaacaatccgacgataacgaatacttcttcccgacaccatacaacaaactacccaaataataacaaaaataatcgattctaccgacgaactacgcgcattcctacgttaacctattccatcgtaataatcccgttttcccgaaaaaccaaaacccactaacgacgaatttcgttcacttcgttctaatcacgattaaccaaactcgccgaaaaaattaccaataactaactaaacacaccgttaataatctacgctacctactatacctacgacttttcgtcgtactattccgaca

SEQ ID NO: 37559 - DNA, 562 bp, Artificial Sequence
  chemically treated genomic DNA (Homo sapiens) CpG-island No: 37559
agaggtttatcgtttatgataggaagttgttttattggtttagggatcgttttattacggttaattttcgtagttatatggataagtttatttgcggttttacggcgtaatttcgtattagtaagcgtattggttcgtatgttttgatataggttggtaattagttagtagtgcgcgtttgatttttacggataagatttcgtattcggatataggtttcgttttcggtaatattcgtaaattatatttattagttcgttgacgtttggtagttcggcggtaacggatgttttttttcggtattatgtaataaattgtttaggtgatggtagaaatggtcgattttgtcgacgggttacgcgtatttttgcgttaatttgttttatcgtggtgatttcgttttttcgaaaagttagaatttattggcgacggatttcgtttatttcgttttggttacggttagttaggttcgtcgggaaagttgttagtaattggttgaatatatcgttgatgatttgcgttatttgttgtatttgcggtttttcgtcgtattgtttcggta

SEQ ID NO: 37560 - DNA, 562 bp, Artificial Sequence
  chemically treated genomic DNA (Homo sapiens) CpG-island No: 37560
taccgaaacaatacgacgaaaaaccgcaaatacaacaaataacgcaaatcatcaacgatatattcaaccaattactaacaactttcccgacgaacctaactaaccgtaaccaaaacgaaataaacgaaatccgtcgccaataaattctaacttttcgaaaaaacgaaatcaccacgataaaacaaattaacgcaaaaatacgcgtaacccgtcgacaaaatcgaccatttctaccatcacctaaacaatttattacataataccgaaaaaaaacatccgttaccgccgaactaccaaacgtcaacgaactaataaatataatttacgaatattaccgaaaacgaaacctatatccgaatacgaaatcttatccgtaaaaatcaaacgcgcactactaactaattaccaacctatatcaaaacatacgaaccaatacgcttactaatacgaaattacgccgtaaaaccgcaaataaacttatccatataactacgaaaattaaccgtaataaaacgatccctaaaccaataaaacaacttcctatcataaacgataaacctct

SEQ ID NO: 37561 - DNA, 571 bp, Artificial Sequence
  chemically treated genomic DNA (Homo sapiens) CpG-island No: 37561
ttcggttcgtgcggaaggtggatatggtacgtttacggtgggttatttttaagtgaaatcgggtatattgtcgtcgttgtcgggcggggatatcggtgtgagttatttgaaagggattaacgtgaagtatcgttatgagttgacggatagtgtgggggtgatggtttttttggggttcgtcgcgtcgaaaaagagtagtatagtgatgatcggggaggatacgttttattatgagagtttgcgtggacgttatgtgagcgtgatggtcggatcggttttataaattagtaagtaggttagtgcgtacgttatggtcggagtggtttatagtcggtggttcggtagtataatggattatcgtaagacggaaattattttcgggtatatgaaagagacgattattgttagggacgaaagtgtaatgcggtatattttagtggcgtggagtgtaggtatatagattaattcggtagcgttcgtcgttgttgatattgtttatgaaggtttcggtagtggcgattggcgtattgacggatttatcgttggggtcggttataaattttgattagtt

SEQ ID NO: 37562 - DNA, 571 bp, Artificial Sequence
  chemically treated genomic DNA (Homo sapiens) CpG-island No: 37562
aactaatcaaaatttataaccgaccccaacgataaatccgtcaatacgccaatcgccactaccgaaaccttcataaacaatatcaacaacgacgaacgctaccgaattaatctatatacctacactccacgccactaaaatataccgcattacactttcgtccctaacaataatcgtctctttcatatacccgaaaataatttccgtcttacgataatccattatactaccgaaccaccgactataaaccactccgaccataacgtacgcactaacctacttactaatttataaaaccgatccgaccatcacgctcacataacgtccacgcaaactctcataataaaacgtatcctccccgatcatcactatactactctttttcgacgcgacgaaccccaaaaaaaccatcacccccacactatccgtcaactcataacgatacttcacgttaatccctttcaaataactcacaccgatatccccgcccgacaacgacgacaatatacccgatttcacttaaaaataacccaccgtaaacgtaccatatccaccttccgcacgaaccgaa

SEQ ID NO: 37563 - DNA, 571 bp, Artificial Sequence
  chemically treated genomic DNA (Homo sapiens) CpG-island No: 37563
ggttaattagaatttataatcgattttaacgatgaattcgttagtacgttagtcgttattgtcggagtttttataagtaatattaataacgacggacgttgtcggattaatttgtatatttgtattttacgttattgaggtatgtcgtattgtattttcgtttttggtagtggtcgttttttttatatattcgggagtgattttcgttttacggtaatttattgtattgtcggattatcgattgtgagttatttcggttatggcgtacgtattgatttgtttattgatttgtaaaatcggttcggttattacgtttatataacgtttacgtaggtttttatagtgaaacgtatttttttcggttattattgtgttgttttttttcgacgcggcgaattttagggaagttattatttttatattgttcgttagtttataacggtattttacgttaattttttttagatgatttatatcggtattttcgttcgataacgacggtaatgtattcggttttatttgaaaatagtttatcgtaaacgtattatgtttatttttcgtacgggtcgga

SEQ ID NO: 37564 - DNA, 571 bp, Artificial Sequence
  chemically treated genomic DNA (Homo sapiens) CpG-island No: 37564
tccgacccgtacgaaaaataaacataatacgtttacgataaactattttcaaataaaaccgaatacattaccgtcgttatcgaacgaaaataccgatataaatcatctaaaaaaaattaacgtaaaataccgttataaactaacgaacaatataaaaataataacttccctaaaattcgccgcgtcgaaaaaaaacaacacaataataaccgaaaaaaatacgtttcactataaaaacctacgtaaacgttatataaacgtaataaccgaaccgattttacaaatcaataaacaaatcaatacgtacgccataaccgaaataactcacaatcgataatccgacaatacaataaattaccgtaaaacgaaaatcactcccgaatatataaaaaaaacgaccactaccaaaaacgaaaatacaatacgacatacctcaataacgtaaaatacaaatatacaaattaatccgacaacgtccgtcgttattaatattacttataaaaactccgacaataacgactaacgtactaacgaattcatcgttaaaatcgattataaattctaattaacc

SEQ ID NO: 37565 - DNA, 797 bp, Artificial Sequence
  chemically treated genomic DNA (Homo sapiens) CpG-island No: 37565
taacgttaggtgatcgggaaggggtcgaggcggagaggggagaggggttaggaggtgcggggtgcgcggcggtagcgggttttttatcggtcggcgagaatttgatagtaggcgtcggtgtttagtattttttttttttttttagtttttgtcggcgggtatttgagtttatttcgttgtcggttttcgcgatttttcggggaggttaatatgcgttttataaggtcgacgtttatttttatttttttcgtttttttttaagtaaacgggaagttttttgggatgttaacgttcggtaatagtcgagcgggaatttttttttttttgatatttgttaaattcggagttggagttaggttcgttgcgtttttcgcggagttttgggattttaaggtcggttcgtattcgggtttcgggcgatatttttaggtcgacgcgtatttgttcgtagatttacggggtatttttgagggtcgtttaggatttggacggtataggttttacgaaagttcgtaggttggggtcggtttcgtgtcggtcggggattttcgggtgtagcgttagttttggttatagggtcgaaggggcgggcggatttggattttttaagttcgacggagacgtttttttcgtttttatttagtttcgcgggttttcgaaagggaagtgaagcggggaggaagggtagacgcggtatcgttcgtttaacgtttttgaggggtagttattaggtatggttttttcggggattttcgaagttttcggggatatatttaggagtttttttcggtcgagtt

SEQ ID NO: 37566 - DNA, 797 bp, Artificial Sequence
  chemically treated genomic DNA (Homo sapiens) CpG-island No: 37566
aactcgaccgaaaaaaactcctaaatatatccccgaaaacttcgaaaatccccgaaaaaaccatacctaataactacccctcaaaaacgttaaacgaacgataccgcgtctacccttcctccccgcttcacttccctttcgaaaacccgcgaaactaaataaaaacgaaaaaaacgtctccgtcgaacttaaaaaatccaaatccgcccgccccttcgaccctataaccaaaactaacgctacacccgaaaatccccgaccgacacgaaaccgaccccaacctacgaactttcgtaaaacctataccgtccaaatcctaaacgaccctcaaaaataccccgtaaatctacgaacaaatacgcgtcgacctaaaaatatcgcccgaaacccgaatacgaaccgaccttaaaatcccaaaactccgcgaaaaacgcaacgaacctaactccaactccgaatttaacaaatatcaaaaaaaaaaaaattcccgctcgactattaccgaacgttaacatcccaaaaaacttcccgtttacttaaaaaaaaacgaaaaaaataaaaataaacgtcgaccttataaaacgcatattaacctccccgaaaaatcgcgaaaaccgacaacgaaataaactcaaatacccgccgacaaaaactaaaaaaaaaaaaaaaatactaaacaccgacgcctactatcaaattctcgccgaccgataaaaaacccgctaccgccgcgcaccccgcacctcctaacccctctcccctctccgcctcgaccccttcccgatcacctaacgtta

SEQ ID NO: 37567 - DNA, 797 bp, Artificial Sequence
  chemically treated genomic DNA (Homo sapiens) CpG-island No: 37567
gattcggtcgaagaggatttttagatgtgttttcgggagtttcggggattttcgaggggattatgtttggtggttgttttttaagggcgttgggcgaacggtgtcgcgtttgtttttttttttcgttttatttttttttcgggagttcgcgaggttgggtgggggcggggagggcgttttcgtcgggtttggggagtttaagttcgttcgttttttcggttttgtagttagggttggcgttgtattcgggaattttcggtcggtacggggtcgattttagtttgcgaattttcgtggggtttgtgtcgtttaggttttgggcggtttttaaggatgtttcgtgggtttgcgggtaggtgcgcgtcggtttggggatgtcgttcggagttcgggtgcgggtcggttttggagttttagagtttcgcggagggcgtagcgagtttggttttagtttcgggtttgatagatgttagggaagaaaaggttttcgttcggttattgtcgggcgttgatattttagagagtttttcgtttgtttggaagaagacgaggaaggtagaggtgaacgtcgattttgtggggcgtatgttagttttttcgaggggtcgcgagagtcggtagcggggtgagtttaggtgttcgtcggtaggagttggggagggaaggggagtgttggatatcggcgtttgttgttaagttttcgtcggtcggtgagagattcgttgtcgtcgcgtatttcgtattttttgatttttttttttttttcgtttcggttttttttcggttatttagcgttg

SEQ ID NO: 37568 - DNA, 797 bp, Artificial Sequence
  chemically treated genomic DNA (Homo sapiens) CpG-island No: 37568
caacgctaaataaccgaaaaaaaaccgaaacgaaaaaaaaaaaaaaatcaaaaaatacgaaatacgcgacgacaacgaatctctcaccgaccgacgaaaacttaacaacaaacgccgatatccaacactccccttccctccccaactcctaccgacgaacacctaaactcaccccgctaccgactctcgcgacccctcgaaaaaactaacatacgccccacaaaatcgacgttcacctctaccttcctcgtcttcttccaaacaaacgaaaaactctctaaaatatcaacgcccgacaataaccgaacgaaaaccttttcttccctaacatctatcaaacccgaaactaaaaccaaactcgctacgccctccgcgaaactctaaaactccaaaaccgacccgcacccgaactccgaacgacatccccaaaccgacgcgcacctacccgcaaacccacgaaacatccttaaaaaccgcccaaaacctaaacgacacaaaccccacgaaaattcgcaaactaaaatcgaccccgtaccgaccgaaaattcccgaatacaacgccaaccctaactacaaaaccgaaaaaacgaacgaacttaaactccccaaacccgacgaaaacgccctccccgcccccacccaacctcgcgaactcccgaaaaaaaaataaaacgaaaaaaaaaaacaaacgcgacaccgttcgcccaacgcccttaaaaaacaaccaccaaacataatcccctcgaaaatccccgaaactcccgaaaacacatctaaaaatcctcttcgaccgaatc

SEQ ID NO: 37569 - DNA, 991 bp, Artificial Sequence
  chemically treated genomic DNA (Homo sapiens) CpG-island No: 37569
cggacgggcgcggcgtttttaaggggcgtagtttttttacggttcgggtgggggtagggagcggttacgggttttttaaggtcggtagcgggtacgtcgggtagggtttttcggcggtcgggttgttttcggggcggcggtaggggcgtagcgttcgcgagggtgttaacggttttcgacggggtgcgcgggatcgcgtcgttggtcgtcgtcggtttgatatttatcgtggttcgtcgggagcgttcgcgttcgcgttcgtattcggatttcgcggcggcggcggcggtgagttcggcgcgggtaaataggtattttcgtttttgatttattttttgttttttttaaatgtcgtattattaatttatttttcgattaattcgtttttcgtcggtttaggttcggtttttcgtttattaatcgttgtgtttaatttttttttttcgtttattaatggaggagtcgtagcgttcggatatttgttttttttcgttagttaattcgaacgttcgaagggagtcggtttcggcggtcgtttttagttaattcgcgcgcggttcggtagttcgttggttagttgtgtggcggttagagaggtcgttgattaatggcgaggcggcgggagtcggtttatttgttatttttttgttattaattatttggcgtataggagcgtacgtttcgaggagaggattaattcgcgcgcgttttttgggtttttcgtttttgttttttttttttttttttaggttttttattagtcgcggttattgcggtgtttaagtcgcgtttttcggggtcgttcgggatgttttttttttttgggttttttgtcggttggcgtttggtcgttcgtttttattttttttttttttttttttttttttcgggtatttcgacgaaaagtagtagtttttgatttttttttttttttcggttttatttaggaaattaattttaggaacgttgagtgttagattttttttaaaat

SEQ ID NO: 37570 - DNA, 991 bp, Artificial Sequence
  chemically treated genomic DNA (Homo sapiens) CpG-island No: 37570
attttaaaaaaaatctaacactcaacgttcctaaaattaatttcctaaataaaaccgaaaaaaaaaaaaaaatcaaaaactactacttttcgtcgaaatacccgaaaaaaaaaaaaaaaaaaaaaaaaaataaaaacgaacgaccaaacgccaaccgacaaaaaacccaaaaaaaaaaaacatcccgaacgaccccgaaaaacgcgacttaaacaccgcaataaccgcgactaataaaaaacctaaaaaaaaaaaaaaaaaacaaaaacgaaaaacccaaaaaacgcgcgcgaattaatcctctcctcgaaacgtacgctcctatacgccaaataattaataacaaaaaaataacaaataaaccgactcccgccgcctcgccattaatcaacgacctctctaaccgccacacaactaaccaacgaactaccgaaccgcgcgcgaattaactaaaaacgaccgccgaaaccgactcccttcgaacgttcgaattaactaacgaaaaaaaacaaatatccgaacgctacgactcctccattaataaacgaaaaaaaaaaattaaacacaacgattaataaacgaaaaaccgaacctaaaccgacgaaaaacgaattaatcgaaaaataaattaataatacgacatttaaaaaaaacaaaaaataaatcaaaaacgaaaatacctatttacccgcgccgaactcaccgccgccgccgccgcgaaatccgaatacgaacgcgaacgcgaacgctcccgacgaaccacgataaatatcaaaccgacgacgaccaacgacgcgatcccgcgcaccccgtcgaaaaccgttaacaccctcgcgaacgctacgcccctaccgccgccccgaaaacaacccgaccgccgaaaaaccctacccgacgtacccgctaccgaccttaaaaaacccgtaaccgctccctacccccacccgaaccgtaaaaaaactacgccccttaaaaacgccgcgcccgtccg

SEQ ID NO: 37571 - DNA, 991 bp, Artificial Sequence
  chemically treated genomic DNA (Homo sapiens) CpG-island No: 37571
attttaggaagggtttggtatttaacgtttttaaaattggttttttagatggagtcggagggagagagggagttaggaattgttgtttttcgtcggaatgttcggaggggagaagaagaaggaggaggggtgagggcgggcggttaaacgttagtcggtaggggatttagagaagagggatatttcgggcgatttcgaggagcgcggtttgggtatcgtagtggtcgcggttagtgggagatttgaggggaaagggagagggtaggggcgaggaatttagggagcgcgcgcggattggtttttttttcggggcgtgcgtttttgtgcgttaaatgattggtggtaggaaagtagtaggtaaatcggttttcgtcgtttcgttattggttagcggtttttttagtcgttatataattggttagcgggttgtcgagtcgcgcgcggattggttgggggcggtcgtcgggatcggtttttttcgggcgttcggattggttggcgggaagaggtaggtattcgggcgttgcggtttttttattggtgggcggggaaggggggttgggtatagcgattggtgggcggggggtcgggtttgggtcggcggggagcggattggtcggaaagtaggttagtggtgcgatatttagggaaggtagaaagtaggttagggacggaggtgtttgtttattcgcgtcggatttatcgtcgtcgtcgtcgcgggattcgagtgcgggcgcgggcgcgggcgttttcggcgagttacggtgagtgttaggtcggcggcggttagcgacgcgatttcgcgtatttcgtcgggggtcgttagtattttcgcgggcgttgcgtttttgtcgtcgtttcgggggtaattcggtcgtcgaagaattttgttcgacgtgttcgttgtcggttttaaagggttcgtgatcgttttttgtttttattcgggtcgtggggaggttgcgttttttaaaggcgtcgcgttcgttcg

SEQ ID NO: 37572 - DNA, 991 bp, Artificial Sequence
  chemically treated genomic DNA (Homo sapiens) CpG-island No: 37572
cgaacgaacgcgacgcctttaaaaaacgcaacctccccacgacccgaataaaaacaaaaaacgatcacgaaccctttaaaaccgacaacgaacacgtcgaacaaaattcttcgacgaccgaattacccccgaaacgacgacaaaaacgcaacgcccgcgaaaatactaacgacccccgacgaaatacgcgaaatcgcgtcgctaaccgccgccgacctaacactcaccgtaactcgccgaaaacgcccgcgcccgcgcccgcactcgaatcccgcgacgacgacgacgataaatccgacgcgaataaacaaacacctccgtccctaacctactttctaccttccctaaatatcgcaccactaacctactttccgaccaatccgctccccgccgacccaaacccgaccccccgcccaccaatcgctatacccaaccccccttccccgcccaccaataaaaaaaccgcaacgcccgaatacctacctcttcccgccaaccaatccgaacgcccgaaaaaaaccgatcccgacgaccgcccccaaccaatccgcgcgcgactcgacaacccgctaaccaattatataacgactaaaaaaaccgctaaccaataacgaaacgacgaaaaccgatttacctactactttcctaccaccaatcatttaacgcacaaaaacgcacgccccgaaaaaaaaaccaatccgcgcgcgctccctaaattcctcgcccctaccctctccctttcccctcaaatctcccactaaccgcgaccactacgatacccaaaccgcgctcctcgaaatcgcccgaaatatccctcttctctaaatcccctaccgactaacgtttaaccgcccgccctcacccctcctccttcttcttctcccctccgaacattccgacgaaaaacaacaattcctaactccctctctccctccgactccatctaaaaaaccaattttaaaaacgttaaataccaaacccttcctaaaat

SEQ ID NO: 37573 - DNA, 696 bp, Artificial Sequence
  chemically treated genomic DNA (Homo sapiens) CpG-island No: 37573
tgcgggagagcggagggagggagttgcgagtcgggaggaggaaggttgggagggaaggagagggaggggtcgagggacgaagcgggtgggggttagttcggtagtagtcgtcgcggttattagcgtcgttacgttcgttcgtttagtcgttttcggtgttcgttgttcgtcgttcggttttcggttgttcgcggttttttgtttttgtttggcgttttgggtagttacgtgtttcggaatataggattgcgcgattggtcggtcgatttttggtcgcggttaggataggataggtggttgagtggggatcgtgagatcgcgagttttcggacgtcgtaggtacgaggggacgcgtgggtgggggtttcggttttgggatagggattttgatggtcgcgattaatttttattagtttcgtgatgtcgggtgtttgttcgggtcgcgttgttgaagcgagttgtgtttcgggagtaggtggattcggagtattgaggagcgttagggggttcggtagattgtagggcgttttaatgtgggtatgcgaggtttttcgtcggagtcgtgatgtagttttcgcgtcgtttttacgtgtgggggaagaacgatagtagtggtttgtgcgggtgtttagggagtgtttcgttgtttttttgaatttgggaattcgttttaagcgtacgggtgcgcggtttaat

SEQ ID NO: 37574 - DNA, 696 bp, Artificial Sequence
  chemically treated genomic DNA (Homo sapiens) CpG-island No: 37574
attaaaccgcgcacccgtacgcttaaaacgaattcccaaattcaaaaaaacaacgaaacactccctaaacacccgcacaaaccactactatcgttcttcccccacacgtaaaaacgacgcgaaaactacatcacgactccgacgaaaaacctcgcatacccacattaaaacgccctacaatctaccgaaccccctaacgctcctcaatactccgaatccacctactcccgaaacacaactcgcttcaacaacgcgacccgaacaaacacccgacatcacgaaactaataaaaattaatcgcgaccatcaaaatccctatcccaaaaccgaaacccccacccacgcgtcccctcgtacctacgacgtccgaaaactcgcgatctcacgatccccactcaaccacctatcctatcctaaccgcgaccaaaaatcgaccgaccaatcgcgcaatcctatattccgaaacacgtaactacccaaaacgccaaacaaaaacaaaaaaccgcgaacaaccgaaaaccgaacgacgaacaacgaacaccgaaaacgactaaacgaacgaacgtaacgacgctaataaccgcgacgactactaccgaactaacccccacccgcttcgtccctcgacccctccctctccttccctcccaaccttcctcctcccgactcgcaactccctccctccgctctcccgca

SEQ ID NO: 37575 - DNA, 696 bp, Artificial Sequence
  chemically treated genomic DNA (Homo sapiens) CpG-island No: 37575
attaagtcgcgtattcgtgcgtttaagacgaatttttagatttaaggggataacggagtattttttggatattcgtatagattattgttatcgttttttttttatacgtggaggcgacgcggaagttgtattacgatttcggcgggaggtttcgtatgtttatattgaggcgttttataatttgtcggattttttggcgttttttaatgtttcggatttatttattttcggagtataattcgttttagtagcgcgattcgggtaggtattcggtattacggagttggtaaaagttagtcgcggttattaaagtttttattttagggtcggaatttttatttacgcgttttttcgtgtttacggcgttcgagaattcgcgattttacggtttttatttaattatttattttgttttagtcgcgattagggatcggtcggttagtcgcgtaattttgtatttcggagtacgtagttgtttagagcgttaggtaggagtagggggtcgcgagtagtcgggagtcgggcggcgggtagcgggtatcgggagcgattgagcgagcgagcgtgacggcgttggtagtcgcggcggttgttgtcgagttagtttttattcgtttcgtttttcggttttttttttttttttttttttagttttttttttttcggttcgtagtttttttttttcgttttttcgta

SEQ ID NO: 37576 - DNA, 696 bp, Artificial Sequence
  chemically treated genomic DNA (Homo sapiens) CpG-island No: 37576
tacgaaaaaacgaaaaaaaaaaactacgaaccgaaaaaaaaaaaactaaaaaaaaaaaaaaaaaaaaaaccgaaaaacgaaacgaataaaaactaactcgacaacaaccgccgcgactaccaacgccgtcacgctcgctcgctcaatcgctcccgatacccgctacccgccgcccgactcccgactactcgcgaccccctactcctacctaacgctctaaacaactacgtactccgaaatacaaaattacgcgactaaccgaccgatccctaatcgcgactaaaacaaaataaataattaaataaaaaccgtaaaatcgcgaattctcgaacgccgtaaacacgaaaaaacgcgtaaataaaaattccgaccctaaaataaaaactttaataaccgcgactaacttttaccaactccgtaataccgaatacctacccgaatcgcgctactaaaacgaattatactccgaaaataaataaatccgaaacattaaaaaacgccaaaaaatccgacaaattataaaacgcctcaatataaacatacgaaacctcccgccgaaatcgtaatacaacttccgcgtcgcctccacgtataaaaaaaaaacgataacaataatctatacgaatatccaaaaaatactccgttatccccttaaatctaaaaattcgtcttaaacgcacgaatacgcgacttaat

SEQ ID NO: 37577 - DNA, 525 bp, Artificial Sequence
  chemically treated genomic DNA (Homo sapiens) CpG-island No: 37577
  misc_feature (490)..(490): n is either a, c, g or t
  misc_feature (504)..(504): n is either a, c, g or t
  misc_feature (524)..(524): n is either a, c, g or t
tcgttttagtcgggcgtagtttttttcgtcgtatatttatttttaggaaggaagagatatcgttttagtttagagtttggtaatcgggtatcgtttgggaattttgggcgggtcgagatagaggtcggtacggcgcgtttttggtatatttgttaggcgacgacggattttaggttttgaaatcgttggggttcggtggtcgaggttagttggagcgcgttattcgatttttcgtttcgggaacgttttgttttttcgattttcgtttcgttttttttatataaaggtaatttatatttatcgttattttttttttattttaaaaattattttttcgttaaatttcggtgttattttttttcgttatgttattcgttttagtacgatgggaaatgaaggcgggagtataggcggtacgaagttttagttttgtcgtttcgtgggtttaaaaaattataatttttaatatttttcgtcggttatcgttttntttttcgagttcgnttattggagaagaaagtgant

SEQ ID NO: 37578 - DNA, 525 bp, Artificial Sequence
  chemically treated genomic DNA (Homo sapiens) CpG-island No: 37578
  misc_feature (2)..(2): n is either a, c, g or t
  misc_feature (22)..(22): n is either a, c, g or t
  misc_feature (36)..(36): n is either a, c, g or t
antcactttcttctccaataancgaactcgaaaaanaaaacgataaccgacgaaaaatattaaaaattataattttttaaacccacgaaacgacaaaactaaaacttcgtaccgcctatactcccgccttcatttcccatcgtactaaaacgaataacataacgaaaaaaaataacaccgaaatttaacgaaaaaataatttttaaaataaaaaaaaaataacgataaatataaattacctttatataaaaaaaacgaaacgaaaatcgaaaaaacaaaacgttcccgaaacgaaaaatcgaataacgcgctccaactaacctcgaccaccgaaccccaacgatttcaaaacctaaaatccgtcgtcgcctaacaaatataccaaaaacgcgccgtaccgacctctatctcgacccgcccaaaattcccaaacgatacccgattaccaaactctaaactaaaacgatatctcttccttcctaaaaataaatatacgacgaaaaaaactacgcccgactaaaacga

SEQ ID NO: 37579 - DNA, 525 bp, Artificial Sequence
  chemically treated genomic DNA (Homo sapiens) CpG-island No: 37579
  misc_feature (2)..(2): n is either a, c, g or t
  misc_feature (22)..(22): n is either a, c, g or t
  misc_feature (36)..(36): n is either a, c, g or t
gnttatttttttttttaataancgggttcgaaaagnggggcggtgatcggcgaggaatattgggaattgtagttttttggatttacgggacggtagagttggagtttcgtgtcgtttgtattttcgtttttattttttatcgtgttgaggcgggtggtatggcggagaaggatgatatcggagtttgacgaagaggtggtttttgaggtaagaggaaaatggcggtgggtgtggattgtttttgtgtgagaaggacgagacggaaatcgaggaagtaaggcgttttcggggcgagggatcgggtgacgcgttttagttggtttcgattatcgaattttagcgattttagggtttagagttcgtcgtcgtttgataggtgtattagaggcgcgtcgtgtcggtttttatttcggttcgtttagaatttttagacggtgttcggttgttaggttttgggttggagcggtgtttttttttttttgggaatggatgtgcggcgggggggattgcgttcggttggggcgg

SEQ ID NO: 37580 - DNA, 525 bp, Artificial Sequence
  chemically treated genomic DNA (Homo sapiens) CpG-island No: 37580
  misc_feature (490)..(490): n is either a, c, g or t
  misc_feature (504)..(504): n is either a, c, g or t
  misc_feature (524)..(524): n is either a, c, g or t
ccgccccaaccgaacgcaatcccccccgccgcacatccattcccaaaaaaaaaaaaacaccgctccaacccaaaacctaacaaccgaacaccgtctaaaaattctaaacgaaccgaaataaaaaccgacacgacgcgcctctaatacacctatcaaacgacgacgaactctaaaccctaaaatcgctaaaattcgataatcgaaaccaactaaaacgcgtcacccgatccctcgccccgaaaacgccttacttcctcgatttccgtctcgtccttctcacacaaaaacaatccacacccaccgccattttcctcttacctcaaaaaccacctcttcgtcaaactccgatatcatccttctccgccataccacccgcctcaacacgataaaaaataaaaacgaaaatacaaacgacacgaaactccaactctaccgtcccgtaaatccaaaaaactacaattcccaatattcctcgccgatcaccgccccncttttcgaacccgnttattaaaaaaaaaaataanc

SEQ ID NO: 37581 - DNA, 950 bp, Artificial Sequence
  chemically treated genomic DNA (Homo sapiens) CpG-island No: 37581
tcgggtcggtcgggttagtgttttgcggtggggtcgcgttattgcgttaggattcggtcggggttcggcggtttgtgcgttcgggtttagtcgggtcggattagtattttggggttcggtcgtattagaattagtgcgttggggtcggggttcggtgtacgcgttggggtcggggcgggtgggtgtttagaggatgtgtcggataggttcggtttatttgttgtcgcgttgatgtatttttacgtggatcgttggcgattcggttatatagggaagcgtttgttttaggtcgtttacggtttcgtttatggcgttttcgagagtagtggggatttaattagggcgcggtcgtcgttattttacgtttagcgtcgtcgttatagtcgttgttttagttcgcgggtttcgttttagtttcgaatttgtcgcgcgaggcgtattattttttgattcggaagcgttcgggttcggtagggttattttttgtcgcggtttcgtttcgtttcgttttcggcgcggtttagcgagttcggtaatttcggcgtagcgagcgcgggcggttagttagggttagggggcggtggcggttaaggttcgatcgggtgttagttgtttttagttttcgtttcgggttcgtcgtcggcgtcgttatgggtaagaagtataagaagtataaggtcgagtggcgttcgttttacgagggtgaggcggcggcgttttgtgacgcgcggcgggcggggtttcgggtacgggggaggagtttcgggtacgcggacgggggttttgggtatcgggcgaggttttggttacgagggaggggttttgggtacgcgggagggggttttgggatttcgggtagggaatcgggtatacgtgaggggttttgggtaggcgtttacgtttttggtagagggttttgggttcgaggttgtaagtttatttatttcggt

SEQ ID NO: 37582 - DNA, 950 bp, Artificial Sequence
  chemically treated genomic DNA (Homo sapiens) CpG-island No: 37582
accgaaataaataaacttacaacctcgaacccaaaaccctctaccaaaaacgtaaacgcctacccaaaacccctcacgtatacccgattccctacccgaaatcccaaaaccccctcccgcgtacccaaaacccctccctcgtaaccaaaacctcgcccgatacccaaaacccccgtccgcgtacccgaaactcctcccccgtacccgaaaccccgcccgccgcgcgtcacaaaacgccgccgcctcaccctcgtaaaacgaacgccactcgaccttatacttcttatacttcttacccataacgacgccgacgacgaacccgaaacgaaaactaaaaacaactaacacccgatcgaaccttaaccgccaccgccccctaaccctaactaaccgcccgcgctcgctacgccgaaattaccgaactcgctaaaccgcgccgaaaacgaaacgaaacgaaaccgcgacaaaaaataaccctaccgaacccgaacgcttccgaatcaaaaaataatacgcctcgcgcgacaaattcgaaactaaaacgaaacccgcgaactaaaacaacgactataacgacgacgctaaacgtaaaataacgacgaccgcgccctaattaaatccccactactctcgaaaacgccataaacgaaaccgtaaacgacctaaaacaaacgcttccctatataaccgaatcgccaacgatccacgtaaaaatacatcaacgcgacaacaaataaaccgaacctatccgacacatcctctaaacacccacccgccccgaccccaacgcgtacaccgaaccccgaccccaacgcactaattctaatacgaccgaaccccaaaatactaatccgacccgactaaacccgaacgcacaaaccgccgaaccccgaccgaatcctaacgcaataacgcgaccccaccgcaaaacactaacccgaccgacccga

SEQ ID NO: 37583 - DNA, 950 bp, Artificial Sequence
  chemically treated genomic DNA (Homo sapiens) CpG-island No: 37583
atcggggtgagtgggtttgtagtttcgaatttagaattttttattaggaacgtaagcgtttatttaggattttttacgtgtgttcggttttttgttcgaaattttaggattttttttcgcgtgtttagaatttttttttcgtggttaggatttcgttcggtgtttaggattttcgttcgcgtgttcggaatttttttttcgtgttcgggatttcgttcgtcgcgcgttataaagcgtcgtcgttttattttcgtaggacgagcgttattcggttttgtgttttttgtgttttttgtttatggcggcgtcggcggcgggttcgaggcgggggttgggaatagttggtattcggtcggattttggtcgttatcgttttttggttttggttggtcgttcgcgttcgttgcgtcgaggttgtcgagttcgttgggtcgcgtcggaaacggggcgaggcggggtcgcggtaggaagtggttttgtcgggttcgagcgttttcgggttaggaggtggtgcgtttcgcgcggtagattcgaagttagggcggggttcgcgggttgaggtagcggttgtggcggcgacgttgggcgtgaggtggcggcggtcgcgttttggttgggtttttattgttttcgggggcgttatggacgaggtcgtgggcgatttgaagtaggcgtttttttgtgtggtcgagtcgttaacggtttacgtggaggtgtattagcgcggtagtaggtgagtcggatttgttcgatatattttttgggtatttattcgtttcgattttagcgcgtgtatcgagtttcgattttagcgtattgattttgatgcgatcgaattttagggtattgattcggttcgattggattcgggcgtataggtcgtcgggtttcgatcggattttagcgtaatgacgcgattttatcgtagggtattgattcggtcgattcga

SEQ ID NO: 37584 - DNA, 950 bp, Artificial Sequence
  chemically treated genomic DNA (Homo sapiens) CpG-island No: 37584
tcgaatcgaccgaatcaataccctacgataaaatcgcgtcattacgctaaaatccgatcgaaacccgacgacctatacgcccgaatccaatcgaaccgaatcaataccctaaaattcgatcgcatcaaaatcaatacgctaaaatcgaaactcgatacacgcgctaaaatcgaaacgaataaatacccaaaaaatatatcgaacaaatccgactcacctactaccgcgctaatacacctccacgtaaaccgttaacgactcgaccacacaaaaaaacgcctacttcaaatcgcccacgacctcgtccataacgcccccgaaaacaataaaaacccaaccaaaacgcgaccgccgccacctcacgcccaacgtcgccgccacaaccgctacctcaacccgcgaaccccgccctaacttcgaatctaccgcgcgaaacgcaccacctcctaacccgaaaacgctcgaacccgacaaaaccacttcctaccgcgaccccgcctcgccccgtttccgacgcgacccaacgaactcgacaacctcgacgcaacgaacgcgaacgaccaaccaaaaccaaaaaacgataacgaccaaaatccgaccgaataccaactattcccaacccccgcctcgaacccgccgccgacgccgccataaacaaaaaacacaaaaaacacaaaaccgaataacgctcgtcctacgaaaataaaacgacgacgctttataacgcgcgacgaacgaaatcccgaacacgaaaaaaaaattccgaacacgcgaacgaaaatcctaaacaccgaacgaaatcctaaccacgaaaaaaaaattctaaacacgcgaaaaaaaatcctaaaatttcgaacaaaaaaccgaacacacgtaaaaaatcctaaataaacgcttacgttcctaataaaaaattctaaattcgaaactacaaacccactcaccccgat

SEQ ID NO: 37585 - DNA, 787 bp, Artificial Sequence
  chemically treated genomic DNA (Homo sapiens) CpG-island No: 37585
gtcgatgcgttgcgggtagcggtcgtcgggggcgttgcgggggtcgcggttaaagtttcggcgcgggcgtacgcgtttagagggagtcgggtcgtcgtcgttgtcgtcgttgttttcgcgttttgcgttcggtggttttttattttcgtttcgcggtcgtatttggcgttttttggttttttcggttttcgcgcggcgtggagttatttttttttattttttatcggtattttagtttgttttcggtttatgcggttttcgcgggttttcggtttcggttttagaatttagttttgtatttgagcgcggggttcggcggggcgtggcggcggcgatggggaaattgtagtcgaagtacggtgagtcgcgggtcggtagggcgggagggcgggcgggcgggcgtggggtcgttttttattgtcgttttttttttttcgcgtttcgtcgtgtcgtagtcgtcgtcgttcgtaagcggagagagagttcggaaggtgagcgggcgagtcgacgggcggggcggggggcggcgattcggttcgggatttttagagttaggagttcgcgcgcgttttgttttggagttagcggtggggggacggggtcgcgggtttttaggagcgcgcgggatttttacgtttgtttttgcgcggtttttaggcgatggggatatagcgaaggcgtagcgttcgcggggtttacggcgcgttttttttttttttcggtgcgggtttttcgcgcgttcgttttcggatcgtaggggatagtttcgtggcgttcgcgtacgcga

SEQ ID NO: 37586 - DNA, 787 bp, Artificial Sequence
  chemically treated genomic DNA (Homo sapiens) CpG-island No: 37586
tcgcgtacgcgaacgccacgaaactatcccctacgatccgaaaacgaacgcgcgaaaaacccgcaccgaaaaaaaaaaaaaacgcgccgtaaaccccgcgaacgctacgccttcgctatatccccatcgcctaaaaaccgcgcaaaaacaaacgtaaaaatcccgcgcgctcctaaaaacccgcgaccccgtccccccaccgctaactccaaaacaaaacgcgcgcgaactcctaactctaaaaatcccgaaccgaatcgccgccccccgccccgcccgtcgactcgcccgctcaccttccgaactctctctccgcttacgaacgacgacgactacgacacgacgaaacgcgaaaaaaaaaaaacgacaataaaaaacgaccccacgcccgcccgcccgccctcccgccctaccgacccgcgactcaccgtacttcgactacaatttccccatcgccgccgccacgccccgccgaaccccgcgctcaaatacaaaactaaattctaaaaccgaaaccgaaaacccgcgaaaaccgcataaaccgaaaacaaactaaaataccgataaaaaataaaaaaaaataactccacgccgcgcgaaaaccgaaaaaaccaaaaaacgccaaatacgaccgcgaaacgaaaataaaaaaccaccgaacgcaaaacgcgaaaacaacgacgacaacgacgacgacccgactccctctaaacgcgtacgcccgcgccgaaactttaaccgcgacccccgcaacgcccccgacgaccgctacccgcaacgcatcgac

SEQ ID NO: 37587 - DNA, 787 bp, Artificial Sequence
  chemically treated genomic DNA (Homo sapiens) CpG-island No: 37587
tcgcgtacgcggacgttacgaagttgttttttgcggttcgggggcggacgcgcgggaaattcgtatcgaggagggaaagagacgcgtcgtgagtttcgcgggcgttgcgttttcgttgtgtttttatcgtttggagatcgcgtaggggtaggcgtgggggtttcgcgcgtttttggagattcgcggtttcgtttttttatcgttggttttagggtaggacgcgcgcgggtttttagttttgagggtttcgggtcgggtcgtcgtttttcgtttcgttcgtcggttcgttcgtttatttttcgggtttttttttcgtttgcgggcggcggcggttgcggtacggcgggacgcggggagaggaaaacgatagtgagaggcggttttacgttcgttcgttcgttttttcgttttatcggttcgcggtttatcgtgtttcgattgtagtttttttatcgtcgtcgttacgtttcgtcgggtttcgcgtttaggtgtagggttgagttttgaagtcggggtcgggagttcgcgggggtcgtatgggtcgggagtaagttagggtgtcggtaggaggtgagggaagatggttttacgtcgcgcgggggtcgggggagttagggggcgttaggtacggtcgcggggcggaggtggggggttatcgggcgtagggcgcggggatagcggcggtagcgacggcggttcggttttttttgagcgcgtgcgttcgcgtcggggttttaatcgcggttttcgtagcgttttcggcggtcgttgttcgtagcgtatcggt

SEQ ID NO: 37588 - DNA, 787 bp, Artificial Sequence
  chemically treated genomic DNA (Homo sapiens) CpG-island No: 37588
accgatacgctacgaacaacgaccgccgaaaacgctacgaaaaccgcgattaaaaccccgacgcgaacgcacgcgctcaaaaaaaaccgaaccgccgtcgctaccgccgctatccccgcgccctacgcccgataaccccccacctccgccccgcgaccgtacctaacgccccctaactcccccgacccccgcgcgacgtaaaaccatcttccctcacctcctaccgacaccctaacttactcccgacccatacgacccccgcgaactcccgaccccgacttcaaaactcaaccctacacctaaacgcgaaacccgacgaaacgtaacgacgacgataaaaaaactacaatcgaaacacgataaaccgcgaaccgataaaacgaaaaaacgaacgaacgaacgtaaaaccgcctctcactatcgttttcctctccccgcgtcccgccgtaccgcaaccgccgccgcccgcaaacgaaaaaaaaacccgaaaaataaacgaacgaaccgacgaacgaaacgaaaaacgacgacccgacccgaaaccctcaaaactaaaaacccgcgcgcgtcctaccctaaaaccaacgataaaaaaacgaaaccgcgaatctccaaaaacgcgcgaaacccccacgcctacccctacgcgatctccaaacgataaaaacacaacgaaaacgcaacgcccgcgaaactcacgacgcgtctctttccctcctcgatacgaatttcccgcgcgtccgcccccgaaccgcaaaaaacaacttcgtaacgtccgcgtacgcga

SEQ ID NO: 37589 - DNA, 1148 bp, Artificial Sequence
  chemically treated genomic DNA (Homo sapiens) CpG-island No: 37589
tgcgttgtagtagagttcggcgttttcgtcgttatttttgcgcgtttttcggttttttcgacgttgttagggaggatgtttcgtttttcgtttcgagtttttagcggttcggcgcgaagttttttaaagtgattcgggcgtcgagaattttcgtttttttttttcgggttttttcggagatttcgttcgtcgttttttttcgcgttttcggaaaagttgcgagcgacgttttaaatttcggttttttcgtttcgcgtcgcgcgcgttttgggcgttttcgcgttcggtcgtcgcgtaggggcgtagttttttttattttagtttcggcgttatgacgcggggagcgtagcgggggttatcggtggcggcggcggcgtagaggcggttaagtgcggggcgtgggcggtagcgcggggcgtacgtgcgtcgggtcgggggtcggggtcgggcggggggtcgtttatttgttggaggtagaggaaggcgggcgggtagggtacggagtgcgggagtatgttgtcggagttggatagtaggaggtagttcgagttcgttatggagtatagtatggggcggtaggggggcgttcggcggcggttttgcgttcgttgcgtttttcggagtgtgcgcgcgttttgtttttcgggcgttttttcggtttttttttttttttttttttgggttttttttttttttcgtggcgttttttaagagggaggtatcgaaaggagagcggcgcgtttttgttcggtgttttttttgttcgggcggggaggttggagagagcgcgcgcgagaatacggttagagagtttgtgcgcgagagatcgggcgagcgggcgagagtaggagttagttattttggagttttcggagttttgtttgtaaagagtggtgcgtgtgcgtgtgtgagtgcgcgcgtgtgcgcgcgtgtgtagcggtgggagggggagtttttggcgtattttaatattaaacggagtttcgcgcggagggaagagaattcggagcgacggtataatagttgattttatatttaatttttcgttcgtcggtatcggggtagttttttttcgcgtttttttacgttcgggtttttgcgcgttttttttttttttcgttgttagtatttgtttttggtttgggggg

SEQ ID NO: 37590 - DNA, 1148 bp, Artificial Sequence
  chemically treated genomic DNA (Homo sapiens) CpG-island No: 37590
ccccccaaaccaaaaacaaatactaacaacgaaaaaaaaaaaaaacgcgcaaaaacccgaacgtaaaaaaacgcgaaaaaaaactaccccgataccgacgaacgaaaaattaaatataaaatcaactattataccgtcgctccgaattctcttccctccgcgcgaaactccgtttaatattaaaatacgccaaaaactccccctcccaccgctacacacgcgcgcacacgcgcgcactcacacacgcacacgcaccactctttacaaacaaaactccgaaaactccaaaataactaactcctactctcgcccgctcgcccgatctctcgcgcacaaactctctaaccgtattctcgcgcgcgctctctccaacctccccgcccgaacaaaaaaaacaccgaacaaaaacgcgccgctctcctttcgatacctccctcttaaaaaacgccacgaaaaaaaaaaaaaacccaaaaaaaaaaaaaaaaaaaaaccgaaaaaacgcccgaaaaacaaaacgcgcgcacactccgaaaaacgcaacgaacgcaaaaccgccgccgaacgcccccctaccgccccatactatactccataacgaactcgaactacctcctactatccaactccgacaacatactcccgcactccgtaccctacccgcccgccttcctctacctccaacaaataaacgaccccccgcccgaccccgacccccgacccgacgcacgtacgccccgcgctaccgcccacgccccgcacttaaccgcctctacgccgccgccgccaccgataacccccgctacgctccccgcgtcataacgccgaaactaaaataaaaaaaactacgcccctacgcgacgaccgaacgcgaaaacgcccaaaacgcgcgcgacgcgaaacgaaaaaaccgaaatttaaaacgtcgctcgcaacttttccgaaaacgcgaaaaaaaacgacgaacgaaatctccgaaaaaacccgaaaaaaaaaaacgaaaattctcgacgcccgaatcactttaaaaaacttcgcgccgaaccgctaaaaactcgaaacgaaaaacgaaacatcctccctaacaacgtcgaaaaaaccgaaaaacgcgcaaaaataacgacgaaaacgccgaactctactacaacgca

SEQ ID NO: 37591 - DNA, 1148 bp, Artificial Sequence
  chemically treated genomic DNA (Homo sapiens) CpG-island No: 37591
ttttttaggttaggagtaagtgttggtaacgggggggaggaggggcgcgtaggggttcgagcgtgggagggcgcgagggagggttgtttcggtgtcggcgggcgaggggttaagtgtgggattagttgttgtgtcgtcgtttcggattttttttttttcgcgcggggtttcgtttgatgttggagtacgttagggatttttttttttatcgttatatacgcgcgtatacgcgcgtatttatatacgtatacgtattattttttgtagatagggtttcggaggttttaaagtgattgatttttgttttcgttcgttcgttcgatttttcgcgtatagattttttggtcgtattttcgcgcgcgttttttttagttttttcgttcgggtagggggaatatcgggtagaggcgcgtcgtttttttttcgatgttttttttttaaagagcgttacgagggggaggggaggtttagaggaggaggaggagagagatcgggagggcgttcgggaggtagggcgcgcgtatatttcgagggacgtagcgagcgtagagtcgtcgtcgggcgtttttttgtcgttttatgttgtgttttatggcgaattcgggttgttttttgttgtttaatttcggtagtatgttttcgtatttcgtgttttgttcgttcgtttttttttatttttaataggtaagcggtttttcgttcggtttcggttttcggttcggcgtacgtgcgtttcgcgttgtcgtttacgtttcgtatttggtcgtttttgcgtcgtcgtcgttatcggtggttttcgttgcgtttttcgcgttatggcgtcggggttggggtagggggaattgcgtttttgcgcggcggtcgagcgcgggggcgtttagggcgcgcgcggcgcgaggcgggggggtcggagtttggggcgtcgttcgtaattttttcgaaggcgcgggagggggcggcgggcggagttttcggggaagttcgaggggagggggcgggggttttcggcgttcgggttattttggggaatttcgcgtcgggtcgttggggattcggggcggggagcggggtattttttttggtagcgtcgggaaagtcggggggcgcgtagaggtggcggcgggggcgtcgagttttgttgtagcgta

SEQ ID NO: 37592 - DNA, 1148 bp, Artificial Sequence
  chemically treated genomic DNA (Homo sapiens) CpG-island No: 37592
tacgctacaacaaaactcgacgcccccgccgccacctctacgcgccccccgactttcccgacgctaccaaaaaaaataccccgctccccgccccgaatccccaacgacccgacgcgaaattccccaaaataacccgaacgccgaaaacccccgccccctcccctcgaacttccccgaaaactccgcccgccgccccctcccgcgccttcgaaaaaattacgaacgacgccccaaactccgacccccccgcctcgcgccgcgcgcgccctaaacgcccccgcgctcgaccgccgcgcaaaaacgcaattccccctaccccaaccccgacgccataacgcgaaaaacgcaacgaaaaccaccgataacgacgacgacgcaaaaacgaccaaatacgaaacgtaaacgacaacgcgaaacgcacgtacgccgaaccgaaaaccgaaaccgaacgaaaaaccgcttacctattaaaaataaaaaaaaacgaacgaacaaaacacgaaatacgaaaacatactaccgaaattaaacaacaaaaaacaacccgaattcgccataaaacacaacataaaacgacaaaaaaacgcccgacgacgactctacgctcgctacgtccctcgaaatatacgcgcgccctacctcccgaacgccctcccgatctctctcctcctcctcctctaaacctcccctccccctcgtaacgctctttaaaaaaaaaacatcgaaaaaaaaacgacgcgcctctacccgatattccccctacccgaacgaaaaaactaaaaaaaacgcgcgcgaaaatacgaccaaaaaatctatacgcgaaaaatcgaacgaacgaacgaaaacaaaaatcaatcactttaaaacctccgaaaccctatctacaaaaaataatacgtatacgtatataaatacgcgcgtatacgcgcgtatataacgataaaaaaaaaaatccctaacgtactccaacatcaaacgaaaccccgcgcgaaaaaaaaaaaatccgaaacgacgacacaacaactaatcccacacttaacccctcgcccgccgacaccgaaacaaccctccctcgcgccctcccacgctcgaacccctacgcgcccctcctcccccccgttaccaacacttactcctaacctaaaaaa

SEQ ID NO: 37593 - DNA, 574 bp, Artificial Sequence
  chemically treated genomic DNA (Homo sapiens) CpG-island No: 37593
cgcgttttaaaatttttttttcgttttatacgcgtttttcgatataagcgttttataagtttttagttttataagcgttttacgaatttttatgagggttgcgtttttcgagttttcgcggttttttacgttttcgtgtttttcgttttttagcgtcgcgtttttttttttcgtagcgtttgtttttatcgattattttttgtagttcgtaatcgtttttgttgatggattagggtagggcgttcgagttttcggatatgacggcggtagcggttcgcggtttttttttaaattcgttgatttcgttcgttttttcgtcgcgcgtttttttatttttaatagtcgtcgtcgtcgtcgtcgcgtttttattaatcgtttcggaatagttacgggtcggacggcgtcggggcgcggggttatcgcgcggtagagtagcgggggtttagagtttcggcggatttcgttttttgttttttcgagttcggtattgttcggtttagtttacgttttgttttcggttttcgtagtagtagcgatagaagttttgtttgggtttagtttttttgtttcgttt

SEQ ID NO: 37594 - DNA, 574 bp, Artificial Sequence
  chemically treated genomic DNA (Homo sapiens) CpG-island No: 37594
aaacgaaacaaaaaaactaaacccaaacaaaacttctatcgctactactacgaaaaccgaaaacaaaacgtaaactaaaccgaacaataccgaactcgaaaaaacaaaaaacgaaatccgccgaaactctaaacccccgctactctaccgcgcgataaccccgcgccccgacgccgtccgacccgtaactattccgaaacgattaataaaaacgcgacgacgacgacgacgactattaaaaataaaaaaacgcgcgacgaaaaaacgaacgaaatcaacgaatttaaaaaaaaaccgcgaaccgctaccgccgtcatatccgaaaactcgaacgccctaccctaatccatcaacaaaaacgattacgaactacaaaaaataatcgataaaaacaaacgctacgaaaaaaaaaaacgcgacgctaaaaaacgaaaaacacgaaaacgtaaaaaaccgcgaaaactcgaaaaacgcaaccctcataaaaattcgtaaaacgcttataaaactaaaaacttataaaacgcttatatcgaaaaacgcgtataaaacgaaaaaaaaattttaaaacgcg

SEQ ID NO: 37595 - DNA, 574 bp, Artificial Sequence
  chemically treated genomic DNA (Homo sapiens) CpG-island No: 37595
gggcgggatagaggggttgggtttaggtaaagtttttgtcgttgttgttgcggaggtcgaggataggacgtgggttgggtcgggtagtgtcggattcggaggagtaggaggcgaggttcgtcggagttttgagttttcgttgttttgtcgcgcggtgatttcgcgtttcggcgtcgttcgattcgtggttgtttcgagacgattggtgggggcgcggcggcggcggcggcggttgttgggggtggggagacgcgcggcgaggagacgagcgaggttagcgagtttgagggaggatcgcgagtcgttgtcgtcgttatgttcgaggattcgagcgttttgttttggtttattaatagggacgattacgagttgtaggaggtgatcggtgagagtaggcgttgcggaggggggaggcgcggcgttgggaggcgggggatacgggaacgtggggagtcgcgggagttcggggagcgtagtttttataggaattcgtggggcgtttgtggggttgggggtttgtaggacgtttgtgtcgaggagcgcgtgtgagacgggaagggggttttgaggcgcg

SEQ ID NO: 37596 - DNA, 574 bp, Artificial Sequence
  chemically treated genomic DNA (Homo sapiens) CpG-island No: 37596
cgcgcctcaaaacccccttcccgtctcacacgcgctcctcgacacaaacgtcctacaaacccccaaccccacaaacgccccacgaattcctataaaaactacgctccccgaactcccgcgactccccacgttcccgtatcccccgcctcccaacgccgcgcctcccccctccgcaacgcctactctcaccgatcacctcctacaactcgtaatcgtccctattaataaaccaaaacaaaacgctcgaatcctcgaacataacgacgacaacgactcgcgatcctccctcaaactcgctaacctcgctcgtctcctcgccgcgcgtctccccacccccaacaaccgccgccgccgccgccgcgcccccaccaatcgtctcgaaacaaccacgaatcgaacgacgccgaaacgcgaaatcaccgcgcgacaaaacaacgaaaactcaaaactccgacgaacctcgcctcctactcctccgaatccgacactacccgacccaacccacgtcctatcctcgacctccgcaacaacaacgacaaaaactttacctaaacccaacccctctatcccgccc

SEQ ID NO: 37597 - DNA, 968 bp, Artificial Sequence
  chemically treated genomic DNA (Homo sapiens) CpG-island No: 37597
  misc_feature (508)..(508): n is either a, c, g or t
  misc_feature (797)..(797): n is either a, c, g or t
tgcgattcgcgcgggttagttgggtcgtattttcgagaagtcgcggagacgatcgataggtaggcgcggttcgacgtgtttatcgttcgcgtcgatttcggggagtcgttttttcgcgttcgtagtatttgtttacggcgcggattttacggcggggattttatatcgcggtcgttcgttttaggggaggagtgagttcgtttcgggcgttagattcggggattcggggtaaggattcggggtttcgttgggggcggagcgtttgaggtagtatcggcggtcgggcgcgtttttattcggaaagcggcgacggtttttaagttgggttgcggagtgggaggcgcgtcgagttttaagtagataatgcgggagaagggcgatgcgtagggaggaggggttcgtagatttgaggtttcggcgtcgtcggattcgtttgtttagttcgttttcgaaattttcgtagttttcgtttttttttcggggttcgttttatcgagtaatcgtaggngattggtcgcgtttcgttttcgatttataaattataaaattttttttaatttcgttaattaagttgcgtttttatcgtgcggttttcggggttttttcgcgggtcgagttgggataattttttattttcgtcgcggagaaagataataggcggtcgttttttcggaggcggttaaagcggcggcgatcgaggcgagtaatgggtacggtagtttcggtagagtataggcgttttatcgcggttgttcgggtttcgcgttggttttgtatatagttttagttcgcgtatngtcgaaagacgttcgggagggtgggcggggtacgcgggaaggcggtaacgtttgcgagttttttcgtgagtatacgcggagtaagaattgcgagttgggattgtacggtagaattgtttatttcgttgtatgagattaatagtaaggtttttggacggggtatttaggttg

SEQ ID NO: 37598 - DNA, 968 bp, Artificial Sequence
  chemically treated genomic DNA (Homo sapiens) CpG-island No: 37598
  misc_feature (172)..(172): n is either a, c, g or t
  misc_feature (461)..(461): n is either a, c, g or t
caacctaaataccccgtccaaaaaccttactattaatctcatacaacgaaataaacaattctaccgtacaatcccaactcgcaattcttactccgcgtatactcacgaaaaaactcgcaaacgttaccgccttcccgcgtaccccgcccaccctcccgaacgtctttcgacnatacgcgaactaaaactatatacaaaaccaacgcgaaacccgaacaaccgcgataaaacgcctatactctaccgaaactaccgtacccattactcgcctcgatcgccgccgctttaaccgcctccgaaaaaacgaccgcctattatctttctccgcgacgaaaataaaaaattatcccaactcgacccgcgaaaaaaccccgaaaaccgcacgataaaaacgcaacttaattaacgaaattaaaaaaaattttataatttataaatcgaaaacgaaacgcgaccaatcncctacgattactcgataaaacgaaccccgaaaaaaaaacgaaaactacgaaaatttcgaaaacgaactaaacaaacgaatccgacgacgccgaaacctcaaatctacgaacccctcctccctacgcatcgcccttctcccgcattatctacttaaaactcgacgcgcctcccactccgcaacccaacttaaaaaccgtcgccgctttccgaataaaaacgcgcccgaccgccgatactacctcaaacgctccgcccccaacgaaaccccgaatccttaccccgaatccccgaatctaacgcccgaaacgaactcactcctcccctaaaacgaacgaccgcgatataaaatccccgccgtaaaatccgcgccgtaaacaaatactacgaacgcgaaaaaacgactccccgaaatcgacgcgaacgataaacacgtcgaaccgcgcctacctatcgatcgtctccgcgacttctcgaaaatacgacccaactaacccgcgcgaatcgca

SEQ ID NO: 37599 - DNA, 968 bp, Artificial Sequence
  chemically treated genomic DNA (Homo sapiens) CpG-island No: 37599
  misc_feature (172)..(172): n is either a, c, g or t
  misc_feature (461)..(461): n is either a, c, g or t
taatttgagtgtttcgtttaggagttttattattggttttatgtagcgagatgggtagttttgtcgtgtaattttagttcgtagtttttgtttcgcgtgtatttacgggaggattcgtaggcgttatcgttttttcgcgtgtttcgtttattttttcgagcgtttttcggtnatgcgcggattggagttgtgtgtagggttagcgcggagttcgagtagtcgcggtgaagcgtttgtgttttgtcgagattgtcgtgtttattgttcgtttcggtcgtcgtcgttttagtcgttttcgggggagcggtcgtttattgttttttttcgcggcgaaggtgaagagttgttttagttcggttcgcgggggagtttcgggagtcgtacggtgagagcgtaatttagttggcggagttgggggaagttttgtgatttgtgggtcgggggcggagcgcggttagttntttgcggttgttcggtggggcgggtttcggaggaggggcgggggttgcgggggtttcgggggcgggttggatagacgggttcggcggcgtcgggattttaggtttgcggattttttttttttgcgtatcgtttttttttcgtattgtttgtttggggttcggcgcgttttttatttcgtagtttaatttagaggtcgtcgtcgtttttcgggtgggggcgcgttcggtcgtcgatgttattttaggcgtttcgtttttagcgaggtttcgaatttttgtttcgggttttcgggtttggcgttcggggcgggtttattttttttttggggcgggcggtcgcggtgtggagttttcgtcgtggagttcgcgtcgtgaataagtgttgcgggcgcgagggagcggtttttcggggtcgacgcggacggtaaatacgtcgggtcgcgtttgtttgtcggtcgttttcgcggtttttcgggggtgcggtttagttgattcgcgcgggtcgta

SEQ ID NO: 37600 - DNA, 968 bp, Artificial Sequence
  chemically treated genomic DNA (Homo sapiens) CpG-island No: 37600
  misc_feature (508)..(508): n is either a, c, g or t
  misc_feature (797)..(797): n is either a, c, g or t
tacgacccgcgcgaatcaactaaaccgcacccccgaaaaaccgcgaaaacgaccgacaaacaaacgcgacccgacgtatttaccgtccgcgtcgaccccgaaaaaccgctccctcgcgcccgcaacacttattcacgacgcgaactccacgacgaaaactccacaccgcgaccgcccgccccaaaaaaaaaataaacccgccccgaacgccaaacccgaaaacccgaaacaaaaattcgaaacctcgctaaaaacgaaacgcctaaaataacatcgacgaccgaacgcgcccccacccgaaaaacgacgacgacctctaaattaaactacgaaataaaaaacgcgccgaaccccaaacaaacaatacgaaaaaaaaacgatacgcaaaaaaaaaaaatccgcaaacctaaaatcccgacgccgccgaacccgtctatccaacccgcccccgaaacccccgcaacccccgcccctcctccgaaacccgccccaccgaacaaccgcaaanaactaaccgcgctccgcccccgacccacaaatcacaaaacttcccccaactccgccaactaaattacgctctcaccgtacgactcccgaaactcccccgcgaaccgaactaaaacaactcttcaccttcgccgcgaaaaaaaacaataaacgaccgctcccccgaaaacgactaaaacgacgacgaccgaaacgaacaataaacacgacaatctcgacaaaacacaaacgcttcaccgcgactactcgaactccgcgctaaccctacacacaactccaatccgcgcatnaccgaaaaacgctcgaaaaaataaacgaaacacgcgaaaaaacgataacgcctacgaatcctcccgtaaatacacgcgaaacaaaaactacgaactaaaattacacgacaaaactacccatctcgctacataaaaccaataataaaactcctaaacgaaacactcaaatta

SEQ ID NO: 37601 - DNA, 726 bp, Artificial Sequence
  chemically treated genomic DNA (Homo sapiens) CpG-island No: 37601
tcgtcgttcgggttacgggtcgggttcgtttcgtttagaggcgttgtagacggtttagtttcgcgttttcggttttattcggttcggttcgacgtatcgattagtttcggttacgagttggtttacgtaggatagttttatttttttattttgtttcgtcgttgttggggttgttgttacggtgttcggtggggtagggcgaggtcgatgttcgatggagatttagtagaggaaaggttggagagcgggcgaagaggaagacgatagttgggtttcggcggttgttgatgggggagtttttgggaggggttgcggttttagtcggggaaagggcgagtcgcggcggcgaatgtttggggggtggggcgaggggggttgagagggattaatatgttcgtttttttgtttaaataaacggagatcgtcggggtagattgcgtatgcggggcgcggacgttcggaaggggaattagtcgggatttcgcgcgcgcgcgcgtattttgtcgttttcgtagggtggggtggggcggggcggtgaggtgggcggggttttgcgggtaggcggtggagaaggcggatcgttgggaggagtcgagtgcgggtaagtagttgtcggtaaggttttcgttttggtcggttttgaggagttatgtagggttttggagcggttttggaggttcggacggaggcggagttttggttgtttttgatcgttgtttcggtaga

SEQ ID NO: 37602 - DNA, 726 bp, Artificial Sequence
  chemically treated genomic DNA (Homo sapiens) CpG-island No: 37602
tctaccgaaacaacgatcaaaaacaaccaaaactccgcctccgtccgaacctccaaaaccgctccaaaaccctacataactcctcaaaaccgaccaaaacgaaaaccttaccgacaactacttacccgcactcgactcctcccaacgatccgccttctccaccgcctacccgcaaaaccccgcccacctcaccgccccgccccaccccaccctacgaaaacgacaaaatacgcgcgcgcgcgcgaaatcccgactaattccccttccgaacgtccgcgccccgcatacgcaatctaccccgacgatctccgtttatttaaacaaaaaaacgaacatattaatccctctcaacccccctcgccccaccccccaaacattcgccgccgcgactcgccctttccccgactaaaaccgcaacccctcccaaaaactcccccatcaacaaccgccgaaacccaactatcgtcttcctcttcgcccgctctccaacctttcctctactaaatctccatcgaacatcgacctcgccctaccccaccgaacaccgtaacaacaaccccaacaacgacgaaacaaaataaaaaaataaaactatcctacgtaaaccaactcgtaaccgaaactaatcgatacgtcgaaccgaaccgaataaaaccgaaaacgcgaaactaaaccgtctacaacgcctctaaacgaaacgaacccgacccgtaacccgaacgacga

SEQ ID NO: 37603 - DNA, 726 bp, Artificial Sequence
  chemically treated genomic DNA (Homo sapiens) CpG-island No: 37603
tttgtcgggatagcgattagaagtagttagagtttcgttttcgttcggatttttaaggtcgttttagagttttgtatggttttttagagtcggttaaggcgagaattttgtcggtagttgtttattcgtattcggttttttttagcggttcgttttttttatcgtttgttcgtaaggtttcgtttattttatcgtttcgttttattttattttgcggaggcgatagagtgcgcgcgcgcgcgcggggtttcggttggtttttttttcgagcgttcgcgtttcgtatgcgtagtttgtttcggcggttttcgtttgtttgaataggaaggcggatatattagttttttttagtttttttcgttttattttttaggtattcgtcgtcgcgattcgtttttttttcggttgggatcgtagttttttttagaagtttttttattagtagtcgtcgggatttaattatcgttttttttttcgttcgttttttagttttttttttgttaagtttttatcgggtatcgatttcgttttgttttatcggatatcgtagtagtagttttagtagcgacgggataaaatgggagagtgaggttgttttgcgtggattagttcgtggtcgagattgatcggtgcgtcgggtcgggtcgagtagagtcggggacgcggggttagatcgtttatagcgtttttgagcggagcgggttcggttcgtggttcgagcggcgg

SEQ ID NO: 37604 - DNA, 726 bp, Artificial Sequence
  chemically treated genomic DNA (Homo sapiens) CpG-island No: 37604
ccgccgctcgaaccacgaaccgaacccgctccgctcaaaaacgctataaacgatctaaccccgcgtccccgactctactcgacccgacccgacgcaccgatcaatctcgaccacgaactaatccacgcaaaacaacctcactctcccattttatcccgtcgctactaaaactactactacgatatccgataaaacaaaacgaaatcgatacccgataaaaacttaacaaaaaaaaaactaaaaaacgaacgaaaaaaaaaacgataattaaatcccgacgactactaataaaaaaacttctaaaaaaaactacgatcccaaccgaaaaaaaaacgaatcgcgacgacgaatacctaaaaaataaaacgaaaaaaactaaaaaaaactaatatatccgccttcctattcaaacaaacgaaaaccgccgaaacaaactacgcatacgaaacgcgaacgctcgaaaaaaaaaccaaccgaaaccccgcgcgcgcgcgcgcactctatcgcctccgcaaaataaaataaaacgaaacgataaaataaacgaaaccttacgaacaaacgataaaaaaaacgaaccgctaaaaaaaaccgaatacgaataaacaactaccgacaaaattctcgccttaaccgactctaaaaaaccatacaaaactctaaaacgaccttaaaaatccgaacgaaaacgaaactctaactacttctaatcgctatcccgacaaa

SEQ ID NO: 37605 - DNA, 654 bp, Artificial Sequence
  chemically treated genomic DNA (Homo sapiens) CpG-island No: 37605
gttaacgtcgattttcgggtttttttgttggttaaagcgttgaatggtgagtaggcggtcggtacgcgcgtagttttacgttatggttacgcgtattcgttagtagtatttgtaagatttgttattaacgaggtgattattacgtcgttggattcggttttacgtttcggtttgtttttttgggtgggaacgtcgggtcgttcggggtttaggcgtcgattgtaggtagcgggtttattggtgtggggagatgcgttcgcgcgggcgcgggtcgtcgtcggggtttaggcgagcggtttcgaaggtatcgaggtgttttgtttgttgggtatttcggtcgaggttttggtgttggtggcgtcgcgcgacggtcgcgtagtgtttaattgcgtttgtcgcgacgtgttggtttggatttttttcgagtagtagttggatttgtattacggtcgcggggaggcgattacgttgcgtttcgacgggtttttcgttaagcgtgggcgaggtggtggcgcgtttgtaggtgagttggagtggtaaattggggtttttgcgcgcggcgggcggagtttgttttggatttttttttttcgtcgtttttgttttttatttttgcggaagggaaagtcgaggagggtagaagttatttcgggg

SEQ ID NO: 37606 - DNA, 654 bp, Artificial Sequence
  chemically treated genomic DNA (Homo sapiens) CpG-island No: 37606
ccccgaaataacttctaccctcctcgactttcccttccgcaaaaataaaaaacaaaaacgacgaaaaaaaaaaatccaaaacaaactccgcccgccgcgcgcaaaaaccccaatttaccactccaactcacctacaaacgcgccaccacctcgcccacgcttaacgaaaaacccgtcgaaacgcaacgtaatcgcctccccgcgaccgtaatacaaatccaactactactcgaaaaaaatccaaaccaacacgtcgcgacaaacgcaattaaacactacgcgaccgtcgcgcgacgccaccaacaccaaaacctcgaccgaaatacccaacaaacaaaacacctcgataccttcgaaaccgctcgcctaaaccccgacgacgacccgcgcccgcgcgaacgcatctccccacaccaataaacccgctacctacaatcgacgcctaaaccccgaacgacccgacgttcccacccaaaaaaacaaaccgaaacgtaaaaccgaatccaacgacgtaataatcacctcgttaataacaaatcttacaaatactactaacgaatacgcgtaaccataacgtaaaactacgcgcgtaccgaccgcctactcaccattcaacgctttaaccaacaaaaaaacccgaaaatcgacgttaac

SEQ ID NO: 37607 - DNA, 654 bp, Artificial Sequence
  chemically treated genomic DNA (Homo sapiens) CpG-island No: 37607
tttcggggtggtttttgtttttttcgattttttttttcgtaggagtaggggataaaggcggcgggagggaggggtttaaagtaggtttcgttcgtcgcgcgtaggggttttagtttattattttagtttatttgtaggcgcgttattatttcgtttacgtttggcgggggattcgtcgaagcgtagcgtgatcgttttttcgcggtcgtggtataggtttagttgttgttcggagaaggtttaggttagtacgtcgcgataggcgtaattgaatattacgcggtcgtcgcgcggcgttattagtattagagtttcggtcgagatgtttagtaggtagggtatttcgatgttttcggggtcgttcgtttgagtttcggcggcgattcgcgttcgcgcggacgtatttttttatattagtgagttcgttgtttgtagtcggcgtttgggtttcgagcggttcggcgtttttatttagggaggtaggtcgaagcgtgaagtcgagtttagcgacgtagtggttatttcgttggtggtaggttttgtaggtattgttggcgggtgcgcgtggttatggcgtggaattgcgcgcgtgtcggtcgtttgtttattatttagcgttttggttagtaggaaggttcggaagtcggcgttggt

SEQ ID NO: 37608 - DNA, 654 bp, Artificial Sequence
  chemically treated genomic DNA (Homo sapiens) CpG-island No: 37608
accaacgccgacttccgaaccttcctactaaccaaaacgctaaataataaacaaacgaccgacacgcgcgcaattccacgccataaccacgcgcacccgccaacaatacctacaaaacctaccaccaacgaaataaccactacgtcgctaaactcgacttcacgcttcgacctacctccctaaataaaaacgccgaaccgctcgaaacccaaacgccgactacaaacaacgaactcactaatataaaaaaatacgtccgcgcgaacgcgaatcgccgccgaaactcaaacgaacgaccccgaaaacatcgaaataccctacctactaaacatctcgaccgaaactctaatactaataacgccgcgcgacgaccgcgtaatattcaattacgcctatcgcgacgtactaacctaaaccttctccgaacaacaactaaacctataccacgaccgcgaaaaaacgatcacgctacgcttcgacgaatcccccgccaaacgtaaacgaaataataacgcgcctacaaataaactaaaataataaactaaaacccctacgcgcgacgaacgaaacctactttaaacccctccctcccgccgcctttatcccctactcctacgaaaaaaaaaatcgaaaaaaacaaaaaccaccccgaaa

SEQ ID NO: 37609 - DNA, 559 bp, Artificial Sequence
  chemically treated genomic DNA (Homo sapiens) CpG-island No: 37609
ttatttttcgggcggtggtatacgcggttttcggggattgtggaaagtttcgtgtggtttgggacgtagtttagggggcgggtattggcggttttatttttcggtagtttcgtttattcgtttcgtttcgttcgtagttggtgagtcgtggttgcgagattcgcgagttggcgttgtttcgcgacggttaaggtcgtttgggtttcgaggtggacgtcgagggattcgttacgtacgtggagcgttttatattcgtcgagacggcggttgcggcggggcgcgttttttggcgtgtgcggttagacgttgtttagttttcgttcgagtcgttgtttagttttttgtcggcgtttaaggtttgcgttatcgttttgtttttcgacgagagcggtcggtttcgtaggttagggtgtcggggacgcggggaggtgggagggtcggtagttggtatcgcgtagtttgcgttttcgggtcgttattagtagttttaggaatttagtgtggatatttttttttttggaaagaatttttcgttttttagttcgtttgagtttgtttt

SEQ ID NO: 37610 - DNA, 559 bp, Artificial Sequence
  chemically treated genomic DNA (Homo sapiens) CpG-island No: 37610
aaaacaaactcaaacgaactaaaaaacgaaaaattctttccaaaaaaaaaaatatccacactaaattcctaaaactactaataacgacccgaaaacgcaaactacgcgataccaactaccgaccctcccacctccccgcgtccccgacaccctaacctacgaaaccgaccgctctcgtcgaaaaacaaaacgataacgcaaaccttaaacgccgacaaaaaactaaacaacgactcgaacgaaaactaaacaacgtctaaccgcacacgccaaaaaacgcgccccgccgcaaccgccgtctcgacgaatataaaacgctccacgtacgtaacgaatccctcgacgtccacctcgaaacccaaacgaccttaaccgtcgcgaaacaacgccaactcgcgaatctcgcaaccacgactcaccaactacgaacgaaacgaaacgaataaacgaaactaccgaaaaataaaaccgccaatacccgccccctaaactacgtcccaaaccacacgaaactttccacaatccccgaaaaccgcgtataccaccgcccgaaaaataa

SEQ ID NO: 37611 - DNA, 559 bp, Artificial Sequence
  chemically treated genomic DNA (Homo sapiens) CpG-island No: 37611
gagataggtttagacgggttaagagacgggagattttttttagaaggaaaggtatttatattgggtttttgaaattgttgatggcgattcgggagcgtagattgcgcggtgttaattgtcggtttttttattttttcgcgttttcggtattttgatttgcggggtcggtcgttttcgtcggggggtaggacggtgacgtagattttgggcgtcgatagggagttgggtagcggttcgggcggaggttgggtagcgtttggtcgtatacgttaggaggcgcgtttcgtcgtagtcgtcgtttcggcgaatgtgaagcgttttacgtgcgtgacgaatttttcggcgtttatttcgaagtttaggcggttttgatcgtcgcggggtagcgttagttcgcgggtttcgtagttacggtttattagttgcggacggggcgggacgagtgggcggggttgtcgggaggtggggtcgttagtgttcgttttttggattgcgttttaggttatacggaattttttatagttttcgagggtcgcgtgtgttatcgttcgagggatga

SEQ ID NO: 37612 - DNA, 559 bp, Artificial Sequence
  chemically treated genomic DNA (Homo sapiens) CpG-island No: 37612
tcatccctcgaacgataacacacgcgaccctcgaaaactataaaaaattccgtataacctaaaacgcaatccaaaaaacgaacactaacgaccccacctcccgacaaccccgcccactcgtcccgccccgtccgcaactaataaaccgtaactacgaaacccgcgaactaacgctaccccgcgacgatcaaaaccgcctaaacttcgaaataaacgccgaaaaattcgtcacgcacgtaaaacgcttcacattcgccgaaacgacgactacgacgaaacgcgcctcctaacgtatacgaccaaacgctacccaacctccgcccgaaccgctacccaactccctatcgacgcccaaaatctacgtcaccgtcctaccccccgacgaaaacgaccgaccccgcaaatcaaaataccgaaaacgcgaaaaaataaaaaaaccgacaattaacaccgcgcaatctacgctcccgaatcgccatcaacaatttcaaaaacccaatataaatacctttccttctaaaaaaaatctcccgtctcttaacccgtctaaacctatctc

SEQ ID NO: 37613 - DNA, 611 bp, Artificial Sequence
  chemically treated genomic DNA (Homo sapiens) CpG-island No: 37613
  misc_feature (1)..(1): n is either a, c, g or t
  misc_feature (60)..(60): n is either a, c, g or t
  misc_feature (75)..(75): n is either a, c, g or t
  misc_feature (81)..(81): n is either a, c, g or t
  misc_feature (92)..(92): n is either a, c, g or t
  misc_feature (105)..(106): n is either a, c, g or t
  misc_feature (109)..(109): n is either a, c, g or t
  misc_feature (117)..(117): n is either a, c, g or t
ntagcgtcggtttttttagcgttaggagtttttttatttcgttcgtttttttttcgattnttttttttaggcgtnttcggntattcgttcgngttttgatttggnnttnatgcgagntcgttcgtttttcgcgtgggagtttcgtcgaggttcgttttcgttttaagtttcgttttggtcgttttttcggagtcggagtttcgtggaaaacgttattttttcgacggaattggtttgtcgtttcgtcgcgtcgttcgtcggagtttgtatttagggttttttttgtttttaggagattcgttgaattttgggacgcgtttcgttgacgataatttttttttttttgttattgttttttcgcgacggtgcgaagtttaaacgaagacgttatcggtttcggcggggattttttttagacgttggattcggttttcggttgttgcgggttttttgtgcgtttgcgtagtcgagaagggggtttacgtcggttagcgttttttgttgttgcgtttcgtcggggtaaagcggaagtacgtttagttgtatttttgtgggttgcggttgggtttttgttttggttttttgaggttgtggattgaagattttatcgt

SEQ ID NO: 37614 - DNA, 611 bp, Artificial Sequence
  chemically treated genomic DNA (Homo sapiens) CpG-island No: 37614
  misc_feature (495)..(495): n is either a, c, g or t
  misc_feature (503)..(503): n is either a, c, g or t
  misc_feature (506)..(507): n is either a, c, g or t
  misc_feature (520)..(520): n is either a, c, g or t
  misc_feature (531)..(531): n is either a, c, g or t
  misc_feature (537)..(537): n is either a, c, g or t
  misc_feature (552)..(552): n is either a, c, g or t
  misc_feature (611)..(611): n is either a, c, g or t
acgataaaatcttcaatccacaacctcaaaaaaccaaaacaaaaacccaaccgcaacccacaaaaatacaactaaacgtacttccgctttaccccgacgaaacgcaacaacaaaaaacgctaaccgacgtaaacccccttctcgactacgcaaacgcacaaaaaacccgcaacaaccgaaaaccgaatccaacgtctaaaaaaaatccccgccgaaaccgataacgtcttcgtttaaacttcgcaccgtcgcgaaaaaacaataacaaaaaaaaaaaaattatcgtcaacgaaacgcgtcccaaaattcaacgaatctcctaaaaacaaaaaaaaccctaaatacaaactccgacgaacgacgcgacgaaacgacaaaccaattccgtcgaaaaaataacgttttccacgaaactccgactccgaaaaaacgaccaaaacgaaacttaaaacgaaaacgaacctcgacgaaactcccacgcgaaaaacgaacganctcgcatnaannccaaatcaaaacncgaacgaatanccgaanacgcctaaaaaaaanaatcgaaaaaaaaacgaacgaaataaaaaaactcctaacgctaaaaaaaccgacgctan

SEQ ID NO: 37615 - DNA, 611 bp, Artificial Sequence
  chemically treated genomic DNA (Homo sapiens) CpG-island No: 37615
  misc_feature (495)..(495): n is either a, c, g or t
  misc_feature (503)..(503): n is either a, c, g or t
  misc_feature (506)..(507): n is either a, c, g or t
  misc_feature (520)..(520): n is either a, c, g or t
  misc_feature (531)..(531): n is either a, c, g or t
  misc_feature (537)..(537): n is either a, c, g or t
  misc_feature (552)..(552): n is either a, c, g or t
  misc_feature (611)..(611): n is either a, c, g or t
acggtgaaatttttaatttatagttttaggaagttaaaataaaggtttagtcgtagtttataagggtatagttggacgtattttcgttttgtttcgacgaagcgtagtagtaaaaagcgttggtcggcgtgggtttttttttcgattgcgtaggcgtataaggagttcgtagtaatcggaggtcgggtttagcgtttggggaaaattttcgtcgaggtcgatggcgttttcgtttgggtttcgtatcgtcgcgggaggataatagtaggggaaaaggagttatcgttagcgggacgcgttttaaaatttagcgagttttttaggaatagaaaaggttttgggtgtaggtttcgacgggcggcgcggcgagacggtaggttaatttcgtcgaggaagtggcgttttttacggggtttcggtttcgggggggcggttagggcggggtttggagcgagggcgggtttcggcggaatttttacgcgaggggcggacggnttcgtatnggnnttaggttaggatncgggcgaatgntcggangcgtttgggaggggnggtcggggaggaagcgggcggggtgagaaggtttttaacgttgaggaagtcgacgttan

SEQ ID NO: 37616 - DNA, 611 bp, Artificial Sequence
  chemically treated genomic DNA (Homo sapiens) CpG-island No: 37616
  misc_feature (1)..(1): n is either a, c, g or t
  misc_feature (60)..(60): n is either a, c, g or t
  misc_feature (75)..(75): n is either a, c, g or t
  misc_feature (81)..(81): n is either a, c, g or t
  misc_feature (92)..(92): n is either a, c, g or t
  misc_feature (105)..(106): n is either a, c, g or t
  misc_feature (109)..(109): n is either a, c, g or t
  misc_feature (117)..(117): n is either a, c, g or t
ntaacgtcgacttcctcaacgttaaaaaccttctcaccccgcccgcttcctccccgaccncccctcccaaacgcntccgancattcgcccgnatcctaacctaannccnatacgaanccgtccgcccctcgcgtaaaaattccgccgaaacccgccctcgctccaaaccccgccctaaccgcccccccgaaaccgaaaccccgtaaaaaacgccacttcctcgacgaaattaacctaccgtctcgccgcgccgcccgtcgaaacctacacccaaaaccttttctattcctaaaaaactcgctaaattttaaaacgcgtcccgctaacgataactccttttcccctactattatcctcccgcgacgatacgaaacccaaacgaaaacgccatcgacctcgacgaaaattttccccaaacgctaaacccgacctccgattactacgaactccttatacgcctacgcaatcgaaaaaaaaacccacgccgaccaacgctttttactactacgcttcgtcgaaacaaaacgaaaatacgtccaactatacccttataaactacgactaaacctttattttaacttcctaaaactataaattaaaaatttcaccgt

SEQ ID NO: 37617 - DNA, 527 bp, Artificial Sequence
  chemically treated genomic DNA (Homo sapiens) CpG-island No: 37617
  misc_feature (193)..(193): n is either a, c, g or t
tttttgcgtagtttcgtcgacgggaatggggcggaaacgcggcgcgtgcggtttcgtatagtcgtgcggtttcggcgattgtatttcgcggggttagagggcgattttatcgtttatggtcggggtttcggggcgtggcggggtcgtagttgggttcggcgttgtattatagacgagttattcgttagacgantatgcgttcgcgttcgtcgtcgtttattgttcggaattcgtcgcgtttttgtttcgtcgtcgttcgcgaggcggcgagtttatagtgtacgtcgcgcggaggacgaagaggttgtacgtatagtcgttgtcgggggtcggggttaagtgcgcgtttttcgaggacgaagaggttggcgtgtcggtggttcggttagttttcgggtttcggtttcgtttggaagggtgggttcgtcgattatttattttgtttttaggggattttagggttttttttcgtcgatcggcggagtttggtgatgttattttgggtcgggtttggagtaaattagggt

SEQ ID NO: 37618 - DNA, 527 bp, Artificial Sequence
  chemically treated genomic DNA (Homo sapiens) CpG-island No: 37618
  misc_feature (335)..(335): n is either a, c, g or t
accctaatttactccaaacccgacccaaaataacatcaccaaactccgccgatcgacgaaaaaaaaccctaaaatcccctaaaaacaaaataaataatcgacgaacccacccttccaaacgaaaccgaaacccgaaaactaaccgaaccaccgacacgccaacctcttcgtcctcgaaaaacgcgcacttaaccccgacccccgacaacgactatacgtacaacctcttcgtcctccgcgcgacgtacactataaactcgccgcctcgcgaacgacgacgaaacaaaaacgcgacgaattccgaacaataaacgacgacgaacgcgaacgcatantcgtctaacgaataactcgtctataatacaacgccgaacccaactacgaccccgccacgccccgaaaccccgaccataaacgataaaatcgccctctaaccccgcgaaatacaatcgccgaaaccgcacgactatacgaaaccgcacgcgccgcgtttccgccccattcccgtcgacgaaactacgcaaaaa

SEQ ID NO: 37619 - DNA, 527 bp, Artificial Sequence
  chemically treated genomic DNA (Homo sapiens) CpG-island No: 37619
  misc_feature (335)..(335): n is either a, c, g or t
gttttggtttgttttagattcggtttagagtgatattattaaatttcgtcgatcggcgggagggggttttgaaattttttaaaaataaagtgagtaatcggcggatttatttttttaggcggggtcgggattcgggagttagtcgagttatcggtacgttagttttttcgttttcgggaggcgcgtatttggtttcgattttcggtagcggttgtgcgtgtagttttttcgtttttcgcgcggcgtgtattatagattcgtcgtttcgcgggcggcggcggggtaggagcgcggcggatttcgggtagtgagcgacggcgggcgcgggcgtatgntcgtttggcgaatggttcgtttgtagtgtaacgtcgggtttagttgcgatttcgttacgtttcgagatttcggttatggacggtgaggtcgttttttgatttcgcggggtgtaatcgtcggggtcgtacggttgtgcggagtcgtacgcgtcgcgttttcgttttattttcgtcgacggagttgcgtaggga

SEQ ID NO: 37620 - DNA, 527 bp, Artificial Sequence
  chemically treated genomic DNA (Homo sapiens) CpG-island No: 37620
  misc_feature (193)..(193): n is either a, c, g or t
tccctacgcaactccgtcgacgaaaataaaacgaaaacgcgacgcgtacgactccgcacaaccgtacgaccccgacgattacaccccgcgaaatcaaaaaacgacctcaccgtccataaccgaaatctcgaaacgtaacgaaatcgcaactaaacccgacgttacactacaaacgaaccattcgccaaacgancatacgcccgcgcccgccgtcgctcactacccgaaatccgccgcgctcctaccccgccgccgcccgcgaaacgacgaatctataatacacgccgcgcgaaaaacgaaaaaactacacgcacaaccgctaccgaaaatcgaaaccaaatacgcgcctcccgaaaacgaaaaaactaacgtaccgataactcgactaactcccgaatcccgaccccgcctaaaaaaataaatccgccgattactcactttatttttaaaaaatttcaaaaccccctcccgccgatcgacgaaatttaataatatcactctaaaccgaatctaaaacaaaccaaaac

SEQ ID NO: 37621 - DNA, 689 bp, Artificial Sequence
  chemically treated genomic DNA (Homo sapiens) CpG-island No: 37621
tttttttttggtcgttagtttcggaatttcgtaaggggtttggtttttttatcgatattttttttttttttgttattattacgtattttacgaggttaggcggatcgttatttttttttttcgtagatagcggtttcgaaacgatatttcgagttttggagcgggaggcgtaaagggttttaggtaggatttacgttgggtcgagttcggagttgttttttcgttattttcggacggattacgatttttaggagtttaggcgatgagaagcgcgtaggtcgggcgcgggggttgtcggagtcgtagttcggtcgtaggtttattttcggggttttggcggatggcgggcgtgaagaagcgtttacgggcgggttcgtttatcgtaatttcgtagggtagtagatgtagtgtggcgggtacggcgtcgcgtaatgtggcggagcgtaagtggacgcggtgtttttcgatggtcgtttcgtcgtcgttttttatttttttttttacgcgacgttagggttcgtagttgatattgaagttggcgcggaaagagtggatttttttaggaagttttcgcggggttttacgggaagtcgtcgcgagttttacgggaagtgtagtttttttattttttaacgttttttttgggtttaagttttagggttttttagttgtgttttgttttttttttt

SEQ ID NO: 37622 - DNA, 689 bp, Artificial Sequence
  chemically treated genomic DNA (Homo sapiens) CpG-island No: 37622
aaaaaaaaaaacaaaacacaactaaaaaaccctaaaacttaaacccaaaaaaaacgttaaaaaataaaaaaactacacttcccgtaaaactcgcgacgacttcccgtaaaaccccgcgaaaacttcctaaaaaaatccactctttccgcgccaacttcaatatcaactacgaaccctaacgtcgcgtaaaaaaaaaaataaaaaacgacgacgaaacgaccatcgaaaaacaccgcgtccacttacgctccgccacattacgcgacgccgtacccgccacactacatctactaccctacgaaattacgataaacgaacccgcccgtaaacgcttcttcacgcccgccatccgccaaaaccccgaaaataaacctacgaccgaactacgactccgacaacccccgcgcccgacctacgcgcttctcatcgcctaaactcctaaaaatcgtaatccgtccgaaaataacgaaaaaacaactccgaactcgacccaacgtaaatcctacctaaaaccctttacgcctcccgctccaaaactcgaaatatcgtttcgaaaccgctatctacgaaaaaaaaaaataacgatccgcctaacctcgtaaaatacgtaataataacaaaaaaaaaaaaaatatcgataaaaaaaccaaaccccttacgaaattccgaaactaacgaccaaaaaaaaa

SEQ ID NO: 37623 - DNA, 689 bp, Artificial Sequence
  chemically treated genomic DNA (Homo sapiens) CpG-island No: 37623
aaggaaaaaaataaaatataattggaaaattttaggatttgaatttagggaaagcgttagggggtaaggggattatatttttcgtgaagttcgcggcggtttttcgtgaggtttcgcggaggttttttgagagggtttatttttttcgcgttagttttagtgttagttgcgagttttggcgtcgcgtaggagggaggatggagagcggcgacgaagcggttatcgagaggtatcgcgtttatttgcgtttcgttatattgcgcgacgtcgtattcgttatattgtatttgttgttttgcgaggttgcggtggacgggttcgttcgtgggcgtttttttacgttcgttattcgttagggtttcgagggtgagtttgcggtcggattacggtttcggtagttttcgcgttcggtttgcgcgttttttatcgtttgggtttttggggatcgtggttcgttcggaggtggcgggagggtagtttcgggttcgatttagcgtgggttttgtttgaggttttttgcgtttttcgttttaggattcgaagtgtcgtttcggggtcgttgtttacggggagaggaggtggcggttcgtttggtttcgtgggatacgtgatggtgatagaagagaagaaggtgtcgatggggaagttagattttttgcgggatttcgggattgacgattaagaggagg

SEQ ID NO: 37624 - DNA, 689 bp, Artificial Sequence
  chemically treated genomic DNA (Homo sapiens) CpG-island No: 37624
cctcctcttaatcgtcaatcccgaaatcccgcaaaaaatctaacttccccatcgacaccttcttctcttctatcaccatcacgtatcccacgaaaccaaacgaaccgccacctcctctccccgtaaacaacgaccccgaaacgacacttcgaatcctaaaacgaaaaacgcaaaaaacctcaaacaaaacccacgctaaatcgaacccgaaactaccctcccgccacctccgaacgaaccacgatccccaaaaacccaaacgataaaaaacgcgcaaaccgaacgcgaaaactaccgaaaccgtaatccgaccgcaaactcaccctcgaaaccctaacgaataacgaacgtaaaaaaacgcccacgaacgaacccgtccaccgcaacctcgcaaaacaacaaatacaatataacgaatacgacgtcgcgcaatataacgaaacgcaaataaacgcgatacctctcgataaccgcttcgtcgccgctctccatcctccctcctacgcgacgccaaaactcgcaactaacactaaaactaacgcgaaaaaaataaaccctctcaaaaaacctccgcgaaacctcacgaaaaaccgccgcgaacttcacgaaaaatataatccccttaccccctaacgctttccctaaattcaaatcctaaaattttccaattatattttatttttttcctt

SEQ ID NO: 37625 - DNA, 533 bp, Artificial Sequence
  chemically treated genomic DNA (Homo sapiens) CpG-island No: 37625
atgtcgcgggattttttttattttatgtaggaaggttggaagcgcgagatttagggttttttcgacgagttgcgagttaaggaaaaggtgcgaggaattaagggatttagcgttggaacgagtgttttttcgatttttttggggtagagtcggggcggcgttgtcgggattggtgttaggttgatttttttattatcgttgtttcgggcgtaggaattattgagtcgcgaggaggacgtgaatcgagcggcgcgcgagtagcggttataggcggagtagttgcggcggcgcgagtatttgttggtttagtgggagttagaggtgttcgagcgcgacgtgattggtgttgtagtaggtggacgcgagcgatcgtacgtgtcgtcgtcgcgggatatttaagcgtagtaagtttcgggcgcgcgacggcggcgagcgtattagtatgttattcggtgagggtcgggtttcgggcgtttttcgttattggttgcgggggtgggggtggagttaggtttgtgtgtttatcgcgttgg

SEQ ID NO: 37626 - DNA, 533 bp, Artificial Sequence
  chemically treated genomic DNA (Homo sapiens) CpG-island No: 37626
ccaacgcgataaacacacaaacctaactccacccccacccccgcaaccaataacgaaaaacgcccgaaacccgaccctcaccgaataacatactaatacgctcgccgccgtcgcgcgcccgaaacttactacgcttaaatatcccgcgacgacgacacgtacgatcgctcgcgtccacctactacaacaccaatcacgtcgcgctcgaacacctctaactcccactaaaccaacaaatactcgcgccgccgcaactactccgcctataaccgctactcgcgcgccgctcgattcacgtcctcctcgcgactcaataattcctacgcccgaaacaacgataataaaaaaatcaacctaacaccaatcccgacaacgccgccccgactctaccccaaaaaaatcgaaaaaacactcgttccaacgctaaatcccttaattcctcgcaccttttccttaactcgcaactcgtcgaaaaaaccctaaatctcgcgcttccaaccttcctacataaaataaaaaaaatcccgcgacat

SEQ ID NO: 37627 - DNA, 533 bp, Artificial Sequence
  chemically treated genomic DNA (Homo sapiens) CpG-island No: 37627
ttagcgcggtgagtatataggtttggttttatttttattttcgtagttaatggcgggggacgttcggggttcggtttttatcgagtggtatgttgatacgttcgtcgtcgtcgcgcgttcggagtttgttgcgtttgaatgtttcgcggcggcggtacgtgcggtcgttcgcgtttatttgttgtagtattagttacgtcgcgttcgaatatttttagtttttattgggttagtaggtgttcgcgtcgtcgtagttgtttcgtttgtgatcgttgttcgcgcgtcgttcggtttacgtttttttcgcggtttagtagtttttgcgttcgagatagcgatggtggagaggttagtttggtattaatttcggtagcgtcgtttcgattttgttttagggagatcggggagatattcgttttaacgttgggttttttgatttttcgtattttttttttggttcgtagttcgtcgaagagattttggatttcgcgtttttagtttttttgtatggaatggaaggagtttcgcggtat

SEQ ID NO: 37628 - DNA, 533 bp, Artificial Sequence
  chemically treated genomic DNA (Homo sapiens) CpG-island No: 37628
ataccgcgaaactccttccattccatacaaaaaaactaaaaacgcgaaatccaaaatctcttcgacgaactacgaaccaaaaaaaaaatacgaaaaatcaaaaaacccaacgttaaaacgaatatctccccgatctccctaaaacaaaatcgaaacgacgctaccgaaattaataccaaactaacctctccaccatcgctatctcgaacgcaaaaactactaaaccgcgaaaaaaacgtaaaccgaacgacgcgcgaacaacgatcacaaacgaaacaactacgacgacgcgaacacctactaacccaataaaaactaaaaatattcgaacgcgacgtaactaatactacaacaaataaacgcgaacgaccgcacgtaccgccgccgcgaaacattcaaacgcaacaaactccgaacgcgcgacgacgacgaacgtatcaacataccactcgataaaaaccgaaccccgaacgtcccccgccattaactacgaaaataaaaataaaaccaaacctatatactcaccgcgctaa

SEQ ID NO: 37629 - DNA, 606 bp, Artificial Sequence
  chemically treated genomic DNA (Homo sapiens) CpG-island No: 37629
ttcggttttcggatcgttagttcgttcggtgtttatttcggttttattttatacggtcgttatttttttttgtcgagttattggatttttaatattcggtagtagatttattttttggaggagcgggtagaagatgggattaggcgggagtcgtaacgggagattaatatcgttttttttaaagtttttttttgattagtggaaaatttttttttataaatttcgatttttgattcgattagtttcggtcgtgtgcggagtagcgaatttgttttttcgattttaaagattaattttatgtataggttcgttttcgcggatttcgaaacgttttcgttcgcgttttatttttgtcggggcgcgagaggtggggtcgttattggtcgatacgcgcgttggggcggggtttatgtgtaaaatcggaaagggagggagaagggtgggattcgcgagggtttttgggaaatgtagtttttaatttggttcgtgatagatgtttgcggaggggcgcgtttaaatttagatcgtgatttcgttaggaataaggggatttatataatgatattgttttttaattaataaacgatataggttagtcgtgtgtaa

SEQ ID NO: 37630 - DNA, 606 bp, Artificial Sequence
  chemically treated genomic DNA (Homo sapiens) CpG-island No: 37630
ttacacacgactaacctatatcgtttattaattaaaaaacaatatcattatataaatccccttattcctaacgaaatcacgatctaaatttaaacgcgcccctccgcaaacatctatcacgaaccaaattaaaaactacatttcccaaaaaccctcgcgaatcccacccttctccctccctttccgattttacacataaaccccgccccaacgcgcgtatcgaccaataacgaccccacctctcgcgccccgacaaaaataaaacgcgaacgaaaacgtttcgaaatccgcgaaaacgaacctatacataaaattaatctttaaaatcgaaaaaacaaattcgctactccgcacacgaccgaaactaatcgaatcaaaaatcgaaatttataaaaaaaaattttccactaatcaaaaaaaaactttaaaaaaaacgatattaatctcccgttacgactcccgcctaatcccatcttctacccgctcctccaaaaaataaatctactaccgaatattaaaaatccaataactcgacaaaaaaaaataacgaccgtataaaataaaaccgaaataaacaccgaacgaactaacgatccgaaaaccgaa

SEQ ID NO: 37631 - DNA, 606 bp, Artificial Sequence
  chemically treated genomic DNA (Homo sapiens) CpG-island No: 37631
ttgtatacggttggtttatgtcgtttattaattgggaggtagtgttattgtgtaaatttttttatttttagcggggttacggtttgagtttgaacgcgttttttcgtaagtatttgttacgggttagattaaagattatattttttaaaggttttcgcggattttattttttttttttttttttcggttttatatataggtttcgttttaacgcgcgtgtcggttaatagcggttttatttttcgcgtttcggtaaaaataggacgcgggcgggaacgtttcggggttcgcgggggcgggtttgtgtatggggttggtttttggaatcggagaggtagattcgttgtttcgtatacggtcggagttggtcgggttaagagtcgggatttgtggggagaggttttttattggttaagagaaggttttaagaaagacggtattaatttttcgttgcggttttcgtttggttttattttttgttcgtttttttaggaaatgaatttgttgtcgaatattgagagtttagtgattcggtaggagaagatggcgatcgtgtgggatgaggtcgaggtgggtatcgggcgagttggcggttcgggaatcggg

SEQ ID NO: 37632 - DNA, 606 bp, Artificial Sequence
  chemically treated genomic DNA (Homo sapiens) CpG-island No: 37632
cccgattcccgaaccgccaactcgcccgatacccacctcgacctcatcccacacgatcgccatcttctcctaccgaatcactaaactctcaatattcgacaacaaattcatttcctaaaaaaacgaacaaaaaataaaaccaaacgaaaaccgcaacgaaaaattaataccgtctttcttaaaaccttctcttaaccaataaaaaacctctccccacaaatcccgactcttaacccgaccaactccgaccgtatacgaaacaacgaatctacctctccgattccaaaaaccaaccccatacacaaacccgcccccgcgaaccccgaaacgttcccgcccgcgtcctatttttaccgaaacgcgaaaaataaaaccgctattaaccgacacgcgcgttaaaacgaaacctatatataaaaccgaaaaaaaaaaaaaaaaaataaaatccgcgaaaacctttaaaaaatataatctttaatctaacccgtaacaaatacttacgaaaaaacgcgttcaaactcaaaccgtaaccccgctaaaaataaaaaaatttacacaataacactacctcccaattaataaacgacataaaccaaccgtatacaa

SEQ ID NO: 37633 - DNA, 1495 bp, Artificial Sequence
  chemically treated genomic DNA (Homo sapiens) CpG-island No: 37633
gggcggcgagtaggagtcggggttaggttaggggttcgagttttcgttcgaggggcggggaaggcgggtgacgtgagtcgggtcgggcgggcggagttgggatcggtttcgggaggcgggggcgagcgcgcggagaggtagacgcgaggagggaggcggttgagtagcgcgggcggttttgcggcgggcgcggtgggcgcgggcggcggggtttcgggattttcgcgcgtttttttcgcgcggcgtcgtcgtcgcgcgtttttacgtttcgcgttttacggcgttttcgtttcgcgcgtttttcgtgttcgttttttgttagttttcgggtcgcggtcgtttgtagagcgagcgtttagacggagttttcgggtaatttgagtggcgtcgatcggcggcggagtttttggtagagtttttcgattcggtagcgcggaggggattcgcgttcgttcgcgtcgcgttattttaaattttaagtagcgtcgttttatcggcgcggagtttcggttggaggtaagagtcgcgcgtcgggagatacgtatcgtgagcggtagcgtcgtcggttttttttttcgtcgtttcggagggcgaagtcgcggttttttagttttttgttgcgtcgcgatagcgtcggaatacgtttcgtttcgttgtcgttttcgttgtgtcgtcggcggagggggtcgcgagtttcgcgtttcggtcggaggatgtgcgttttcgcgggtcgtttagtttgagttatgcgttttaacggcggcggcgcgtcggtcggtatggagtttcgcgcggtcgcgttttgattcgttgtgcgtttcgcggtcggcgggcggcgggaggcggcggatcgagagtcggagatcggcgtcgcgggacggaagcgagcgggcgcgggcgtcgcgtagatggtttgggcgagttaggtttgaggtttcgtttttcgaaacgtgattatgtggatttaatagtttttaggatttaggtgagcgattcggtcggcgtcgggtgcgtgtgggcgcgtgggtgttaggttgggcggaagcggcgtttttttttatgttgtaaattaagggattttttttcgtttttcgtaagcgggtaacggggtgtatcggtagtcggaaaggggcgttcgttcggagtttggagtagtatcgcggttttggcggggagcggtcgggtttttagggtttcgcgcgttcggggtcggggtagcggcgttcgttttagtaattcgggaagtggggtcggttaggcgcgttcgtagttttaggagttagtagcgtagtgttttggtcggttgtttcggcgcgtttttttttcggggttcggggcgaggcgtcggtcgttgggcgcggcgggcgcgggggtcggggttgtcggggaaagttaaagtttcgggtttttagcgagagtttcgtaggcggagttggaggaaattatagttaaatagttatttcgttttttttttttttttttcggggtttcgggg

SEQ ID NO: 37634 - DNA, 1495 bp, Artificial Sequence
  chemically treated genomic DNA (Homo sapiens) CpG-island No: 37634
ccccgaaaccccgaaaaaaaaaaaaaaaaaacgaaataactatttaactataatttcctccaactccgcctacgaaactctcgctaaaaacccgaaactttaactttccccgacaaccccgacccccgcgcccgccgcgcccaacgaccgacgcctcgccccgaaccccgaaaaaaaaacgcgccgaaacaaccgaccaaaacactacgctactaactcctaaaactacgaacgcgcctaaccgaccccacttcccgaattactaaaacgaacgccgctaccccgaccccgaacgcgcgaaaccctaaaaacccgaccgctccccgccaaaaccgcgatactactccaaactccgaacgaacgcccctttccgactaccgatacaccccgttacccgcttacgaaaaacgaaaaaaaatcccttaatttacaacataaaaaaaaacgccgcttccgcccaacctaacacccacgcgcccacacgcacccgacgccgaccgaatcgctcacctaaatcctaaaaactattaaatccacataatcacgtttcgaaaaacgaaacctcaaacctaactcgcccaaaccatctacgcgacgcccgcgcccgctcgcttccgtcccgcgacgccgatctccgactctcgatccgccgcctcccgccgcccgccgaccgcgaaacgcacaacgaatcaaaacgcgaccgcgcgaaactccataccgaccgacgcgccgccgccgttaaaacgcataactcaaactaaacgacccgcgaaaacgcacatcctccgaccgaaacgcgaaactcgcgaccccctccgccgacgacacaacgaaaacgacaacgaaacgaaacgtattccgacgctatcgcgacgcaacaaaaaactaaaaaaccgcgacttcgccctccgaaacgacgaaaaaaaaaaccgacgacgctaccgctcacgatacgtatctcccgacgcgcgactcttacctccaaccgaaactccgcgccgataaaacgacgctacttaaaatttaaaataacgcgacgcgaacgaacgcgaatcccctccgcgctaccgaatcgaaaaactctaccaaaaactccgccgccgatcgacgccactcaaattacccgaaaactccgtctaaacgctcgctctacaaacgaccgcgacccgaaaactaacaaaaaacgaacacgaaaaacgcgcgaaacgaaaacgccgtaaaacgcgaaacgtaaaaacgcgcgacgacgacgccgcgcgaaaaaaacgcgcgaaaatcccgaaaccccgccgcccgcgcccaccgcgcccgccgcaaaaccgcccgcgctactcaaccgcctccctcctcgcgtctacctctccgcgcgctcgcccccgcctcccgaaaccgatcccaactccgcccgcccgacccgactcacgtcacccgccttccccgcccctcgaacgaaaactcgaacccctaacctaaccccgactcctactcgccgccc

SEQ ID NO: 37635 - DNA, 1495 bp, Artificial Sequence
  chemically treated genomic DNA (Homo sapiens) CpG-island No: 37635
tttcggggtttcgagaaaggagaagggggagcggagtggttgtttggttgtggttttttttaatttcgtttgcgaagttttcgttgggagttcggagttttagtttttttcggtagtttcggttttcgcgttcgtcgcgtttagcggtcggcgtttcgtttcgggtttcggggaggaggcgcgtcggggtagtcggttaggatattgcgttgttggtttttagagttgcgggcgcgtttggtcggttttatttttcgggttgttggggcgggcgtcgttgtttcgatttcggacgcgcggaattttggagattcggtcgtttttcgttagggtcgcggtgttgttttaggtttcgggcgggcgttttttttcggttatcggtgtatttcgttgttcgtttgcgggaagcgaagaggggttttttgatttgtaatatagaggaaagcgtcgttttcgtttagtttggtatttacgcgtttatacgtattcggcgtcggtcgggtcgtttatttgagttttaaaagttgttgaatttatatggttacgtttcggggagcggggttttagatttggttcgtttaggttatttgcgcggcgttcgcgttcgttcgttttcgtttcgcggcgtcggttttcggttttcggttcgtcgtttttcgtcgttcgtcggtcgcggggcgtatagcgagttagagcgcggtcgcgcggggttttatgtcggtcggcgcgtcgtcgtcgttggggcgtatggtttaggttgggcggttcgcgggggcgtatatttttcggtcggggcgcggggttcgcggtttttttcgtcggcggtatagcgaaggcggtagcgaggcggggcgtgtttcggcgttgtcgcggcgtagtaaagggttggggagtcgcggtttcgtttttcggggcggcgaggagggaggtcggcggcgttgtcgtttacggtgcgtgtttttcggcgcgcggtttttgtttttagtcggagtttcgcgtcgatggggcggcgttgtttagggtttggggtgacgcgacgcggacggacgcgagtttttttcgcgttgtcgggtcggggggttttgttagaggtttcgtcgtcgatcggcgttatttaagttgttcgggggtttcgtttgagcgttcgttttgtagacggtcgcggttcggagattggtaggaggcgggtacgagaggcgcgcggggcgagggcgtcgtggagcgcggggcgtggggacgcgcggcggcggcgtcgcgcggaggaggcgcgcggggatttcggggtttcgtcgttcgcgtttatcgcgttcgtcgtagagtcgttcgcgttgtttagtcgttttttttttcgcgtttgttttttcgcgcgttcgttttcgtttttcggagtcggttttaatttcgttcgttcggttcggtttacgttattcgtttttttcgtttttcgaacgggagttcgagtttttggtttggtttcggtttttgttcgtcgttt

SEQ ID NO: 37636 - DNA, 1495 bp, Artificial Sequence
  chemically treated genomic DNA (Homo sapiens) CpG-island No: 37636
aaacgacgaacaaaaaccgaaaccaaaccaaaaactcgaactcccgttcgaaaaacgaaaaaaacgaataacgtaaaccgaaccgaacgaacgaaattaaaaccgactccgaaaaacgaaaacgaacgcgcgaaaaaacaaacgcgaaaaaaaaaacgactaaacaacgcgaacgactctacgacgaacgcgataaacgcgaacgacgaaaccccgaaatccccgcgcgcctcctccgcgcgacgccgccgccgcgcgtccccacgccccgcgctccacgacgccctcgccccgcgcgcctctcgtacccgcctcctaccaatctccgaaccgcgaccgtctacaaaacgaacgctcaaacgaaacccccgaacaacttaaataacgccgatcgacgacgaaacctctaacaaaaccccccgacccgacaacgcgaaaaaaactcgcgtccgtccgcgtcgcgtcaccccaaaccctaaacaacgccgccccatcgacgcgaaactccgactaaaaacaaaaaccgcgcgccgaaaaacacgcaccgtaaacgacaacgccgccgacctccctcctcgccgccccgaaaaacgaaaccgcgactccccaaccctttactacgccgcgacaacgccgaaacacgccccgcctcgctaccgccttcgctataccgccgacgaaaaaaaccgcgaaccccgcgccccgaccgaaaaatatacgcccccgcgaaccgcccaacctaaaccatacgccccaacgacgacgacgcgccgaccgacataaaaccccgcgcgaccgcgctctaactcgctatacgccccgcgaccgacgaacgacgaaaaacgacgaaccgaaaaccgaaaaccgacgccgcgaaacgaaaacgaacgaacgcgaacgccgcgcaaataacctaaacgaaccaaatctaaaaccccgctccccgaaacgtaaccatataaattcaacaacttttaaaactcaaataaacgacccgaccgacgccgaatacgtataaacgcgtaaataccaaactaaacgaaaacgacgctttcctctatattacaaatcaaaaaacccctcttcgcttcccgcaaacgaacaacgaaatacaccgataaccgaaaaaaaacgcccgcccgaaacctaaaacaacaccgcgaccctaacgaaaaacgaccgaatctccaaaattccgcgcgtccgaaatcgaaacaacgacgcccgccccaacaacccgaaaaataaaaccgaccaaacgcgcccgcaactctaaaaaccaacaacgcaatatcctaaccgactaccccgacgcgcctcctccccgaaacccgaaacgaaacgccgaccgctaaacgcgacgaacgcgaaaaccgaaactaccgaaaaaaactaaaactccgaactcccaacgaaaacttcgcaaacgaaattaaaaaaaaccacaaccaaacaaccactccgctcccccttctcctttctcgaaaccccgaaa

SEQ ID NO: 37637 - DNA, 523 bp, Artificial Sequence
  chemically treated genomic DNA (Homo sapiens) CpG-island No: 37637
  misc_feature (225)..(225): n is either a, c, g or t
gcggtcgttagatttttcgggtagttttcggtagtttcgaggtagcgtttttttttttaattatcgtttttcgggatgggtcgtatcgaagagttcgttttttagttagggtacgaagtgcgtcgtcgcgatgggtagttggaggaaggggcgtgacgtaagtggaattttcgcgtgacgtcgcgcgggttttcgggcggggcgggttcggtcgttttcgagttntcgcggtagttttcggttttaaagcgcgggttgttcggaggggtcggtttttttatcgaggatttggtattttggtgagggaaaagggcgaaagagaaaagcgagtagtcgtttttttatagttttagaaagtgttcgttttttttcgggggttttcgcgaatttcgaggtaatttcggaggcggtgagtaaaagtaatttttttattttattcggagttttgggtcggagcgattgtttttggtttggagttgcgtgtttggcgaagggttttcggggtaggggtggttttcggttt

SEQ ID NO: 37638 - DNA, 523 bp, Artificial Sequence
  chemically treated genomic DNA (Homo sapiens) CpG-island No: 37638
  misc_feature (299)..(299): n is either a, c, g or t
aaaccgaaaaccacccctaccccgaaaacccttcgccaaacacgcaactccaaaccaaaaacaatcgctccgacccaaaactccgaataaaataaaaaaattacttttactcaccgcctccgaaattacctcgaaattcgcgaaaacccccgaaaaaaaacgaacactttctaaaactataaaaaaacgactactcgcttttctctttcgcccttttccctcaccaaaataccaaatcctcgataaaaaaaccgacccctccgaacaacccgcgctttaaaaccgaaaactaccgcganaactcgaaaacgaccgaacccgccccgcccgaaaacccgcgcgacgtcacgcgaaaattccacttacgtcacgccccttcctccaactacccatcgcgacgacgcacttcgtaccctaactaaaaaacgaactcttcgatacgacccatcccgaaaaacgataattaaaaaaaaaaacgctacctcgaaactaccgaaaactacccgaaaaatctaacgaccgc

SEQ ID NO: 37639 - DNA, 523 bp, Artificial Sequence
  chemically treated genomic DNA (Homo sapiens) CpG-island No: 37639
  misc_feature (299)..(299): n is either a, c, g or t
gagtcgggagttatttttatttcgggagtttttcgttaagtacgtagttttagattagaagtagtcgtttcgatttagagtttcgggtggggtaaagagattgtttttatttatcgttttcgagattgtttcgggattcgcgaaagttttcgaagggaagcgagtattttttgaggttgtgaaaggacggttgttcgtttttttttttcgttttttttttttattagagtgttaaattttcggtgggaaagtcgattttttcggatagttcgcgttttaaggtcgggggttgtcgcgangattcggaggcggtcggattcgtttcgttcgggagttcgcgcgacgttacgcgggagttttatttgcgttacgtttttttttttagttgtttatcgcggcggcgtatttcgtgttttagttgaggagcgggtttttcggtgcggtttatttcggagggcgatggttggggaggggagcgttatttcggagttgtcgggagttattcgaagagtttggcgatcgt

SEQ ID NO: 37640 - DNA, 523 bp, Artificial Sequence
  chemically treated genomic DNA (Homo sapiens) CpG-island No: 37640
  misc_feature (225)..(225): n is either a, c, g or t
acgatcgccaaactcttcgaataactcccgacaactccgaaataacgctcccctccccaaccatcgccctccgaaataaaccgcaccgaaaaacccgctcctcaactaaaacacgaaatacgccgccgcgataaacaactaaaaaaaaaaacgtaacgcaaataaaactcccgcgtaacgtcgcgcgaactcccgaacgaaacgaatccgaccgcctccgaatcntcgcgacaacccccgaccttaaaacgcgaactatccgaaaaaatcgactttcccaccgaaaatttaacactctaataaaaaaaaaaaacgaaaaaaaaaaacgaacaaccgtcctttcacaacctcaaaaaatactcgcttcccttcgaaaactttcgcgaatcccgaaacaatctcgaaaacgataaataaaaacaatctctttaccccacccgaaactctaaatcgaaacgactacttctaatctaaaactacgtacttaacgaaaaactcccgaaataaaaataactcccgactc

SEQ ID NO: 37641 - DNA, 623 bp, Artificial Sequence
  chemically treated genomic DNA (Homo sapiens) CpG-island No: 37641
ggcgatgttttgagcggcgttttcgttggcgatgttttgggcggcgttttcgttggcgatgttttgggcggcgttttttttgtcgatgttttgggcggcgttttcgttggcgatttcgtgggcgtcgttttcgttggcgatgttttgggcggcgttttcgttggcgatgttttgggcggcgttttttttggcgatgttttgggcggcgttttttttggcgatgttttgggcggcgttttttttggcgatgttttgggcggcgttttttttggcgatgttttgggcggcgttttcgttggcgatgttttgggcggcgttttcgttggcgatgttttgggcggcgttttcgttggcgatgttttgggcggcgttttcgttggcgatgtcgtgggcggcgttttcgttggcgatgtcgtgggcggcgttttcgttggcgatgttgtgggcggtattttcgttggcgatgtttttgtcggcggtttcgttagcgatgtcgtgtatagtattttcgttagcgatgtcgtgtgtggcgttttcgttagtgatgtcgtgtacggtgtttttatggggagttagaaaaatatagagttaaggttagtgttttggtggtggagattgtgaat

SEQ ID NO: 37642 - DNA, 623 bp, Artificial Sequence
  chemically treated genomic DNA (Homo sapiens) CpG-island No: 37642
attcacaatctccaccaccaaaacactaaccttaactctatatttttctaactccccataaaaacaccgtacacgacatcactaacgaaaacgccacacacgacatcgctaacgaaaatactatacacgacatcgctaacgaaaccgccgacaaaaacatcgccaacgaaaataccgcccacaacatcgccaacgaaaacgccgcccacgacatcgccaacgaaaacgccgcccacgacatcgccaacgaaaacgccgcccaaaacatcgccaacgaaaacgccgcccaaaacatcgccaacgaaaacgccgcccaaaacatcgccaacgaaaacgccgcccaaaacatcgccaaaaaaaacgccgcccaaaacatcgccaaaaaaaacgccgcccaaaacatcgccaaaaaaaacgccgcccaaaacatcgccaaaaaaaacgccgcccaaaacatcgccaacgaaaacgccgcccaaaacatcgccaacgaaaacgacgcccacgaaatcgccaacgaaaacgccgcccaaaacatcgacaaaaaaaacgccgcccaaaacatcgccaacgaaaacgccgcccaaaacatcgccaacgaaaacgccgctcaaaacatcgcc

SEQ ID NO: 37643 - DNA, 623 bp, Artificial Sequence
  chemically treated genomic DNA (Homo sapiens) CpG-island No: 37643
atttatagtttttattattagggtattgattttaattttgtgtttttttagttttttatgaggatatcgtatacgatattattaacgaggacgttatatacgatatcgttaacgaggatattgtatacgatatcgttaacgaggtcgtcgataagggtatcgttagcgaggatgtcgtttatagtatcgttagcgaggacgtcgtttacggtatcgttagcgaggacgtcgtttacggtatcgttagcgaggacgtcgtttagggtatcgttagcgaggacgtcgtttagggtatcgttagcgaggacgtcgtttagggtatcgttaacgaggacgtcgtttagggtatcgttaaagaggacgtcgtttagggtatcgttaaggaggacgtcgtttagggtatcgttaaggaggacgtcgtttagggtatcgttaaggaggacgtcgtttagggtatcgttaacgaggacgtcgtttagggtatcgttaacgaggacggcgtttacggaatcgttagcgaggacgtcgtttagggtatcgataaggaggacgtcgtttagggtatcgttaacgaggacgtcgtttagggtatcgttaacgaggacgtcgtttagggtatcgtt

SEQ ID NO: 37644 - DNA, 623 bp, Artificial Sequence
  chemically treated genomic DNA (Homo sapiens) CpG-island No: 37644
aacgataccctaaacgacgtcctcgttaacgataccctaaacgacgtcctcgttaacgataccctaaacgacgtcctccttatcgataccctaaacgacgtcctcgctaacgattccgtaaacgccgtcctcgttaacgataccctaaacgacgtcctcgttaacgataccctaaacgacgtcctccttaacgataccctaaacgacgtcctccttaacgataccctaaacgacgtcctccttaacgataccctaaacgacgtcctctttaacgataccctaaacgacgtcctcgttaacgataccctaaacgacgtcctcgctaacgataccctaaacgacgtcctcgctaacgataccctaaacgacgtcctcgctaacgataccgtaaacgacgtcctcgctaacgataccgtaaacgacgtcctcgctaacgatactataaacgacatcctcgctaacgatacccttatcgacgacctcgttaacgatatcgtatacaatatcctcgttaacgatatcgtatataacgtcctcgttaataatatcgtatacgatatcctcataaaaaactaaaaaaacacaaaattaaaatcaataccctaataataaaaactataaat

SEQ ID NO: 37645 - DNA, 758 bp, Artificial Sequence
  chemically treated genomic DNA (Homo sapiens) CpG-island No: 37645
tcgatatttttaaagttttggtttttcgattttttaacgattttagagttttcgtcgttcggtttttagacggtttatagatttttatgattattttgtttttatatttttaatttcgagtttcggtttttcgcgtttttttagtcgttggttttacgtatcggattcgtatttgatgtcgtgcgagtgtagtcgtacgcggtggtgcgtattgagtagttttagtatcgattcgtaggttacgagtttcgtatcggttttggcggtattatcgttcggtattaatagcgttagtagtagttttaatagtatcggttaggtagtttcgtcgcggttcgcgttttatatcgtttcggttcggttttagtttttcgggtttaggggtcgttttcgttttcgtcgcggtttaattcggttttgatagcgttcgtttgcggtagttaatagtcggttcgcgcggtatttcgtttgtattgttattgggttagcgcggggagggttcgttttcggttcgcgagagtcgtagttgggcggggattggagatacgaggagggttttgattggtttacgttttcgaggatttattaatgagtgtttagggaagggcggttgagttttcgagtcgcggagagtgagcgtgaatagttggtgaagacgcggtttttcgtagtcggtgagtttttggatatcggtttaggattttaggattttgtaggtacgtttttacgacgttttttgattttggatttttgggtat

SEQ ID NO: 37646 - DNA, 758 bp, Artificial Sequence
  chemically treated genomic DNA (Homo sapiens) CpG-island No: 37646
atacccaaaaatccaaaatcaaaaaacgtcgtaaaaacgtacctacaaaatcctaaaatcctaaaccgatatccaaaaactcaccgactacgaaaaaccgcgtcttcaccaactattcacgctcactctccgcgactcgaaaactcaaccgcccttccctaaacactcattaataaatcctcgaaaacgtaaaccaatcaaaaccctcctcgtatctccaatccccgcccaactacgactctcgcgaaccgaaaacgaaccctccccgcgctaacccaataacaatacaaacgaaataccgcgcgaaccgactattaactaccgcaaacgaacgctatcaaaaccgaattaaaccgcgacgaaaacgaaaacgacccctaaacccgaaaaactaaaaccgaaccgaaacgatataaaacgcgaaccgcgacgaaactacctaaccgatactattaaaactactactaacgctattaataccgaacgataataccgccaaaaccgatacgaaactcgtaacctacgaatcgatactaaaactactcaatacgcaccaccgcgtacgactacactcgcacgacatcaaatacgaatccgatacgtaaaaccaacgactaaaaaaacgcgaaaaaccgaaactcgaaattaaaaatataaaaacaaaataatcataaaaatctataaaccgtctaaaaaccgaacgacgaaaactctaaaatcgttaaaaaatcgaaaaaccaaaactttaaaaatatcga

SEQ ID NO: 37647 - DNA, 758 bp, Artificial Sequence
  chemically treated genomic DNA (Homo sapiens) CpG-island No: 37647
gtgtttaggagtttaggattaaggggcgtcgtgaaaacgtgtttgtagggttttaggattttgagtcggtgtttagggatttatcggttgcgaggagtcgcgtttttattaattgtttacgtttatttttcgcggttcggagatttagtcgtttttttttgggtatttattggtaagttttcggaagcgtggattaattaaaatttttttcgtgtttttagttttcgtttagttacggttttcgcgaatcgggggcgggtttttttcgcgttgatttagtggtagtgtaagcggagtgtcgcgcgggtcgattattggttgtcgtaagcgggcgttgttagaatcggattgggtcgcggcggggacggaagcggtttttgggttcgaggggttggagtcgggtcggggcgatgtggagcgcgggtcgcggcggggttgtttggtcggtgttgttggggttgttgttggcgttgttagtgtcgggcggtggtgtcgttaagatcggtgcggagttcgtgatttgcgggtcggtgttgaagttgtttaatacgtattatcgcgtgcggttgtattcgtacgatattaaatacggattcggtgcgtggggttagcgattgggagagcgcggggaatcggggttcggggttgggagtgtggagatagggtggttatgggggtttgtgggtcgtttggaagtcgggcggcgggggttttagagtcgttgggaggtcgaggggttaaagttttgagggtgtcga

SEQ ID NO: 37648 - DNA, 758 bp, Artificial Sequence
  chemically treated genomic DNA (Homo sapiens) CpG-island No: 37648
tcgacaccctcaaaactttaacccctcgacctcccaacgactctaaaacccccgccgcccgacttccaaacgacccacaaacccccataaccaccctatctccacactcccaaccccgaaccccgattccccgcgctctcccaatcgctaaccccacgcaccgaatccgtatttaatatcgtacgaatacaaccgcacgcgataatacgtattaaacaacttcaacaccgacccgcaaatcacgaactccgcaccgatcttaacgacaccaccgcccgacactaacaacgccaacaacaaccccaacaacaccgaccaaacaaccccgccgcgacccgcgctccacatcgccccgacccgactccaacccctcgaacccaaaaaccgcttccgtccccgccgcgacccaatccgattctaacaacgcccgcttacgacaaccaataatcgacccgcgcgacactccgcttacactaccactaaatcaacgcgaaaaaaacccgcccccgattcgcgaaaaccgtaactaaacgaaaactaaaaacacgaaaaaaattttaattaatccacgcttccgaaaacttaccaataaatacccaaaaaaaaacgactaaatctccgaaccgcgaaaaataaacgtaaacaattaataaaaacgcgactcctcgcaaccgataaatccctaaacaccgactcaaaatcctaaaaccctacaaacacgttttcacgacgccccttaatcctaaactcctaaacac

SEQ ID NO: 37649 - DNA, 587 bp, Artificial Sequence
  chemically treated genomic DNA (Homo sapiens) CpG-island No: 37649
cgttgcggttgcgttttatcggcggtttatagtagtagggttcgtgtaggagtagtttgcgtagcggtattagcgggatggtgtgtgcgtttattagtttttgttgttggtgacgcgcgtcgtttcgtcgtttgaggcgtttaaatttcgttagcgcgttggtcgacgtttggtagagtagtagggttatggtttgcgttttttcgggtttggatattagtacggcgtggtagcgtagtattacggttttgtgttttagttcgtgtcggtatatttaggcgaagattttgggtagtcgcgcgtcggttacgtagtaggtgacgcggtgtagtaggtagaggtggttcgggcggcgtagcgcgcgtttttcggcgtgtattatgcggatattttgcgtatttatcgttagttttattttggtgttttgacggttcgtttcgtttttgttttagattttgtttatagtaaggtcggtgtagtcgtcgtcgcgcgtttggatggtggtggtattgtttaggtagagtacggtgtaagttgggttttcgttagtgatgtgtagttttttgcgtttggagcggaatatgttg

SEQ ID NO: 37650 - DNA, 587 bp, Artificial Sequence
  chemically treated genomic DNA (Homo sapiens) CpG-island No: 37650
caacatattccgctccaaacgcaaaaaactacacatcactaacgaaaacccaacttacaccgtactctacctaaacaataccaccaccatccaaacgcgcgacgacgactacaccgaccttactataaacaaaatctaaaacaaaaacgaaacgaaccgtcaaaacaccaaaataaaactaacgataaatacgcaaaatatccgcataatacacgccgaaaaacgcgcgctacgccgcccgaaccacctctacctactacaccgcgtcacctactacgtaaccgacgcgcgactacccaaaatcttcgcctaaatataccgacacgaactaaaacacaaaaccgtaatactacgctaccacgccgtactaatatccaaacccgaaaaaacgcaaaccataaccctactactctaccaaacgtcgaccaacgcgctaacgaaatttaaacgcctcaaacgacgaaacgacgcgcgtcaccaacaacaaaaactaataaacgcacacaccatcccgctaataccgctacgcaaactactcctacacgaaccctactactataaaccgccgataaaacgcaaccgcaacg

SEQ ID NO: 37651 - DNA, 587 bp, Artificial Sequence
  chemically treated genomic DNA (Homo sapiens) CpG-island No: 37651
tagtatgtttcgttttaagcgtaagaagttgtatattattagcgaggatttaatttatatcgtgttttatttgggtaatgttattattatttaggcgcgcggcgacggttgtatcgattttgttgtgggtaagatttggagtaagagcgaggcgggtcgttagggtattaagatgaagttgacggtgagtgcgtagggtattcgtatggtgtacgtcgaggagcgcgcgttgcgtcgttcgggttatttttatttgttgtatcgcgttatttattgcgtggtcgacgcgcggttgtttaaggttttcgtttgggtgtatcggtacgagttgaagtataaggtcgtgatgttgcgttgttacgtcgtgttggtgtttaagttcgaaaaggcgtaggttatggttttgttgttttattagacgtcggttaacgcgttggcggaatttaaacgttttaagcggcgggacgacgcgcgttattagtagtaggagttggtgggcgtatatattatttcgttagtgtcgttgcgtaagttgtttttatacggattttgttgttataaatcgtcggtggagcgtagtcgtagcg

SEQ ID NO: 37652 - DNA, 587 bp, Artificial Sequence
  chemically treated genomic DNA (Homo sapiens) CpG-island No: 37652
cgctacgactacgctccaccgacgatttataacaacaaaatccgtataaaaacaacttacgcaacgacactaacgaaataatatatacgcccaccaactcctactactaataacgcgcgtcgtcccgccgcttaaaacgtttaaattccgccaacgcgttaaccgacgtctaataaaacaacaaaaccataacctacgccttttcgaacttaaacaccaacacgacgtaacaacgcaacatcacgaccttatacttcaactcgtaccgatacacccaaacgaaaaccttaaacaaccgcgcgtcgaccacgcaataaataacgcgatacaacaaataaaaataacccgaacgacgcaacgcgcgctcctcgacgtacaccatacgaataccctacgcactcaccgtcaacttcatcttaataccctaacgacccgcctcgctcttactccaaatcttacccacaacaaaatcgatacaaccgtcgccgcgcgcctaaataataataacattacccaaataaaacacgatataaattaaatcctcgctaataatatacaacttcttacgcttaaaacgaaacatacta

SEQ ID NO: 37653 - DNA, 530 bp, Artificial Sequence
  chemically treated genomic DNA (Homo sapiens) CpG-island No: 37653
tggtcgcggcgggtttcgcgtagtagtttcgcggggatttattgtattttcgtttcgtcggacgtcggggattcgcgttcggttcgtttagtgttcgggttggtttggtcgagacggcgttgggtttcgagaataggggacgggtatggtcgggttcgggaatcgtcgttattttatttttttttttcgaggcggtgtttagtttcgttttcgggttttttacggtttgttgttcgtttttgtagtgcgtttttttcggtgttgcgagcggcgttcggttcgtttgttttatatttttgtcgttcgggaggaagatttcgggtaaatataggtcggcgcgaattattcgtcgcgcggggataggggaggagtagagaagaggatttgttttgggtttcgatttcgggcggatttttggttttttaaagggatcgcgtgatagttattggtcgagggagcggggagatcggtttaattttttaattatattttaaatttattagtattttttttgtttatggaaattattg

SEQ ID NO: 37654 - DNA, 530 bp, Artificial Sequence
  chemically treated genomic DNA (Homo sapiens) CpG-island No: 37654
caataatttccataaacaaaaaaaatactaataaatttaaaatataattaaaaaattaaaccgatctccccgctccctcgaccaataactatcacgcgatccctttaaaaaaccaaaaatccgcccgaaatcgaaacccaaaacaaatcctcttctctactcctcccctatccccgcgcgacgaataattcgcgccgacctatatttacccgaaatcttcctcccgaacgacaaaaatataaaacaaacgaaccgaacgccgctcgcaacaccgaaaaaaacgcactacaaaaacgaacaacaaaccgtaaaaaacccgaaaacgaaactaaacaccgcctcgaaaaaaaaaaataaaataacgacgattcccgaacccgaccatacccgtcccctattctcgaaacccaacgccgtctcgaccaaaccaacccgaacactaaacgaaccgaacgcgaatccccgacgtccgacgaaacgaaaatacaataaatccccgcgaaactactacgcgaaacccgccgcgacca

SEQ ID NO: 37655 - DNA, 530 bp, Artificial Sequence
  chemically treated genomic DNA (Homo sapiens) CpG-island No: 37655
tagtgatttttatagataaaagagatgttggtaaatttgggatgtaattggaggattggatcggttttttcgttttttcgattaatggttgttacgcggtttttttaagaaattaggaattcgttcggagtcggagtttaaaatagatttttttttttgttttttttttgttttcgcgcggcgaatggttcgcgtcggtttatatttattcgagatttttttttcggacggtaaggatgtgaggtaggcgagtcggacgtcgttcgtagtatcggagagggcgtattgtaaaggcgggtagtagatcgtggagagttcgggagcggagttggatatcgtttcggagggaagaaatgaggtagcggcggttttcggattcggttatgttcgttttttgttttcggagtttagcgtcgtttcggttaggttagttcggatattgagcgggtcgagcgcgagttttcggcgttcggcggagcgaagatgtagtgagttttcgcgggattgttgcgcggggttcgtcgcggtta

SEQ ID NO: 37656 - DNA, 530 bp, Artificial Sequence
  chemically treated genomic DNA (Homo sapiens) CpG-island No: 37656
taaccgcgacgaaccccgcgcaacaatcccgcgaaaactcactacatcttcgctccgccgaacgccgaaaactcgcgctcgacccgctcaatatccgaactaacctaaccgaaacgacgctaaactccgaaaacaaaaaacgaacataaccgaatccgaaaaccgccgctacctcatttcttccctccgaaacgatatccaactccgctcccgaactctccacgatctactacccgcctttacaatacgccctctccgatactacgaacgacgtccgactcgcctacctcacatccttaccgtccgaaaaaaaaatctcgaataaatataaaccgacgcgaaccattcgccgcgcgaaaacaaaaaaaaaacaaaaaaaaaaatctattttaaactccgactccgaacgaattcctaatttcttaaaaaaaccgcgtaacaaccattaatcgaaaaaacgaaaaaaccgatccaatcctccaattacatcccaaatttaccaacatctcttttatctataaaaatcacta

SEQ ID NO: 37657 - DNA, 800 bp, Artificial Sequence
  chemically treated genomic DNA (Homo sapiens) CpG-island No: 37657
tcgttcgatagtttttcgattcgtggttttattatagcgcgtgggcggcgatttagtaggaggaggcgtagatttataggtcgaaggagatgtagacgcggtggcgggcgaagtagcggtttaggtagttttagttttagagcgcgggcgcggggttgggcgttttttttatggcgcggttgggcgcgcggcgcggggtcggggatttgggcgtagtttttttcgtcgcgggtaagtttcgagcgtcgtcgtttcgcgtgtttttttttgggtttcgtttcgtcgcggcggttttcggtcgagcgtatcgatcgcgggtagagaagggcgcgttttcgggcgcgggcggcggcggcgaaggcgtcggggaaaagttttcgggatcgcgcgttttttatttttcgcgttattgtcgggggtcggtagggcggaggtcgttttttagcggcgggagtcgggagttgcgcgcgtataaagattgcggttttcgtttttcgtcgattttttcgcggttatttatttttaatattttggtcggagcggggcgggcggttgggttcgcggacggtcgagtttttgtcggtcgttgtaaggtacggcgtttttttttgcgtattgtttatattttttgagttaatagtaattagttgcgttgttgaagcgtatgggtgttgggatttcgaggtgaagggggcgtggttttgatcgtcgatagggcgtagtaaaaagggtggggtgtaagattaggaaggaggaaataaacgtgtcggagaataaatatttttatatttgttttttat

SEQ ID NO: 37658 - DNA, 800 bp, Artificial Sequence
  chemically treated genomic DNA (Homo sapiens) CpG-island No: 37658
ataaaaaacaaatataaaaatatttattctccgacacgtttatttcctccttcctaatcttacaccccaccctttttactacgccctatcgacgatcaaaaccacgcccccttcacctcgaaatcccaacacccatacgcttcaacaacgcaactaattactattaactcaaaaaatataaacaatacgcaaaaaaaaacgccgtaccttacaacgaccgacaaaaactcgaccgtccgcgaacccaaccgcccgccccgctccgaccaaaatattaaaaataaataaccgcgaaaaaatcgacgaaaaacgaaaaccgcaatctttatacgcgcgcaactcccgactcccgccgctaaaaaacgacctccgccctaccgacccccgacaataacgcgaaaaataaaaaacgcgcgatcccgaaaacttttccccgacgccttcgccgccgccgcccgcgcccgaaaacgcgcccttctctacccgcgatcgatacgctcgaccgaaaaccgccgcgacgaaacgaaacccaaaaaaaaacacgcgaaacgacgacgctcgaaacttacccgcgacgaaaaaaactacgcccaaatccccgaccccgcgccgcgcgcccaaccgcgccataaaaaaaacgcccaaccccgcgcccgcgctctaaaactaaaactacctaaaccgctacttcgcccgccaccgcgtctacatctccttcgacctataaatctacgcctcctcctactaaatcgccgcccacgcgctataataaaaccacgaatcgaaaaactatcgaacga

SEQ ID NO: 37659 - DNA, 800 bp, Artificial Sequence
  chemically treated genomic DNA (Homo sapiens) CpG-island No: 37659
gtgagaggtagatgtgggggtatttgtttttcggtacgtttgtttttttttttttggttttgtattttattttttttattgcgttttgtcggcgattaggattacgttttttttatttcgggattttagtatttatgcgttttagtagcgtaattaattgttgttggtttaggaaatgtggataatacgtaggaagggacgtcgtgttttatagcgatcggtagggattcggtcgttcgcgagtttagtcgttcgtttcgtttcggttaggatgttggaggtgggtgatcgcgaagaggtcggcggggggcgggggtcgtagtttttgtgcgcgcgtagttttcggttttcgtcgttggggggcggttttcgttttgtcgattttcgataatagcgcgaggggtggggagcgcgcggtttcggaaattttttttcggcgttttcgtcgtcgtcgttcgcgttcgggagcgcgtttttttttgttcgcggtcggtgcgttcggtcggaggtcgtcgcggcggaacggaatttagagaagggtacgcggggcggcggcgttcggggtttgttcgcggcgagggaggttgcgtttaggttttcggtttcgcgtcgcgcgtttagtcgcgttatgggggaggcgtttagtttcgcgttcgcgttttgggattgggattatttggatcgttgtttcgttcgttatcgcgtttgtatttttttcggtttgtggatttgcgtttttttttgttggatcgtcgtttacgcgttgtaatggggttacgggtcggggggttgtcgggcgg

SEQ ID NO: 37660 - DNA, 800 bp, Artificial Sequence
  chemically treated genomic DNA (Homo sapiens) CpG-island No: 37660
ccgcccgacaaccccccgacccgtaaccccattacaacgcgtaaacgacgatccaacaaaaaaaaacgcaaatccacaaaccgaaaaaaatacaaacgcgataacgaacgaaacaacgatccaaataatcccaatcccaaaacgcgaacgcgaaactaaacgcctcccccataacgcgactaaacgcgcgacgcgaaaccgaaaacctaaacgcaacctccctcgccgcgaacaaaccccgaacgccgccgccccgcgtacccttctctaaattccgttccgccgcgacgacctccgaccgaacgcaccgaccgcgaacaaaaaaaaacgcgctcccgaacgcgaacgacgacgacgaaaacgccgaaaaaaaatttccgaaaccgcgcgctccccacccctcgcgctattatcgaaaatcgacaaaacgaaaaccgccccccaacgacgaaaaccgaaaactacgcgcgcacaaaaactacgacccccgccccccgccgacctcttcgcgatcacccacctccaacatcctaaccgaaacgaaacgaacgactaaactcgcgaacgaccgaatccctaccgatcgctataaaacacgacgtcccttcctacgtattatccacatttcctaaaccaacaacaattaattacgctactaaaacgcataaatactaaaatcccgaaataaaaaaaacgtaatcctaatcgccgacaaaacgcaataaaaaaaataaaatacaaaaccaaaaaaaaaaaaacaaacgtaccgaaaaacaaatacccccacatctacctctcac

SEQ ID NO: 37661 - DNA, 645 bp, Artificial Sequence
  chemically treated genomic DNA (Homo sapiens) CpG-island No: 37661
tttcgtcgtcgaagtttttttcgcggttttttttattttcgttttaggttcgtttatatttttgttcgggatttaagttcggtatcgtcgttttttttttcgtttcgtcgcgttagagtttggggtttcggtaattttcggcggcgggagttgtagagcgtaaggcgcgtttattgcgcgtgcgtttcggttcggttttttttgcgttttcggtttttgcgattgggatttggtacggtcgggcggttggcgttttttgcggtttttgttaggggcgggttttttaaattttttttttgaaggagtggcgacggttcggatagttcgcgttggagatggtaggggtcgagtttgtagggttttgcgtttcgtttggcggggttttttatttagtacgtgagttgcgggtaggtattttgtcgcggtaagcgtacggtatcggcgttttgtttttttcgtattgtttcgtttagtatttcgtaatattttttttcgtttttttatagtatttcggttttaaatatcgtacgtttagtttattcgtttcggcgttttattttcgtaattttattttttatttttagttttagtttattttattatttttttttttattttttttttttttttttttttttttttttt

SEQ ID NO: 37662 - DNA, 645 bp, Artificial Sequence
  chemically treated genomic DNA (Homo sapiens) CpG-island No: 37662
aaaaaaaaaaaaaaaaaaaaaaaaaaaaaaataaaaaaaaaaataataaaataaactaaaactaaaaataaaaaataaaattacgaaaataaaacgccgaaacgaataaactaaacgtacgatatttaaaaccgaaatactataaaaaaacgaaaaaaaatattacgaaatactaaacgaaacaatacgaaaaaaacaaaacgccgataccgtacgcttaccgcgacaaaatacctacccgcaactcacgtactaaataaaaaaccccgccaaacgaaacgcaaaaccctacaaactcgacccctaccatctccaacgcgaactatccgaaccgtcgccactccttcaaaaaaaaaatttaaaaaacccgcccctaacaaaaaccgcaaaaaacgccaaccgcccgaccgtaccaaatcccaatcgcaaaaaccgaaaacgcaaaaaaaaccgaaccgaaacgcacgcgcaataaacgcgccttacgctctacaactcccgccgccgaaaattaccgaaaccccaaactctaacgcgacgaaacgaaaaaaaaaacgacgataccgaacttaaatcccgaacaaaaatataaacgaacctaaaacgaaaataaaaaaaaccgcgaaaaaaacttcgacgacgaaa

SEQ ID NO: 37663 - DNA, 645 bp, Artificial Sequence
  chemically treated genomic DNA (Homo sapiens) CpG-island No: 37663
ggggggagaggggggggaaggggaggaagggtggggggggggatggtgggatggattaggattgagagtggggggtgaagttgcgggggtggagcgtcggagcgagtgggttaggcgtgcggtgtttggggtcggggtgttatagaggagcggggggaggtgttgcggggtgttgggcggggtaatgcgggaggggtagaacgtcggtgtcgtgcgtttgtcgcggtagggtgtttgttcgtaatttacgtgttgggtgggaagtttcgttaggcggagcgtaggattttgtaggttcggtttttgttatttttaacgcgaattgttcgggtcgtcgttatttttttaaagggaagatttgaaaagttcgtttttggtaggagtcgtagaggacgttaatcgttcggtcgtattaagttttagtcgtaggggtcgggggcgtaggaggagtcgggtcgaagcgtacgcgtagtgggcgcgttttgcgttttgtagttttcgtcgtcggaagttgtcgagattttaggttttagcgcggcggggcgggggagagggcggcggtgtcggatttaagtttcggatagggatgtgggcgggtttgggacgggagtgggaggggtcgcggggaaagtttcggcggcggag

SEQ ID NO: 37664 - DNA, 645 bp, Artificial Sequence
  chemically treated genomic DNA (Homo sapiens) CpG-island No: 37664
ctccgccgccgaaactttccccgcgacccctcccactcccgtcccaaacccgcccacatccctatccgaaacttaaatccgacaccgccgccctctcccccgccccgccgcgctaaaacctaaaatctcgacaacttccgacgacgaaaactacaaaacgcaaaacgcgcccactacgcgtacgcttcgacccgactcctcctacgcccccgacccctacgactaaaacttaatacgaccgaacgattaacgtcctctacgactcctaccaaaaacgaacttttcaaatcttccctttaaaaaaataacgacgacccgaacaattcgcgttaaaaataacaaaaaccgaacctacaaaatcctacgctccgcctaacgaaacttcccacccaacacgtaaattacgaacaaacaccctaccgcgacaaacgcacgacaccgacgttctacccctcccgcattaccccgcccaacaccccgcaacacctccccccgctcctctataacaccccgaccccaaacaccgcacgcctaacccactcgctccgacgctccacccccgcaacttcaccccccactctcaatcctaatccatcccaccatccccccccccacccttcctccccttcccccccctctcccccc

SEQ ID NO: 37665 - DNA, 941 bp, Artificial Sequence
  chemically treated genomic DNA (Homo sapiens) CpG-island No: 37665
ttcgtatcgggtaggagggtgggcgtgagtgcgcgttcgcgtgtggtttcgatgggaggcgaggcgttgggaggtcggggggcgcgggggcggtcggcgtcgttttttattttttcgatatttcgttttttttttttttttttcgtttttttttttcgggttcgttttcgtattgtttggttattttttttaggtgttcggggggaaaggacggttcgcgaattgggggaatttatgtgaggtttcgagttagggtttcggcggggcgcgaaggggcgtttgttattgagcgatttattcgcgttttcgacggcgtttgtacgtttttcgagttcgcggttttttacgtagttggtcgttatttcggacgcggtaggcgggattgcgtggggcgcgtcgagttttttcggggtgttttcgtcgttaaggtcgagggttcggggcggcgggaacgttgggttcgcgtttttttcgtttcggataggtattttagacgcgtcggggagttatagtttgcgcggtcggagtcgttcgcgggttattgggttcggttcggtcgcgttttgacggttttttttttggtcggttttcgttttcggaaggttttgtgcgagtcgggggaggtggggtttgggcgggcgcgggagggagtcggaggtgggtttcgcggtttttttcgggattcggcggggatattttttttttttttttttcgggcgcgttcgggtttgggaattggttgcgttttattggaagtgcgcggggtcgtttttttgtttttttcggtaattttgtcgtggcgttgcggttatttcgaggggatttttttgaaggtgtttcgtcggagagggtcggtgttttaaggtcgcgggtcgttgggtttgttatggagaagtggcggggattcgttttaagttgagggattacgagggaggagtggg

SEQ ID NO: 37666 - DNA, 941 bp, Artificial Sequence
  chemically treated genomic DNA (Homo sapiens) CpG-island No: 37666
cccactcctccctcgtaatccctcaacttaaaacgaatccccgccacttctccataacaaacccaacgacccgcgaccttaaaacaccgaccctctccgacgaaacaccttcaaaaaaatcccctcgaaataaccgcaacgccacgacaaaattaccgaaaaaaacaaaaaaacgaccccgcgcacttccaataaaacgcaaccaattcccaaacccgaacgcgcccgaaaaaaaaaaaaaaaaaatatccccgccgaatcccgaaaaaaaccgcgaaacccacctccgactccctcccgcgcccgcccaaaccccacctcccccgactcgcacaaaaccttccgaaaacgaaaaccgaccaaaaaaaaaaccgtcaaaacgcgaccgaaccgaacccaataacccgcgaacgactccgaccgcgcaaactataactccccgacgcgtctaaaatacctatccgaaacgaaaaaaacgcgaacccaacgttcccgccgccccgaaccctcgaccttaacgacgaaaacaccccgaaaaaactcgacgcgccccacgcaatcccgcctaccgcgtccgaaataacgaccaactacgtaaaaaaccgcgaactcgaaaaacgtacaaacgccgtcgaaaacgcgaataaatcgctcaataacaaacgccccttcgcgccccgccgaaaccctaactcgaaacctcacataaattcccccaattcgcgaaccgtcctttccccccgaacacctaaaaaaaataaccaaacaatacgaaaacgaacccgaaaaaaaaaaacgaaaaaaaaaaaaaaaaaacgaaatatcgaaaaaataaaaaacgacgccgaccgcccccgcgccccccgacctcccaacgcctcgcctcccatcgaaaccacacgcgaacgcgcactcacgcccaccctcctacccgatacgaa

SEQ ID NO: 37667 - DNA, 941 bp, Artificial Sequence
  chemically treated genomic DNA (Homo sapiens) CpG-island No: 37667
tttatttttttttcgtggttttttaatttgggacgggttttcgttatttttttatgataggtttagcggttcgcggttttggggtatcggtttttttcggcgagatatttttaggaaggttttttcggggtggtcgtaacgttacggtaaagttatcggggaaagtaaaagggcggtttcgcgtatttttaataggacgtagttagtttttaggttcggacgcgttcgagaggagggggaagggagtgttttcgtcgaatttcgagaaaggtcgcgggatttattttcggttttttttcgcgttcgtttaggttttatttttttcggttcgtataaagtttttcgagggcgggggtcggttaggggggaggtcgttaggacgcggtcggatcgggtttagtgattcgcgggcggtttcggtcgcgtaggttgtggtttttcgacgcgtttggagtgtttgttcgggacgggaaggacgcgagtttagcgttttcgtcgtttcgagttttcggttttgacggcgagagtatttcgagaaggttcggcgcgttttacgtagtttcgtttgtcgcgttcgaggtggcggttaattgcgtggagggtcgcgagttcgaggggcgtgtagacgtcgtcgggggcgcgggtgaatcgtttagtggtaggcgttttttcgcgtttcgtcgaggttttaattcgaggttttatatgagtttttttagttcgcgaatcgtttttttttttcgggtatttgaggaaggtggttaaataatgcgggggcggattcgggggagggaggcgggggaggggggaggaaggcgggatgtcgagggagtgggggacggcgtcggtcgttttcgcgtttttcggttttttagcgtttcgttttttatcggggttatacgcgggcgcgtatttacgtttatttttttgttcggtgcgag

SEQ ID NO: 37668 - DNA, 941 bp, Artificial Sequence
  chemically treated genomic DNA (Homo sapiens) CpG-island No: 37668
ctcgcaccgaacaaaaaaataaacgtaaatacgcgcccgcgtataaccccgataaaaaacgaaacgctaaaaaaccgaaaaacgcgaaaacgaccgacgccgtcccccactccctcgacatcccgccttcctcccccctcccccgcctccctcccccgaatccgcccccgcattatttaaccaccttcctcaaatacccgaaaaaaaaaaacgattcgcgaactaaaaaaactcatataaaacctcgaattaaaacctcgacgaaacgcgaaaaaacgcctaccactaaacgattcacccgcgcccccgacgacgtctacacgcccctcgaactcgcgaccctccacgcaattaaccgccacctcgaacgcgacaaacgaaactacgtaaaacgcgccgaaccttctcgaaatactctcgccgtcaaaaccgaaaactcgaaacgacgaaaacgctaaactcgcgtccttcccgtcccgaacaaacactccaaacgcgtcgaaaaaccacaacctacgcgaccgaaaccgcccgcgaatcactaaacccgatccgaccgcgtcctaacgacctcccccctaaccgacccccgccctcgaaaaactttatacgaaccgaaaaaaataaaacctaaacgaacgcgaaaaaaaaccgaaaataaatcccgcgacctttctcgaaattcgacgaaaacactcccttccccctcctctcgaacgcgtccgaacctaaaaactaactacgtcctattaaaaatacgcgaaaccgcccttttactttccccgataactttaccgtaacgttacgaccaccccgaaaaaaccttcctaaaaatatctcgccgaaaaaaaccgataccccaaaaccgcgaaccgctaaacctatcataaaaaaataacgaaaacccgtcccaaattaaaaaaccacgaaaaaaaaataaa

SEQ ID NO: 37669 - DNA, 883 bp, Artificial Sequence
  chemically treated genomic DNA (Homo sapiens) CpG-island No: 37669
aatatcggtagggatgttcgattgtagtttgggttttcgtttgtagagcgcggcggcggagggcgtagtaagtcgggtagttatcgggtgttggagaatttcgtatcgtatttgttggacgtggacgtagatagcgggtttttttatattaagtagcgtatcgatcgcgagtttttgtgtcgttataatgttaagtgttagttgtttttcgaggtgttcgttaacgataaggagatttgtatgattaaggtagagatttaggatattaacgataacgcgtttttttttttttcggattagatcgaaatggatatttcggagaacgttgtttcgggtattcgttttttttttattagcgtatatgatttcgacgtcggcgagaatgggtttcgtatttatttgtttacgcgcgacgattacggtttttttggattggacgttaagtttcgcggcgacggtattaagtttttagaattggttatttagaaggttttggatcgcgagtaatagaattattatacgttcgtgttgattgttttggacggtggcgagtttttacgtttcgttatcgtatagattaacgtgaaggtgattgattttaacgataatagttcggttttcgaggcgttattttatttggtggaattgttcgagaacgtttcgttgggtatagtggttatcgatttgaacgttatcgacgtcgatgaaggttttaatggtgaagtgttttatttttttagtagttacgtgtttgatcgcgtgcgggagtttttttttatcgattttaagatcggtttaattcgtgtgaagggtaatttggattatgaggaaaacgggatgttggagattgacgtgtaggttcgagatttggggtttaatttta

SEQ ID NO: 37670 - DNA, 883 bp, Artificial Sequence
  chemically treated genomic DNA (Homo sapiens) CpG-island No: 37670
taaaattaaaccccaaatctcgaacctacacgtcaatctccaacatcccgttttcctcataatccaaattacccttcacacgaattaaaccgatcttaaaatcgataaaaaaaaactcccgcacgcgatcaaacacgtaactactaaaaaaataaaacacttcaccattaaaaccttcatcgacgtcgataacgttcaaatcgataaccactatacccaacgaaacgttctcgaacaattccaccaaataaaataacgcctcgaaaaccgaactattatcgttaaaatcaatcaccttcacgttaatctatacgataacgaaacgtaaaaactcgccaccgtccaaaacaatcaacacgaacgtataataattctattactcgcgatccaaaaccttctaaataaccaattctaaaaacttaataccgtcgccgcgaaacttaacgtccaatccaaaaaaaccgtaatcgtcgcgcgtaaacaaataaatacgaaacccattctcgccgacgtcgaaatcatatacgctaataaaaaaaaaacgaatacccgaaacaacgttctccgaaatatccatttcgatctaatccgaaaaaaaaaaaaacgcgttatcgttaatatcctaaatctctaccttaatcatacaaatctccttatcgttaacgaacacctcgaaaaacaactaacacttaacattataacgacacaaaaactcgcgatcgatacgctacttaatataaaaaaacccgctatctacgtccacgtccaacaaatacgatacgaaattctccaacacccgataactacccgacttactacgccctccgccgccgcgctctacaaacgaaaacccaaactacaatcgaacatccctaccgatatt

SEQ ID NO: 37671 - DNA, 883 bp, Artificial Sequence
  chemically treated genomic DNA (Homo sapiens) CpG-island No: 37671
tagggttaggttttaggtttcgggtttgtacgttaatttttagtatttcgttttttttatagtttagattgttttttatacggattaggtcggttttggggtcgatggagaagagttttcgtacgcggttaggtacgtagttgttgaaagagtagagtattttattattgggatttttatcggcgtcggtggcgtttagatcgatgattattgtatttagcggagcgttttcgggtagttttattaagtaggatggcgtttcgaagatcgggttgttgtcgttggagttaattatttttacgttgatttgtacggtggcggaacgtggaggttcgttatcgtttagggtagttagtacgagcgtatggtgattttgttgttcgcggtttagagttttttggatgattagttttgggaatttggtgtcgtcgtcgcgggatttaacgtttagtttaaagaggtcgtgatcgtcgcgcgtgagtaggtaggtgcggagtttattttcgtcggcgtcggggttatgtgcgttggtgagggggaagcgggtgttcggagtagcgtttttcgagatgtttatttcgatttggttcgaggagaaggagggcgcgttgtcgttgatgttttggatttttattttgattatgtagatttttttgtcgttggcgaatatttcgagggatagttggtatttggtattgtggcggtatagggattcgcggtcgatgcgttgtttggtgtagaggagttcgttgtttgcgtttacgtttagtaggtgcggtgcggagttttttagtattcggtagttattcgatttgttgcgtttttcgtcgtcgcgttttgtaggcggaagtttaggttgtagtcgagtatttttgtcgatgtt

SEQ ID NO: 37672 - DNA, 883 bp, Artificial Sequence
  chemically treated genomic DNA (Homo sapiens) CpG-island No: 37672
aacatcgacaaaaatactcgactacaacctaaacttccgcctacaaaacgcgacgacgaaaaacgcaacaaatcgaataactaccgaatactaaaaaactccgcaccgcacctactaaacgtaaacgcaaacaacgaactcctctacaccaaacaacgcatcgaccgcgaatccctataccgccacaataccaaataccaactatccctcgaaatattcgccaacgacaaaaaaatctacataatcaaaataaaaatccaaaacatcaacgacaacgcgccctccttctcctcgaaccaaatcgaaataaacatctcgaaaaacgctactccgaacacccgcttccccctcaccaacgcacataaccccgacgccgacgaaaataaactccgcacctacctactcacgcgcgacgatcacgacctctttaaactaaacgttaaatcccgcgacgacgacaccaaattcccaaaactaatcatccaaaaaactctaaaccgcgaacaacaaaatcaccatacgctcgtactaactaccctaaacgataacgaacctccacgttccgccaccgtacaaatcaacgtaaaaataattaactccaacgacaacaacccgatcttcgaaacgccatcctacttaataaaactacccgaaaacgctccgctaaatacaataatcatcgatctaaacgccaccgacgccgataaaaatcccaataataaaatactctactctttcaacaactacgtacctaaccgcgtacgaaaactcttctccatcgaccccaaaaccgacctaatccgtataaaaaacaatctaaactataaaaaaaacgaaatactaaaaattaacgtacaaacccgaaacctaaaacctaacccta

SEQ ID NO: 37673 - DNA, 1300 bp, Artificial Sequence
  chemically treated genomic DNA (Homo sapiens) CpG-island No: 37673
tcgatcgtaacgataatgcgtcgtttatcggtttcgttttcgtgcgttagggggcgttgagcgaggtcgtttttttcggtatcgttatcgttttggtgcgggttattgatcgggattttggtaagaacggatagttgtagtgtcgggttttaggcggaggagggacgggcggcggcgggggtttgggcgggttcgggggtttcgttttttttaagtttgaggagaattacgataatttttatacggtggtgattgatcgttcgttggatcgcgagatataagacgagtataacgtgattatcgtggcgcgggacgggggtttttttttttttaattttattaagtcgttcgcgattaagattttagacgagaacgataattcgtttcggtttattaaagggttttacgtgttttaggtgtacgagaataatatttcgggagagtatttgggttttgtgttcgtttaggatttcgatttgggttagaacggtatcgtattttattttattttgttttcgtatatcggcgacgtgtttatttatatttatgtgtttgtgaattttacgaacggggttatttacgttttgcgtttttttaatttcgagtagattaaggtttttgagtttaaggtgtttgttaaggattcgggggcgttcgcgtatttggagagtaacgttacggtgagggtgatagtgttagacgtgaatgataacgcgttagtgatcgtgttttttacgttgtagaacgatatcgcggagttgtaggtgtcgcgtaacgttggtttgggttatttggtgagtattgtgcgcgttttagatagcgatttcggcgagagcgggcgttttatttacgagatcgtggacggtaacgacgattatttgtttgagatcgattcgtttagcggcgagattcgtacgttgtattttttttgggaggacgtgacgttcgtggtggagttggtggtgaaggtgatcgattacggtaagtttattttgttcgtagtggttaagtttattattcgttcggtgagcggattttttttcgagggggtattacgggtgaatggcgagtagtattattgggatatgtcgttgtcgtttatcgtgattttgagtattatttttattatttttttagcggttatgattattatcgtcgttaagtgtaagcgcgagaataaggagattcgtatttataattgtcgtatcgtcgagtatagttattcgtagttgggtgggggtaagggtaagaagaagaagattaataaaaatgatattatgttggtgtagagcgaagtgga

SEQ ID NO: 37674 - DNA, 1300 bp, Artificial Sequence
  chemically treated genomic DNA (Homo sapiens) CpG-island No: 37674
tccacttcgctctacaccaacataatatcatttttattaatcttcttcttcttacccttacccccacccaactacgaataactatactcgacgatacgacaattataaatacgaatctccttattctcgcgcttacacttaacgacgataataatcataaccgctaaaaaaataataaaaataatactcaaaatcacgataaacgacaacgacatatcccaataatactactcgccattcacccgtaataccccctcgaaaaaaaatccgctcaccgaacgaataataaacttaaccactacgaacaaaataaacttaccgtaatcgatcaccttcaccaccaactccaccacgaacgtcacgtcctcccaaaaaaaatacaacgtacgaatctcgccgctaaacgaatcgatctcaaacaaataatcgtcgttaccgtccacgatctcgtaaataaaacgcccgctctcgccgaaatcgctatctaaaacgcgcacaatactcaccaaataacccaaaccaacgttacgcgacacctacaactccgcgatatcgttctacaacgtaaaaaacacgatcactaacgcgttatcattcacgtctaacactatcaccctcaccgtaacgttactctccaaatacgcgaacgcccccgaatccttaacaaacaccttaaactcaaaaaccttaatctactcgaaattaaaaaaacgcaaaacgtaaataaccccgttcgtaaaattcacaaacacataaatataaataaacacgtcgccgatatacgaaaacaaaataaaataaaatacgataccgttctaacccaaatcgaaatcctaaacgaacacaaaacccaaatactctcccgaaatattattctcgtacacctaaaacacgtaaaaccctttaataaaccgaaacgaattatcgttctcgtctaaaatcttaatcgcgaacgacttaataaaattaaaaaaaaaaaaacccccgtcccgcgccacgataatcacgttatactcgtcttatatctcgcgatccaacgaacgatcaatcaccaccgtataaaaattatcgtaattctcctcaaacttaaaaaaaacgaaacccccgaacccgcccaaacccccgccgccgcccgtccctcctccgcctaaaacccgacactacaactatccgttcttaccaaaatcccgatcaataacccgcaccaaaacgataacgataccgaaaaaaacgacctcgctcaacgccccctaacgcacgaaaacgaaaccgataaacgacgcattatcgttacgatcga

SEQ ID NO: 37675 - DNA, 1300 bp, Artificial Sequence
  chemically treated genomic DNA (Homo sapiens) CpG-island No: 37675
tttatttcgttttgtattagtatgatattatttttgttgatttttttttttttgtttttgtttttatttagttgcgggtggttgtattcggcgatgcggtagttgtaagtgcggatttttttgttttcgcgtttgtatttgacggcgatggtgattatggtcgttaggaggatgatggagatagtgtttagagttacgatgagcggtagcgatatgttttagtggtgttgttcgttatttattcgtggtattttttcgggaagggattcgtttatcgagcggatgatgagtttggttattgcggatagggtaggtttgtcgtggtcggttatttttattattagttttattacgggcgttacgtttttttagaaagggtgtagcgtgcggatttcgtcgttggacgggtcgattttaaataggtggtcgtcgttgtcgtttacgatttcgtaggtgagacgttcgttttcgtcgaagtcgttgtttagggcgcgtatagtgtttattagatagtttaggttagcgttgcgcggtatttgtagtttcgcggtgtcgttttgtagcgtggggagtacgattattggcgcgttgttatttacgtttagtattgttatttttatcgtggcgttgttttttaagtgcgcgggcgttttcgagtttttagtaagtattttgaatttaaaagttttggtttgttcgaagttaaaggagcgtagggcgtagatggtttcgttcgtgggatttatagatatataggtgtagatagatacgtcgtcgatgtgcgagggtaggatagagtaggatacggtgtcgttttggtttaggtcgggattttgggcgagtatagagtttaggtattttttcgggatgttgttttcgtgtatttgaagtacgtagagttttttggtgaatcgaggcgggttgtcgttttcgtttagaattttgatcgcgaacgatttggtggagttgaggggaggagagttttcgtttcgcgttacgatggttacgttgtattcgttttgtgtttcgcggtttagcgggcggttagttattatcgtgtagaagttgtcgtagttttttttaagtttgaaggggacggaattttcgggttcgtttaggttttcgtcgtcgttcgtttttttttcgtttaggattcgatattgtagttgttcgtttttgttagagtttcggttagtgattcgtattagggcgatgacggtgtcgggaggggcggtttcgtttagcgttttttggcgtacggagacgaaatcgatggacggcgtattgtcgttgcggtcga

SEQ ID NO: 37676 - DNA, 1300 bp, Artificial Sequence
  chemically treated genomic DNA (Homo sapiens) CpG-island No: 37676
tcgaccgcaacgacaatacgccgtccatcgatttcgtctccgtacgccaaaaaacgctaaacgaaaccgcccctcccgacaccgtcatcgccctaatacgaatcactaaccgaaactctaacaaaaacgaacaactacaatatcgaatcctaaacgaaaaaaaaacgaacgacgacgaaaacctaaacgaacccgaaaattccgtccccttcaaacttaaaaaaaactacgacaacttctacacgataataactaaccgcccgctaaaccgcgaaacacaaaacgaatacaacgtaaccatcgtaacgcgaaacgaaaactctcctcccctcaactccaccaaatcgttcgcgatcaaaattctaaacgaaaacgacaacccgcctcgattcaccaaaaaactctacgtacttcaaatacacgaaaacaacatcccgaaaaaatacctaaactctatactcgcccaaaatcccgacctaaaccaaaacgacaccgtatcctactctatcctaccctcgcacatcgacgacgtatctatctacacctatatatctataaatcccacgaacgaaaccatctacgccctacgctcctttaacttcgaacaaaccaaaacttttaaattcaaaatacttactaaaaactcgaaaacgcccgcgcacttaaaaaacaacgccacgataaaaataacaatactaaacgtaaataacaacgcgccaataatcgtactccccacgctacaaaacgacaccgcgaaactacaaataccgcgcaacgctaacctaaactatctaataaacactatacgcgccctaaacaacgacttcgacgaaaacgaacgtctcacctacgaaatcgtaaacgacaacgacgaccacctatttaaaatcgacccgtccaacgacgaaatccgcacgctacaccctttctaaaaaaacgtaacgcccgtaataaaactaataataaaaataaccgaccacgacaaacctaccctatccgcaataaccaaactcatcatccgctcgataaacgaatcccttcccgaaaaaataccacgaataaataacgaacaacaccactaaaacatatcgctaccgctcatcgtaactctaaacactatctccatcatcctcctaacgaccataatcaccatcgccgtcaaatacaaacgcgaaaacaaaaaaatccgcacttacaactaccgcatcgccgaatacaaccacccgcaactaaataaaaacaaaaacaaaaaaaaaaaaatcaacaaaaataatatcatactaatacaaaacgaaataaa

SEQ ID NO: 37677 - DNA, 520 bp, Artificial Sequence
  chemically treated genomic DNA (Homo sapiens) CpG-island No: 37677
acgaattttttttaggtttataggcggttcgggtggtcggtgattgttttttcgagtgtcgggtattcggttatggcgttttcgggtcgtttaagaagtaagagttagagttttttaaggtcgttcgttggtttttgggatgtggggtcgattttttatattcgggtagtatgcggtcgttattaagcggcggggcgggaggacggttttggggcgggatttcgggtcgggagaacgattttggggcggggcgtaaggtaggatggggcggggtttgtgggggttttggtggtaagtgagggtttcgcgtaggcgttacgtttcggtttgatttgttttttggaacggtggtagtttttgggaacgtagattcggttttagttggttcgcgtttttttcgaggtttcggttagtagcgatatcgatcgtcgttttttgttgttgttggagaggtatcggggtgattttggttttttttttttttggaagattttttcgtttttttcggttgtcggatcgg

SEQ ID NO: 37678 - DNA, 520 bp, Artificial Sequence
  chemically treated genomic DNA (Homo sapiens) CpG-island No: 37678
ccgatccgacaaccgaaaaaaacgaaaaaatcttccaaaaaaaaaaaaaaccaaaatcaccccgatacctctccaacaacaacaaaaaacgacgatcgatatcgctactaaccgaaacctcgaaaaaaacgcgaaccaactaaaaccgaatctacgttcccaaaaactaccaccgttccaaaaaacaaatcaaaccgaaacgtaacgcctacgcgaaaccctcacttaccaccaaaacccccacaaaccccgccccatcctaccttacgccccgccccaaaatcgttctcccgacccgaaatcccgccccaaaaccgtcctcccgccccgccgcttaataacgaccgcatactacccgaatataaaaaatcgaccccacatcccaaaaaccaacgaacgaccttaaaaaactctaactcttacttcttaaacgacccgaaaacgccataaccgaatacccgacactcgaaaaaacaatcaccgaccacccgaaccgcctataaacctaaaaaaaattcgt

SEQ ID NO: 37679 - DNA, 520 bp, Artificial Sequence
  chemically treated genomic DNA (Homo sapiens) CpG-island No: 37679
tcggttcggtagtcgagggaagcgggggggttttttagaagaagaaagggttaaggttatttcggtgtttttttagtagtagtagagggcggcggtcggtgtcgttgttggtcggggtttcgaggaaggcgcgggttagttggggtcgggtttgcgtttttaggagttgttatcgttttagggagtaagttaggtcgggacgtagcgtttgcgcgggatttttatttgttattaagatttttataaatttcgttttattttgttttacgtttcgttttaaggtcgttttttcgattcggggtttcgttttaaggtcgttttttcgtttcgtcgtttggtggcggtcgtatgttgttcggatataaagggtcggttttatattttagggattagcgagcggttttgagaggttttggtttttgttttttaggcggttcgaggacgttatggtcgagtgttcgatattcggggaggtagttatcgattattcggatcgtttgtgggtttgggagaagttcgt

SEQ ID NO: 37680 - DNA, 520 bp, Artificial Sequence
  chemically treated genomic DNA (Homo sapiens) CpG-island No: 37680
acgaacttctcccaaacccacaaacgatccgaataatcgataactacctccccgaatatcgaacactcgaccataacgtcctcgaaccgcctaaaaaacaaaaaccaaaacctctcaaaaccgctcgctaatccctaaaatataaaaccgaccctttatatccgaacaacatacgaccgccaccaaacgacgaaacgaaaaaacgaccttaaaacgaaaccccgaatcgaaaaaacgaccttaaaacgaaacgtaaaacaaaataaaacgaaatttataaaaatcttaataacaaataaaaatcccgcgcaaacgctacgtcccgacctaacttactccctaaaacgataacaactcctaaaaacgcaaacccgaccccaactaacccgcgccttcctcgaaaccccgaccaacaacgacaccgaccgccgccctctactactactaaaaaaacaccgaaataaccttaaccctttcttcttctaaaaaacccccccgcttccctcgactaccgaaccga

SEQ ID NO: 37681 - DNA, 670 bp, Artificial Sequence
  chemically treated genomic DNA (Homo sapiens) CpG-island No: 37681
cgttagcgaggtatagcgcgattcgcgcgcgggttcggcgttattggttgaggacgtgtaggtggattcgcgtaaggattcgtatagtagtttcgagcgttttttagagtagtcgtattcgtttatggagcgcgttttcgaggtcgattacgggcgtttttgcgattataaggtggggtcgtcgttttatttggataagttgttgtggcgcgataataagtcgtattattattcggagtttaagtttattttggatttgtcgtattggaagtaggcggtcggcgcgttttttacggttacggggttggcggatacgggggcgcgcgaggacgagtcggttagtttttttttggagatcgcgtagtgggttaagagtacgtagggcggtttagagtacgttagttcgttcgtcgacgatttcgagcgtcgtttgtttgtttcgtttttcggtcgttcggtttcggtggacggcggcgttagtttttagttcgatttggacgtgtttatttttcgcgttttgaagttttgtattaagttcgaggatttgtcggataataaattgggcgattttaatggtgcgtgtattttcgagtattttggcgatttcgtgtagatcgaggttttttttaaagaaaggtggtgagggcggaggggtcgttttaggttttat

SEQ ID NO: 37682 - DNA, 670 bp, Artificial Sequence
  chemically treated genomic DNA (Homo sapiens) CpG-island No: 37682
ataaaacctaaaacgacccctccgccctcaccacctttctttaaaaaaaacctcgatctacacgaaatcgccaaaatactcgaaaatacacgcaccattaaaatcgcccaatttattatccgacaaatcctcgaacttaatacaaaacttcaaaacgcgaaaaataaacacgtccaaatcgaactaaaaactaacgccgccgtccaccgaaaccgaacgaccgaaaaacgaaacaaacaaacgacgctcgaaatcgtcgacgaacgaactaacgtactctaaaccgccctacgtactcttaacccactacgcgatctccaaaaaaaaactaaccgactcgtcctcgcgcgcccccgtatccgccaaccccgtaaccgtaaaaaacgcgccgaccgcctacttccaatacgacaaatccaaaataaacttaaactccgaataataatacgacttattatcgcgccacaacaacttatccaaataaaacgacgaccccaccttataatcgcaaaaacgcccgtaatcgacctcgaaaacgcgctccataaacgaatacgactactctaaaaaacgctcgaaactactatacgaatccttacgcgaatccacctacacgtcctcaaccaataacgccgaacccgcgcgcgaatcgcgctatacctcgctaacg

SEQ ID NO: 37683 - DNA, 670 bp, Artificial Sequence
  chemically treated genomic DNA (Homo sapiens) CpG-island No: 37683
gtggggtttggagcggttttttcgtttttattatttttttttggagaaggtttcggtttgtacgaggtcgttagggtgttcggggatgtacgtattattgaggtcgtttagtttattgttcggtaggttttcgggtttggtgtagagttttagggcgcgggagatgaatacgtttaggtcgaattgggggttggcgtcgtcgtttatcggggtcgggcggtcggggggcgaggtagataagcggcgttcggggtcgtcggcgggcgggttggcgtgttttgggtcgttttgcgtgtttttgatttattgcgcgatttttaggaagaggttggtcggttcgttttcgcgcgttttcgtgttcgttagtttcgtggtcgtggggggcgcgtcggtcgtttgtttttagtgcgataggtttaggatgagtttgggtttcgagtagtggtgcggtttgttgtcgcgttatagtagtttgtttaggtaggacggcgattttattttgtagtcgtaggagcgttcgtagtcggtttcgaaggcgcgttttatggacgagtgcgattgttttaggaagcgttcggagttgttgtgcgagtttttgcgcgggtttatttgtacgtttttagttagtggcgtcgaattcgcgcgcgggtcgcgttgtatttcgttggcg

SEQ ID NO: 37684 - DNA, 670 bp, Artificial Sequence
  chemically treated genomic DNA (Homo sapiens) CpG-island No: 37684
cgccaacgaaatacaacgcgacccgcgcgcgaattcgacgccactaactaaaaacgtacaaataaacccgcgcaaaaactcgcacaacaactccgaacgcttcctaaaacaatcgcactcgtccataaaacgcgccttcgaaaccgactacgaacgctcctacgactacaaaataaaatcgccgtcctacctaaacaaactactataacgcgacaacaaaccgcaccactactcgaaacccaaactcatcctaaacctatcgcactaaaaacaaacgaccgacgcgccccccacgaccacgaaactaacgaacacgaaaacgcgcgaaaacgaaccgaccaacctcttcctaaaaatcgcgcaataaatcaaaaacacgcaaaacgacccaaaacacgccaacccgcccgccgacgaccccgaacgccgcttatctacctcgccccccgaccgcccgaccccgataaacgacgacgccaacccccaattcgacctaaacgtattcatctcccgcgccctaaaactctacaccaaacccgaaaacctaccgaacaataaactaaacgacctcaataatacgtacatccccgaacaccctaacgacctcgtacaaaccgaaaccttctccaaaaaaaaataataaaaacgaaaaaaccgctccaaaccccac

SEQ ID NO: 37685 - DNA, 681 bp, Artificial Sequence
  chemically treated genomic DNA (Homo sapiens) CpG-island No: 37685
gtagtcgggtatcgtcggtttgtgggcgatatttttttagcgttatcgttatttgagagcgtaaatttataattcgtttttgtttcgggaataacgttaagaattgttttttcgtttgggtgcggttttgcgttatttgttcgttgacgttttataacgttacgtttcgttttattgttagcgtaattagaattagtaatatcggtagaattattattcgttagcgcgtttattgttttcggtagttgacgcgaggttgttacggttttgttagtaggttttttttcggttcgttataagtggtaatggcgggtagagttgtaacggttaggcgtttagcgtttgcgttagtttatgttgatagttttttcggtgtaatgtcgattacggttagcgaaagcggtaaattttgtttattgagttgggcgcggaatatgatcggagttagcgttagttcggcgttttattttcggtatttatcgatgcggtagataattcgttgcgtatcgtaagttataaatttataaggaatggatatttagttcggcgcgacggtagcgcgggtgatgtcgtttttttgtaattattgcgtaatgttgcgtatatgttgttggtgaattattgttacggttgttagttgttggtcgatatttaacggggcgaaatgtagtttatcgatat

SEQ ID NO: 37686 - DNA, 681 bp, Artificial Sequence
  chemically treated genomic DNA (Homo sapiens) CpG-island No: 37686
atatcgataaactacatttcgccccgttaaatatcgaccaacaactaacaaccgtaacaataattcaccaacaacatatacgcaacattacgcaataattacaaaaaaacgacatcacccgcgctaccgtcgcgccgaactaaatatccattccttataaatttataacttacgatacgcaacgaattatctaccgcatcgataaataccgaaaataaaacgccgaactaacgctaactccgatcatattccgcgcccaactcaataaacaaaatttaccgctttcgctaaccgtaatcgacattacaccgaaaaaactatcaacataaactaacgcaaacgctaaacgcctaaccgttacaactctacccgccattaccacttataacgaaccgaaaaaaaacctactaacaaaaccgtaacaacctcgcgtcaactaccgaaaacaataaacgcgctaacgaataataattctaccgatattactaattctaattacgctaacaataaaacgaaacgtaacgttataaaacgtcaacgaacaaataacgcaaaaccgcacccaaacgaaaaaacaattcttaacgttattcccgaaacaaaaacgaattataaatttacgctctcaaataacgataacgctaaaaaaatatcgcccacaaaccgacgatacccgactac

SEQ ID NO: 37687 - DNA, 681 bp, Artificial Sequence
  chemically treated genomic DNA (Homo sapiens) CpG-island No: 37687
atatcgatgaattgtatttcgtttcgttgaatatcgattagtaattggtaatcgtagtagtgatttattaatagtatatgcgtaatattgcgtagtggttgtaggaaaacggtattattcgcgttatcgtcgcgtcggattggatgtttattttttgtgggtttatggtttgcgatgcgtaacgggttatttgtcgtatcgatgaatgtcggggatggagcgtcgggttggcgttggtttcggttatgtttcgcgtttagtttaatgagtaggatttatcgttttcgttaatcgtagtcggtattgtatcggaaaagttattagtatgggttggcgtagacgttgaacgtttgatcgttatagttttgttcgttattattatttatggcgaatcggaagggaatttgttgatagggtcgtggtagtttcgcgttagttatcgaaaatagtgggcgcgttggcgggtgatgattttgtcgatattgttgattttggttgcgttggtagtggagcggggcgtgacgttatggagcgttagcgaataggtggcgtaaagtcgtatttaggcggaggaatagtttttaacgttgttttcggagtagaagcggattgtgaatttacgtttttaggtgacgatggcgttgaaaaaatatcgtttataggtcgacgatattcggttgt

SEQ ID NO: 37688 - DNA, 681 bp, Artificial Sequence
  chemically treated genomic DNA (Homo sapiens) CpG-island No: 37688
acaaccgaatatcgtcgacctataaacgatattttttcaacgccatcgtcacctaaaaacgtaaattcacaatccgcttctactccgaaaacaacgttaaaaactattcctccgcctaaatacgactttacgccacctattcgctaacgctccataacgtcacgccccgctccactaccaacgcaaccaaaatcaacaatatcgacaaaatcatcacccgccaacgcgcccactattttcgataactaacgcgaaactaccacgaccctatcaacaaattcccttccgattcgccataaataataataacgaacaaaactataacgatcaaacgttcaacgtctacgccaacccatactaataacttttccgatacaataccgactacgattaacgaaaacgataaatcctactcattaaactaaacgcgaaacataaccgaaaccaacgccaacccgacgctccatccccgacattcatcgatacgacaaataacccgttacgcatcgcaaaccataaacccacaaaaaataaacatccaatccgacgcgacgataacgcgaataataccgttttcctacaaccactacgcaatattacgcatatactattaataaatcactactacgattaccaattactaatcgatattcaacgaaacgaaatacaattcatcgatat

SEQ ID NO: 37689 - DNA, 1215 bp, Artificial Sequence
  chemically treated genomic DNA (Homo sapiens) CpG-island No: 37689
  misc_feature (31)..(31): n is either a, c, g or t
gtggagggagggggtcgggagcggacggtgncggtgggtaattattgtttttagcgttaagttttgtgtcgtcgtcgtcgtttaggcgtttgggggtcggtggggcggcgcgggcgggggtcgttgcgcgggcggcgagtttttgttttgtttttttttttttttgtggagcggttcgggttgttggggaggtttcggtttttttcggacgttcggttaacggcggcggttagttcgcggttttgttgagagggaaaaggacgtcgcggtttttttaggcgtcgcggagagtaggtaagagcgcgggtagtcgaggttggtgagagggagcgcgaagggcgcggcgataaagtttggttgtttcgattgtcgtcgttttttttcgcgttttcgtttcgcgtttgtgttgtttgtttcggggtttgcggaggggtttttcggcggttgcggcggtgatatcggtcgggggttgggggaagggggttgagtgtttttaggtaacggtcgcggagcgggatttggagaaaggggaaggcgcgttgcgtttcgttcgcggggagcggggcgcggggtagggttgagggaagaggttatagatttcggcgggggggatgggtcgagcgtagttggttttttcgtgtttatatttttgcgcgagttatttttgtcgagaagcggattgaattgattcgttttatttcgcggggaggttagggcgggggttcggtttcggaggaagcgcgttttgggagggtttgtgtagggcgggagtttgcggtcggcgtcggggttgggcggcgagttcggggcgggatttgggaggtttcggtcgttttgggtggcgggtaggcgggggggggcgttggatattagtttttttttttgtcgtgttttatcgtcgtcgtttatttttttttttcggcgttgttagtttgtacgataggttgtattcggtagtttttttattttcgttttttacgtcggtatcgtgttgttatttttttttatttttcgggaggtagggaggttttgttcggatcggaatttgttttttaagtaaaataaaaacgggttcgtaataggtacgtttagtgatcgttttttggattttcgcgaacgtggtttttagggatcgcgcgacgggatggtttaggggcgcggaaggaggatagggagggttttgttagggttggatgttgattttattttaggagt

SEQ ID NO: 37690 - DNA, 1215 bp, Artificial Sequence
  chemically treated genomic DNA (Homo sapiens) CpG-island No: 37690
  misc_feature (1185)..(1185): n is either a, c, g or t
actcctaaaataaaatcaacatccaaccctaacaaaaccctccctatcctccttccgcgcccctaaaccatcccgtcgcgcgatccctaaaaaccacgttcgcgaaaatccaaaaaacgatcactaaacgtacctattacgaacccgtttttattttacttaaaaaacaaattccgatccgaacaaaacctccctacctcccgaaaaataaaaaaaaataacaacacgataccgacgtaaaaaacgaaaataaaaaaactaccgaatacaacctatcgtacaaactaacaacgccgaaaaaaaaaaataaacgacgacgataaaacacgacaaaaaaaaaaactaatatccaacgcccccccccgcctacccgccacccaaaacgaccgaaacctcccaaatcccgccccgaactcgccgcccaaccccgacgccgaccgcaaactcccgccctacacaaaccctcccaaaacgcgcttcctccgaaaccgaacccccgccctaacctccccgcgaaataaaacgaatcaattcaatccgcttctcgacaaaaataactcgcgcaaaaatataaacacgaaaaaaccaactacgctcgacccatcccccccgccgaaatctataacctcttccctcaaccctaccccgcgccccgctccccgcgaacgaaacgcaacgcgccttcccctttctccaaatcccgctccgcgaccgttacctaaaaacactcaacccccttcccccaacccccgaccgatatcaccgccgcaaccgccgaaaaacccctccgcaaaccccgaaacaaacaacacaaacgcgaaacgaaaacgcgaaaaaaaacgacgacaatcgaaacaaccaaactttatcgccgcgcccttcgcgctccctctcaccaacctcgactacccgcgctcttacctactctccgcgacgcctaaaaaaaccgcgacgtccttttccctctcaacaaaaccgcgaactaaccgccgccgttaaccgaacgtccgaaaaaaaccgaaacctccccaacaacccgaaccgctccacaaaaaaaaaaaaaaacaaaacaaaaactcgccgcccgcgcaacgacccccgcccgcgccgccccaccgacccccaaacgcctaaacgacgacgacgacacaaaacttaacgctaaaaacaataattacccaccgncaccgtccgctcccgaccccctccctccac

SEQ ID NO: 37691 - DNA, 1215 bp, Artificial Sequence
  chemically treated genomic DNA (Homo sapiens) CpG-island No: 37691
  misc_feature (1185)..(1185): n is either a, c, g or t
gtttttggggtagagttagtatttagttttggtagagttttttttgtttttttttcgcgtttttagattatttcgtcgcgcggtttttgaggattacgttcgcgaggatttagaaggcggttattggacgtgtttgttacgagttcgtttttgttttgtttaagaaatagatttcgattcgagtaaagtttttttatttttcggggaatagggggagatggtagtacggtgtcggcgtggagagcgagaataaaagaattgtcgagtataatttgtcgtgtaagttagtagcgtcgggaaggaaaggtaagcggcggcgataaggtacgatagggaaggaaattggtgtttagcgttttttttcgtttgttcgttatttagagcggtcggagttttttaggtttcgtttcgagttcgtcgtttagtttcggcgtcggtcgtagattttcgttttatataaatttttttaggacgcgtttttttcggagtcggattttcgttttggttttttcgcgggatgaggcgggttagtttagttcgtttttcggtagaggtgattcgcgtagagatgtaaatacggagagattagttgcgttcggtttatttttttcgtcggggtttgtaatttttttttttagttttgtttcgcgtttcgtttttcgcgggcgaggcgtagcgcgtttttttttttttttaagtttcgtttcgcgatcgttgtttggggatatttagttttttttttttagttttcggtcggtgttatcgtcgtagtcgtcggaaaattttttcgtaaatttcgaagtaaataatataagcgcggggcgggggcgcggagggaggcggcggtagtcgggatagttaggttttatcgtcgcgtttttcgcgtttttttttattagtttcggttgttcgcgtttttatttgtttttcgcgacgtttgggaagatcgcggcgttttttttttttttagtagggtcgcggattagtcgtcgtcgttggtcgagcgttcggagggagtcggggtttttttagtagttcgagtcgttttatagggagagaaggagataaaatagaggttcgtcgttcgcgtagcgattttcgttcgcgtcgttttatcgatttttaaacgtttaggcgacggcggcgatatagagtttggcgttgggagtaatggttgtttatcgntatcgttcgttttcggttttttttttttat

SEQ ID NO: 37692 - DNA, 1215 bp, Artificial Sequence
  chemically treated genomic DNA (Homo sapiens) CpG-island No: 37692
  misc_feature (31)..(31): n is either a, c, g or t
ataaaaaaaaaaaaccgaaaacgaacgatancgataaacaaccattactcccaacgccaaactctatatcgccgccgtcgcctaaacgtttaaaaatcgataaaacgacgcgaacgaaaatcgctacgcgaacgacgaacctctattttatctccttctctccctataaaacgactcgaactactaaaaaaaccccgactccctccgaacgctcgaccaacgacgacgactaatccgcgaccctactaaaaaaaaaaaaaacgccgcgatcttcccaaacgtcgcgaaaaacaaataaaaacgcgaacaaccgaaactaataaaaaaaaacgcgaaaaacgcgacgataaaacctaactatcccgactaccgccgcctccctccgcgcccccgccccgcgcttatattatttacttcgaaatttacgaaaaaattttccgacgactacgacgataacaccgaccgaaaactaaaaaaaaaaaactaaatatccccaaacaacgatcgcgaaacgaaacttaaaaaaaaaaaaaaacgcgctacgcctcgcccgcgaaaaacgaaacgcgaaacaaaactaaaaaaaaaaattacaaaccccgacgaaaaaaataaaccgaacgcaactaatctctccgtatttacatctctacgcgaatcacctctaccgaaaaacgaactaaactaacccgcctcatcccgcgaaaaaaccaaaacgaaaatccgactccgaaaaaaacgcgtcctaaaaaaatttatataaaacgaaaatctacgaccgacgccgaaactaaacgacgaactcgaaacgaaacctaaaaaactccgaccgctctaaataacgaacaaacgaaaaaaaacgctaaacaccaatttccttccctatcgtaccttatcgccgccgcttacctttccttcccgacgctactaacttacacgacaaattatactcgacaattcttttattctcgctctccacgccgacaccgtactaccatctccccctattccccgaaaaataaaaaaactttactcgaatcgaaatctatttcttaaacaaaacaaaaacgaactcgtaacaaacacgtccaataaccgccttctaaatcctcgcgaacgtaatcctcaaaaaccgcgcgacgaaataatctaaaaacgcgaaaaaaaaacaaaaaaaactctaccaaaactaaatactaactctaccccaaaaac

SEQ ID NO: 37693 - DNA, 807 bp, Artificial Sequence
  chemically treated genomic DNA (Homo sapiens) CpG-island No: 37693
ttcggattgttattcggtggtagtattttcgttttacggttttgttattcgcgggttttcggagttttattgtaagttagggaggtgggtagtcgatacgcggcgttttagttttttagagcggttcggacggcgtttcggatttagatagtcggttgacgttattttcggatcggtttcgattggcggggagggagggtcgaacgggcgaggttgggttgtcgtgttgttcggcggcgttgaggtgagtgtgagttcggcgggggcgggcgcgcggggcgtagattttttcggcgtagatttttttttgcgcgttgtttttgtgttcggttttttcgcggtgttgtaggcgtgggttcgtttcgttattagcggtattttttgttcgagggatttttcggataaggtttcgagtacggattgcgtttcgtcgttttttgttagttttggggtcgttttttacggggtttttttcgttttcgagtttttgataatttttttgttttacgcggggttttttggatttttgtcgtatagagcggtttttgcgtttcgatgcgttttagattttttggttttagcggttcgaggttttttatttcggtttttttttacgttttttttttgttagttttttaggggcggggttcgtgcgtttcgcggtttttttagttttttgcgaatgtcgttttttttgtttttagcgttcgcgtttcgttagtgtttttttttttgtttgtgtttttttttcgttttatttttttcgtttttggcgttttaaggttttttttttcgtagttaggtagt

SEQ ID NO: 37694 - DNA, 807 bp, Artificial Sequence
  chemically treated genomic DNA (Homo sapiens) CpG-island No: 37694
actacctaactacgaaaaaaaaaaccttaaaacgccaaaaacgaaaaaaataaaacgaaaaaaaaacacaaacaaaaaaaaaaacactaacgaaacgcgaacgctaaaaacaaaaaaaacgacattcgcaaaaaactaaaaaaaccgcgaaacgcacgaaccccgcccctaaaaaactaacaaaaaaaaaacgtaaaaaaaaaccgaaataaaaaacctcgaaccgctaaaaccaaaaaatctaaaacgcatcgaaacgcaaaaaccgctctatacgacaaaaatccaaaaaaccccgcgtaaaacaaaaaaattatcaaaaactcgaaaacgaaaaaaaccccgtaaaaaacgaccccaaaactaacaaaaaacgacgaaacgcaatccgtactcgaaaccttatccgaaaaatccctcgaacaaaaaataccgctaataacgaaacgaacccacgcctacaacaccgcgaaaaaaccgaacacaaaaacaacgcgcaaaaaaaaatctacgccgaaaaaatctacgccccgcgcgcccgcccccgccgaactcacactcacctcaacgccgccgaacaacacgacaacccaacctcgcccgttcgaccctccctccccgccaatcgaaaccgatccgaaaataacgtcaaccgactatctaaatccgaaacgccgtccgaaccgctctaaaaaactaaaacgccgcgtatcgactacccacctccctaacttacaataaaactccgaaaacccgcgaataacaaaaccgtaaaacgaaaatactaccaccgaataacaatccgaa

SEQ ID NO: 37695 - DNA, 807 bp, Artificial Sequence
  chemically treated genomic DNA (Homo sapiens) CpG-island No: 37695
gttgtttggttgcgggaagaaaagttttggagcgttagaagcgaggagggtggggcggagggaaggtataagtagagggaggagtattggcggagcgcggacgttaaaggtaggaggggcggtattcgtagagggttgggaggatcgcgagacgtacgagtttcgtttttgaaaagttgataggagaggagcgtgggagggagtcgggatgggaagtttcgggtcgttgggattaaggggtttggagcgtatcgggacgtagaagtcgttttgtgcggtaggagtttaggggatttcgcgtggggtaagggagttgttaggggttcgagagcggaaggagtttcgtgaggagcgattttagggttggtagagagcggcgaggcgtagttcgtattcggggttttgttcggggggtttttcgaataggaagtgtcgttgatggcgggacggatttacgtttgtagtatcgcgagaggatcgggtataggggtaacgcgtaggggagggtttgcgtcgggagggtttgcgtttcgcgcgttcgttttcgtcgggtttatatttattttagcgtcgtcgagtagtacggtagtttaatttcgttcgttcggtttttttttttcgttaatcggaatcgattcggaagtgacgttagtcgattgtttgggttcgaggcgtcgttcgggtcgttttgggaagttagaacgtcgcgtgtcggttgtttatttttttggtttgtagtaaggtttcggggattcgcgaatggtaaagtcgtaaagcgggaatgttgttatcgggtggtagttcgaa

SEQ ID NO: 37696 - DNA, 807 bp, Artificial Sequence
  chemically treated genomic DNA (Homo sapiens) CpG-island No: 37696
ttcgaactaccacccgataacaacattcccgctttacgactttaccattcgcgaatccccgaaaccttactacaaaccaaaaaaataaacaaccgacacgcgacgttctaacttcccaaaacgacccgaacgacgcctcgaacccaaacaatcgactaacgtcacttccgaatcgattccgattaacgaaaaaaaaaaaccgaacgaacgaaattaaactaccgtactactcgacgacgctaaaataaatataaacccgacgaaaacgaacgcgcgaaacgcaaaccctcccgacgcaaaccctcccctacgcgttacccctatacccgatcctctcgcgatactacaaacgtaaatccgtcccgccatcaacgacacttcctattcgaaaaaccccccgaacaaaaccccgaatacgaactacgcctcgccgctctctaccaaccctaaaatcgctcctcacgaaactccttccgctctcgaacccctaacaactcccttaccccacgcgaaatcccctaaactcctaccgcacaaaacgacttctacgtcccgatacgctccaaaccccttaatcccaacgacccgaaacttcccatcccgactccctcccacgctcctctcctatcaacttttcaaaaacgaaactcgtacgtctcgcgatcctcccaaccctctacgaataccgcccctcctacctttaacgtccgcgctccgccaatactcctccctctacttataccttccctccgccccaccctcctcgcttctaacgctccaaaacttttcttcccgcaaccaaacaac

SEQ ID NO: 37697 - DNA, 751 bp, Artificial Sequence
  chemically treated genomic DNA (Homo sapiens) CpG-island No: 37697
cgtaggcgcggtatcggtatggtttttcgtcgttgtggagtcggtagtgttcgtttagcgtgtagtttttgcggaacgttttgtcgtattcggtgtacgcgaagggtttttttttggtgtggattttttggtgtagagtgaggttggatttgcgatcgaaggttttgtcgtatttcgcgtattcgaacggtttttcgttcgtgtgtaggcgtaggtgtagtagtagtagggagttgtgtcggaacggtttttcgtatatcgggtattcgtggggcgggtttttcgtttggggtttttgcgtagtttcgagtagggcgttttgtttcgcgtcgtcgttttgggtatttttttgcgcgtgtagtcggtggtgttttaggagcgaggattttcggatgaagcgttgtttatatcgtaggtatcggtagggtcgtttttcgttgtggatgcggtcgtgttcgttgagggtgaatttgcggtagaacgttttgtcgtattttgtgtacgcgaagggttttttttcggtgtggaatttttggtgttgtagtagtcgggagttgcggttgaaggttttgtcgtattcgtcgtatgcgtagggtcgttcgcgggtgtggacgcggtggtgggtagttagttgcgtgttttgtcggaaggttttttcgtattcgtcgtattggaacggtttttttttagtgtggattagttggtgtcgtagtaggatggagttttgtttgaaggttttttcgtattttgt

SEQ ID NO: 37698 - DNA, 751 bp, Artificial Sequence
  chemically treated genomic DNA (Homo sapiens) CpG-island No: 37698
acaaaatacgaaaaaaccttcaaacaaaactccatcctactacgacaccaactaatccacactaaaaaaaaaccgttccaatacgacgaatacgaaaaaaccttccgacaaaacacgcaactaactacccaccaccgcgtccacacccgcgaacgaccctacgcatacgacgaatacgacaaaaccttcaaccgcaactcccgactactacaacaccaaaaattccacaccgaaaaaaaacccttcgcgtacacaaaatacgacaaaacgttctaccgcaaattcaccctcaacgaacacgaccgcatccacaacgaaaaacgaccctaccgatacctacgatataaacaacgcttcatccgaaaatcctcgctcctaaaacaccaccgactacacgcgcaaaaaaatacccaaaacgacgacgcgaaacaaaacgccctactcgaaactacgcaaaaaccccaaacgaaaaacccgccccacgaatacccgatatacgaaaaaccgttccgacacaactccctactactactacacctacgcctacacacgaacgaaaaaccgttcgaatacgcgaaatacgacaaaaccttcgatcgcaaatccaacctcactctacaccaaaaaatccacaccaaaaaaaaacccttcgcgtacaccgaatacgacaaaacgttccgcaaaaactacacgctaaacgaacactaccgactccacaacgacgaaaaaccataccgataccgcgcctacg

SEQ ID NO: 37699 - DNA, 751 bp, Artificial Sequence
  chemically treated genomic DNA (Homo sapiens) CpG-island No: 37699
atagagtgcgggaaggtttttaagtaaagttttattttgttgcggtattagttgatttatattgaggagaagtcgttttagtgcggcgagtgcgggaaggtttttcggtagagtacgtagttggttgtttattatcgcgtttatattcgcgagcggttttacgtatgcggcgagtgcggtaaggtttttagtcgtagttttcggttgttgtagtattagaagttttatatcggggagaagtttttcgcgtgtatagagtgcggtaaggcgttttgtcgtaggtttatttttaacgagtacggtcgtatttatagcggggagcggttttatcggtgtttgcggtgtgggtagcgttttattcgagggttttcgtttttgaagtattatcggttgtacgcgtaggagggtgtttaggacggcggcgcggggtagggcgttttgttcggagttgcgtagaggttttaggcgggggattcgttttacgagtgttcggtgtgcgggaggtcgtttcgatataattttttgttgttgttgtatttgcgtttatatacgggcgagaagtcgttcgagtgcgcggagtgcggtaaggttttcggtcgtaagtttaattttattttgtattagaagatttatattaaggagaagtttttcgcgtgtatcgagtgcggtaaggcgtttcgtaggagttatacgttgaacgagtattatcggttttatagcggcgagaggttatatcggtgtcgcgtttgcg

SEQ ID NO: 37700 - DNA, 751 bp, Artificial Sequence
  chemically treated genomic DNA (Homo sapiens) CpG-island No: 37700
cgcaaacgcgacaccgatataacctctcgccgctataaaaccgataatactcgttcaacgtataactcctacgaaacgccttaccgcactcgatacacgcgaaaaacttctccttaatataaatcttctaatacaaaataaaattaaacttacgaccgaaaaccttaccgcactccgcgcactcgaacgacttctcgcccgtatataaacgcaaatacaacaacaacaaaaaattatatcgaaacgacctcccgcacaccgaacactcgtaaaacgaatcccccgcctaaaacctctacgcaactccgaacaaaacgccctaccccgcgccgccgtcctaaacaccctcctacgcgtacaaccgataatacttcaaaaacgaaaaccctcgaataaaacgctacccacaccgcaaacaccgataaaaccgctccccgctataaatacgaccgtactcgttaaaaataaacctacgacaaaacgccttaccgcactctatacacgcgaaaaacttctccccgatataaaacttctaatactacaacaaccgaaaactacgactaaaaaccttaccgcactcgccgcatacgtaaaaccgctcgcgaatataaacgcgataataaacaaccaactacgtactctaccgaaaaaccttcccgcactcgccgcactaaaacgacttctcctcaatataaatcaactaataccgcaacaaaataaaactttacttaaaaaccttcccgcactctat

SEQ ID NO: 37701 - DNA, 730 bp, Artificial Sequence
  chemically treated genomic DNA (Homo sapiens) CpG-island No: 37701
atttttgcgtaatcgttcggttcggcggagcgggtttcgggggttcggtcgtacgttttcgattatagttagtatggatcggggcgtagggtttttcgtttcgataagggttcggaatttaaggcgagcggaggcgatagtgacggttgcgggttcgttttttgtcgagtttcgcgcgtttattgcgggggttatagtttttattaggtcgggttcggaggatcgcgttttttttagttttcgtttcgcggtcgcggtcgatttattttgggtcgtcgagatagcgcggggaggagcgtacggcgttcggtttttaggtttcggtttttttttcgttttcggaaacggtcgttgcgtcgttttgggaggtttggaggatcgcgcgtttcgatggcgttcgcgtttcgacggtttttagtttttgcggcgcggcggtcgttagggttttagttaggggcgcgtttggggggtttcgggttagatcgggtattagttttaggttcgacgggcgcggaagggcgtcgacgttttcggcgtttcgtttttttcgggatcggaggtagcgaacgtttattttttgcgtttattttttgttttcgggtggtttgcgggggttggggagtacggtgcgggatcgattttcggattcgtaggaagggcggagcgggggcgttcggttagggtcggttttatataaatttatgatattgtttagtatgatttttttttt

SEQ ID NO: 37702 - DNA, 730 bp, Artificial Sequence
  chemically treated genomic DNA (Homo sapiens) CpG-island No: 37702
aaaaaaaaaatcatactaaacaatatcataaatttatataaaaccgaccctaaccgaacgcccccgctccgcccttcctacgaatccgaaaatcgatcccgcaccgtactccccaacccccgcaaaccacccgaaaacaaaaaataaacgcaaaaaataaacgttcgctacctccgatcccgaaaaaaacgaaacgccgaaaacgtcgacgcccttccgcgcccgtcgaacctaaaactaatacccgatctaacccgaaaccccccaaacgcgcccctaactaaaaccctaacgaccgccgcgccgcaaaaactaaaaaccgtcgaaacgcgaacgccatcgaaacgcgcgatcctccaaacctcccaaaacgacgcaacgaccgtttccgaaaacgaaaaaaaaaccgaaacctaaaaaccgaacgccgtacgctcctccccgcgctatctcgacgacccaaaataaatcgaccgcgaccgcgaaacgaaaactaaaaaaaacgcgatcctccgaacccgacctaataaaaactataacccccgcaataaacgcgcgaaactcgacaaaaaacgaacccgcaaccgtcactatcgcctccgctcgccttaaattccgaacccttatcgaaacgaaaaaccctacgccccgatccatactaactataatcgaaaacgtacgaccgaacccccgaaacccgctccgccgaaccgaacgattacgcaaaaat

SEQ ID NO: 37703 - DNA, 730 bp, Artificial Sequence
  chemically treated genomic DNA (Homo sapiens) CpG-island No: 37703
aaaaaaaaagttatattaaataatgttataaatttatatgagatcgattttggtcggacgttttcgtttcgttttttttgcgggttcgggagtcgatttcgtatcgtgttttttaattttcgtaggttattcgggggtagagagtgggcgtaaggggtgaacgttcgttgttttcgatttcgggggaaacggagcgtcgagaacgtcgacgttttttcgcgttcgtcgggtttgggattgatattcggtttggttcggaattttttaggcgcgtttttagttggggttttggcgatcgtcgcgtcgtaggggttagaagtcgtcgagacgcgagcgttatcgaggcgcgcggttttttaggttttttagagcggcgtagcggtcgttttcgggggcggggaaggaatcggagtttgagagtcgggcgtcgtgcgttttttttcgcgttgtttcggcggtttagggtgagtcggtcgcggtcgcggggcggggattgggaggggcgcggtttttcgagttcggtttggtggaggttgtagttttcgtagtgggcgcgcggagttcggtagggagcggattcgtagtcgttattgtcgttttcgttcgttttgggtttcgaatttttatcggggcgaagggttttgcgtttcggtttatgttggttgtggtcgggggcgtgcggtcgggttttcgagattcgtttcgtcgagtcggacggttgcgtagagat

SEQ ID NO: 37704 - DNA, 730 bp, Artificial Sequence
  chemically treated genomic DNA (Homo sapiens) CpG-island No: 37704
atctctacgcaaccgtccgactcgacgaaacgaatctcgaaaacccgaccgcacgcccccgaccacaaccaacataaaccgaaacgcaaaacccttcgccccgataaaaattcgaaacccaaaacgaacgaaaacgacaataacgactacgaatccgctccctaccgaactccgcgcgcccactacgaaaactacaacctccaccaaaccgaactcgaaaaaccgcgcccctcccaatccccgccccgcgaccgcgaccgactcaccctaaaccgccgaaacaacgcgaaaaaaaacgcacgacgcccgactctcaaactccgattccttccccgcccccgaaaacgaccgctacgccgctctaaaaaacctaaaaaaccgcgcgcctcgataacgctcgcgtctcgacgacttctaacccctacgacgcgacgatcgccaaaaccccaactaaaaacgcgcctaaaaaattccgaaccaaaccgaatatcaatcccaaacccgacgaacgcgaaaaaacgtcgacgttctcgacgctccgtttcccccgaaatcgaaaacaacgaacgttcaccccttacgcccactctctacccccgaataacctacgaaaattaaaaaacacgatacgaaatcgactcccgaacccgcaaaaaaaacgaaacgaaaacgtccgaccaaaatcgatctcatataaatttataacattatttaatataacttttttttt

SEQ ID NO: 37705 - DNA, 658 bp, Artificial Sequence
  chemically treated genomic DNA (Homo sapiens) CpG-island No: 37705
gtcgcgtcgcggtcgttttttttcggtttttgtagttcgtcggtggttttcgcggtatttagaataggttttttttggaatggtcgtcgttttttcgcgtttttttcgcgtttttttcgtttgtttgttcgtttggcgtttttttttggttcgatattgttttatttgtttgttcgattcggggaagttatcgaggaagcgtcgaggagttgcgtagtcgtatcgagttcggaacggatttttttatagaatcgggtttagagtcggggagggggcgggttaggatgaagagggcgggtcgggtcgagttgcgtatacgtaggttttttcgttttttgcggggttttagtacgttttcgagaacgtcgggaatcggaagttagtcgcggtttcgttcggattttttcggggtcgttttgggatgattggaggtttgcgtcgtttatggtcggggagggggagagtttacggtagttgagcggagggtttggcgcggtgacgttgcgtattcgggtcgcgtcgcgttcgtttcgattttaaatttttatttgaattttaatttcgttgggttttcggttttttcgtcggttattatatatcgtgtgtttcgatttattataattattagaaagtcgtttatgaagatgttataattatt

SEQ ID NO: 37706 - DNA, 658 bp, Artificial Sequence
  chemically treated genomic DNA (Homo sapiens) CpG-island No: 37706
aataattataacatcttcataaacgactttctaataattataataaatcgaaacacacgatatataataaccgacgaaaaaaccgaaaacccaacgaaattaaaattcaaataaaaatttaaaatcgaaacgaacgcgacgcgacccgaatacgcaacgtcaccgcgccaaaccctccgctcaactaccgtaaactctccccctccccgaccataaacgacgcaaacctccaatcatcccaaaacgaccccgaaaaaatccgaacgaaaccgcgactaacttccgattcccgacgttctcgaaaacgtactaaaaccccgcaaaaaacgaaaaaacctacgtatacgcaactcgacccgacccgccctcttcatcctaacccgccccctccccgactctaaacccgattctataaaaaaatccgttccgaactcgatacgactacgcaactcctcgacgcttcctcgataacttccccgaatcgaacaaacaaataaaacaatatcgaaccaaaaaaaaacgccaaacgaacaaacaaacgaaaaaaacgcgaaaaaaacgcgaaaaaacgacgaccattccaaaaaaaacctattctaaataccgcgaaaaccaccgacgaactacaaaaaccgaaaaaaaacgaccgcgacgcgac

SEQ ID NO: 37707 - DNA, 658 bp, Artificial Sequence
  chemically treated genomic DNA (Homo sapiens) CpG-island No: 37707
gataattgtaatatttttataagcgattttttggtggttatggtgaatcgggatatacgatgtatggtgatcgacgggggagtcgggagtttagcggggttagggtttaggtgagggtttagggtcggggcgagcgcggcgcggttcggatgcgtagcgttatcgcgttagatttttcgtttagttgtcgtgggtttttttttttttcgattatagacggcgtaggtttttagttattttagagcggtttcggaagaattcgggcggaatcgcggttggttttcggttttcggcgttttcggaggcgtattgaggtttcgtagggggcggggaagtttgcgtgtgcgtagttcggttcggttcgttttttttattttagttcgtttttttttcggttttggattcggttttgtgggagggttcgtttcgggttcggtgcgattgcgtagtttttcggcgttttttcggtggttttttcgggtcgagtaaataggtggggtagtgtcggattaggaaggagcgttaagcgggtaggtaggcggggagggcgcggggagggcgcggggaggcggcggttattttaggaggagtttgttttgggtgtcgcgggagttatcgacgggttgtagaggtcgggaggaggcgatcgcggcgcggt

SEQ ID NO: 37708 - DNA, 658 bp, Artificial Sequence
  chemically treated genomic DNA (Homo sapiens) CpG-island No: 37708
accgcgccgcgatcgcctcctcccgacctctacaacccgtcgataactcccgcgacacccaaaacaaactcctcctaaaataaccgccgcctccccgcgccctccccgcgccctccccgcctacctacccgcttaacgctccttcctaatccgacactaccccacctatttactcgacccgaaaaaaccaccgaaaaaacgccgaaaaactacgcaatcgcaccgaacccgaaacgaaccctcccacaaaaccgaatccaaaaccgaaaaaaaaacgaactaaaataaaaaaaacgaaccgaaccgaactacgcacacgcaaacttccccgccccctacgaaacctcaatacgcctccgaaaacgccgaaaaccgaaaaccaaccgcgattccgcccgaattcttccgaaaccgctctaaaataactaaaaacctacgccgtctataatcgaaaaaaaaaaaaacccacgacaactaaacgaaaaatctaacgcgataacgctacgcatccgaaccgcgccgcgctcgccccgaccctaaaccctcacctaaaccctaaccccgctaaactcccgactcccccgtcgatcaccatacatcgtatatcccgattcaccataaccaccaaaaaatcgcttataaaaatattacaattatc

SEQ ID NO: 37709 - DNA, 650 bp, Artificial Sequence
  chemically treated genomic DNA (Homo sapiens) CpG-island No: 37709
acgtatttgtataatgttttcgcgtttcgtatagatgtttgtaaaggttgttaaattgatgttacgggcgagattttcgttgttttattattatcgttttcgagtagggttaaaaatcgtggcgtaatagtagtggtttgttgtatgaatttttattttcgttagtagcggttttagtattcggcggataaaattcgtagtgcggcgtcgacggtgttatcggtgtcgtcgtttattttaatacgcgaaggtttatcggttaaattatagcgcgggtagtatcgtttgtagtattagcgtataattttcggcgttatcgtatagtaaagcggtaatcgtcgtcgcgtacggtgtcgggtcggaagagtagacgttgcgattttagtttcgcgttttttacggttgtttcgtaaattttcgtcgtcgtttttatcgcggttagatgttggcgtaatagtttcggtttcgttcgttcggtacgaatgttggtgatggtaaatggttggtcggttattatcgataggtttagcgtcgagcgtaggatttgttcgttattttcgttttgtgcgttatttagcgtaattattttttttattatttatttttttacgtatattatttgacgtagggtatagataatttttattaga

SEQ ID NO: 37710 - DNA, 650 bp, Artificial Sequence
  chemically treated genomic DNA (Homo sapiens) CpG-island No: 37710
tctaataaaaattatctataccctacgtcaaataatatacgtaaaaaaataaataataaaaaaaataattacgctaaataacgcacaaaacgaaaataacgaacaaatcctacgctcgacgctaaacctatcgataataaccgaccaaccatttaccatcaccaacattcgtaccgaacgaacgaaaccgaaactattacgccaacatctaaccgcgataaaaacgacgacgaaaatttacgaaacaaccgtaaaaaacgcgaaactaaaatcgcaacgtctactcttccgacccgacaccgtacgcgacgacgattaccgctttactatacgataacgccgaaaattatacgctaatactacaaacgatactacccgcgctataatttaaccgataaaccttcgcgtattaaaataaacgacgacaccgataacaccgtcgacgccgcactacgaattttatccgccgaatactaaaaccgctactaacgaaaataaaaattcatacaacaaaccactactattacgccacgatttttaaccctactcgaaaacgataataataaaacaacgaaaatctcgcccgtaacatcaatttaacaacctttacaaacatctatacgaaacgcgaaaacattatacaaatacgt

SEQ ID NO: 37711 - DNA, 650 bp, Artificial Sequence
  chemically treated genomic DNA (Homo sapiens) CpG-island No: 37711
tttggtggaagttatttatattttgcgttaggtggtgtgcgtaaaaggataaatgatgaaaaggatgattgcgttggatggcgtatagggcgaaggtggcgggtagattttgcgttcggcgttgagtttgtcgatgataatcggttagttatttattattattagtattcgtgtcgggcgggcgaaatcggggttgttgcgttagtatttgatcgcggtaaaggcggcgacggaaatttgcggagtaatcgtggaaggcgcggagttggggtcgtagcgtttgttttttcggttcggtatcgtgcgcggcggcgattatcgttttgttatgcggtagcgtcggaagttgtacgttggtgttgtaaacggtgttgttcgcgttgtggtttgatcgatggattttcgcgtgttgaagtgagcggcggtatcgataatatcgtcggcgtcgtattgcggattttattcgtcgggtgttggagtcgttgttggcgaaaataggaatttatgtagtaaattattgttgttacgttacggtttttaattttgttcggaggcggtagtggtaggataacggaagtttcgttcgtggtattagtttaatagtttttgtaagtatttgtgcgagacgcgggaatattgtgtagatgcgt

SEQ ID NO: 37712 - DNA, 650 bp, Artificial Sequence
  chemically treated genomic DNA (Homo sapiens) CpG-island No: 37712
acgcatctacacaatattcccgcgtctcgcacaaatacttacaaaaactattaaactaataccacgaacgaaacttccgttatcctaccactaccgcctccgaacaaaattaaaaaccgtaacgtaacaacaataatttactacataaattcctattttcgccaacaacgactccaacacccgacgaataaaatccgcaatacgacgccgacgatattatcgataccgccgctcacttcaacacgcgaaaatccatcgatcaaaccacaacgcgaacaacaccgtttacaacaccaacgtacaacttccgacgctaccgcataacaaaacgataatcgccgccgcgcacgataccgaaccgaaaaaacaaacgctacgaccccaactccgcgccttccacgattactccgcaaatttccgtcgccgcctttaccgcgatcaaatactaacgcaacaaccccgatttcgcccgcccgacacgaatactaataataataaataactaaccgattatcatcgacaaactcaacgccgaacgcaaaatctacccgccaccttcgccctatacgccatccaacgcaatcatccttttcatcatttatccttttacgcacaccacctaacgcaaaatataaataacttccaccaaa

SEQ ID NO: 37713 - DNA, 618 bp, Artificial Sequence
  chemically treated genomic DNA (Homo sapiens) CpG-island No: 37713
ggcgcgaggattgcgcggtcgtcgattaatgagtggatgtattgatatttgtcgcgaagaaagtttgatatttagtgagcggcggtaagtgggtgtagtatatacgtaagcgtattcgtttttttaacgacgtttttttttatatcgcgtttaacgttttcgtatataggtcggtattcgttgagaatttttgcgcgttattagttatcgcgtttaatttttcgtcgcgatcgcggagattcgcgtgtttcgtaacggagggtaatgagttaagattttattgggagattttcgttattgatagatttcgatatgttgtagaaagtggagaacgttggagttagacgattttgtttcgtttattcgtagtttttttatcgcgcgataagtcgcgcgacgcgcgtttcgcgttatatttcgataattcggattagttggaagtttatatatagcgtttagagtttttgtatttcgtttttgatacgcgcggcgtcgaggagtttattcgtttagacgcgtcgggcgcgtcgatcgcgttacgagcgcgcgcgcggggcggtacgaattaacgttttttatcgttgaattgataatagtttagtagtattgagcgtttgt

SEQ ID NO: 37714 - DNA, 618 bp, Artificial Sequence
  chemically treated genomic DNA (Homo sapiens) CpG-island No: 37714
acaaacgctcaatactactaaactattatcaattcaacgataaaaaacgttaattcgtaccgccccgcgcgcgcgctcgtaacgcgatcgacgcgcccgacgcgtctaaacgaataaactcctcgacgccgcgcgtatcaaaaacgaaatacaaaaactctaaacgctatatataaacttccaactaatccgaattatcgaaatataacgcgaaacgcgcgtcgcgcgacttatcgcgcgataaaaaaactacgaataaacgaaacaaaatcgtctaactccaacgttctccactttctacaacatatcgaaatctatcaataacgaaaatctcccaataaaatcttaactcattaccctccgttacgaaacacgcgaatctccgcgatcgcgacgaaaaattaaacgcgataactaataacgcgcaaaaattctcaacgaataccgacctatatacgaaaacgttaaacgcgatataaaaaaaaacgtcgttaaaaaaacgaatacgcttacgtatatactacacccacttaccgccgctcactaaatatcaaactttcttcgcgacaaatatcaatacatccactcattaatcgacgaccgcgcaatcctcgcgcc

SEQ ID NO: 37715 - DNA, 618 bp, Artificial Sequence
  chemically treated genomic DNA (Homo sapiens) CpG-island No: 37715
gtagacgtttaatattgttggattgttgttagtttagcgatgggaggcgttggttcgtgtcgtttcgcgcgcgcgttcgtagcgcggtcggcgcgttcgacgcgtttgggcgggtagatttttcggcgtcgcgcgtgttaaagacggggtgtaggagttttggacgttatgtatggatttttagttgattcgaattgtcggggtgtgacgcgagacgcgcgtcgcgcggtttgtcgcgcggtgagggagttgcggatggacggggtagggtcgtttgattttaacgttttttattttttataatatatcggagtttgttaatagcggaggttttttagtgagattttggtttattatttttcgttgcggggtacgcggattttcgcggtcgcggcgggggattaggcgcggtggttggtggcgcgtaagaatttttagcgagtgtcggtttatgtgcgggagcgttaggcgcggtataggagagggcgtcgttagagggacgaatgcgtttacgtgtatgttatatttatttatcgtcgtttattagatgttagatttttttcgcggtaagtattagtatatttatttattagtcggcggtcgcgtagttttcgcgtt

SEQ ID NO: 37716 - DNA, 618 bp, Artificial Sequence
  chemically treated genomic DNA (Homo sapiens) CpG-island No: 37716
aacgcgaaaactacgcgaccgccgactaataaataaatatactaatacttaccgcgaaaaaaatctaacatctaataaacgacgataaataaatataacatacacgtaaacgcattcgtccctctaacgacgccctctcctataccgcgcctaacgctcccgcacataaaccgacactcgctaaaaattcttacgcgccaccaaccaccgcgcctaatcccccgccgcgaccgcgaaaatccgcgtaccccgcaacgaaaaataataaaccaaaatctcactaaaaaacctccgctattaacaaactccgatatattataaaaaataaaaaacgttaaaatcaaacgaccctaccccgtccatccgcaactccctcaccgcgcgacaaaccgcgcgacgcgcgtctcgcgtcacaccccgacaattcgaatcaactaaaaatccatacataacgtccaaaactcctacaccccgtctttaacacgcgcgacgccgaaaaatctacccgcccaaacgcgtcgaacgcgccgaccgcgctacgaacgcgcgcgcgaaacgacacgaaccaacgcctcccatcgctaaactaacaacaatccaacaatattaaacgtctac

SEQ ID NO: 37717 - DNA, 616 bp, Artificial Sequence
  chemically treated genomic DNA (Homo sapiens) CpG-island No: 37717
  misc_feature (117)..(117): n is either a, c, g or t
  misc_feature (551)..(551): n is either a, c, g or t
gcggtattattatttcgcggggtcgtttttaggattttcgtaattatgttgtttcgtatttataggtatatgttgatatcgttattatcgttaatttaggcgtattagttcgttaantcgttggagtatagtattttcgtttaagtcgtgtattatgtttacgtatagatagagtcggtgttagcgcgaggcggagtggtgtaatttcgtattcgtatagcgttcgtagtatggtttcgtttttttataacgaagtgtagatacgtaagtcgtattcgcgacgggcggttagttgtcgatgtttatcgttttttttttacgttttcgtttcgacgcggcggtttattcgcgcgacgtttggagacgattcggcggtttcggacgcgcgggcgtcgttacggatgtgtttttcgtcgtatagcggtattcgtcgtatttcgaacgtcgtattttcgtttttgcggttttttgtcggcggagtatcgattatttcggtattttattcgcggtttcgatcgtcgtacgagtcgcgcgtcgatcgttcgtaaatnagtagataacgataatagttgaagatagttttttaggagcgcgtaggtttagttttaacggttcg

SEQ ID NO: 37718 - DNA, 616 bp, Artificial Sequence
  chemically treated genomic DNA (Homo sapiens) CpG-island No: 37718
  misc_feature (66)..(66): n is either a, c, g or t
  misc_feature (500)..(500): n is either a, c, g or t
cgaaccgttaaaactaaacctacgcgctcctaaaaaactatcttcaactattatcgttatctactnatttacgaacgatcgacgcgcgactcgtacgacgatcgaaaccgcgaataaaataccgaaataatcgatactccgccgacaaaaaaccgcaaaaacgaaaatacgacgttcgaaatacgacgaataccgctatacgacgaaaaacacatccgtaacgacgcccgcgcgtccgaaaccgccgaatcgtctccaaacgtcgcgcgaataaaccgccgcgtcgaaacgaaaacgtaaaaaaaaaacgataaacatcgacaactaaccgcccgtcgcgaatacgacttacgtatctacacttcgttataaaaaaacgaaaccatactacgaacgctatacgaatacgaaattacaccactccgcctcgcgctaacaccgactctatctatacgtaaacataatacacgacttaaacgaaaatactatactccaacganttaacgaactaatacgcctaaattaacgataataacgatatcaacatatacctataaatacgaaacaacataattacgaaaatcctaaaaacgaccccgcgaaataataataccgc

SEQ ID NO: 37719 - DNA, 616 bp, Artificial Sequence
  chemically treated genomic DNA (Homo sapiens) CpG-island No: 37719
  misc_feature (66)..(66): n is either a, c, g or t
  misc_feature (500)..(500): n is either a, c, g or t
cgagtcgttggagttgggtttacgcgtttttagggagttgtttttagttgttgtcgttgtttgttnatttacgagcggtcggcgcgcggttcgtacggcggtcgggatcgcgggtgaggtgtcggggtggtcggtgtttcgtcggtagaagatcgtaagggcgaaggtacgacgttcggagtgcgacgggtgtcgttgtgcggcggaggatatattcgtggcggcgttcgcgcgttcgaagtcgtcggatcgtttttaaacgtcgcgcgaatgaatcgtcgcgtcggagcgagggcgtagaggggaagcggtaggtatcggtagttagtcgttcgtcgcgagtgcggtttacgtgtttgtatttcgttgtaggagggcggggttatgttgcggacgttgtacggatgcgaagttgtattatttcgtttcgcgttgatatcggttttgtttgtgcgtggatatagtgtacggtttgagcgggggtattatgttttagcggnttggcgggttagtacgtttgaattaacgatggtggcggtgttaatatgtgtttatgaatacggagtaatatagttgcgagggttttagaggcggtttcgcgaggtaatgatatcgt

SEQ ID NO: 37720 - DNA, 616 bp, Artificial Sequence
  chemically treated genomic DNA (Homo sapiens) CpG-island No: 37720
  misc_feature (117)..(117): n is either a, c, g or t
  misc_feature (551)..(551): n is either a, c, g or t
acgatatcattacctcgcgaaaccgcctctaaaaccctcgcaactatattactccgtattcataaacacatattaacaccgccaccatcgttaattcaaacgtactaacccgccaanccgctaaaacataatacccccgctcaaaccgtacactatatccacgcacaaacaaaaccgatatcaacgcgaaacgaaataatacaacttcgcatccgtacaacgtccgcaacataaccccgccctcctacaacgaaatacaaacacgtaaaccgcactcgcgacgaacgactaactaccgatacctaccgcttcccctctacgccctcgctccgacgcgacgattcattcgcgcgacgtttaaaaacgatccgacgacttcgaacgcgcgaacgccgccacgaatatatcctccgccgcacaacgacacccgtcgcactccgaacgtcgtaccttcgcccttacgatcttctaccgacgaaacaccgaccaccccgacacctcacccgcgatcccgaccgccgtacgaaccgcgcgccgaccgctcgtaaatnaacaaacaacgacaacaactaaaaacaactccctaaaaacgcgtaaacccaactccaacgactcg

SEQ ID NO: 37721 - DNA, 703 bp, Artificial Sequence
  chemically treated genomic DNA (Homo sapiens) CpG-island No: 37721
ttgcggaaggtaacgagaagtagcgcggtttagtcgtttggttcgttcgtttttagtacgtcggggatttacggttaatttcgcgttttaatttttcgttataagttttttttgtatcggtaaaaagagaaattttatttattttttcgttaatacgtcggattcgtttttggtaaacgtgagtagaaggggacgttttgtttttatttttagcggggaaaaaagaattaaacgcggaagtagcgattttgttcgggtcggagttgaggttcgggggttgggacggttcggagttttcggtatttaatttcgacggtagttttttttcgagcggggtcgcggtttcggtattgtaagcggaggtgtcgttcgttatttaagattttagagtaagagattgatcgggttttaggatttttcgtcgtcgggtcgcgcgtatcgttttttatttgtcgttgcgacgaggcggagttttcgggtttatagtttcgcggggaggcgggtttagtattcgagtttgttttttttaggatttgtttaatttttttttagttgcgtcggtttcgtagtgtagcggttcgcggagttttatataggtcgtagtcggttttttttagcggtttgtttacgtttcggagacgtttaggggaaggagagggcgcggttatatggggaatgggagttgtgttattatttttatttt

SEQ ID NO: 37722 - DNA, 703 bp, Artificial Sequence
  chemically treated genomic DNA (Homo sapiens) CpG-island No: 37722
aaaataaaaataataacacaactcccattccccatataaccgcgccctctccttcccctaaacgtctccgaaacgtaaacaaaccgctaaaaaaaaccgactacgacctatataaaactccgcgaaccgctacactacgaaaccgacgcaactaaaaaaaaattaaacaaatcctaaaaaaaacaaactcgaatactaaacccgcctccccgcgaaactataaacccgaaaactccgcctcgtcgcaacgacaaataaaaaacgatacgcgcgacccgacgacgaaaaatcctaaaacccgatcaatctcttactctaaaatcttaaataacgaacgacacctccgcttacaataccgaaaccgcgaccccgctcgaaaaaaaactaccgtcgaaattaaataccgaaaactccgaaccgtcccaacccccgaacctcaactccgacccgaacaaaatcgctacttccgcgtttaattcttttttccccgctaaaaataaaaacaaaacgtccccttctactcacgtttaccaaaaacgaatccgacgtattaacgaaaaaataaataaaatttctctttttaccgatacaaaaaaaacttataacgaaaaattaaaacgcgaaattaaccgtaaatccccgacgtactaaaaacgaacgaaccaaacgactaaaccgcgctacttctcgttaccttccgcaa

SEQ ID NO: 37723 - DNA, 703 bp, Artificial Sequence
  chemically treated genomic DNA (Homo sapiens) CpG-island No: 37723
agggtggaggtagtaatatagtttttattttttatgtagtcgcgtttttttttttttttgggcgttttcggggcgtggataggtcgttgaaaggaatcggttgcggtttgtgtgaggtttcgcgggtcgttgtattgcgaggtcgacgtagttggagagaagttaggtaggttttagggagggtaggttcgagtgttgggttcgttttttcgcgggattgtaggttcgggggtttcgtttcgtcgtagcggtaggtaggaggcggtgcgcgcggttcggcgacgggggattttgaggttcggttagttttttgttttggggttttgggtggcgggcggtattttcgtttgtagtgtcggagtcgcggtttcgttcggaaaagggttgtcgtcggagttagatgtcggggatttcgggtcgttttagttttcgggttttagtttcggttcgggtagagtcgttgttttcgcgtttggttttttttttttcgttgggagtgagaataaggcgtttttttttatttacgtttgttaaaagcgggttcgacgtgttagcggaaaagtgggtggagtttttttttttgtcggtgtagagagaatttgtggcgggaagttggggcgcggggttggtcgtaggttttcggcgtgttaagggcggacggattaggcggttgggtcgcgttgtttttcgttatttttcgtag

SEQ ID NO: 37724 - DNA, 703 bp, Artificial Sequence
  chemically treated genomic DNA (Homo sapiens) CpG-island No: 37724
ctacgaaaaataacgaaaaacaacgcgacccaaccgcctaatccgtccgcccttaacacgccgaaaacctacgaccaaccccgcgccccaacttcccgccacaaattctctctacaccgacaaaaaaaaaaactccacccacttttccgctaacacgtcgaacccgcttttaacaaacgtaaataaaaaaaaacgccttattctcactcccaacgaaaaaaaaaaaaccaaacgcgaaaacaacgactctacccgaaccgaaactaaaacccgaaaactaaaacgacccgaaatccccgacatctaactccgacgacaacccttttccgaacgaaaccgcgactccgacactacaaacgaaaataccgcccgccacccaaaaccccaaaacaaaaaactaaccgaacctcaaaatcccccgtcgccgaaccgcgcgcaccgcctcctacctaccgctacgacgaaacgaaacccccgaacctacaatcccgcgaaaaaacgaacccaacactcgaacctaccctccctaaaacctacctaacttctctccaactacgtcgacctcgcaatacaacgacccgcgaaacctcacacaaaccgcaaccgattcctttcaacgacctatccacgccccgaaaacgcccaaaaaaaaaaaaaaacgcgactacataaaaaataaaaactatattactacctccaccct

SEQ ID NO: 37725 - DNA, 981 bp, Artificial Sequence
  chemically treated genomic DNA (Homo sapiens) CpG-island No: 37725
  misc_feature (547)..(547): n is either a, c, g or t
agcgggggcgttttcgatttcggtagtttcgatgtacgcgcgttcgtacgcgtttcggatacgtttttcggttttttcgtcgcgtttttatataggcgtggtttttttgttgagcgtgttggtgttggaggcggcggttttttggttagggtttcgggggcggcgtagagggtcggggtggcgtggcgcgggcggggcgggcggtcgggtgaacgtgatcgtgacgtcgtcgttcgtttttttggggaaggcgttgtgtagcgtgaggaagtcggacgatttttcgcggtttcgttcggtattcgttcgtcgtcgttttcgtcgtcgttttcgcgttttcggtcgcgcgtcgcgaacgtttttacgggtcggtcgtcgtcgtcgcgtttcgttagtttcgcgttatcgtgtttttggaggggtcgcggttgagtgttatatggagatgttcgtggaggtaaatcgggttttcggtttcggtagacgcgtttcgacggcgacggttcgttggacgagtttagagcgggagtcggcgttaggatagttnaattgggtagacggaggatggcgagggcgttttcgtattgtcgttcgcgttttcgtcggttttgagtaggttcgagcgagattggtagtgcgtttcggttggttcgatgtagatgttgacggttagtacgtttattatttcggttaggatgaacgatagttcgtcgaagtagaaggattagtcgtacgagtagtggtttttttttttttcgtttcgtttcggttcggttcgttcgcgttggcggagatgtatacgattacgtcgatgatgttgtttaggtttgggcggggacggttagacgggagtttcgagttattttcggtttcgtttcgttttcggtttcgatttttgttcgtttgcgttagcggtttaggcgttatttttaggcggtttaggttttatttcgagtggtttagattttcgttttggatttg

SEQ ID NO: 37726 - DNA, 981 bp, Artificial Sequence
  chemically treated genomic DNA (Homo sapiens) CpG-island No: 37726
  misc_feature (435)..(435): n is either a, c, g or t
caaatccaaaacgaaaatctaaaccactcgaaataaaacctaaaccgcctaaaaataacgcctaaaccgctaacgcaaacgaacaaaaatcgaaaccgaaaacgaaacgaaaccgaaaataactcgaaactcccgtctaaccgtccccgcccaaacctaaacaacatcatcgacgtaatcgtatacatctccgccaacgcgaacgaaccgaaccgaaacgaaacgaaaaaaaaaaaaaccactactcgtacgactaatccttctacttcgacgaactatcgttcatcctaaccgaaataataaacgtactaaccgtcaacatctacatcgaaccaaccgaaacgcactaccaatctcgctcgaacctactcaaaaccgacgaaaacgcgaacgacaatacgaaaacgccctcgccatcctccgtctacccaattnaactatcctaacgccgactcccgctctaaactcgtccaacgaaccgtcgccgtcgaaacgcgtctaccgaaaccgaaaacccgatttacctccacgaacatctccatataacactcaaccgcgacccctccaaaaacacgataacgcgaaactaacgaaacgcgacgacgacgaccgacccgtaaaaacgttcgcgacgcgcgaccgaaaacgcgaaaacgacgacgaaaacgacgacgaacgaataccgaacgaaaccgcgaaaaatcgtccgacttcctcacgctacacaacgccttccccaaaaaaacgaacgacgacgtcacgatcacgttcacccgaccgcccgccccgcccgcgccacgccaccccgaccctctacgccgcccccgaaaccctaaccaaaaaaccgccgcctccaacaccaacacgctcaacaaaaaaaccacgcctatataaaaacgcgacgaaaaaaccgaaaaacgtatccgaaacgcgtacgaacgcgcgtacatcgaaactaccgaaatcgaaaacgcccccgct

SEQ ID NO: 37727 - DNA, 981 bp, Artificial Sequence
  chemically treated genomic DNA (Homo sapiens) CpG-island No: 37727
  misc_feature (435)..(435): n is either a, c, g or t
tagatttaggacgggggtttagattattcggggtggggtttagatcgtttgggggtggcgtttgggtcgttggcgtaggcgggtaggggtcggggtcgggggcggggcggggtcgggggtggttcgaggttttcgtttgatcgttttcgtttaggtttgagtaatattatcggcgtgatcgtgtatattttcgttaacgcgggcgagtcgggtcgaagcgggacgaggagaagaaaaattattattcgtacggttggtttttttatttcggcgggttgtcgtttattttggtcgaggtgataggcgtgttggtcgttaatatttatatcgagttagtcgaggcgtattgttagtttcgttcggatttgtttaaggtcggcgggggcgcgggcggtagtgcgggagcgttttcgttatttttcgtttgtttagttnagttgttttagcgtcggttttcgttttgagttcgtttagcgagtcgtcgtcgtcgggacgcgtttatcgagatcgggggttcggtttgtttttacggatatttttatgtagtatttagtcgcgatttttttaagggtacggtggcgcggggttggcggggcgcggcggcggcggtcggttcgtgggggcgttcgcggcgcgcggtcgggagcgcgggggcggcggcggaggcggcggcgggcgggtgtcgagcgggatcgcggggggtcgttcggtttttttacgttgtataacgttttttttaaggaggcgggcggcggcgttacggttacgtttattcggtcgttcgtttcgttcgcgttacgttatttcggttttttgcgtcgttttcgggattttggttaaggagtcgtcgtttttaatattaatacgtttaataggaaaattacgtttgtgtaggggcgcggcgggggagtcgaggggcgtgttcggggcgcgtgcgggcgcgcgtgtatcgaggttgtcggggtcgggggcgttttcgtt

SEQ ID NO: 37728 - DNA, 981 bp, Artificial Sequence
  chemically treated genomic DNA (Homo sapiens) CpG-island No: 37728
  misc_feature (547)..(547): n is either a, c, g or t
aacgaaaacgcccccgaccccgacaacctcgatacacgcgcgcccgcacgcgccccgaacacgcccctcgactcccccgccgcgcccctacacaaacgtaattttcctattaaacgtattaatattaaaaacgacgactccttaaccaaaatcccgaaaacgacgcaaaaaaccgaaataacgtaacgcgaacgaaacgaacgaccgaataaacgtaaccgtaacgccgccgcccgcctccttaaaaaaaacgttatacaacgtaaaaaaaccgaacgaccccccgcgatcccgctcgacacccgcccgccgccgcctccgccgccgcccccgcgctcccgaccgcgcgccgcgaacgcccccacgaaccgaccgccgccgccgcgccccgccaaccccgcgccaccgtacccttaaaaaaatcgcgactaaatactacataaaaatatccgtaaaaacaaaccgaacccccgatctcgataaacgcgtcccgacgacgacgactcgctaaacgaactcaaaacgaaaaccgacgctaaaacaactnaactaaacaaacgaaaaataacgaaaacgctcccgcactaccgcccgcgcccccgccgaccttaaacaaatccgaacgaaactaacaatacgcctcgactaactcgatataaatattaacgaccaacacgcctatcacctcgaccaaaataaacgacaacccgccgaaataaaaaaaccaaccgtacgaataataatttttcttctcctcgtcccgcttcgacccgactcgcccgcgttaacgaaaatatacacgatcacgccgataatattactcaaacctaaacgaaaacgatcaaacgaaaacctcgaaccacccccgaccccgccccgcccccgaccccgacccctacccgcctacgccaacgacccaaacgccacccccaaacgatctaaaccccaccccgaataatctaaacccccgtcctaaatcta

SEQ ID NO: 37729 - DNA, 552 bp, Artificial Sequence
  chemically treated genomic DNA (Homo sapiens) CpG-island No: 37729
tattcgtagaggttttgcggtcggcgtttttagttaggcgcgtcggatttttttttattagtgtgtatagtatcggattcggattcggttttagcgttagttttatttttttttttatcgttcgcgttatagttgggaatcgcggtttagacgtggtagcgttaacgtttttatttcgtttttgtttttttacgtagggtcgcgcgtaggcgagcggaggcggaggttaaggcgttattcgtttaggttcggagagcgaggggcggggttcggagagcgggggcgggattaggagggcgaggggcggggttcggagagcgggggcgggattaggagggcgaggggcggggtttgaggttcgagtcgcggcgtttggggcggtggtcgtcggattaaagttggtttttttcggtttttttttttcgttttttaaggttttttttatcgcgttattgtttcggtttatttgtagatacgtttatttagtagttagtttagtagcgtaagtggtgattagtgtgggtttttttgattttgagatcgaaggttcgg

SEQ ID NO: 37730 - DNA, 552 bp, Artificial Sequence
  chemically treated genomic DNA (Homo sapiens) CpG-island No: 37730
ccgaaccttcgatctcaaaatcaaaaaaacccacactaatcaccacttacgctactaaactaactactaaataaacgtatctacaaataaaccgaaacaataacgcgataaaaaaaaccttaaaaaacgaaaaaaaaaaaccgaaaaaaaccaactttaatccgacgaccaccgccccaaacgccgcgactcgaacctcaaaccccgcccctcgccctcctaatcccgcccccgctctccgaaccccgcccctcgccctcctaatcccgcccccgctctccgaaccccgcccctcgctctccgaacctaaacgaataacgccttaacctccgcctccgctcgcctacgcgcgaccctacgtaaaaaaacaaaaacgaaataaaaacgttaacgctaccacgtctaaaccgcgattcccaactataacgcgaacgataaaaaaaaaaataaaactaacgctaaaaccgaatccgaatccgatactatacacactaataaaaaaaaatccgacgcgcctaactaaaaacgccgaccgcaaaacctctacgaata

SEQ ID NO: 37731 - DNA, 552 bp, Artificial Sequence
  chemically treated genomic DNA (Homo sapiens) CpG-island No: 37731
tcgagttttcggttttaggattaaagaggtttatattggttattatttacgttgttgggttgattgttaggtagacgtatttgtagataaatcgagataatgacgcggtgggaaaggttttggggagcgaggaggaggagtcgggagaggttagttttggttcggcggttatcgttttaggcgtcgcgattcgagttttaggtttcgtttttcgtttttttggtttcgttttcgtttttcgagtttcgtttttcgtttttttggtttcgttttcgtttttcgggtttcgtttttcgtttttcgggtttgggcgggtggcgttttggttttcgttttcgttcgtttgcgcgcggttttgcgtgagggggtagaggcgaggtggaggcgttggcgttgttacgtttgggtcgcggtttttaattgtggcgcgggcggtggaggaggaggtggggttggcgttgaagtcggattcggattcggtgttgtgtatattggtgggggagagttcgacgcgtttggttaggagcgtcgatcgtagggtttttacgggtg

SEQ ID NO: 37732 - DNA, 552 bp, Artificial Sequence
  chemically treated genomic DNA (Homo sapiens) CpG-island No: 37732
cacccgtaaaaaccctacgatcgacgctcctaaccaaacgcgtcgaactctcccccaccaatatacacaacaccgaatccgaatccgacttcaacgccaaccccacctcctcctccaccgcccgcgccacaattaaaaaccgcgacccaaacgtaacaacgccaacgcctccacctcgcctctaccccctcacgcaaaaccgcgcgcaaacgaacgaaaacgaaaaccaaaacgccacccgcccaaacccgaaaaacgaaaaacgaaacccgaaaaacgaaaacgaaaccaaaaaaacgaaaaacgaaactcgaaaaacgaaaacgaaaccaaaaaaacgaaaaacgaaacctaaaactcgaatcgcgacgcctaaaacgataaccgccgaaccaaaactaacctctcccgactcctcctcctcgctccccaaaacctttcccaccgcgtcattatctcgatttatctacaaatacgtctacctaacaatcaacccaacaacgtaaataataaccaatataaacctctttaatcctaaaaccgaaaactcga

SEQ ID NO: 37733 - DNA, 530 bp, Artificial Sequence
  chemically treated genomic DNA (Homo sapiens) CpG-island No: 37733
tcgtattcgttttttatttcgtatttttagtttttcgtttttcggtttgcgtttcgggttatttcgcgggcggttttgtttgttatttttttaaacgttacggttgttttagcgttggttttcggttttttgttttttttattcgacggcgttttttttgggcgatagtttttattttttgtagttagagtgattttttagtattaaaaagcggttacgtgacgttttcgattaaaggttgtcgaatagattttattttaaatttcgtagttaggtatcgggattttggatcgcgttttttttaggttttatcgtcgtcgtttttcgtttcgttttaggagcgtttatattcgtcgcgtacgttgtttttttcgtttggatcgttcgcgtcggcgtcgattggtttagttcgtttcgtatttacgcgtgcgtttttcgagggtaggcggtttttattattatgacggttttgtatacggtgttttatttgtttagcgaagttttttttttttttttcggttagcggggtt

SEQ ID NO: 37734 - DNA, 530 bp, Artificial Sequence
  chemically treated genomic DNA (Homo sapiens) CpG-island No: 37734
aaccccgctaaccgaaaaaaaaaaaaaaaacttcgctaaacaaataaaacaccgtatacaaaaccgtcataataataaaaaccgcctaccctcgaaaaacgcacgcgtaaatacgaaacgaactaaaccaatcgacgccgacgcgaacgatccaaacgaaaaaaacaacgtacgcgacgaatataaacgctcctaaaacgaaacgaaaaacgacgacgataaaacctaaaaaaaacgcgatccaaaatcccgatacctaactacgaaatttaaaataaaatctattcgacaacctttaatcgaaaacgtcacgtaaccgctttttaatactaaaaaatcactctaactacaaaaaataaaaactatcgcccaaaaaaaacgccgtcgaataaaaaaaacaaaaaaccgaaaaccaacgctaaaacaaccgtaacgtttaaaaaaataacaaacaaaaccgcccgcgaaataacccgaaacgcaaaccgaaaaacgaaaaactaaaaatacgaaataaaaaacgaatacga

SEQ ID NO: 37735 - DNA, 530 bp, Artificial Sequence
  chemically treated genomic DNA (Homo sapiens) CpG-island No: 37735
gatttcgttggtcggagggagagggagagatttcgttgggtagatgggatatcgtgtgtagggtcgttatggtagtaggggtcgtttgttttcgggagacgtacgcgtgaatgcggagcgggttgagttagtcggcgtcggcgcgggcggtttaggcggaggaagtagcgtgcgcggcgggtgtggacgtttttggagcgaggcggggggcggcggcggtgaggtttagggagggcgcggtttagggtttcggtgtttggttgcggaatttagggtagagtttgttcggtagtttttaatcggagacgttacgtggtcgttttttaatgttgaaaaattattttggttgtagggagtggaggttgtcgtttagagagagcgtcgtcgggtgagaggagtagaaagtcggaagttaacgttggggtagtcgtggcgtttaggagagtgataggtagagtcgttcgcgaggtggttcgagacgtagatcggagggcggagggttgggggtgcgaggtagggagcgggtgcga

SEQ ID NO: 37736 - DNA, 530 bp, Artificial Sequence
  chemically treated genomic DNA (Homo sapiens) CpG-island No: 37736
tcgcacccgctccctacctcgcacccccaaccctccgccctccgatctacgtctcgaaccacctcgcgaacgactctacctatcactctcctaaacgccacgactaccccaacgttaacttccgactttctactcctctcacccgacgacgctctctctaaacgacaacctccactccctacaaccaaaataatttttcaacattaaaaaacgaccacgtaacgtctccgattaaaaactaccgaacaaactctaccctaaattccgcaaccaaacaccgaaaccctaaaccgcgccctccctaaacctcaccgccgccgccccccgcctcgctccaaaaacgtccacacccgccgcgcacgctacttcctccgcctaaaccgcccgcgccgacgccgactaactcaacccgctccgcattcacgcgtacgtctcccgaaaacaaacgacccctactaccataacgaccctacacacgatatcccatctacccaacgaaatctctccctctccctccgaccaacgaaatc

SEQ ID NO: 37737 - DNA, 1139 bp, Artificial Sequence
  chemically treated genomic DNA (Homo sapiens) CpG-island No: 37737
gggtacgcggtcgtcgttttttaggtttggacgtttaggtttaagttttaggtcggaagtatttcgcgaattcgttcgggtttgggtggaatggagttcgcgcgcggcgggcgtttttttaggaagggttaagttattttttttttatttcgagaggcgagggggcgagttcggtagaaggttttgtttatcgtagtttcgcgcggggtcgggttttgggagaggggttgtcgtggtaatcggtcgggcgttcgttagttgcggattagtttattgggtcgggcgggatgggtcgggaggagggggcgcgcgtcgcgtagatcgtcgcggagttacggtaggaggaggtaggggtcgcgggcgagtttgcgttgggtcggtcgagggaagcgcgtcgttggggtcgggggcggcggggattttacgggagcgcgcgcggcggggatttttaggggtttgcgggcggtcgggggaggttcggcggataaaggggcggagggcggagggttatggcgttttcggtattcgtcgtcgttcgttttcgagtcgcgtcgttagtcgtttcggttcgtttcggagtttttaagatgcgttttagagttcgcggagtcgtcgttcgcggggaggtagggtcgggtcgggttagggggtgtagggtcgagttggggagggaaaggggacggaggaggggacgcgcgggggagggaggaaacggttcgcgcggtttgagttttgacgggggaagcggttttgtagacgggagtttgagttttcgtttggtttcgggattgtgtagagcgcgatttaggcgtttttttcgggttcgggttgatttttaggattgagttcggacgtcgtcgtttcgcgtttcggggatttgtagaaagtcggtagattttcgttttgcgtcgtgttgggtttttcggggcgcgagtgtgagtgtgtgtgtgttcgcgcgcgcgcgtgtgtgtgcgcgtttgtgtgtttgtgtgtgagtgtgtttgtgcgagtgtgtgtgagtgtgtgcgtgcgcgtgtaagcgcggggtatcgaggcggttgagtagtcgggttttttttatagcggttagtatttgtagttttgggaaagtaagaaggtaaagatgattgaatggtttt

SEQ ID NO: 37738 - DNA, 1139 bp, Artificial Sequence
  chemically treated genomic DNA (Homo sapiens) CpG-island No: 37738
aaaaccattcaatcatctttaccttcttactttcccaaaactacaaatactaaccgctataaaaaaaacccgactactcaaccgcctcgataccccgcgcttacacgcgcacgcacacactcacacacactcgcacaaacacactcacacacaaacacacaaacgcgcacacacacgcgcgcgcgcgaacacacacacactcacactcgcgccccgaaaaacccaacacgacgcaaaacgaaaatctaccgactttctacaaatccccgaaacgcgaaacgacgacgtccgaactcaatcctaaaaatcaacccgaacccgaaaaaaacgcctaaatcgcgctctacacaatcccgaaaccaaacgaaaactcaaactcccgtctacaaaaccgcttcccccgtcaaaactcaaaccgcgcgaaccgtttcctccctcccccgcgcgtcccctcctccgtcccctttccctccccaactcgaccctacaccccctaacccgacccgaccctacctccccgcgaacgacgactccgcgaactctaaaacgcatcttaaaaactccgaaacgaaccgaaacgactaacgacgcgactcgaaaacgaacgacgacgaataccgaaaacgccataaccctccgccctccgcccctttatccgccgaacctcccccgaccgcccgcaaacccctaaaaatccccgccgcgcgcgctcccgtaaaatccccgccgcccccgaccccaacgacgcgcttccctcgaccgacccaacgcaaactcgcccgcgacccctacctcctcctaccgtaactccgcgacgatctacgcgacgcgcgccccctcctcccgacccatcccgcccgacccaataaactaatccgcaactaacgaacgcccgaccgattaccacgacaacccctctcccaaaacccgaccccgcgcgaaactacgataaacaaaaccttctaccgaactcgccccctcgcctctcgaaataaaaaaaaaataacttaacccttcctaaaaaaacgcccgccgcgcgcgaactccattccacccaaacccgaacgaattcgcgaaatacttccgacctaaaacttaaacctaaacgtccaaacctaaaaaacgacgaccgcgtaccc

SEQ ID NO: 37739 - DNA, 1139 bp, Artificial Sequence
  chemically treated genomic DNA (Homo sapiens) CpG-island No: 37739
aagattatttaattatttttatttttttgtttttttaagattgtaaatgttgatcgttgtgaggggggttcggttgtttagtcgtttcgatgtttcgcgtttgtacgcgtacgtatatatttatatatattcgtatagatatatttatatatagatatataagcgcgtatatatacgcgcgcgcgcggatatatatatatttatattcgcgtttcgagggatttagtacggcgtagggcgggggtttatcggttttttgtaggttttcgaggcgcgagacggcggcgttcgggtttagttttgggagttagttcgagttcgggaggaacgtttggatcgcgttttgtatagtttcgggattaggcgggaatttagattttcgtttgtagagtcgtttttttcgttagggtttaggtcgcgcgagtcgttttttttttttttcgcgcgttttttttttcgttttttttttttttttagttcgattttgtattttttggttcggttcggttttattttttcgcgggcggcggtttcgcgggttttggggcgtattttgggggtttcggggcgggtcgggacggttggcggcgcggttcgggggcgggcggcggcgggtgtcggggacgttatggtttttcgtttttcgtttttttgttcgtcgagtttttttcggtcgttcgtaagtttttgggggttttcgtcgcgcgcgttttcgtggggttttcgtcgttttcggttttagcggcgcgtttttttcggtcggtttagcgtaggttcgttcgcggtttttgtttttttttgtcgtggtttcgcgacgatttgcgcgacgcgcgtttttttttttcgatttatttcgttcggtttagtgagttaattcgtagttggcgggcgttcggtcggttgttacggtaattttttttttagggttcggtttcgcgcggagttgcggtaaataggattttttgtcggattcgttttttcgtttttcggggtgggggagaggtggtttaattttttttgggaggacgttcgtcgcgcgcgggttttattttatttaggttcgggcggattcgcgaggtgttttcggtttgaggtttagatttggacgtttaagtttggggaacggcggtcgcgtgttt

SEQ ID NO: 37740 - DNA, 1139 bp, Artificial Sequence
  chemically treated genomic DNA (Homo sapiens) CpG-island No: 37740
aaacacgcgaccgccgttccccaaacttaaacgtccaaatctaaacctcaaaccgaaaacacctcgcgaatccgcccgaacctaaataaaataaaacccgcgcgcgacgaacgtcctcccaaaaaaaattaaaccacctctcccccaccccgaaaaacgaaaaaacgaatccgacaaaaaatcctatttaccgcaactccgcgcgaaaccgaaccctaaaaaaaaaattaccgtaacaaccgaccgaacgcccgccaactacgaattaactcactaaaccgaacgaaataaatcgaaaaaaaaaaacgcgcgtcgcgcaaatcgtcgcgaaaccacgacaaaaaaaaacaaaaaccgcgaacgaacctacgctaaaccgaccgaaaaaaacgcgccgctaaaaccgaaaacgacgaaaaccccacgaaaacgcgcgcgacgaaaacccccaaaaacttacgaacgaccgaaaaaaactcgacgaacaaaaaaacgaaaaacgaaaaaccataacgtccccgacacccgccgccgcccgcccccgaaccgcgccgccaaccgtcccgacccgccccgaaacccccaaaatacgccccaaaacccgcgaaaccgccgcccgcgaaaaaataaaaccgaaccgaaccaaaaaatacaaaatcgaactaaaaaaaaaaaaaaaacgaaaaaaaaaacgcgcgaaaaaaaaaaaaaacgactcgcgcgacctaaaccctaacgaaaaaaacgactctacaaacgaaaatctaaattcccgcctaatcccgaaactatacaaaacgcgatccaaacgttcctcccgaactcgaactaactcccaaaactaaacccgaacgccgccgtctcgcgcctcgaaaacctacaaaaaaccgataaacccccgccctacgccgtactaaatccctcgaaacgcgaatataaatatatatatatccgcgcgcgcgcgtatatatacgcgcttatatatctatatataaatatatctatacgaatatatataaatatatacgtacgcgtacaaacgcgaaacatcgaaacgactaaacaaccgaacccccctcacaacgatcaacatttacaatcttaaaaaaacaaaaaaataaaaataattaaataatctt

SEQ ID NO: 37741 - DNA, 1395 bp, Artificial Sequence
  chemically treated genomic DNA (Homo sapiens) CpG-island No: 37741
tcgacgtaattatttcgggatggtgattaacgcgcggttgttgcgggtagagggattgaagagaatcggtggtttcgacgttggtttcgagttcgaggagttaaattaataaagagtttttcgagtcgcgaaattttttagagcggaagcgacgttttttcgtcgtcgtcgtcgcgtcgcgattttttttaagtttagggttcggtagtggattcgttgcggggtttgcggttaggacggcgtcgggttcgtagtcgggatgcgggaaataggtagaggttagaatacgagttttaaagagaagagtgggcgtttttttaaacgggtcggcgtagcggaaaaggttaattgaagtaagcgggaggtttcgtatcgaggttttgtttttcggggagtagttaggtatagcggataggggggtcgcgttttgttatcggttgagagaagtttcggtcgtcgtcgtcgttatcgttttcgtttcggggcgtcgtttttcggcggttttcgtttttttcggtcgagtagtcgattttttttttttcggttttgagacgtttggtttggttttcgtattttcggtttttttcgtacgtttttttgggggaggaagaggaggaggatatggcggcggtcggagggatcggttggtaggcgggtgggggtggcggtggggcgcgcgtttcggatgtcgtcggttagttttcgtcgtcggtagcgttttttttgcgagggttttcgcggttcggtcgttcgcggggattgcgcggttaggagattggcggttgagaagcgcggacggattgaggggggcgtttcgggaggaagttttggagcggtcgttttttttaattatcgagttaatatttagtttttttttttttttttttcgttttcgttttttgttcggaggagcgaatttaaggatggggacgtaatcgtggttttcggttttttttttttttttaagtcgtttttagtcgcgtaggtcgagttttcgttttcgttttcgcggtcgtcgcgtaggatcgaatttagtcgtagtttgcgggaagcgtttttttcggttcgggttttgttttttattggtaggggcgggaaagtcgatcgggttttttattggttgtgagggtcgttcgttaaaagtcgttcgttgttcgattttattttttttttcgcgttttttgaattcgtcgcggttttgggaggttcggcgcgtaaggcgcgtcgtttgggagtagttgcgattcgtaatcgttggcgttatgcggtttttattcgaggttaggcgtggagtgaatacggacgagcgacgagaagtgcggagaggttagggttgcgggtgttaatcgttttgtcgttaatttaaatgttttttattattttttaaaaagagaa

SEQ ID NO: 37742 - DNA, 1395 bp, Artificial Sequence
  chemically treated genomic DNA (Homo sapiens) CpG-island No: 37742
ttctctttttaaaaaataataaaaaacatttaaattaacgacaaaacgattaacacccgcaaccctaacctctccgcacttctcgtcgctcgtccgtattcactccacgcctaacctcgaataaaaaccgcataacgccaacgattacgaatcgcaactactcccaaacgacgcgccttacgcgccgaacctcccaaaaccgcgacgaattcaaaaaacgcgaaaaaaaaaataaaatcgaacaacgaacgacttttaacgaacgaccctcacaaccaataaaaaacccgatcgactttcccgcccctaccaataaaaaacaaaacccgaaccgaaaaaaacgcttcccgcaaactacgactaaattcgatcctacgcgacgaccgcgaaaacgaaaacgaaaactcgacctacgcgactaaaaacgacttaaaaaaaaaaaaaaaaccgaaaaccacgattacgtccccatccttaaattcgctcctccgaacaaaaaacgaaaacgaaaaaaaaaaaaaaaaaaactaaatattaactcgataattaaaaaaaacgaccgctccaaaacttcctcccgaaacgcccccctcaatccgtccgcgcttctcaaccgccaatctcctaaccgcgcaatccccgcgaacgaccgaaccgcgaaaaccctcgcaaaaaaaacgctaccgacgacgaaaactaaccgacgacatccgaaacgcgcgccccaccgccacccccacccgcctaccaaccgatccctccgaccgccgccatatcctcctcctcttcctcccccaaaaaaacgtacgaaaaaaaccgaaaatacgaaaaccaaaccaaacgtctcaaaaccgaaaaaaaaaaaatcgactactcgaccgaaaaaaacgaaaaccgccgaaaaacgacgccccgaaacgaaaacgataacgacgacgacgaccgaaacttctctcaaccgataacaaaacgcgacccccctatccgctatacctaactactccccgaaaaacaaaacctcgatacgaaacctcccgcttacttcaattaaccttttccgctacgccgacccgtttaaaaaaacgcccactcttctctttaaaactcgtattctaacctctacctatttcccgcatcccgactacgaacccgacgccgtcctaaccgcaaaccccgcaacgaatccactaccgaaccctaaacttaaaaaaaatcgcgacgcgacgacgacgacgaaaaaacgtcgcttccgctctaaaaaatttcgcgactcgaaaaactctttattaatttaactcctcgaactcgaaaccaacgtcgaaaccaccgattctcttcaatccctctacccgcaacaaccgcgcgttaatcaccatcccgaaataattacgtcga

SEQ ID NO: 37743 - DNA, 1395 bp, Artificial Sequence
  chemically treated genomic DNA (Homo sapiens) CpG-island No: 37743
ttttttttttaagaggtgataaaaagtatttaaattagcggtagggcggttaatattcgtagttttagttttttcgtatttttcgtcgttcgttcgtgtttattttacgtttggtttcgggtaggagtcgtatagcgttaacggttgcgggtcgtaattatttttaggcggcgcgttttgcgcgtcgggttttttaggatcgcggcgagtttagaaggcgcggggagagaagtgaggtcgagtagcgggcggtttttgacgaacggtttttatagttaatgggaagttcggtcgattttttcgtttttgttaatagggagtagaattcgggtcggggggggcgtttttcgtaggttgcggttggattcgattttgcgcgacggtcgcgaaggcgggggcggaggttcggtttgcgcggttgggagcggtttaggggaggagggaagatcggaagttacggttgcgtttttatttttagattcgttttttcgggtagggagcggagacggaggaggaggagggagaggttgaatgttggttcggtaattgagaggagcggtcgttttagagttttttttcggggcgttttttttagttcgttcgcgttttttagtcgttagttttttggtcgcgtagttttcgcggacggtcgggtcgcggagattttcgtagaagaggcgttgtcggcggcgaggattggtcggcggtattcgaggcgcgcgttttatcgttatttttattcgtttgttagtcggttttttcggtcgtcgttatgtttttttttttttttttttttagggagacgtacgaggaggatcgggagtacgagagttaggttaagcgttttaagatcgaggagggggagatcgattattcggtcgaggaaggcgagaatcgtcgggaagcgacgtttcggggcgggggcgatggcggcggcggcggtcggagttttttttagtcggtaataaagcgcggtttttttgttcgttgtgtttggttgtttttcgggaagtagggtttcggtgcggggtttttcgtttgttttagttagtttttttcgttgcgtcgattcgtttggggaagcgtttatttttttttttggggttcgtattttggtttttatttgtttttcgtatttcgattgcgaattcggcgtcgttttggtcgtaggtttcgtagcgagtttattgtcgggttttgaatttggggagggtcgcggcgcggcggcggcggcggggaggcgtcgttttcgttttggggggtttcgcggttcggggagttttttgttagtttaatttttcgggttcggggttagcgtcgggattatcggttttttttagtttttttgttcgtagtagtcgcgcgttggttattatttcgggatggttgcgtcgg

SEQ ID NO: 37744 - DNA, 1395 bp, Artificial Sequence
  chemically treated genomic DNA (Homo sapiens) CpG-island No: 37744
ccgacgcaaccatcccgaaataataaccaacgcgcgactactacgaacaaaaaaactaaaaaaaaccgataatcccgacgctaaccccgaacccgaaaaattaaactaacaaaaaactccccgaaccgcgaaaccccccaaaacgaaaacgacgcctccccgccgccgccgccgcgccgcgaccctccccaaattcaaaacccgacaataaactcgctacgaaacctacgaccaaaacgacgccgaattcgcaatcgaaatacgaaaaacaaataaaaaccaaaatacgaaccccaaaaaaaaaaataaacgcttccccaaacgaatcgacgcaacgaaaaaaactaactaaaacaaacgaaaaaccccgcaccgaaaccctacttcccgaaaaacaaccaaacacaacgaacaaaaaaaccgcgctttattaccgactaaaaaaaactccgaccgccgccgccgccatcgcccccgccccgaaacgtcgcttcccgacgattctcgccttcctcgaccgaataatcgatctccccctcctcgatcttaaaacgcttaacctaactctcgtactcccgatcctcctcgtacgtctccctaaaaaaaaaaaaaaaaaaaaacataacgacgaccgaaaaaaccgactaacaaacgaataaaaataacgataaaacgcgcgcctcgaataccgccgaccaatcctcgccgccgacaacgcctcttctacgaaaatctccgcgacccgaccgtccgcgaaaactacgcgaccaaaaaactaacgactaaaaaacgcgaacgaactaaaaaaaacgccccgaaaaaaaactctaaaacgaccgctcctctcaattaccgaaccaacattcaacctctccctcctcctcctccgtctccgctccctacccgaaaaaacgaatctaaaaataaaaacgcaaccgtaacttccgatcttccctcctcccctaaaccgctcccaaccgcgcaaaccgaacctccgcccccgccttcgcgaccgtcgcgcaaaatcgaatccaaccgcaacctacgaaaaacgccccccccgacccgaattctactccctattaacaaaaacgaaaaaatcgaccgaacttcccattaactataaaaaccgttcgtcaaaaaccgcccgctactcgacctcacttctctccccgcgccttctaaactcgccgcgatcctaaaaaacccgacgcgcaaaacgcgccgcctaaaaataattacgacccgcaaccgttaacgctatacgactcctacccgaaaccaaacgtaaaataaacacgaacgaacgacgaaaaatacgaaaaaactaaaactacgaatattaaccgccctaccgctaatttaaatactttttatcacctcttaaaaaaaaaa

SEQ ID NO: 37745 - DNA, 533 bp, Artificial Sequence
  chemically treated genomic DNA (Homo sapiens) CpG-island No: 37745
gtttttttttttgtttcgtcggttgttgagggagcggcggtcgttttgcgtttggaggtcgttttttcgtttttttcgggtcgcgggtagcgagaggcggcggcggtcggagtcggtgtgggcggtttgaggcgaaagttcggtcggtttttaggggaatgaaataattatcggttattagagtaataacggttttcgcggttgtatcgtcgatttttcggaggagcgaaggcgtttcgtaaaaatacgtcgtagagcggaattcgggtttcgtcgttttagtagggggtagtagcgacgtagataggaagtttaggttttgggcgttggatatttcggcggttttcgcgattaatgagcgttatattaatttttaggcggcgtttttatcgtatttgtcgtcgtcgtcgtttcggggcgagaattgcgtcgtcggttttgttacgttgattcgtggggtttcggtcgtcgttttagggtgacgaggaggagtaggacggggttttagagaagggtaagagtttagagttcgg

SEQ ID NO: 37746 - DNA, 533 bp, Artificial Sequence
  chemically treated genomic DNA (Homo sapiens) CpG-island No: 37746
ccgaactctaaactcttacccttctctaaaaccccgtcctactcctcctcgtcaccctaaaacgacgaccgaaaccccacgaatcaacgtaacaaaaccgacgacgcaattctcgccccgaaacgacgacgacgacaaatacgataaaaacgccgcctaaaaattaatataacgctcattaatcgcgaaaaccgccgaaatatccaacgcccaaaacctaaacttcctatctacgtcgctactaccccctactaaaacgacgaaacccgaattccgctctacgacgtatttttacgaaacgccttcgctcctccgaaaaatcgacgatacaaccgcgaaaaccgttattactctaataaccgataattatttcattcccctaaaaaccgaccgaactttcgcctcaaaccgcccacaccgactccgaccgccgccgcctctcgctacccgcgacccgaaaaaaacgaaaaaacgacctccaaacgcaaaacgaccgccgctccctcaacaaccgacgaaacaaaaaaaaaaac

SEQ ID NO: 37747 - DNA, 533 bp, Artificial Sequence
  chemically treated genomic DNA (Homo sapiens) CpG-island No: 37747
tcgagttttgagtttttgtttttttttggggtttcgttttgttttttttcgttattttggggcggcggtcggggttttacgggttaacgtggtagggtcgacggcgtagttttcgtttcggggcggcggcggcggtaagtgcggtgggagcgtcgtttggaggttggtgtggcgtttattggtcgcggaggtcgtcgaggtgtttagcgtttaggatttgggttttttgtttgcgtcgttgttgttttttgttggggcggcggggttcgggtttcgttttgcggcgtgtttttgcggggcgttttcgttttttcgggaagtcggcggtgtagtcgcggaggtcgttgttgttttggtagtcggtggttgttttatttttttaggggtcggtcgggttttcgttttaggtcgtttatatcggtttcggtcgtcgtcgtttttcgttattcgcggttcggaggaggcgagggaacgatttttaggcgtagggcggtcgtcgtttttttagtagtcggcggggtagagggaaagat

SEQ ID NO: 37748 - DNA, 533 bp, Artificial Sequence
  chemically treated genomic DNA (Homo sapiens) CpG-island No: 37748
atctttccctctaccccgccgactactaaaaaaacgacgaccgccctacgcctaaaaatcgttccctcgcctcctccgaaccgcgaataacgaaaaacgacgacgaccgaaaccgatataaacgacctaaaacgaaaacccgaccgacccctaaaaaaataaaacaaccaccgactaccaaaacaacaacgacctccgcgactacaccgccgacttcccgaaaaaacgaaaacgccccgcaaaaacacgccgcaaaacgaaacccgaaccccgccgccccaacaaaaaacaacaacgacgcaaacaaaaaacccaaatcctaaacgctaaacacctcgacgacctccgcgaccaataaacgccacaccaacctccaaacgacgctcccaccgcacttaccgccgccgccgccccgaaacgaaaactacgccgtcgaccctaccacgttaacccgtaaaaccccgaccgccgccccaaaataacgaaaaaaaacaaaacgaaaccccaaaaaaaaacaaaaactcaaaactcga

SEQ ID NO: 37749 - DNA, 696 bp, Artificial Sequence
  chemically treated genomic DNA (Homo sapiens) CpG-island No: 37749
ttttgttacgacgcgggtaagaggggtttcgggggttagagttgtgtttcgagcgtacgtgtgtcgggttcggagtttttagcgggtttttagaggcgcgcgtgtttgatgcggatggggggcggcgattgggatttttagttttttagttcgtgatagcgtttcgggagagcgcggttcgggtattcgaaggttgcgtattagtcgggtggatatgcggggcggttgtttttcgtgggtcgcgcgagttatttatttgggcgggtaaggcgtgcgtcgtagtttagagttttagttcgacggttagcgcggtttagacggcgacgggcgttatgggtgcgggcggggttcggttgttttttgttttcgcgttttcgcgttttcgtagtttagcgttttttttttaggtttcgttgcgttcgttagttttcgattgaaagcgaaagttcgcgttttagcgggttagaggttaggcggcggggcggggcggggttagtcggttttggatacgttttttttacgtttttttttagacgttgttgttgggttttcgattcgattattttagtatcgttgggtcgatatttttagcgttatttttagtattcgggtgattttttaatttttttttatcgttttttttttttcgaattattatttttatttgttcggtttttatttgtttttttagttttt

SEQ ID NO: 37750 - DNA, 696 bp, Artificial Sequence
  chemically treated genomic DNA (Homo sapiens) CpG-island No: 37750
aaaaactaaaaaaacaaataaaaaccgaacaaataaaaataataattcgaaaaaaaaaaaacgataaaaaaaaattaaaaaatcacccgaatactaaaaataacgctaaaaatatcgacccaacgatactaaaataatcgaatcgaaaacccaacaacaacgtctaaaaaaaaacgtaaaaaaaacgtatccaaaaccgactaaccccgccccgccccgccgcctaacctctaacccgctaaaacgcgaactttcgctttcaatcgaaaactaacgaacgcaacgaaacctaaaaaaaaaacgctaaactacgaaaacgcgaaaacgcgaaaacaaaaaacaaccgaaccccgcccgcacccataacgcccgtcgccgtctaaaccgcgctaaccgtcgaactaaaactctaaactacgacgcacgccttacccgcccaaataaataactcgcgcgacccacgaaaaacaaccgccccgcatatccacccgactaatacgcaaccttcgaatacccgaaccgcgctctcccgaaacgctatcacgaactaaaaaactaaaaatcccaatcgccgccccccatccgcatcaaacacgcgcgcctctaaaaacccgctaaaaactccgaacccgacacacgtacgctcgaaacacaactctaacccccgaaacccctcttacccgcgtcgtaacaaaa

SEQ ID NO: 37751 - DNA, 696 bp, Artificial Sequence
  chemically treated genomic DNA (Homo sapiens) CpG-island No: 37751
gggagttgggagggtaggtggaggtcgggtaggtggagatggtgattcgaagaggaggggacgataggaggaggttgaggggttattcgagtgttgggagtgacgttggaggtatcggtttagcgatgttggagtggtcgggtcggaggtttagtagtagcgtttggggaggggcgtgggggaggcgtgtttaaggtcggttggtttcgtttcgtttcgtcgtttggtttttggttcgttggggcgcgggttttcgtttttagtcgagggttagcgagcgtagcggagtttggagagaaggcgttgggttgcgagggcgcgagggcgcgagggtagggggtaatcggatttcgttcgtatttatggcgttcgtcgtcgtttgggtcgcgttggtcgtcggattggagttttgggttgcggcgtacgttttgttcgtttaggtgggtgattcgcgcggtttacgggggatagtcgtttcgtatgtttattcggttggtgcgtagttttcgggtgttcgggtcgcgttttttcggggcgttgttacgggttgggaggttgggagttttagtcgtcgttttttattcgtattagatacgcgcgtttttggggattcgttggggatttcgggttcggtatacgtgcgttcggggtataattttggttttcgaagttttttttattcgcgtcgtgataggg

SEQ ID NO: 37752 - DNA, 696 bp, Artificial Sequence
  chemically treated genomic DNA (Homo sapiens) CpG-island No: 37752
ccctatcacgacgcgaataaaaaaaacttcgaaaaccaaaattataccccgaacgcacgtataccgaacccgaaatccccaacgaatccccaaaaacgcgcgtatctaatacgaataaaaaacgacgactaaaactcccaacctcccaacccgtaacaacgccccgaaaaaacgcgacccgaacacccgaaaactacgcaccaaccgaataaacatacgaaacgactatcccccgtaaaccgcgcgaatcacccacctaaacgaacaaaacgtacgccgcaacccaaaactccaatccgacgaccaacgcgacccaaacgacgacgaacgccataaatacgaacgaaatccgattaccccctaccctcgcgccctcgcgccctcgcaacccaacgccttctctccaaactccgctacgctcgctaaccctcgactaaaaacgaaaacccgcgccccaacgaaccaaaaaccaaacgacgaaacgaaacgaaaccaaccgaccttaaacacgcctcccccacgcccctccccaaacgctactactaaacctccgacccgaccactccaacatcgctaaaccgatacctccaacgtcactcccaacactcgaataacccctcaacctcctcctatcgtcccctcctcttcgaatcaccatctccacctacccgacctccacctaccctcccaactccc

SEQ ID NO: 37753 - DNA, 911 bp, Artificial Sequence
  chemically treated genomic DNA (Homo sapiens) CpG-island No: 37753
atttttgcgttcggcgtcgcgtttcggagcgagttgatagtcgcggtaggcgaaggcgcggtagagaggggggagaaaggttttttttttcgttcgtaagattattatggttttacgttttttggttttcgcggcgtacggtagtattgcgacggcgcgaggggtcgttttacggtagggtcgcgaagttcgaggaagcgcggcggcgcggtcgatcgtgcgtttttttagcggtgcgacggggtgagggggcggcgggcggcgcgggttgattcgggcggtcgttttttggtcgcggttattttaggttgtttcgttgcgtcgttggcggtgggcgtggcgttgtcggcggttaggcgcggacgtcggaggaggtgttttcgggtttaggggtgttcggttaggggcggggttgtcgggttcgggcgattgtcggagttgcggaagtcgtggaagcgtcggcgacgtatcgcgcgatggcgcgggcgggataggtgagcgaagcgcggtttgtagttttttttttttttcggggggacgagtggggtattattttcgcgcggggtttttcgttgggttattttttcgttagcgtttagtttcgtgcggtttgtcggattaggtagggtagagtcggtttcggcgttgttttcgtttttggggtcggaagcgatcggggttggtcgggtttggtttttggtgttttcggtcgggtttcggttttttttttttttcggtttttttcggtcgggtcgagtttttttcgcgcgtttattgtgaggttacgttttgtaggcgcgttttggtattcgggttaagacgttcggagcggttgttgtagttagtagcggtttttttatcggttgtttcgtttagatttagtcgggaggggtgcgaggtatgtagttggg

SEQ ID NO: 37754 - DNA, 911 bp, Artificial Sequence
  chemically treated genomic DNA (Homo sapiens) CpG-island No: 37754
cccaactacatacctcgcacccctcccgactaaatctaaacgaaacaaccgataaaaaaaccgctactaactacaacaaccgctccgaacgtcttaacccgaataccaaaacgcgcctacaaaacgtaacctcacaataaacgcgcgaaaaaaactcgacccgaccgaaaaaaaccgaaaaaaaaaaaaaaccgaaacccgaccgaaaacaccaaaaaccaaacccgaccaaccccgatcgcttccgaccccaaaaacgaaaacaacgccgaaaccgactctaccctacctaatccgacaaaccgcacgaaactaaacgctaacgaaaaaataacccaacgaaaaaccccgcgcgaaaataataccccactcgtccccccgaaaaaaaaaaaaaactacaaaccgcgcttcgctcacctatcccgcccgcgccatcgcgcgatacgtcgccgacgcttccacgacttccgcaactccgacaatcgcccgaacccgacaaccccgcccctaaccgaacacccctaaacccgaaaacacctcctccgacgtccgcgcctaaccgccgacaacgccacgcccaccgccaacgacgcaacgaaacaacctaaaataaccgcgaccaaaaaacgaccgcccgaatcaacccgcgccgcccgccgccccctcaccccgtcgcaccgctaaaaaaacgcacgatcgaccgcgccgccgcgcttcctcgaacttcgcgaccctaccgtaaaacgacccctcgcgccgtcgcaatactaccgtacgccgcgaaaaccaaaaaacgtaaaaccataataatcttacgaacgaaaaaaaaaacctttctcccccctctctaccgcgccttcgcctaccgcgactatcaactcgctccgaaacgcgacgccgaacgcaaaaat

SEQ ID NO: 37755 - DNA, 911 bp, Artificial Sequence
  chemically treated genomic DNA (Homo sapiens) CpG-island No: 37755
tttagttgtatgtttcgtatttttttcgattaggtttgagcggggtagtcggtgaaggggtcgttattggttgtagtagtcgtttcgggcgttttggttcgggtgttagggcgcgtttgtaggacgtgattttataatgggcgcgcgaggggagttcggttcggtcgggggaagtcgggggaggaggggaatcgaggttcggtcggagatattagagattaggttcggttagtttcggtcgttttcgattttaggggcggggatagcgtcgagatcgattttgttttgtttgattcgataggtcgtacggggttgggcgttggcgaaggggtggtttagcggggagtttcgcgcggaggtggtgttttattcgttttttcgagagagggaaaaggttataagtcgcgtttcgtttatttgtttcgttcgcgttatcgcgcgatgcgtcgtcgacgtttttacgattttcgtagtttcggtagtcgttcgggttcggtagtttcgtttttggtcgaatatttttaaattcggggatatttttttcggcgttcgcgtttagtcgtcggtagcgttacgtttatcgttagcggcgtagcgaggtagtttggagtgatcgcgattaaggagcggtcgttcgggttagttcgcgtcgttcgtcgtttttttatttcgtcgtatcgttgggaaagcgtacggtcggtcgcgtcgtcgcgttttttcgggtttcgcgattttgtcgtaaagcggtttttcgcgtcgtcgtaatgttgtcgtgcgtcgcgggagttagggggcgtggggttatggtggttttgcgggcggggaagaagattttttttttttttttttgtcgcgttttcgtttgtcgcggttgttaattcgtttcggagcgcggcgtcgagcgtagggat

SEQ ID NO: 37756 - DNA, 911 bp, Artificial Sequence
  chemically treated genomic DNA (Homo sapiens) CpG-island No: 37756
atccctacgctcgacgccgcgctccgaaacgaattaacaaccgcgacaaacgaaaacgcgacaaaaaaaaaaaaaaaaaatcttcttccccgcccgcaaaaccaccataaccccacgccccctaactcccgcgacgcacgacaacattacgacgacgcgaaaaaccgctttacgacaaaatcgcgaaacccgaaaaaacgcgacgacgcgaccgaccgtacgctttcccaacgatacgacgaaataaaaaaacgacgaacgacgcgaactaacccgaacgaccgctccttaatcgcgatcactccaaactacctcgctacgccgctaacgataaacgtaacgctaccgacgactaaacgcgaacgccgaaaaaaatatccccgaatttaaaaatattcgaccaaaaacgaaactaccgaacccgaacgactaccgaaactacgaaaatcgtaaaaacgtcgacgacgcatcgcgcgataacgcgaacgaaacaaataaacgaaacgcgacttataaccttttccctctctcgaaaaaacgaataaaacaccacctccgcgcgaaactccccgctaaaccaccccttcgccaacgcccaaccccgtacgacctatcgaatcaaacaaaacaaaatcgatctcgacgctatccccgcccctaaaatcgaaaacgaccgaaactaaccgaacctaatctctaatatctccgaccgaacctcgattcccctcctcccccgacttcccccgaccgaaccgaactcccctcgcgcgcccattataaaatcacgtcctacaaacgcgccctaacacccgaaccaaaacgcccgaaacgactactacaaccaataacgaccccttcaccgactaccccgctcaaacctaatcgaaaaaaatacgaaacatacaactaaa

SEQ ID NO: 37757 - DNA, 1346 bp, Artificial Sequence
  chemically treated genomic DNA (Homo sapiens) CpG-island No: 37757
tatttggttattgaaaataaggggtcgttaaggaggtaaagcggagttagttttcgggagggattcggtttttcgtcgttcgcgagaatgataggcgcgttcgtttagggcggtgtcgggagaggcgggggtggaaggaagaggaggaatcggataaagttagtttcgtcgggttttcggttttttcgttcgtcgcgatttcggggttagttattttttttgtcgcgggttttcggggtttatagttgttttcgggaacggtcgtcgtcgttcgtagtagggttaagtcggggatgcggggttagggcggggttttgggtagggtcggggatcggaatttgtagtgggacgcggatggggaggacgcgcggcgtcgggagtcggggttggtaaaagggtcggggataagaattcgatttgaatttggaaggggtcgcggatcggtcggggcggtgaattggggcgggtatcggggtgggaacggagaggggtcgggatttaaatcgggaaggaggtttggatggggatagagttacggttcggggcgggttcgaagaggagcgggatagggacggggcggaggatgaggagggggtcgcggttcggggcgtacgtcggggatttatcgttttgtttttgagggtcgcgttttttcgcgttgttagtatttggagcgtcgtcgggcgcgcgcgcggagtagcgattgtgcgtcgagttcgtttcggttgtgtgaggtacggcgtagtagttattagttaggggcgtcggagttatcgtttcgtagtattttcggttatttacgcgttgtttttttggtcgtcgagtatagtttcgcggtttttcgtattagtagtttagtcgatttagttagtttcgttcggtcgtttgcgtcgttttcgtcgtcgaaaatggcgttttagtgttgtttttttcggcgtttcgtttcgtttcgttttataatgtcgcgcgtcggtatgacgttatcgtttttcgtttcgttcggggttggggaaattgaggttgggtggtttttcgtaagcgttcggcgagttggggattggaggggcgagaaagttgtttgggtattaggtgggcggttatagggaggagggtgacggtgtaggatttagcgggtttttcggttgtaacgcggacgggggtggggcgttcggggtagggcgcggttcgcggggtgggcggttaggttttggttttttcgatttcgtagtcgcgatgatcgagcgtttcggtagttttttttttagtcggattgtgggttttattagaatgcggtcggggacggtgtaggttcggtcgtagtcgttattattgggttttcgttttat

SEQ ID NO: 37758 - DNA, 1346 bp, Artificial Sequence
  chemically treated genomic DNA (Homo sapiens) CpG-island No: 37758
ataaaacgaaaacccaataataacgactacgaccgaacctacaccgtccccgaccgcattctaataaaacccacaatccgactaaaaaaaaaactaccgaaacgctcgatcatcgcgactacgaaatcgaaaaaaccaaaacctaaccgcccaccccgcgaaccgcgccctaccccgaacgccccacccccgtccgcgttacaaccgaaaaacccgctaaatcctacaccgtcaccctcctccctataaccgcccacctaatacccaaacaactttctcgcccctccaatccccaactcgccgaacgcttacgaaaaaccacccaacctcaatttccccaaccccgaacgaaacgaaaaacgataacgtcataccgacgcgcgacattataaaacgaaacgaaacgaaacgccgaaaaaaacaacactaaaacgccattttcgacgacgaaaacgacgcaaacgaccgaacgaaactaactaaatcgactaaactactaatacgaaaaaccgcgaaactatactcgacgaccaaaaaaacaacgcgtaaataaccgaaaatactacgaaacgataactccgacgcccctaactaataactactacgccgtacctcacacaaccgaaacgaactcgacgcacaatcgctactccgcgcgcgcgcccgacgacgctccaaatactaacaacgcgaaaaaacgcgaccctcaaaaacaaaacgataaatccccgacgtacgccccgaaccgcgaccccctcctcatcctccgccccgtccctatcccgctcctcttcgaacccgccccgaaccgtaactctatccccatccaaacctccttcccgatttaaatcccgacccctctccgttcccaccccgatacccgccccaattcaccgccccgaccgatccgcgaccccttccaaattcaaatcgaattcttatccccgacccttttaccaaccccgactcccgacgccgcgcgtcctccccatccgcgtcccactacaaattccgatccccgaccctacccaaaaccccgccctaaccccgcatccccgacttaaccctactacgaacgacgacgaccgttcccgaaaacaactataaaccccgaaaacccgcgacaaaaaaaataactaaccccgaaatcgcgacgaacgaaaaaaccgaaaacccgacgaaactaactttatccgattcctcctcttccttccacccccgcctctcccgacaccgccctaaacgaacgcgcctatcattctcgcgaacgacgaaaaaccgaatccctcccgaaaactaactccgctttacctccttaacgaccccttattttcaataaccaaata

SEQ ID NO: 37759 - DNA, 1346 bp, Artificial Sequence
  chemically treated genomic DNA (Homo sapiens) CpG-island No: 37759
gtggggcgggagtttagtggtggcggttgcggtcgggtttgtatcgttttcggtcgtattttggtagggtttatagttcggttggaagggaagttgtcgaagcgttcggttatcgcggttgcggagtcggagaggttagggtttggtcgtttatttcgcgagtcgcgttttgtttcgagcgttttattttcgttcgcgttataatcgggaggttcgttgggttttgtatcgttatttttttttttgtgatcgtttatttgatatttaaataattttttcgtttttttagtttttagttcgtcgagcgtttgcggggagttatttagttttagtttttttagtttcgggcggggcgaggggcgatgacgttatgtcggcgcgcggtattgtggggcggggcgaggcggggcgtcggggggagtaatattgagacgttattttcggcggcgggagcggcgtaggcggtcgagcgggattggttgggtcggttgggttgttggtgcgaggagtcgcggggttgtgttcggcggttaaggggatagcgcgtgggtggtcgaggatgttgcggggcggtagtttcggcgtttttagttggtgattgttgcgtcgtgttttatatagtcgaggcgggttcggcgtatagtcgttgtttcgcgcgcgcgttcggcggcgttttaggtgttgatagcgcgagagagcgcggtttttaggagtaaggcggtgagttttcggcgtgcgtttcggatcgcggttttttttttatttttcgtttcgtttttgtttcgttttttttcggattcgtttcgggtcgtaattttgtttttatttaggtttttttttcggtttgggtttcggttttttttcgtttttatttcggtattcgttttagtttatcgtttcggtcggttcgcgattttttttaggtttaggtcgggtttttgttttcggtttttttgttagtttcggttttcggcgtcgcgcgttttttttattcgcgttttattgtaggtttcggttttcggttttgtttagggtttcgttttggtttcgtattttcggtttggttttgttgcgggcggcggcggtcgttttcggggatagttgtggatttcgggaattcgcgataggggaggtggttgatttcgggatcgcggcgggcggggaggtcggaggttcggcggggttggttttgttcgatttttttttttttttttattttcgtttttttcggtatcgttttgagcggacgcgtttgttattttcgcgggcggcggggggtcgggtttttttcgagagttggtttcgttttgtttttttggcgattttttatttttagtaattagatg

SEQ ID NO: 37760 - DNA, 1346 bp, Artificial Sequence
  chemically treated genomic DNA (Homo sapiens) CpG-island No: 37760
catctaattactaaaaataaaaaatcgccaaaaaaacaaaacgaaaccaactctcgaaaaaaacccgaccccccgccgcccgcgaaaataacaaacgcgtccgctcaaaacgataccgaaaaaaacgaaaataaaaaaaaaaaaaaaaatcgaacaaaaccaaccccgccgaacctccgacctccccgcccgccgcgatcccgaaatcaaccacctcccctatcgcgaattcccgaaatccacaactatccccgaaaacgaccgccgccgcccgcaacaaaaccaaaccgaaaatacgaaaccaaaacgaaaccctaaacaaaaccgaaaaccgaaacctacaataaaacgcgaataaaaaaaacgcgcgacgccgaaaaccgaaactaacaaaaaaaccgaaaacaaaaacccgacctaaacctaaaaaaaatcgcgaaccgaccgaaacgataaactaaaacgaataccgaaataaaaacgaaaaaaaaccgaaacccaaaccgaaaaaaaaacctaaataaaaacaaaattacgacccgaaacgaatccgaaaaaaaacgaaacaaaaacgaaacgaaaaataaaaaaaaaaccgcgatccgaaacgcacgccgaaaactcaccgccttactcctaaaaaccgcgctctctcgcgctatcaacacctaaaacgccgccgaacgcgcgcgcgaaacaacgactatacgccgaacccgcctcgactatataaaacacgacgcaacaatcaccaactaaaaacgccgaaactaccgccccgcaacatcctcgaccacccacgcgctatccccttaaccgccgaacacaaccccgcgactcctcgcaccaacaacccaaccgacccaaccaatcccgctcgaccgcctacgccgctcccgccgccgaaaataacgtctcaatattactccccccgacgccccgcctcgccccgccccacaataccgcgcgccgacataacgtcatcgcccctcgccccgcccgaaactaaaaaaactaaaactaaataactccccgcaaacgctcgacgaactaaaaactaaaaaaacgaaaaaattatttaaatatcaaataaacgatcacaaaaaaaaaaataacgatacaaaacccaacgaacctcccgattataacgcgaacgaaaataaaacgctcgaaacaaaacgcgactcgcgaaataaacgaccaaaccctaacctctccgactccgcaaccgcgataaccgaacgcttcgacaacttcccttccaaccgaactataaaccctaccaaaatacgaccgaaaacgatacaaacccgaccgcaaccgccaccactaaactcccgccccac

SEQ ID NO: 37761 - DNA, 820 bp, Artificial Sequence
  chemically treated genomic DNA (Homo sapiens) CpG-island No: 37761
ggggcgttgaattatttgggcgggaatcgttcggcgattgtttcgcgcgttttcgtttgagttagttcggtcgggagtttgatagtcggaagtttatcgtaagttcggcgacgcgcgtacgcgttgttttcgttagattttcgcgtttgcgtagttaggaagtgaggtcgcggcggaggggacggggttaggtcgggtcgtcgtttgacgcgacgttttttacgggcgtttacgttacggcgtcgaggcggaagatggtgtattttcgggtcggcggttgttgagttgattcggacggcgagggagcgggagttcgagttcgattatttcggttgtcgcggggtgcggcgtagttatcgttatgtcgttgttgtagtcggcgttcgattttttggcgggtttaggttttttgggcggtgttttcggtcgcgattagagtgatttcgtggggtagacggtggaattgggcgagttgcggttgcgggtgcggcgggttttggtcgaaggtgaggtttcgggtcggtagcgcgggtgcggtcgcggagtgttgttttcgggacgttgggggtagcgttagttcggagtggaagggcgtgggttagggttggggagggttttagcgggatcgtgggttagggtcggttaggggagggtttttgtcgagggcgtgggttagggttaggcgaaggttatagcgcgggcgtaggtgagtgtttgttggcggtgattgcggagggcgaggttgggatcgggtcggggtatttttttgttataagagtagggttaagtcggagtaaggtttggggtttggggaattttt

SEQ ID NO: 37762 - DNA, 820 bp, Artificial Sequence
  chemically treated genomic DNA (Homo sapiens) CpG-island No: 37762
aaaaattccccaaaccccaaaccttactccgacttaaccctactcttataacaaaaaaataccccgacccgatcccaacctcgccctccgcaatcaccgccaacaaacactcacctacgcccgcgctataaccttcgcctaaccctaacccacgccctcgacaaaaaccctcccctaaccgaccctaacccacgatcccgctaaaaccctccccaaccctaacccacgcccttccactccgaactaacgctacccccaacgtcccgaaaacaacactccgcgaccgcacccgcgctaccgacccgaaacctcaccttcgaccaaaacccgccgcacccgcaaccgcaactcgcccaattccaccgtctaccccacgaaatcactctaatcgcgaccgaaaacaccgcccaaaaaacctaaacccgccaaaaaatcgaacgccgactacaacaacgacataacgataactacgccgcaccccgcgacaaccgaaataatcgaactcgaactcccgctccctcgccgtccgaatcaactcaacaaccgccgacccgaaaatacaccatcttccgcctcgacgccgtaacgtaaacgcccgtaaaaaacgtcgcgtcaaacgacgacccgacctaaccccgtcccctccgccgcgacctcacttcctaactacgcaaacgcgaaaatctaacgaaaacaacgcgtacgcgcgtcgccgaacttacgataaacttccgactatcaaactcccgaccgaactaactcaaacgaaaacgcgcgaaacaatcgccgaacgattcccgcccaaataattcaacgcccc

SEQ ID NO: 37763 - DNA, 820 bp, Artificial Sequence
  chemically treated genomic DNA (Homo sapiens) CpG-island No: 37763
gggggttttttaagttttaggttttgtttcgatttgattttatttttatgataagaaagtatttcgattcggttttagtttcgtttttcgtaattatcgttagtaggtatttatttacgttcgcgttatgattttcgtttggttttgatttacgttttcggtagagatttttttttggtcgattttgatttacgatttcgttgggattttttttagttttaatttacgtttttttatttcgggttgacgttgtttttagcgtttcggagataatatttcgcggtcgtattcgcgttgtcgattcggggttttattttcggttaggattcgtcgtattcgtagtcgtagttcgtttagttttatcgtttgttttacgaagttattttggtcgcggtcggaagtatcgtttagggagtttggattcgttaagaagtcgagcgtcgattgtagtagcgatatggcggtggttgcgtcgtatttcgcggtagtcggagtggtcgggttcgggttttcgttttttcgtcgttcgggttagtttagtaatcgtcggttcggaggtgtattatttttcgtttcgacgtcgtgacgtaggcgttcgtgaggagcgtcgcgttaggcggcgattcggtttagtttcgtttttttcgtcgcggttttattttttggttgcgtaggcgcggaggtttgacggagatagcgcgtgcgcgcgtcgtcgggtttgcgatgaattttcggttgttaagttttcggtcgggttgatttaagcggaggcgcgcggaatagtcgtcgagcgattttcgtttaggtagtttagcgtttt

SEQ ID NO: 37764 - DNA, 820 bp, Artificial Sequence
  chemically treated genomic DNA (Homo sapiens) CpG-island No: 37764
aaaacgctaaactacctaaacgaaaatcgctcgacgactattccgcgcgcctccgcttaaatcaacccgaccgaaaacttaacaaccgaaaattcatcgcaaacccgacgacgcgcgcacgcgctatctccgtcaaacctccgcgcctacgcaaccaaaaaataaaaccgcgacgaaaaaaacgaaactaaaccgaatcgccgcctaacgcgacgctcctcacgaacgcctacgtcacgacgtcgaaacgaaaaataatacacctccgaaccgacgattactaaactaacccgaacgacgaaaaaacgaaaacccgaacccgaccactccgactaccgcgaaatacgacgcaaccaccgccatatcgctactacaatcgacgctcgacttcttaacgaatccaaactccctaaacgatacttccgaccgcgaccaaaataacttcgtaaaacaaacgataaaactaaacgaactacgactacgaatacgacgaatcctaaccgaaaataaaaccccgaatcgacaacgcgaatacgaccgcgaaatattatctccgaaacgctaaaaacaacgtcaacccgaaataaaaaaacgtaaattaaaactaaaaaaaatcccaacgaaatcgtaaatcaaaatcgaccaaaaaaaaatctctaccgaaaacgtaaatcaaaaccaaacgaaaatcataacgcgaacgtaaataaatacctactaacgataattacgaaaaacgaaactaaaaccgaatcgaaatactttcttatcataaaaataaaatcaaatcgaaacaaaacctaaaacttaaaaaaccccc

SEQ ID NO: 37765 - DNA, 798 bp, Artificial Sequence
  chemically treated genomic DNA (Homo sapiens) CpG-island No: 37765
  misc_feature (80)..(80): n is either a, c, g or t
  misc_feature (690)..(690): n is either a, c, g or t
ttacggttcggtatattgttttcgattgcgtttgttttattgcgtaggcggggtcgcggggcggggcggaggcgttgttnggtgggcggatttgggggttggcggggcggggtttgttaagggtcgtagtcgtgtttcgtcgatgagcgggttgtggggcgggtttgtgatcgggcggggcggggttgttaaggggcggggttgtgcgcggaggtcgttcgcgaattagtcgtggggaattggtttacgtgggttcggtttgatcgtagtcgggttagattttttcggacgtcgtacgcgcgagttgatttgcggggtttcggttcgcggttgttagataggcgtttttacgcgagacgcgatgttgttcgaggttttcggcgcgtaggacgttttcggagggggtagcgttgcggttttttatagtgggtttcggaaagcggggtttgcggtgtttgggcggtttcgttcgtggggttttcgtacgcgtagatttggttttgttcgaggtttaggattttcggcgttcgatcgttgtttttattgtaacgggggatcgtttgcggttcggggttgttcgttcgcgatttttattcgggttttacgtcgagcgtttagtttttttgtttcgtgcgcgttacgggttttgtttaggtggcgttggtgttttttgagagtcgcgtttacggnttaattttttttcgtcgttggagtagtttgggtttttgtttcgtggtttaattgtggataggagtttgcgaacgggggatttatttcgggttatcgagcggggatttg

SEQ ID NO: 37766 - DNA, 798 bp, Artificial Sequence
  chemically treated genomic DNA (Homo sapiens) CpG-island No: 37766
  misc_feature (109)..(109): n is either a, c, g or t
  misc_feature (719)..(719): n is either a, c, g or t
caaatccccgctcgataacccgaaataaatcccccgttcgcaaactcctatccacaattaaaccacgaaacaaaaacccaaactactccaacgacgaaaaaaaattaanccgtaaacgcgactctcaaaaaacaccaacgccacctaaacaaaacccgtaacgcgcacgaaacaaaaaaactaaacgctcgacgtaaaacccgaataaaaatcgcgaacgaacaaccccgaaccgcaaacgatcccccgttacaataaaaacaacgatcgaacgccgaaaatcctaaacctcgaacaaaaccaaatctacgcgtacgaaaaccccacgaacgaaaccgcccaaacaccgcaaaccccgctttccgaaacccactataaaaaaccgcaacgctaccccctccgaaaacgtcctacgcgccgaaaacctcgaacaacatcgcgtctcgcgtaaaaacgcctatctaacaaccgcgaaccgaaaccccgcaaatcaactcgcgcgtacgacgtccgaaaaaatctaacccgactacgatcaaaccgaacccacgtaaaccaattccccacgactaattcgcgaacgacctccgcgcacaaccccgccccttaacaaccccgccccgcccgatcacaaacccgccccacaacccgctcatcgacgaaacacgactacgacccttaacaaaccccgccccgccaacccccaaatccgcccaccnaacaacgcctccgccccgccccgcgaccccgcctacgcaataaaacaaacgcaatcgaaaacaatataccgaaccgtaa

SEQ ID NO: 37767 - DNA, 798 bp, Artificial Sequence
  chemically treated genomic DNA (Homo sapiens) CpG-island No: 37767
  misc_feature (109)..(109): n is either a, c, g or t
  misc_feature (719)..(719): n is either a, c, g or t
taggttttcgttcggtggttcggggtgggtttttcgttcgtagatttttatttatagttaggttacggggtaaggatttagattgttttagcggcggggaggggttgantcgtggacgcggtttttaaaggatattagcgttatttgaataagattcgtggcgcgtacgaggtaggagagttgggcgttcggcgtgaggttcgggtgggggtcgcgagcggatagtttcgggtcgtaggcggtttttcgttgtagtgaggatagcggtcgggcgtcgggggttttgggtttcgggtagggttaagtttgcgcgtgcgaagattttacggacggagtcgtttaagtatcgtaaatttcgtttttcgggatttattgtgggaggtcgtagcgttgtttttttcgggggcgttttgcgcgtcgggggtttcggatagtatcgcgtttcgcgtgggagcgtttgtttggtagtcgcgggtcgggatttcgtaggttaattcgcgcgtgcggcgttcggagaagtttggttcggttgcggttaaatcgagtttacgtggattagttttttacggttggttcgcgagcggttttcgcgtatagtttcgttttttagtagtttcgtttcgttcgattataggttcgttttatagttcgtttatcgacggggtacggttgcgatttttagtaggtttcgtttcgttagtttttagattcgtttattnagtagcgttttcgtttcgtttcgcggtttcgtttgcgtagtggggtaggcgtagtcggaagtagtgtatcgggtcgtgg

SEQ ID NO: 37768 - DNA, 798 bp, Artificial Sequence
  chemically treated genomic DNA (Homo sapiens) CpG-island No: 37768
  misc_feature (80)..(80): n is either a, c, g or t
  misc_feature (690)..(690): n is either a, c, g or t
ccacgacccgatacactacttccgactacgcctaccccactacgcaaacgaaaccgcgaaacgaaacgaaaacgctactnaataaacgaatctaaaaactaacgaaacgaaacctactaaaaatcgcaaccgtaccccgtcgataaacgaactataaaacgaacctataatcgaacgaaacgaaactactaaaaaacgaaactatacgcgaaaaccgctcgcgaaccaaccgtaaaaaactaatccacgtaaactcgatttaaccgcaaccgaaccaaacttctccgaacgccgcacgcgcgaattaacctacgaaatcccgacccgcgactaccaaacaaacgctcccacgcgaaacgcgatactatccgaaacccccgacgcgcaaaacgcccccgaaaaaaacaacgctacgacctcccacaataaatcccgaaaaacgaaatttacgatacttaaacgactccgtccgtaaaatcttcgcacgcgcaaacttaaccctacccgaaacccaaaacccccgacgcccgaccgctatcctcactacaacgaaaaaccgcctacgacccgaaactatccgctcgcgacccccacccgaacctcacgccgaacgcccaactctcctacctcgtacgcgccacgaatcttattcaaataacgctaatatcctttaaaaaccgcgtccacgantcaacccctccccgccgctaaaacaatctaaatccttaccccgtaacctaactataaataaaaatctacgaacgaaaaacccaccccgaaccaccgaacgaaaaccta

SEQ ID NO: 37769 - DNA, 702 bp, Artificial Sequence
  chemically treated genomic DNA (Homo sapiens) CpG-island No: 37769
  misc_feature (394)..(394): n is either a, c, g or t
  misc_feature (427)..(427): n is either a, c, g or t
  misc_feature (455)..(455): n is either a, c, g or t
  misc_feature (473)..(473): n is either a, c, g or t
  misc_feature (484)..(484): n is either a, c, g or t
  misc_feature (610)..(610): n is either a, c, g or t
gggtcgggcgggaagggggcggcgttggcggaggttaggttggtcggttgggcgttagaatttatttcgggcggcggcggtcggcgggaaggtttttagtagtagcggcggtagtaggagtagtaatagggggttcggcgttatttcggtttgttcggatttggggatattgggggcgtcgttattaatacgtggaattgggagatatcgtttttttcggtttcgagtcgcggtgattaggggtttggtcgttttttttataggtttttttcgtacgcgttttaggcggaggaagtcgtagcgagtgagaagttgtgggttttaaaggtagataaagggtttatattaattatcgggttttttcgtcgttttttttttttttttttcgtttggntttttggcgtttgtttttgggggggtgttcgtngggttttttgttttttgcgtttcgttgnttttcgtttgcgtttttngtcggtttttntgcgttgggttttttttttttttgggcgcgggggcgggggcggggtcggacgggggttcgttggggcggtttttttttttttggttcgtttttttttttgcgttttttttcggcgttcggtttttntttttttttgtgttttcgtttttttgtgtcgttttttggttttttttttttttttttttttttcgtttgtgttgtttttgttttcgtttttt

SEQ ID NO: 37770 - DNA, 702 bp, Artificial Sequence
  chemically treated genomic DNA (Homo sapiens) CpG-island No: 37770
  misc_feature (93)..(93): n is either a, c, g or t
  misc_feature (219)..(219): n is either a, c, g or t
  misc_feature (230)..(230): n is either a, c, g or t
  misc_feature (248)..(248): n is either a, c, g or t
  misc_feature (276)..(276): n is either a, c, g or t
  misc_feature (309)..(309): n is either a, c, g or t
aaaaaacgaaaacaaaaacaacacaaacgaaaaaaaaaaaaaaaaaaaaaaaaccaaaaaacgacacaaaaaaacgaaaacacaaaaaaaaanaaaaaccgaacgccgaaaaaaaacgcaaaaaaaaaaacgaaccaaaaaaaaaaaaaccgccccaacgaacccccgtccgaccccgcccccgcccccgcgcccaaaaaaaaaaaaaacccaacgcanaaaaaccgacnaaaaacgcaaacgaaaancaacgaaacgcaaaaaacaaaaaacccnacgaacacccccccaaaaacaaacgccaaaaanccaaacgaaaaaaaaaaaaaaaaaacgacgaaaaaacccgataattaatataaaccctttatctacctttaaaacccacaacttctcactcgctacgacttcctccgcctaaaacgcgtacgaaaaaaacctataaaaaaaacgaccaaacccctaatcaccgcgactcgaaaccgaaaaaaacgatatctcccaattccacgtattaataacgacgcccccaatatccccaaatccgaacaaaccgaaataacgccgaaccccctattactactcctactaccgccgctactactaaaaaccttcccgccgaccgccgccgcccgaaataaattctaacgcccaaccgaccaacctaacctccgccaacgccgcccccttcccgcccgaccc

SEQ ID NO: 37771 - DNA, 702 bp, Artificial Sequence
  chemically treated genomic DNA (Homo sapiens) CpG-island No: 37771
  misc_feature (93)..(93): n is either a, c, g or t
  misc_feature (219)..(219): n is either a, c, g or t
  misc_feature (230)..(230): n is either a, c, g or t
  misc_feature (248)..(248): n is either a, c, g or t
  misc_feature (276)..(276): n is either a, c, g or t
  misc_feature (309)..(309): n is either a, c, g or t
aagagacgaaaataagaatagtataaacgagggggaggaggggagagaagaagttagaaggcgatatagaggagcgagaatataaagagaaanaagggtcgagcgtcggaagagggcgtaaaaaagaaaacgggttaaggggggggaggtcgttttagcgggttttcgttcggtttcgttttcgttttcgcgtttaaagaggaggaaaatttagcgtanagaggtcggtnaaaggcgtaggcgaaaantagcggggcgtagagagtagagagtttngcgggtatttttttagaaataagcgttaggaanttagacggaaaaaaaagagggggggcggcgggggagttcggtaattagtgtaaattttttgtttgtttttgaaatttatagttttttattcgttgcggtttttttcgtttggagcgcgtgcggggagggtttgtggggagggcggttagatttttgattatcgcgattcgggatcggggagggcggtattttttagttttacgtgttagtgacggcgtttttaatgtttttaggttcggataggtcgagatgacgtcgagttttttgttgttgtttttgttgtcgtcgttgttgttgggggttttttcgtcggtcgtcgtcgttcgaggtgagttttggcgtttagtcggttagtttggttttcgttagcgtcgtttttttttcgttcggttt

SEQ ID NO: 37772 - DNA, 702 bp, Artificial Sequence
  chemically treated genomic DNA (Homo sapiens) CpG-island No: 37772
  misc_feature (394)..(394): n is either a, c, g or t
  misc_feature (427)..(427): n is either a, c, g or t
  misc_feature (455)..(455): n is either a, c, g or t
  misc_feature (473)..(473): n is either a, c, g or t
  misc_feature (484)..(484): n is either a, c, g or t
  misc_feature (610)..(610): n is either a, c, g or t
aaaccgaacgaaaaaaaaacgacgctaacgaaaaccaaactaaccgactaaacgccaaaactcacctcgaacgacgacgaccgacgaaaaaacccccaacaacaacgacgacaacaaaaacaacaacaaaaaactcgacgtcatctcgacctatccgaacctaaaaacattaaaaacgccgtcactaacacgtaaaactaaaaaataccgccctccccgatcccgaatcgcgataatcaaaaatctaaccgccctccccacaaaccctccccgcacgcgctccaaacgaaaaaaaccgcaacgaataaaaaactataaatttcaaaaacaaacaaaaaatttacactaattaccgaactcccccgccgccccccctcttttttttccgtctaanttcctaacgcttatttctaaaaaaatacccgcnaaactctctactctctacgccccgctanttttcgcctacgcctttnaccgacctctntacgctaaattttcctcctctttaaacgcgaaaacgaaaacgaaaccgaacgaaaacccgctaaaacgacctccccccccttaacccgttttcttttttacgccctcttccgacgctcgacccttntttctctttatattctcgctcctctatatcgccttctaacttcttctctcccctcctccccctcgtttatactattcttattttcgtctctt

SEQ ID NO: 37773 - DNA, 1126 bp, Artificial Sequence
  chemically treated genomic DNA (Homo sapiens) CpG-island No: 37773
tacgcgggtattcggagtgataacgattaagtggtatttaggagtcggacggtttttattgtatgataatcgttgtttaaataggagttaaaggttagatttattgaacgtatttcgagtaggttcgaggggcggtcggcgttcggggttgtttagtaggggtttcgcgcggttgagttttacggggttaaagtttcgatcgacgggagagaggggcgggtattggtttcggattcgaaatttcgtttttagtaaaaagcggttttcgggaattggaagtttggcgaggtgggggtgggggcgggggaggggggcgaggggcggcgaggggcgagtaggggggcggagggcgagtaggggggcgggggtacggttcgtttcgggtgtcgggtcgatggtagtcggggttggggagggataggtttagtaagcgggcggtcgggagtttcggggggttcgttcgagaggcgtcggattttacggagatcgggatcggggcgagggcgtattcggattcgtcgcgacgacgcgtttattttttgttagaaaggtcgggtttgggatacggggtggcgaggggcgtttatatcggcggtttcgcggggtagtttcggttttattgtttcgcgatcgtagttcgatcgtcggtttcggggagggggtcggggaggcgggagggggaaggggcgcggcgacggtatttgtggttgttacgggtgacggggtgggcggggtcgggcgtcgggaggggcgcgcgtgcgcggtcgcggtcgagggagcgggggcgggagcgggcgatggttgttaagaaaggggaggggggaggatattcggggttcgaattgcgtaggcgcgagtttcgattcgcgagcgtgggaggagttcggagaaggcgtcggtttcgtcgtattgttggatgtgttcgaggttttcgtggttttttttagttttgcgttatttgttgggggcggggtcgggttgggtttcgcgagtagcgggcggaggcggagtgaagttttaaggggttgtcggcgtgtaggggaggggttcggttgagcgggaaaagggaagtttgcgggaggttaaaattatcggggttttttcgtatggttgttgttttgaggtt

SEQ ID NO: 37774 - DNA, 1126 bp, Artificial Sequence
  chemically treated genomic DNA (Homo sapiens) CpG-island No: 37774
aacctcaaaacaacaaccatacgaaaaaaccccgataattttaacctcccgcaaacttcccttttcccgctcaaccgaacccctcccctacacgccgacaaccccttaaaacttcactccgcctccgcccgctactcgcgaaacccaacccgaccccgcccccaacaaataacgcaaaactaaaaaaaaccacgaaaacctcgaacacatccaacaatacgacgaaaccgacgccttctccgaactcctcccacgctcgcgaatcgaaactcgcgcctacgcaattcgaaccccgaatatcctcccccctcccctttcttaacaaccatcgcccgctcccgcccccgctccctcgaccgcgaccgcgcacgcgcgcccctcccgacgcccgaccccgcccaccccgtcacccgtaacaaccacaaataccgtcgccgcgccccttccccctcccgcctccccgaccccctccccgaaaccgacgatcgaactacgatcgcgaaacaataaaaccgaaactaccccgcgaaaccgccgatataaacgcccctcgccaccccgtatcccaaacccgacctttctaacaaaaaataaacgcgtcgtcgcgacgaatccgaatacgccctcgccccgatcccgatctccgtaaaatccgacgcctctcgaacgaaccccccgaaactcccgaccgcccgcttactaaacctatccctccccaaccccgactaccatcgacccgacacccgaaacgaaccgtacccccgcccccctactcgccctccgcccccctactcgcccctcgccgcccctcgcccccctcccccgcccccacccccacctcgccaaacttccaattcccgaaaaccgctttttactaaaaacgaaatttcgaatccgaaaccaatacccgcccctctctcccgtcgatcgaaactttaaccccgtaaaactcaaccgcgcgaaacccctactaaacaaccccgaacgccgaccgcccctcgaacctactcgaaatacgttcaataaatctaacctttaactcctatttaaacaacgattatcatacaataaaaaccgtccgactcctaaataccacttaatcgttatcactccgaatacccgcgta

SEQ ID NO: 37775 - DNA, 1126 bp, Artificial Sequence
  chemically treated genomic DNA (Homo sapiens) CpG-island No: 37775
ggttttagagtagtagttatacgggagggtttcggtggttttgatttttcgtaaattttttttttttcgtttagtcgaattttttttttgtacgtcggtagttttttggggttttatttcgttttcgttcgttattcgcgaagtttagttcggtttcgtttttaataagtgacgtaaaattgggaggggttacgaggatttcgggtatatttagtagtgcgacggggtcggcgtttttttcgagttttttttacgttcgcgggtcggagttcgcgtttgcgtagttcgggtttcgggtgtttttttttttttttttttttagtaattatcgttcgttttcgttttcgttttttcggtcgcggtcgcgtacgcgcgtttttttcggcgttcggtttcgtttatttcgttattcgtaataattataagtgtcgtcgtcgcgttttttttttttttcgttttttcggtttttttttcggaatcggcggtcgagttacggtcgcggagtagtggaatcgagattgtttcgcggagtcgtcggtatgagcgtttttcgttatttcgtgttttaggttcggtttttttgataagaggtaggcgcgtcgtcgcggcgggttcgagtgcgttttcgtttcggtttcggttttcgtggagttcggcgtttttcgggcgggtttttcggaattttcggtcgttcgtttgttgagtttgtttttttttagtttcggttgttatcggttcggtattcgaaacgggtcgtgttttcgtttttttgttcgtttttcgtttttttgttcgtttttcgtcgtttttcgtttttttttttcgtttttatttttatttcgttaggtttttagttttcgggagtcgttttttgttgagagcggagtttcgggttcggagttagtgttcgtttttttttttcgtcggtcggggttttggtttcgtggggtttagtcgcgcgggatttttgttgagtagtttcgggcgtcggtcgtttttcgagtttgttcgggatgcgtttagtgggtttggtttttggtttttgtttaaatagcgattgttatgtaatggaggtcgttcggtttttggatgttatttggtcgttgttatttcggatgttcgcgta

SEQ ID NO: 37776 - DNA, 1126 bp, Artificial Sequence
  chemically treated genomic DNA (Homo sapiens) CpG-island No: 37776
tacgcgaacatccgaaataacaacgaccaaataacatccaaaaaccgaacgacctccattacataacaatcgctatttaaacaaaaaccaaaaaccaaacccactaaacgcatcccgaacaaactcgaaaaacgaccgacgcccgaaactactcaacaaaaatcccgcgcgactaaaccccacgaaaccaaaaccccgaccgacgaaaaaaaaaaacgaacactaactccgaacccgaaactccgctctcaacaaaaaacgactcccgaaaactaaaaacctaacgaaataaaaataaaaacgaaaaaaaaaaacgaaaaacgacgaaaaacgaacaaaaaaacgaaaaacgaacaaaaaaacgaaaacacgacccgtttcgaataccgaaccgataacaaccgaaactaaaaaaaaacaaactcaacaaacgaacgaccgaaaattccgaaaaacccgcccgaaaaacgccgaactccacgaaaaccgaaaccgaaacgaaaacgcactcgaacccgccgcgacgacgcgcctacctcttatcaaaaaaaccgaacctaaaacacgaaataacgaaaaacgctcataccgacgactccgcgaaacaatctcgattccactactccgcgaccgtaactcgaccgccgattccgaaaaaaaaaccgaaaaaacgaaaaaaaaaaaaaacgcgacgacgacacttataattattacgaataacgaaataaacgaaaccgaacgccgaaaaaaacgcgcgtacgcgaccgcgaccgaaaaaacgaaaacgaaaacgaacgataattactaaaaaaaaaaaaaaaaaaaaacacccgaaacccgaactacgcaaacgcgaactccgacccgcgaacgtaaaaaaaactcgaaaaaaacgccgaccccgtcgcactactaaatatacccgaaatcctcgtaacccctcccaattttacgtcacttattaaaaacgaaaccgaactaaacttcgcgaataacgaacgaaaacgaaataaaaccccaaaaaactaccgacgtacaaaaaaaaaattcgactaaacgaaaaaaaaaaaatttacgaaaaatcaaaaccaccgaaaccctcccgtataactactactctaaaacc

SEQ ID NO: 37777 - DNA, 678 bp, Artificial Sequence
  chemically treated genomic DNA (Homo sapiens) CpG-island No: 37777
agatggcggcgttcgtgaagaattcgtaattaggtcgtcgttatatgtcgtttaggaacgtacggaattcgatttacgtacggaatcggattttaagatgacggtatttatgaggaagttacgtagtaggtgtagttatgttgtttgtacgtcgaggtcgtataagtagtcgtcgtacggattttattgataaggtggcggcgttttcgggaaagttatattagagcgcggttatgttttcggcgaatatatggattcggttattatacggatacgataagtaagatggcggcgtttgaggggttttgggggttttaggtcggttatttattggtttgtagcggagacgacgtatggggtttgcgtaataggagtacgttgtttgggaggcgtgattagaagcggaagtagttgtgggcgtttttgtaatcgtttgggacgtcgtcgagtggtttgtgtaggttcgcgggtcgttggcgggggtcgtgagggagtgcgtcgggagcggagatatggtaagtagcgggtttagggaggggttcggcggtggaggtcggtcggttggtaatagtggggtttgtcggtcgatttaggggtttgtggtgagttataatcggagtttgtggattgaacggcgggagtttatgggtagaatgatgaattatttgggagttttat

SEQ ID NO: 37778 - DNA, 678 bp, Artificial Sequence
  chemically treated genomic DNA (Homo sapiens) CpG-island No: 37778
ataaaactcccaaataattcatcattctacccataaactcccgccgttcaatccacaaactccgattataactcaccacaaacccctaaatcgaccgacaaaccccactattaccaaccgaccgacctccaccgccgaacccctccctaaacccgctacttaccatatctccgctcccgacgcactccctcacgacccccgccaacgacccgcgaacctacacaaaccactcgacgacgtcccaaacgattacaaaaacgcccacaactacttccgcttctaatcacgcctcccaaacaacgtactcctattacgcaaaccccatacgtcgtctccgctacaaaccaataaataaccgacctaaaacccccaaaacccctcaaacgccgccatcttacttatcgtatccgtataataaccgaatccatatattcgccgaaaacataaccgcgctctaatataactttcccgaaaacgccgccaccttatcaataaaatccgtacgacgactacttatacgacctcgacgtacaaacaacataactacacctactacgtaacttcctcataaataccgtcatcttaaaatccgattccgtacgtaaatcgaattccgtacgttcctaaacgacatataacgacgacctaattacgaattcttcacgaacgccgccatct

SEQ ID NO: 37779 - DNA, 678 bp, Artificial Sequence
  chemically treated genomic DNA (Homo sapiens) CpG-island No: 37779
atagaatttttagatggtttattattttgtttatagattttcgtcgtttagtttatagatttcggttatggtttattatagatttttgagtcggtcgatagattttattgttgttaatcgatcgatttttatcgtcgaatttttttttggattcgttatttattatattttcgttttcggcgtatttttttacgattttcgttagcgattcgcgaatttgtatagattattcggcggcgttttaggcggttgtaaaggcgtttataattattttcgtttttagttacgttttttaggtagcgtatttttattgcgtaggttttatgcgtcgttttcgttgtaaattagtaggtggtcggtttagagtttttaagattttttaggcgtcgttattttgtttatcgtattcgtatggtggtcgaatttatatgttcgtcgggaatatggtcgcgttttaatgtggttttttcgagggcgtcgttattttgttagtagagttcgtacggcggttgtttgtacggtttcgacgtataggtaatatggttgtatttattgcgtgatttttttatagatgtcgttattttggaattcgatttcgtacgtgggtcgaatttcgtacgtttttaggcgatatatgacggcgatttaattgcggattttttacgggcgtcgttattt

SEQ ID NO: 37780 - DNA, 678 bp, Artificial Sequence
  chemically treated genomic DNA (Homo sapiens) CpG-island No: 37780
aaataacgacgcccgtaaaaaatccgcaattaaatcgccgtcatatatcgcctaaaaacgtacgaaattcgacccacgtacgaaatcgaattccaaaataacgacatctataaaaaaatcacgcaataaatacaaccatattacctatacgtcgaaaccgtacaaacaaccgccgtacgaactctactaacaaaataacgacgccctcgaaaaaaccacattaaaacgcgaccatattcccgacgaacatataaattcgaccaccatacgaatacgataaacaaaataacgacgcctaaaaaatcttaaaaactctaaaccgaccacctactaatttacaacgaaaacgacgcataaaacctacgcaataaaaatacgctacctaaaaaacgtaactaaaaacgaaaataattataaacgcctttacaaccgcctaaaacgccgccgaataatctatacaaattcgcgaatcgctaacgaaaatcgtaaaaaaatacgccgaaaacgaaaatataataaataacgaatccaaaaaaaaattcgacgataaaaatcgatcgattaacaacaataaaatctatcgaccgactcaaaaatctataataaaccataaccgaaatctataaactaaacgacgaaaatctataaacaaaataataaaccatctaaaaattctat

SEQ ID NO: 37781 - DNA, 521 bp, Artificial Sequence
  chemically treated genomic DNA (Homo sapiens) CpG-island No: 37781
gtaggcgcgaagtagtttttttgtcgcgttcggtatcggttgtggagatcgcgggagggaagggagggcgtaggcgtaagtttttttcgatcgtttttttttaggttgaggttggaaagcgtatgcgttagttagatgggtagcgaggagagtcgtaattgttagtttttcggaaggggttagttgtcgttgaacgttagtacgtagatgtaattggttttcggtaggggggcgcgcgtatcgttgcggagcgtcggttcgtaggcgcgggagtttttttattaagggtacgcgatatcgaggtaatagtgcgtaggtgtttagttagaggcggagttcgagaggtaggtagcggattttcggtttcgggagtaacgaatagtcgcggaggcgatagttatcgttttagaggaggcggtcgcggaggaggaggaaggggaggagggcgaggcgggaggtgtaggagggattttcgttatgggtttacgggtttagagtggcggaagatatcggtttggtgt

SEQ ID NO: 37782 - DNA, 521 bp, Artificial Sequence
  chemically treated genomic DNA (Homo sapiens) CpG-island No: 37782
acaccaaaccgatatcttccgccactctaaacccgtaaacccataacgaaaatccctcctacacctcccgcctcgccctcctccccttcctcctcctccgcgaccgcctcctctaaaacgataactatcgcctccgcgactattcgttactcccgaaaccgaaaatccgctacctacctctcgaactccgcctctaactaaacacctacgcactattacctcgatatcgcgtacccttaataaaaaaactcccgcgcctacgaaccgacgctccgcaacgatacgcgcgcccccctaccgaaaaccaattacatctacgtactaacgttcaacgacaactaaccccttccgaaaaactaacaattacgactctcctcgctacccatctaactaacgcatacgctttccaacctcaacctaaaaaaaaacgatcgaaaaaaacttacgcctacgccctcccttccctcccgcgatctccacaaccgataccgaacgcgacaaaaaaactacttcgcgcctac

SEQ ID NO: 37783 - DNA, 521 bp, Artificial Sequence
  chemically treated genomic DNA (Homo sapiens) CpG-island No: 37783
gtattaggtcggtatttttcgttattttaggttcgtggatttatggcgagggttttttttgtatttttcgtttcgtttttttttttttttttttttttcgcggtcgttttttttgaagcggtagttgtcgttttcgcggttgttcgttgttttcggaatcggaagttcgttgtttgtttttcgggtttcgtttttggttaagtatttgcgtattattgtttcgatgtcgcgtgtttttaatagggaggttttcgcgtttacgggtcggcgtttcgtagcggtgcgcgcgtttttttgtcgagagttagttgtatttgcgtgttgacgtttaacgatagttaatttttttcgagggattggtagttgcggtttttttcgttgtttatttagttggcgtatgcgttttttagttttaatttgaagggaagcggtcggggagggtttgcgtttgcgtttttttttttttttcgcggtttttatagtcgatatcgaacgcggtaaggaagttgtttcgcgtttgt

SEQ ID NO: 37784 - DNA, 521 bp, Artificial Sequence
  chemically treated genomic DNA (Homo sapiens) CpG-island No: 37784
acaaacgcgaaacaacttccttaccgcgttcgatatcgactataaaaaccgcgaaaaaaaaaaaaaaacgcaaacgcaaaccctccccgaccgcttcccttcaaattaaaactaaaaaacgcatacgccaactaaataaacaacgaaaaaaaccgcaactaccaatccctcgaaaaaaattaactatcgttaaacgtcaacacgcaaatacaactaactctcgacaaaaaaacgcgcgcaccgctacgaaacgccgacccgtaaacgcgaaaacctccctattaaaaacacgcgacatcgaaacaataatacgcaaatacttaaccaaaaacgaaacccgaaaaacaaacaacgaacttccgattccgaaaacaacgaacaaccgcgaaaacgacaactaccgcttcaaaaaaaacgaccgcgaaaaaaaaaaaaaaaaaaaaaaacgaaacgaaaaatacaaaaaaaaccctcgccataaatccacgaacctaaaataacgaaaaataccgacctaatac

SEQ ID NO: 37785 - DNA, 548 bp, Artificial Sequence
  chemically treated genomic DNA (Homo sapiens) CpG-island No: 37785
ttgggttacggttaagaagttcggcgtttagttgcgtttggattacgttcggggttacggttaagaagttcggcgtttagttgcgtttggattacgttcggggttacggttaagaagttcggcgtttagttgtcgtttggattattttcggggttacggttaagaagttcggcgtttagttgcgtttggattacgttcggggttacggttaagaagttcggcgtttagttgcgtttggattacgttcggggttacggttaagaagttcggcgtttagttgtgtttggattacgtttgcggttattgttaagaagtttagtacgtttaacgttcgaggtttaattttagtacgggttagttatcgtttttttttattttatggttatagaatttatttttaaattagattatttgcggtatagtacgaggttatacgaggtattagacgggagtgtgagcggttttattacgttacgttttttttcgtttttaagtttattttttttaataggttggtgaatagtagttatttttaaaattggtagaat

SEQ ID NO: 37786 - DNA, 548 bp, Artificial Sequence
  chemically treated genomic DNA (Homo sapiens) CpG-island No: 37786
attctaccaattttaaaaataactactattcaccaacctattaaaaaaaataaacttaaaaacgaaaaaaaacgtaacgtaataaaaccgctcacactcccgtctaatacctcgtataacctcgtactataccgcaaataatctaatttaaaaataaattctataaccataaaataaaaaaaaacgataactaacccgtactaaaattaaacctcgaacgttaaacgtactaaacttcttaacaataaccgcaaacgtaatccaaacacaactaaacgccgaacttcttaaccgtaaccccgaacgtaatccaaacgcaactaaacgccgaacttcttaaccgtaaccccgaacgtaatccaaacgcaactaaacgccgaacttcttaaccgtaaccccgaaaataatccaaacgacaactaaacgccgaacttcttaaccgtaaccccgaacgtaatccaaacgcaactaaacgccgaacttcttaaccgtaaccccgaacgtaatccaaacgcaactaaacgccgaacttcttaaccgtaacccaa

SEQ ID NO: 37787 - DNA, 548 bp, Artificial Sequence
  chemically treated genomic DNA (Homo sapiens) CpG-island No: 37787
attttgttaattttgaagatggttgttatttattaatttattaagagaagtaggtttgggagcgggaaaaggcgtgacgtggtggagtcgtttatattttcgtttggtatttcgtgtggtttcgtgttgtgtcgtaagtggtttggtttgggggtagattttgtgattatgaaatgaagggagacggtaattgattcgtattgaggttgagtttcgggcgttgggcgtgttgagttttttgatagtggtcgtagacgtgatttaggtatagttgggcgtcgagttttttgatcgtggtttcggacgtgatttaggcgtagttgggcgtcgagttttttgatcgtggtttcggacgtgatttaggcgtagttgggcgtcgagttttttgatcgtggtttcggaggtgatttaggcggtagttgggcgtcgagttttttgatcgtggtttcggacgtgatttaggcgtagttgggcgtcgagttttttgatcgtggtttcggacgtgatttaggcgtagttgggcgtcgagttttttgatcgtggtttaa

SEQ ID NO: 37788 - DNA, 548 bp, Artificial Sequence
  chemically treated genomic DNA (Homo sapiens) CpG-island No: 37788
ttaaaccacgatcaaaaaactcgacgcccaactacgcctaaatcacgtccgaaaccacgatcaaaaaactcgacgcccaactacgcctaaatcacgtccgaaaccacgatcaaaaaactcgacgcccaactaccgcctaaatcacctccgaaaccacgatcaaaaaactcgacgcccaactacgcctaaatcacgtccgaaaccacgatcaaaaaactcgacgcccaactacgcctaaatcacgtccgaaaccacgatcaaaaaactcgacgcccaactatacctaaatcacgtctacgaccactatcaaaaaactcaacacgcccaacgcccgaaactcaacctcaatacgaatcaattaccgtctcccttcatttcataatcacaaaatctacccccaaaccaaaccacttacgacacaacacgaaaccacacgaaataccaaacgaaaatataaacgactccaccacgtcacgccttttcccgctcccaaacctacttctcttaataaattaataaataacaaccatcttcaaaattaacaaaat

SEQ ID NO: 37789 - DNA, 586 bp, Artificial Sequence
  chemically treated genomic DNA (Homo sapiens) CpG-island No: 37789
cgttcgttattaagtttaagttatttagagggacgcgtatagattttagttttgtttcgggattttacggagggggcgggagcgggattttattagttttcgtagttttcgtagtttttcgagtttcgtagcgttttcgagtttttatttttcggaatttttagttttcgcgggtattttgtttcggagtagtttgttgcgtacgcggttttagagtcgggcgtcggtgttgggggggcgtttgtttttcgatttttttagcgttaggggttcgcgtttcgttttcgggttgtagtcgggttggggtaggacgtcggttatgtcgggggggacgggacgcggcgttggagagaaggcgtttgtggagcgtttagtttcggttgttagtttcgttagttttttagtttcgtcggtttttttcgcgttcgttttttttttttttttttttttcgcgttttttttttttttttttttcgttcgcgtttttttttttttttttttttttcgtattttttttttttcgtttttcgcgaggttgtagtttaggttgagcgtcgttttttaggtttagggtcgtttttttaag

SEQ ID NO: 37790 - DNA, 586 bp, Artificial Sequence
  chemically treated genomic DNA (Homo sapiens) CpG-island No: 37790
cttaaaaaaacgaccctaaacctaaaaaacgacgctcaacctaaactacaacctcgcgaaaaacgaaaaaaaaaaaatacgaaaaaaaaaaaaaaaaaaaaaaacgcgaacgaaaaaaaaaaaaaaaaaaaacgcgaaaaaaaaaaaaaaaaaaaaaacgaacgcgaaaaaaaccgacgaaactaaaaaactaacgaaactaacaaccgaaactaaacgctccacaaacgccttctctccaacgccgcgtcccgtcccccccgacataaccgacgtcctaccccaacccgactacaacccgaaaacgaaacgcgaacccctaacgctaaaaaaatcgaaaaacaaacgcccccccaacaccgacgcccgactctaaaaccgcgtacgcaacaaactactccgaaacaaaatacccgcgaaaactaaaaattccgaaaaataaaaactcgaaaacgctacgaaactcgaaaaactacgaaaactacgaaaactaataaaatcccgctcccgccccctccgtaaaatcccgaaacaaaactaaaatctatacgcgtccctctaaataacttaaacttaataacgaacg

SEQ ID NO: 37791 - DNA, 586 bp, Artificial Sequence
  chemically treated genomic DNA (Homo sapiens) CpG-island No: 37791
tttggaggggcggttttgggtttgggaggcggcgtttagtttgggttgtagtttcgcggagggcggggaaggagggatgcggaggagggaggagggaggagggacgcggacggagggagggagggaggggagcgcggggagggagggagggagggaggcgagcgcggggaaagtcggcgggattagggaattagcgggattggtagtcgggattgagcgttttataggcgttttttttttagcgtcgcgtttcgtttttttcggtatgatcgacgttttgttttagttcgattgtagttcgaaggcggggcgcgaatttttggcgttggaggagtcggggagtaagcgtttttttaatatcggcgttcggttttggggtcgcgtgcgtaataagttgtttcgaaataaggtgttcgcgggggttggaggtttcggggggtgggggttcgggggcgttgcggggttcggggggttgcgggggttgcgggggttgatggggtttcgttttcgtttttttcgtggagtttcgggatagagttggggtttgtgcgcgtttttttaagtggtttgaatttgatggcgaacg

SEQ ID NO: 37792 - DNA, 586 bp, Artificial Sequence
  chemically treated genomic DNA (Homo sapiens) CpG-island No: 37792
cgttcgccatcaaattcaaaccacttaaaaaaacgcgcacaaaccccaactctatcccgaaactccacgaaaaaaacgaaaacgaaaccccatcaacccccgcaacccccgcaaccccccgaaccccgcaacgcccccgaacccccaccccccgaaacctccaacccccgcgaacaccttatttcgaaacaacttattacgcacgcgaccccaaaaccgaacgccgatattaaaaaaacgcttactccccgactcctccaacgccaaaaattcgcgccccgccttcgaactacaatcgaactaaaacaaaacgtcgatcataccgaaaaaaacgaaacgcgacgctaaaaaaaaaacgcctataaaacgctcaatcccgactaccaatcccgctaattccctaatcccgccgactttccccgcgctcgcctccctccctccctccctccccgcgctcccctccctccctccctccgtccgcgtccctcctccctcctccctcctccgcatccctccttccccgccctccgcgaaactacaacccaaactaaacgccgcctcccaaacccaaaaccgcccctccaaa

SEQ ID NO: 37793 - DNA, 604 bp, Artificial Sequence
  chemically treated genomic DNA (Homo sapiens) CpG-island No: 37793
ggttcggtcgcgcgcggggaatgaagatgcgtttgggaagcggttttttcgttttattttatttcggttcggtcgcggttttttcgtttttttttcgtcgtagaagttttcgttagtcgcggtttcgtaattttagaggacgggcggttttatttcgcgacgcgcgttttttgtgtgttcggagcgagcgcgagttcgagtttcggagttcgggaagggcgggttttgcggggtcgggcgggatacggaggagggcgttgggttgttgtgcggcgggttcgttttcgttacgggtcgggtacggcgttaggggttgttcgggttttgttttttttttcgtcgggcgaggacgcgcgaggcggcggcggcggcggcggagcgggttggattaggttcgggatgtagtttcgggtcgggagttttaggtcgggcgcgcgggtgtagatttgttttttttttcgttcgttttttttttttttttttttttcgtcgtcgttgcgtggatttcgttttttgtttgtttttcgcgggtttcggttgttatggaggaggaagaggaggcgataggtttgttggataaggttttggaggacgaagatgtgtt

SEQ ID NO: 37794 - DNA, 604 bp, Artificial Sequence
  chemically treated genomic DNA (Homo sapiens) CpG-island No: 37794
aacacatcttcgtcctccaaaaccttatccaacaaacctatcgcctcctcttcctcctccataacaaccgaaacccgcgaaaaacaaacaaaaaacgaaatccacgcaacgacgacgaaaaaaaaaaaaaaaaaaaaaacgaacgaaaaaaaaaacaaatctacacccgcgcgcccgacctaaaactcccgacccgaaactacatcccgaacctaatccaacccgctccgccgccgccgccgccgcctcgcgcgtcctcgcccgacgaaaaaaaaaacaaaacccgaacaacccctaacgccgtacccgacccgtaacgaaaacgaacccgccgcacaacaacccaacgccctcctccgtatcccgcccgaccccgcaaaacccgcccttcccgaactccgaaactcgaactcgcgctcgctccgaacacacaaaaaacgcgcgtcgcgaaataaaaccgcccgtcctctaaaattacgaaaccgcgactaacgaaaacttctacgacgaaaaaaaaacgaaaaaaccgcgaccgaaccgaaataaaataaaacgaaaaaaccgcttcccaaacgcatcttcattccccgcgcgcgaccgaacc

SEQ ID NO: 37795 - DNA, 604 bp, Artificial Sequence
  chemically treated genomic DNA (Homo sapiens) CpG-island No: 37795
aatatattttcgttttttagaattttgtttagtaagtttatcgtttttttttttttttttatggtagtcggagttcgcggagggtagataggaagcggggtttacgtagcggcggcgggaggagggaggagggaggaggcgggcgggagggggggtaggtttatattcgcgcgttcggtttggggttttcgattcgggattgtatttcggatttagtttagttcgtttcgtcgtcgtcgtcgtcgtttcgcgcgttttcgttcggcgaaagggggagtaaggttcgggtagtttttgacgtcgtgttcggttcgtggcggaggcgaattcgtcgtatagtagtttagcgttttttttcgtgtttcgttcggtttcgtagggttcgtttttttcgggtttcggggttcgggttcgcgttcgtttcgaatatataggaaacgcgcgtcgcgaggtggagtcgttcgttttttggggttgcggggtcgcggttggcggaggtttttgcggcggaggaggagcgaggaggtcgcggtcgggtcggggtggggtggagcggggaggtcgttttttagacgtatttttatttttcgcgcgcggtcgagtt

SEQ ID NO: 37796 - DNA, 604 bp, Artificial Sequence
  chemically treated genomic DNA (Homo sapiens) CpG-island No: 37796
aactcgaccgcgcgcgaaaaataaaaatacgtctaaaaaacgacctccccgctccaccccaccccgacccgaccgcgacctcctcgctcctcctccgccgcaaaaacctccgccaaccgcgaccccgcaaccccaaaaaacgaacgactccacctcgcgacgcgcgtttcctatatattcgaaacgaacgcgaacccgaaccccgaaacccgaaaaaaacgaaccctacgaaaccgaacgaaacacgaaaaaaaacgctaaactactatacgacgaattcgcctccgccacgaaccgaacacgacgtcaaaaactacccgaaccttactccccctttcgccgaacgaaaacgcgcgaaacgacgacgacgacgacgaaacgaactaaactaaatccgaaatacaatcccgaatcgaaaaccccaaaccgaacgcgcgaatataaacctaccccccctcccgcccgcctcctccctcctccctcctcccgccgccgctacgtaaaccccgcttcctatctaccctccgcgaactccgactaccataaaaaaaaaaaaaaaaacgataaacttactaaacaaaattctaaaaaacgaaaatatatt

SEQ ID NO: 37797 - DNA, 759 bp, Artificial Sequence
  chemically treated genomic DNA (Homo sapiens) CpG-island No: 37797
ggagagaaaatgcgggtcgggttgtagttcgggaaagcgtcggtttagcgggttttttttttttttttatttcggtcgtgggttttttagggagagtgcggcgtttcgggttcggtttttcgtttaagtagttatttcgcgtatcgcggtcggtagttgcggatttcgtttgggcggagagttttggttatcgtcggtcgtaaacggggcgtggcgagggcggagggggcgtggcgagggcgggcggaggggcgtggcgagggtagtcgaaggggcgtggcgcgggtcgcggagggggcgtggtagggcgggggaaggggcgtggcgcgggtaggcggagggggcgtggcgtgggcggttttattgggtcgggttttgttttttttagcgtttgtcgtcgacgtcgtcgttttttttcgtcgcgcggatcgtggagcggggtcgtagtcgtttgttcgttttgcggtgggttaggatgtcgggttttttggaggagttgttcggcgagaagttggtgacgggcggcggcgaggaggtggacgtgtattcgttgggcgttcgcggtatttcgttgttgggtttttatttcggttgtagttttagcgttttttgcgcgtagtttagcgttagtttggtcgttttttacgggcgtttgcggggggacgcggcggtcgggtcggggtcgggagcgggggtcggggcggcggcggagttcgagtcgcggcggcgtttggagatcgttttcgtgttttcggatta

SEQ ID NO: 37798 - DNA, 759 bp, Artificial Sequence
  chemically treated genomic DNA (Homo sapiens) CpG-island No: 37798
taatccgaaaacacgaaaacgatctccaaacgccgccgcgactcgaactccgccgccgccccgacccccgctcccgaccccgacccgaccgccgcgtccccccgcaaacgcccgtaaaaaacgaccaaactaacgctaaactacgcgcaaaaaacgctaaaactacaaccgaaataaaaacccaacaacgaaataccgcgaacgcccaacgaatacacgtccacctcctcgccgccgcccgtcaccaacttctcgccgaacaactcctccaaaaaacccgacatcctaacccaccgcaaaacgaacaaacgactacgaccccgctccacgatccgcgcgacgaaaaaaaacgacgacgtcgacgacaaacgctaaaaaaaacaaaacccgacccaataaaaccgcccacgccacgccccctccgcctacccgcgccacgccccttcccccgccctaccacgccccctccgcgacccgcgccacgccccttcgactaccctcgccacgcccctccgcccgccctcgccacgccccctccgccctcgccacgccccgtttacgaccgacgataaccaaaactctccgcccaaacgaaatccgcaactaccgaccgcgatacgcgaaataactacttaaacgaaaaaccgaacccgaaacgccgcactctccctaaaaaacccacgaccgaaataaaaaaaaaaaaaaaacccgctaaaccgacgctttcccgaactacaacccgacccgcattttctctcc

SEQ ID NO: 37799 - DNA, 759 bp, Artificial Sequence
  chemically treated genomic DNA (Homo sapiens) CpG-island No: 37799
tggttcgaggatacgaagacgatttttaggcgtcgtcgcggttcgggtttcgtcgtcgtttcggttttcgttttcggtttcggttcggtcgtcgcgttttttcgtaggcgttcgtagaaggcggttaggttggcgttgagttgcgcgtagggggcgttgaggttgtagtcgaagtagagatttagtagcgagatgtcgcgggcgtttagcgagtgtacgtttattttttcgtcgtcgttcgttattagtttttcgtcgagtagtttttttaggaagttcgatattttggtttatcgtagggcgggtaggcggttgcgatttcgttttacggttcgcgcggcgggaggaggcggcggcgtcggcggtaggcgttggggagagtagagttcggtttagtagggtcgtttacgttacgtttttttcgtttgttcgcgttacgttttttttttcgttttgttacgtttttttcgcggttcgcgttacgttttttcggttgttttcgttacgttttttcgttcgttttcgttacgtttttttcgttttcgttacgtttcgtttgcggtcggcggtggttagagtttttcgtttaggcggggttcgtagttgtcggtcgcggtgcgcggggtgattgtttgggcgagaagtcggattcgaaacgtcgtattttttttggaaagtttacggtcgaagtgaagaaaggagaagggttcgttgagtcggcgttttttcgggttgtagttcggttcgtatttttttttt

SEQ ID NO: 37800 - DNA, 759 bp, Artificial Sequence
  chemically treated genomic DNA (Homo sapiens) CpG-island No: 37800
aaaaaaaaaatacgaaccgaactacaacccgaaaaaacgccgactcaacgaacccttctcctttcttcacttcgaccgtaaactttccaaaaaaaatacgacgtttcgaatccgacttctcgcccaaacaatcaccccgcgcaccgcgaccgacaactacgaaccccgcctaaacgaaaaactctaaccaccgccgaccgcaaacgaaacgtaacgaaaacgaaaaaaacgtaacgaaaacgaacgaaaaaacgtaacgaaaacaaccgaaaaaacgtaacgcgaaccgcgaaaaaaacgtaacaaaacgaaaaaaaaaacgtaacgcgaacaaacgaaaaaaacgtaacgtaaacgaccctactaaaccgaactctactctccccaacgcctaccgccgacgccgccgcctcctcccgccgcgcgaaccgtaaaacgaaatcgcaaccgcctacccgccctacgataaaccaaaatatcgaacttcctaaaaaaactactcgacgaaaaactaataacgaacgacgacgaaaaaataaacgtacactcgctaaacgcccgcgacatctcgctactaaatctctacttcgactacaacctcaacgccccctacgcgcaactcaacgccaacctaaccgccttctacgaacgcctacgaaaaaacgcgacgaccgaaccgaaaccgaaaacgaaaaccgaaacgacgacgaaacccgaaccgcgacgacgcctaaaaatcgtcttcgtatcctcgaacca

SEQ ID NO: 37801 - DNA, 604 bp, Artificial Sequence
  chemically treated genomic DNA (Homo sapiens) CpG-island No: 37801
cggtcggcggattttttagggcgcggatcgtcgttttaggcgtcgttcgcggtcgtggggtttcggtcgggatttatgtttcggcgcgcgggttgcggaggcggcgggaggagtggagggtttcgcggggtcgtagtttggggaagtttcgtcgggcgtttagcgtcgcgtttcgtcgtttagagcgcgtatttcgtcgtcgttcgcgtttttcgatggggtttcgcgaggtttgtcgtcgtttttcgtttcgcgtattttttttttttttttttttttcgtatgtttttttttttttttttttttttttttttcgttcgtaagttttttttttttttcgttattttttgggtttcggtttagattaatttttttggtatttttaaaattgtcgcggtcggtttttttgtgtcgtcgcgggggtttcgcgtttcgtttatttcgttcgtgcgttttcgtagttttagagtttagtttcgaattcgggttttcgcggcgttttttttgttcgcgttgcggtcgtaatgggggggtttatcgggagagttttttgattttagtttattttattatcgggatcgttaagtggttggggtaggggtgg

SEQ ID NO: 37802 - DNA, 604 bp, Artificial Sequence
  chemically treated genomic DNA (Homo sapiens) CpG-island No: 37802
ccacccctaccccaaccacttaacgatcccgataataaaataaactaaaatcaaaaaactctcccgataaacccccccattacgaccgcaacgcgaacaaaaaaaacgccgcgaaaacccgaattcgaaactaaactctaaaactacgaaaacgcacgaacgaaataaacgaaacgcgaaacccccgcgacgacacaaaaaaaccgaccgcgacaattttaaaaataccaaaaaaattaatctaaaccgaaacccaaaaaataacgaaaaaaaaaaaaaacttacgaacgaaaaaaaaaaaaaaaaaaaaaaaaaaaaacatacgaaaaaaaaaaaaaaaaaaaaaatacgcgaaacgaaaaacgacgacaaacctcgcgaaaccccatcgaaaaacgcgaacgacgacgaaatacgcgctctaaacgacgaaacgcgacgctaaacgcccgacgaaacttccccaaactacgaccccgcgaaaccctccactcctcccgccgcctccgcaacccgcgcgccgaaacataaatcccgaccgaaaccccacgaccgcgaacgacgcctaaaacgacgatccgcgccctaaaaaatccgccgaccg

SEQ ID NO: 37803 - DNA, 604 bp, Artificial Sequence
  chemically treated genomic DNA (Homo sapiens) CpG-island No: 37803
ttatttttgttttagttatttggcggtttcgatagtgaaatggattaagattaaggagttttttcggtgagtttttttattgcggtcgtagcgcgggtagggaggacgtcgcgggagttcgggttcgaggttgggttttggggttgcgggggcgtacgggcgaggtaggcggggcgcggggttttcgcggcggtataaagaggtcggtcgcggtagttttgaaaatattaaggaagttgatttgggtcggggtttaagaagtgacgaggagggagggaggtttgcgagcgagggaggaaaggagggagagggagaggagtatgcgggaaggagggagggaggaagggtgcgcggggcgaggggcggcggtagatttcgcggggttttatcgggaagcgcgggcggcggcgggatgcgcgttttgggcggcggggcgcggcgttaggcgttcggcggggtttttttaggttgcgatttcgcgggattttttatttttttcgtcgttttcgtagttcgcgcgtcggagtatgagtttcggtcggagttttacggtcgcgggcggcgtttaggacggcgattcgcgttttggaggattcgtcggtcg

SEQ ID NO: 37804 - DNA, 604 bp, Artificial Sequence
  chemically treated genomic DNA (Homo sapiens) CpG-island No: 37804
cgaccgacgaatcctccaaaacgcgaatcgccgtcctaaacgccgcccgcgaccgtaaaactccgaccgaaactcatactccgacgcgcgaactacgaaaacgacgaaaaaaataaaaaatcccgcgaaatcgcaacctaaaaaaaccccgccgaacgcctaacgccgcgccccgccgcccaaaacgcgcatcccgccgccgcccgcgcttcccgataaaaccccgcgaaatctaccgccgcccctcgccccgcgcacccttcctccctccctccttcccgcatactcctctccctctccctcctttcctccctcgctcgcaaacctccctccctcctcgtcacttcttaaaccccgacccaaatcaacttccttaatattttcaaaactaccgcgaccgacctctttataccgccgcgaaaaccccgcgccccgcctacctcgcccgtacgcccccgcaaccccaaaacccaacctcgaacccgaactcccgcgacgtcctccctacccgcgctacgaccgcaataaaaaaactcaccgaaaaaactccttaatcttaatccatttcactatcgaaaccgccaaataactaaaacaaaaataa

SEQ ID NO: 37805 - DNA, 1082 bp, Artificial Sequence
  chemically treated genomic DNA (Homo sapiens) CpG-island No: 37805
tacggtagcggaaattgttttttaagttatttgggttattcggttttttttttcgcgtttggggtcgggatttcggtcgttcgtttcgttttttttttcgtcgcggtttcgtttttttttcgtttcgtttcgtttcgtttcgtttagtttcgttttcgtcgggtcgggtatgtttagtgggtcgggtcggtaggtttgcgtggtcgttgagttgtcggcgtcggttgagttagcggacgtcgcgttttttggcggtcgtcggttttcgggaagttacgtggcgaagtcggttttcgaggagacgtcgggaggttacgggtgttgttgacgggcgggcgatcgggcgaggtcgacgtggtcgggttgcgaaagttgcgggaggtcgagtgggtggtcgcgttcggagggaggtgtcggtcgggcgcgtttcgtggagaagattcgggcggggcgggcgtttttcggatttttgttcgagttgaattttttttttttgggtcgggttttttcggtcgttttcgttcgtgtttcgttcgttttcgggagatgtttatttgggttgtggcgtgaggagcgggcgggttagcgtcgcggagtttcgggttcgaggagtttcgcgcggcgttggagagagataagatgttcgttagagttgcggtcgttaaggtgagcgttttcgcggtcgttagggttagatcgggtcgatcgtcgtcgttcgtttatcggtatttggttcgcgtttcgttttttttcgttggcggttgtttgggtttcggggcggcggggtgggtagggttggcgcggggtcgcgggtcgcgggtcgcgggtcgcggggagtttttcgggcgggggcggcgcgggtcgtattgggggcggtcggggagggggttgcgggcgttcggtcgtcgtattgggtaggtgtatagttgtcggcgtttgtgtttggttgcggttcgttgagggcggggatacgtaataggtttttcgcggagaaattcggttttagtgagggttcgggggttggaagtcggtttttagcgggtcggggtttggggtgttattttttgttggtcgggagttgt

SEQ ID NO: 37806 - DNA, 1082 bp, Artificial Sequence
  chemically treated genomic DNA (Homo sapiens) CpG-island No: 37806
acaactcccgaccaacaaaaaataacaccccaaaccccgacccgctaaaaaccgacttccaacccccgaaccctcactaaaaccgaatttctccgcgaaaaacctattacgtatccccgccctcaacgaaccgcaaccaaacacaaacgccgacaactatacacctacccaatacgacgaccgaacgcccgcaaccccctccccgaccgcccccaatacgacccgcgccgcccccgcccgaaaaactccccgcgacccgcgacccgcgacccgcgaccccgcgccaaccctacccaccccgccgccccgaaacccaaacaaccgccaacgaaaaaaaacgaaacgcgaaccaaataccgataaacgaacgacgacgatcgacccgatctaaccctaacgaccgcgaaaacgctcaccttaacgaccgcaactctaacgaacatcttatctctctccaacgccgcgcgaaactcctcgaacccgaaactccgcgacgctaacccgcccgctcctcacgccacaacccaaataaacatctcccgaaaacgaacgaaacacgaacgaaaacgaccgaaaaaacccgacccaaaaaaaaaaaattcaactcgaacaaaaatccgaaaaacgcccgccccgcccgaatcttctccacgaaacgcgcccgaccgacacctccctccgaacgcgaccacccactcgacctcccgcaactttcgcaacccgaccacgtcgacctcgcccgatcgcccgcccgtcaacaacacccgtaacctcccgacgtctcctcgaaaaccgacttcgccacgtaacttcccgaaaaccgacgaccgccaaaaaacgcgacgtccgctaactcaaccgacgccgacaactcaacgaccacgcaaacctaccgacccgacccactaaacatacccgacccgacgaaaacgaaactaaacgaaacgaaacgaaacgaaacgaaaaaaaaacgaaaccgcgacgaaaaaaaaaacgaaacgaacgaccgaaatcccgaccccaaacgcgaaaaaaaaaaccgaataacccaaataacttaaaaaacaatttccgctaccgta

SEQ ID NO: 37807 - DNA, 1082 bp, Artificial Sequence
  chemically treated genomic DNA (Homo sapiens) CpG-island No: 37807
gtagttttcggttagtaggaggtggtattttaagtttcgattcgttgagagtcggtttttagttttcgaatttttattggagtcgagttttttcgcgagggatttgttgcgtgttttcgtttttagcgagtcgtagttaggtataggcgtcggtagttatgtatttgtttagtacggcggtcgggcgttcgtagtttttttttcggtcgtttttagtgcggttcgcgtcgttttcgttcgaggggtttttcgcggttcgcggttcgcggttcgcggtttcgcgttagttttgtttatttcgtcgtttcggggtttagatagtcgttagcgagggagggcgggacgcgggttagatgtcggtgggcgggcggcgacggtcggttcggtttggttttggcggtcgcggaggcgtttattttggcggtcgtagttttggcggatattttgtttttttttagcgtcgcgcgaggtttttcggattcgaaatttcgcggcgttggttcgttcgttttttacgttatagtttaaataaatatttttcgagagcgagcggggtacgggcgggggcggtcggaagggttcggtttagggggagggaatttaattcggataaaagttcgggaagcgttcgtttcgttcgggttttttttacggggcgcgttcgatcggtattttttttcgagcgcggttatttattcggtttttcgtagttttcgtagttcggttacgtcggtttcgttcggtcgttcgttcgttagtagtattcgtggtttttcggcgttttttcggaagtcggtttcgttacgtaatttttcgggaatcggcggtcgttaaggaacgcggcgttcgttggtttagtcggcgtcggtaatttagcggttacgtaaatttgtcggttcggtttattgagtatgttcggttcggcgggggcggggttggacgaggcgaggcgaggcgaggcggggagggggcggggtcgcggcgggggagggggcgggacgagcggtcggggtttcgattttaagcgcggaaggaaaagtcgggtaatttaagtaatttggaagatagttttcgttgtcgtg

SEQ ID NO: 37808 - DNA, 1082 bp, Artificial Sequence
  chemically treated genomic DNA (Homo sapiens) CpG-island No: 37808
cacgacaacgaaaactatcttccaaattacttaaattacccgacttttccttccgcgcttaaaatcgaaaccccgaccgctcgtcccgccccctcccccgccgcgaccccgccccctccccgcctcgcctcgcctcgcctcgtccaaccccgcccccgccgaaccgaacatactcaataaaccgaaccgacaaatttacgtaaccgctaaattaccgacgccgactaaaccaacgaacgccgcgttccttaacgaccgccgattcccgaaaaattacgtaacgaaaccgacttccgaaaaaacgccgaaaaaccacgaatactactaacgaacgaacgaccgaacgaaaccgacgtaaccgaactacgaaaactacgaaaaaccgaataaataaccgcgctcgaaaaaaaataccgatcgaacgcgccccgtaaaaaaaacccgaacgaaacgaacgcttcccgaacttttatccgaattaaattccctccccctaaaccgaacccttccgaccgcccccgcccgtaccccgctcgctctcgaaaaatatttatttaaactataacgtaaaaaacgaacgaaccaacgccgcgaaatttcgaatccgaaaaacctcgcgcgacgctaaaaaaaaacaaaatatccgccaaaactacgaccgccaaaataaacgcctccgcgaccgccaaaaccaaaccgaaccgaccgtcgccgcccgcccaccgacatctaacccgcgtcccgccctccctcgctaacgactatctaaaccccgaaacgacgaaataaacaaaactaacgcgaaaccgcgaaccgcgaaccgcgaaccgcgaaaaacccctcgaacgaaaacgacgcgaaccgcactaaaaacgaccgaaaaaaaaactacgaacgcccgaccgccgtactaaacaaatacataactaccgacgcctatacctaactacgactcgctaaaaacgaaaacacgcaacaaatccctcgcgaaaaaactcgactccaataaaaattcgaaaactaaaaaccgactctcaacgaatcgaaacttaaaataccacctcctactaaccgaaaactac

SEQ ID NO: 37809 - DNA, 748 bp, Artificial Sequence
  chemically treated genomic DNA (Homo sapiens) CpG-island No: 37809
tgttagacgcggtgggttcgttcgtgttagatacggagggttcgttcgtgttagatatagtgggttcgttcgtgttagatacggtggattcgttcgtgttagacgcggtgggttcgttcgtgttagatacggagggttcgttcgtgttagatacggtggattcgttcgtgttagatacggtgggttcgttcgtgttagatacggtgggttcgttcgtgttagatacggagggttcgttcgtgttagatacggagggttcgttcgtgttagacgcggtgggttcgttcgtgttagacgcggtgggttcgttcgtgttagacgcggagggttcgttcgtgttagacgcggtgggttcgttggtgttagacgcggtgggttcgttcgtgttagacgcggtgggttcgttcgtgttagacgcggtgggttcgttcgtgttagacgcggtgggttcgttcgtgttagacgcggtggattcgttcgtgttgtgttagatacggtggattcgttcgtgttagacgcggtggattcgttcgtgttgtgttagatacggtggattcgttcgtgttagatacggtggattcgttcgtgttagatacggtgggttcgttcgtgttagatacggtgggttcgttcgtgttagacgcggtggattttttcgtgttgtgttagatacggtggattcgttcgtgttgtgttagatacggtggattcgttcgtgttgtgttagatacggtggattcgtttgtgt

SEQ ID NO: 37810 - DNA, 748 bp, Artificial Sequence
  chemically treated genomic DNA (Homo sapiens) CpG-island No: 37810
acacaaacgaatccaccgtatctaacacaacacgaacgaatccaccgtatctaacacaacacgaacgaatccaccgtatctaacacaacacgaaaaaatccaccgcgtctaacacgaacgaacccaccgtatctaacacgaacgaacccaccgtatctaacacgaacgaatccaccgtatctaacacgaacgaatccaccgtatctaacacaacacgaacgaatccaccgcgtctaacacgaacgaatccaccgtatctaacacaacacgaacgaatccaccgcgtctaacacgaacgaacccaccgcgtctaacacgaacgaacccaccgcgtctaacacgaacgaacccaccgcgtctaacacgaacgaacccaccgcgtctaacaccaacgaacccaccgcgtctaacacgaacgaaccctccgcgtctaacacgaacgaacccaccgcgtctaacacgaacgaacccaccgcgtctaacacgaacgaaccctccgtatctaacacgaacgaaccctccgtatctaacacgaacgaacccaccgtatctaacacgaacgaacccaccgtatctaacacgaacgaatccaccgtatctaacacgaacgaaccctccgtatctaacacgaacgaacccaccgcgtctaacacgaacgaatccaccgtatctaacacgaacgaacccactatatctaacacgaacgaaccctccgtatctaacacgaacgaacccaccgcgtctaaca

SEQ ID NO: 37811 - DNA, 748 bp, Artificial Sequence
  chemically treated genomic DNA (Homo sapiens) CpG-island No: 37811
atataaacgagtttatcgtgtttaatataatacgaacgagtttatcgtgtttaatataatacgaacgagtttatcgtgtttaatataatacgaaggagtttatcgcgtttaatacgaacgaatttatcgtgtttaatacgaacgaatttatcgtgtttaatacgaacgagtttatcgtgtttaatacgaacgagtttatcgtgtttaatataatacgaacgagtttatcgcgtttaatacgaacgagtttatcgtgtttaatataatacgaacgagtttatcgcgtttaatacgaacgagtttatcgcgtttaatacgaacgagtttatcgcgtttaatacgaacgagtttatcgcgtttaatacgaacgagtttatcgcgtttaatattaacgagtttatcgcgtttaatacgaacgaatttttcgcgtttaatacgaacgagtttatcgcgtttaatacgaacgagtttatcgcgtttaatacgaacgagtttttcgtgtttaatacgaacgagtttttcgtgtttaatacgaacgaatttatcgtgtttaatacgaacgaatttatcgtgtttaatacgaacgagtttatcgtgtttaatacgaacgagtttttcgtgtttaatacgaacgaatttatcgcgtttaatacgaacgagtttatcgtgtttaatacgaacgagtttattgtgtttaatacgaacgagtttttcgtgtttaatacgaacgaatttatcgcgtttaata

SEQ ID NO: 37812 - DNA, 748 bp, Artificial Sequence
  chemically treated genomic DNA (Homo sapiens) CpG-island No: 37812
tattaaacgcgataaattcgttcgtattaaacacgaaaaactcgttcgtattaaacacaataaactcgttcgtattaaacacgataaactcgttcgtattaaacgcgataaattcgttcgtattaaacacgaaaaactcgttcgtattaaacacgataaactcgttcgtattaaacacgataaattcgttcgtattaaacacgataaattcgttcgtattaaacacgaaaaactcgttcgtattaaacacgaaaaactcgttcgtattaaacgcgataaactcgttcgtattaaacgcgataaactcgttcgtattaaacgcgaaaaattcgttcgtattaaacgcgataaactcgttaatattaaacgcgataaactcgttcgtattaaacgcgataaactcgttcgtattaaacgcgataaactcgttcgtattaaacgcgataaactcgttcgtattaaacgcgataaactcgttcgtattatattaaacacgataaactcgttcgtattaaacgcgataaactcgttcgtattatattaaacacgataaactcgttcgtattaaacacgataaactcgttcgtattaaacacgataaattcgttcgtattaaacacgataaattcgttcgtattaaacgcgataaactccttcgtattatattaaacacgataaactcgttcgtattatattaaacacgataaactcgttcgtattatattaaacacgataaactcgtttatat

SEQ ID NO: 37813 - DNA, 1068 bp, Artificial Sequence
  chemically treated genomic DNA (Homo sapiens) CpG-island No: 37813
ggtgaagacggtggtgaattgcgcggggaaggggcgaagacggtggtgaattgcgaattgtgcggggtaggggtgaagacggtggtgaattgcgcggggaaggtgtgaagacggtggtgaattgcgcggagaaggggcgaagacggtggtgaattgcggggaaggggtgaagacggtggtgaattgtagggaaggggtgaagacggtgaattgcggggaaggggcgaagacggtggtgaattgtagggaaggggtgaagacggtggtgaattgcgtggggaaggggtgaagacggtggtgaattgcgaattgcgcggggtaggggtgaagacggtggtgaattgcgcggggaaggtgtgaagacggtgaattgcgcggagaaggggtgaagacggtggtgaattgtagggaaggggtgaagacggtggtgaattgcgtggggaaggggtgaagacggtggtgaattgcgaattgcgcggggtaggggtgaagacggtggtgaattgcggggaaggggtgaagacggtggtgaattgcgcggagaaggggcgaagacggtggtgaattgcgcggggaaggggcgaagacggtggtgaattgcgcggggaaggggcgaagatagtggtgaattgtagggaaggggtgaagacggtggtgaattgcggggaaggggtgaagacggtggtgaattgcggggaaggggcgaagacggtggtgaattgcgcggggaaggggcgaagatagtggtgaattgtagggaaggggtgaagacggtggtgaattgcggggaaggggtgaagacggtggtgaattgcggggaaggggcgaagacggtggtgaattgcgcggggaaggggcgaagacggtggtgaattgcgcggggaaggggcgaagacggtggtgaattgcgcggggaagggttaagacggtggttaatgttcggggaaagggtaaaacggtggttaattgcggggaaggtgtgaagacggtggtgaattgcgcggggaaggaggaggcgagtgtcgtttgtaggagtcggagtagttgagggtttattagtgttttggg

SEQ ID NO: 37814 - DNA, 1068 bp, Artificial Sequence
  chemically treated genomic DNA (Homo sapiens) CpG-island No: 37814
cccaaaacactaataaaccctcaactactccgactcctacaaacgacactcgcctcctccttccccgcgcaattcaccaccgtcttcacaccttccccgcaattaaccaccgttttaccctttccccgaacattaaccaccgtcttaacccttccccgcgcaattcaccaccgtcttcgccccttccccgcgcaattcaccaccgtcttcgccccttccccgcgcaattcaccaccgtcttcgccccttccccgcaattcaccaccgtcttcaccccttccccgcaattcaccaccgtcttcaccccttccctacaattcaccactatcttcgccccttccccgcgcaattcaccaccgtcttcgccccttccccgcaattcaccaccgtcttcaccccttccccgcaattcaccaccgtcttcaccccttccctacaattcaccactatcttcgccccttccccgcgcaattcaccaccgtcttcgccccttccccgcgcaattcaccaccgtcttcgccccttctccgcgcaattcaccaccgtcttcaccccttccccgcaattcaccaccgtcttcacccctaccccgcgcaattcgcaattcaccaccgtcttcaccccttccccacgcaattcaccaccgtcttcaccccttccctacaattcaccaccgtcttcaccccttctccgcgcaattcaccgtcttcacaccttccccgcgcaattcaccaccgtcttcacccctaccccgcgcaattcgcaattcaccaccgtcttcaccccttccccacgcaattcaccaccgtcttcaccccttccctacaattcaccaccgtcttcgccccttccccgcaattcaccgtcttcaccccttccctacaattcaccaccgtcttcaccccttccccgcaattcaccaccgtcttcgccccttctccgcgcaattcaccaccgtcttcacaccttccccgcgcaattcaccaccgtcttcacccctaccccgcacaattcgcaattcaccaccgtcttcgccccttccccgcgcaattcaccaccgtcttcacc

SEQ ID NO: 37815 - DNA, 1068 bp, Artificial Sequence
  chemically treated genomic DNA (Homo sapiens) CpG-island No: 37815
tttagggtattggtgggtttttagttgtttcggtttttgtaggcggtattcgtttttttttttttcgcgtagtttattatcgtttttatatttttttcgtagttaattatcgttttgtttttttttcgggtattaattatcgttttaattttttttcgcgtagtttattatcgttttcgtttttttttcgcgtagtttattatcgttttcgtttttttttcgcgtagtttattatcgttttcgtttttttttcgtagtttattatcgtttttatttttttttcgtagtttattatcgtttttattttttttttgtagtttattattgttttcgtttttttttcgcgtagtttattatcgttttcgtttttttttcgtagtttattatcgtttttatttttttttcgtagtttattatcgtttttattttttttttgtagtttattattgttttcgtttttttttcgcgtagtttattatcgttttcgtttttttttcgcgtagtttattatcgttttcgtttttttttcgcgtagtttattatcgtttttatttttttttcgtagtttattatcgtttttatttttatttcgcgtagttcgtagtttattatcgtttttattttttttttacgtagtttattatcgtttttattttttttttgtagtttattatcgtttttatttttttttcgcgtagtttatcgtttttatatttttttcgcgtagtttattatcgtttttatttttatttcgcgtagttcgtagtttattatcgtttttattttttttttacgtagtttattatcgtttttattttttttttgtagtttattatcgttttcgtttttttttcgtagtttatcgtttttattttttttttgtagtttattatcgtttttatttttttttcgtagtttattatcgttttcgtttttttttcgcgtagtttattatcgtttttatatttttttcgcgtagtttattatcgtttttatttttatttcgtatagttcgtagtttattatcgttttcgtttttttttcgcgtagtttattatcgtttttatt

SEQ ID NO: 37816 - DNA, 1068 bp, Artificial Sequence
  chemically treated genomic DNA (Homo sapiens) CpG-island No: 37816
aataaaaacgataataaactacgcgaaaaaaaaacgaaaacgataataaactacgaactatacgaaataaaaataaaaacgataataaactacgcgaaaaaaatataaaaacgataataaactacgcgaaaaaaaaacgaaaacgataataaactacgaaaaaaaaataaaaacgataataaactacaaaaaaaaaataaaaacgataaactacgaaaaaaaaacgaaaacgataataaactacaaaaaaaaaataaaaacgataataaactacgtaaaaaaaaaataaaaacgataataaactacgaactacgcgaaataaaaataaaaacgataataaactacgcgaaaaaaatataaaaacgataaactacgcgaaaaaaaaataaaaacgataataaactacaaaaaaaaaataaaaacgataataaactacgtaaaaaaaaaataaaaacgataataaactacgaactacgcgaaataaaaataaaaacgataataaactacgaaaaaaaaataaaaacgataataaactacgcgaaaaaaaaacgaaaacgataataaactacgcgaaaaaaaaacgaaaacgataataaactacgcgaaaaaaaaacgaaaacaataataaactacaaaaaaaaaataaaaacgataataaactacgaaaaaaaaataaaaacgataataaactacgaaaaaaaaacgaaaacgataataaactacgcgaaaaaaaaacgaaaacaataataaactacaaaaaaaaaataaaaacgataataaactacgaaaaaaaaataaaaacgataataaactacgaaaaaaaaacgaaaacgataataaactacgcgaaaaaaaaacgaaaacgataataaactacgcgaaaaaaaaacgaaaacgataataaactacgcgaaaaaaaattaaaacgataattaatacccgaaaaaaaaacaaaacgataattaactacgaaaaaaatataaaaacgataataaactacgcgaaaaaaaaaaaaacgaataccgcctacaaaaaccgaaacaactaaaaacccaccaataccctaaa

SEQ ID NO: 37817 - DNA, 598 bp, Artificial Sequence
  chemically treated genomic DNA (Homo sapiens) CpG-island No: 37817
cgtgacgttagtacgtcgggcggggatcgggagatttttggggcggtggggggttagcggtagttttcggcggttttcggggcgggcgggcgggcgggtggtggcggcggttggggttcggcgttcgttcgttcgttgggcgggcgggcggtgcgatgttcggagaggatggttcggcggttggttcggggggcggcggcggcggttgttcgggagcggcgacgggagtagttgcggtagtggggggcgcgggcgggcgtcgagtttggtttcggagagcgtcgcgttcgtatcgttcgtttcgagcgcgtcgtcgagtttttggcggtttgtgcgggcggcgatttggacgaggcgcgtttgatgttgcgcgtcgtcgattttggtttcggcgtcgagttcgattttcgtcgcgtcgtcgttcgttcgcgtcgtgttggattttattaacgtcgacggtattagcgttttgtattaggttagcgtttttcgttcggcgtttttcggggttaggtttattttttgttgcgttatttggggtatttttttttttcgttgttagtttcgattcgtttcgtcgtttttggttttggttttg

SEQ ID NO: 37818 - DNA, 598 bp, Artificial Sequence
  chemically treated genomic DNA (Homo sapiens) CpG-island No: 37818
caaaaccaaaaccaaaaacgacgaaacgaatcgaaactaacaacgaaaaaaaaaaataccccaaataacgcaacaaaaaataaacctaaccccgaaaaacgccgaacgaaaaacgctaacctaatacaaaacgctaataccgtcgacgttaataaaatccaacacgacgcgaacgaacgacgacgcgacgaaaatcgaactcgacgccgaaaccaaaatcgacgacgcgcaacatcaaacgcgcctcgtccaaatcgccgcccgcacaaaccgccaaaaactcgacgacgcgctcgaaacgaacgatacgaacgcgacgctctccgaaaccaaactcgacgcccgcccgcgccccccactaccgcaactactcccgtcgccgctcccgaacaaccgccgccgccgccccccgaaccaaccgccgaaccatcctctccgaacatcgcaccgcccgcccgcccaacgaacgaacgaacgccgaaccccaaccgccgccaccacccgcccgcccgcccgccccgaaaaccgccgaaaactaccgctaaccccccaccgccccaaaaatctcccgatccccgcccgacgtactaacgtcacg

SEQ ID NO: 37819 - DNA, 598 bp, Artificial Sequence
  chemically treated genomic DNA (Homo sapiens) CpG-island No: 37819
taaagttagggttaggaacgacggggcggatcgagattggtaacggggaaggaggatgttttaggtggcgtagtagagggtggatttggtttcgggagacgtcgggcggggggcgttgatttggtgtagggcgttgatatcgtcggcgttggtggagtttagtacggcgcgggcgggcggcggcgcggcggaggtcgagttcggcgtcggggttagggtcggcggcgcgtagtattagacgcgtttcgtttaggtcgtcgttcgtataggtcgttaggaattcggcggcgcgttcgaagcggacggtgcgggcgcggcgtttttcggggttaggttcggcgttcgttcgcgttttttattgtcgtagttgttttcgtcgtcgttttcgggtagtcgtcgtcgtcgtttttcgggttagtcgtcgggttatttttttcggatatcgtatcgttcgttcgtttagcgagcgagcgagcgtcgagttttaatcgtcgttattattcgttcgttcgttcgtttcgggggtcgtcgggaattgtcgttggttttttatcgttttaaggatttttcggttttcgttcggcgtgttgacgttacg

SEQ ID NO: 37820 - DNA, 598 bp, Artificial Sequence
  chemically treated genomic DNA (Homo sapiens) CpG-island No: 37820
cgtaacgtcaacacgccgaacgaaaaccgaaaaatccttaaaacgataaaaaaccaacgacaattcccgacgacccccgaaacgaacgaacgaacgaataataacgacgattaaaactcgacgctcgctcgctcgctaaacgaacgaacgatacgatatccgaaaaaaataacccgacgactaacccgaaaaacgacgacgacgactacccgaaaacgacgacgaaaacaactacgacaataaaaaacgcgaacgaacgccgaacctaaccccgaaaaacgccgcgcccgcaccgtccgcttcgaacgcgccgccgaattcctaacgacctatacgaacgacgacctaaacgaaacgcgtctaatactacgcgccgccgaccctaaccccgacgccgaactcgacctccgccgcgccgccgcccgcccgcgccgtactaaactccaccaacgccgacgatatcaacgccctacaccaaatcaacgccccccgcccgacgtctcccgaaaccaaatccaccctctactacgccacctaaaacatcctccttccccgttaccaatctcgatccgccccgtcgttcctaaccctaacttta

SEQ ID NO: 37821 - DNA, 555 bp, Artificial Sequence
  chemically treated genomic DNA (Homo sapiens) CpG-island No: 37821
gtttataggtttttgaaattattaattttagttgtgatagcgtttaggatcgatgtttataggtttcgtttttaggattttcgtttttttcgttcgcgtttcgtttttcgtagtttagtttcggacgcgggtttagtcgcgttatcgttttcgttcgtttgtggttgcgtcgcgcgttttttttcggagttatttaggcggttggtgtgtagtaagtttcgcgtcgatttcggacgtttgacgtttgacgtttgacgtttgtattcggtttcgtatgagtcgttatttgttgtcgttgtcggcgttgggtacggtagtaggcgtcgtcgtgttgtttaagtgagtatattttagtttcgcgtgcgcggttaaggcggtttttagcgtaggggtcgggaaggcggcggagattttcgtttttcgtattcgggtttaggtttcgtagttttcgattcgtagtgttcgttcggagtggggtaaatttgcgttttggtcggttaggttatcggtttaaggttattcggagggaagggcgagtttgggtttttgtaaatg

SEQ ID NO: 37822 - DNA, 555 bp, Artificial Sequence
  chemically treated genomic DNA (Homo sapiens) CpG-island No: 37822
catttacaaaaacccaaactcgcccttccctccgaataaccttaaaccgataacctaaccgaccaaaacgcaaatttaccccactccgaacgaacactacgaatcgaaaactacgaaacctaaacccgaatacgaaaaacgaaaatctccgccgccttcccgacccctacgctaaaaaccgccttaaccgcgcacgcgaaactaaaatatactcacttaaacaacacgacgacgcctactaccgtacccaacgccgacaacgacaacaaataacgactcatacgaaaccgaatacaaacgtcaaacgtcaaacgtcaaacgtccgaaatcgacgcgaaacttactacacaccaaccgcctaaataactccgaaaaaaaacgcgcgacgcaaccacaaacgaacgaaaacgataacgcgactaaacccgcgtccgaaactaaactacgaaaaacgaaacgcgaacgaaaaaaacgaaaatcctaaaaacgaaacctataaacatcgatcctaaacgctatcacaactaaaattaataatttcaaaaacctataaac

SEQ ID NO: 37823 - DNA, 555 bp, Artificial Sequence
  chemically treated genomic DNA (Homo sapiens) CpG-island No: 37823
tatttataagggtttaggttcgttttttttttcgagtgattttgggtcggtgatttggtcggttagagcgtaggtttgttttatttcgggcgggtattgcgggtcgggagttacggggtttggattcgggtgcgaggggcgggggttttcgtcgttttttcggtttttgcgttgggggtcgttttgatcgcgtacgcggggttagaatgtatttatttgagtagtacggcggcgtttgttatcgtgtttagcgtcgatagcggtagtaggtagcggtttatgcggggtcgggtataggcgttaggcgttaggcgttaggcgttcggggtcggcgcggagtttgttgtatattagtcgtttggatagtttcgaggaagagcgcgcgacgtagttataggcgagcggaggcgatggcgcggttgggttcgcgttcggaattgggttgcgaggggcggggcgcgggcggagggggcggggattttagggacgggatttatgagtatcggttttgagcgttgttatagttgggattggtggttttaggagtttgtgggt

SEQ ID NO: 37824 - DNA, 555 bp, Artificial Sequence
  chemically treated genomic DNA (Homo sapiens) CpG-island No: 37824
acccacaaactcctaaaaccaccaatcccaactataacaacgctcaaaaccgatactcataaatcccgtccctaaaatccccgccccctccgcccgcgccccgcccctcgcaacccaattccgaacgcgaacccaaccgcgccatcgcctccgctcgcctataactacgtcgcgcgctcttcctcgaaactatccaaacgactaatatacaacaaactccgcgccgaccccgaacgcctaacgcctaacgcctaacgcctatacccgaccccgcataaaccgctacctactaccgctatcgacgctaaacacgataacaaacgccgccgtactactcaaataaatacattctaaccccgcgtacgcgatcaaaacgacccccaacgcaaaaaccgaaaaaacgacgaaaacccccgcccctcgcacccgaatccaaaccccgtaactcccgacccgcaatacccgcccgaaataaaacaaacctacgctctaaccgaccaaatcaccgacccaaaatcactcgaaaaaaaaaacgaacctaaacccttataaata

SEQ ID NO: 37825 - DNA, 582 bp, Artificial Sequence
  chemically treated genomic DNA (Homo sapiens) CpG-island No: 37825
ttaattgtaggcgttgggtattaaaggcgatagtgatgagaaacgtcgtgtatcggtcgatatcggtatttttcgtttgttgtaaatgtaacgtgataacggcggttttgcgttgtgggataaaaacggtgacgaagagtattggttgacggtttacgtgatggattttttggttcgcgtaggcgaatagggttatagcgtgtcgatagacgttattaatcggggtaatgagcgtttgttgcgttatttataagattcgggtatgatgtcgatttcgtacgcggataattttaaagttagtaaattcgtcgtatagttttacgttgcgttggtgttggttcgttagtaaaaggtttcgttgggtgcgttgcgtgaaatttgggagtatcgtgtagatgtcgtttttggtttatcgttgttgtaatttggcgttgcgttgaaaattatgggtgatgcgacgcgtggtgaagaagcgattgcgttggcgttgaaaacgtcgcgtaatagtgatgagcggatatggttgggtgattacggtagtttattgcgcgataacgcgttaatgttttttttgttggaaga

SEQ ID NO: 37826 - DNA, 582 bp, Artificial Sequence
  chemically treated genomic DNA (Homo sapiens) CpG-island No: 37826
tcttccaacaaaaaaaacattaacgcgttatcgcgcaataaactaccgtaatcacccaaccatatccgctcatcactattacgcgacgttttcaacgccaacgcaatcgcttcttcaccacgcgtcgcatcacccataattttcaacgcaacgccaaattacaacaacgataaaccaaaaacgacatctacacgatactcccaaatttcacgcaacgcacccaacgaaaccttttactaacgaaccaacaccaacgcaacgtaaaactatacgacgaatttactaactttaaaattatccgcgtacgaaatcgacatcatacccgaatcttataaataacgcaacaaacgctcattaccccgattaataacgtctatcgacacgctataaccctattcgcctacgcgaaccaaaaaatccatcacgtaaaccgtcaaccaatactcttcgtcaccgtttttatcccacaacgcaaaaccgccgttatcacgttacatttacaacaaacgaaaaataccgatatcgaccgatacacgacgtttctcatcactatcgcctttaatacccaacgcctacaattaa

SEQ ID NO: 37827 - DNA, 582 bp, Artificial Sequence
  chemically treated genomic DNA (Homo sapiens) CpG-island No: 37827
ttttttagtaaggagagtattaacgcgttgtcgcgtagtgaattatcgtaattatttagttatattcgtttattattattacgcggcgtttttagcgttagcgtaatcgtttttttattacgcgtcgtattatttatggtttttagcgtaacgttaagttgtagtagcggtaaattagaagcggtatttgtacgatgtttttagattttacgtagcgtatttagcggagttttttgttgacgggttaatattagcgtagcgtaagattgtacggcgaatttattggttttgagattattcgcgtacgggatcgatattatgttcggattttgtaaatagcgtagtagacgtttattatttcggttaatggcgtttgtcggtacgttgtaattttgttcgtttgcgcggattaggaaatttattacgtaagtcgttagttagtatttttcgttatcgtttttattttatagcgtaaagtcgtcgttattacgttgtatttgtagtaaacgggaaatgtcgatatcgatcgatgtacggcgttttttattattgtcgtttttgatgtttaacgtttgtagttgg

SEQ ID NO: 37828 - DNA, 582 bp, Artificial Sequence
  chemically treated genomic DNA (Homo sapiens) CpG-island No: 37828
ccaactacaaacgttaaacatcaaaaacgacaataataaaaaacgccgtacatcgatcgatatcgacatttcccgtttactacaaatacaacgtaataacgacgactttacgctataaaataaaaacgataacgaaaaatactaactaacgacttacgtaataaatttcctaatccgcgcaaacgaacaaaattacaacgtaccgacaaacgccattaaccgaaataataaacgtctactacgctatttacaaaatccgaacataatatcgatcccgtacgcgaataatctcaaaaccaataaattcgccgtacaatcttacgctacgctaatattaacccgtcaacaaaaaactccgctaaatacgctacgtaaaatctaaaaacatcgtacaaataccgcttctaatttaccgctactacaacttaacgttacgctaaaaaccataaataatacgacgcgtaataaaaaaacgattacgctaacgctaaaaacgccgcgtaataataataaacgaatataactaaataattacgataattcactacgcgacaacgcgttaatactctccttactaaaaaa

SEQ ID NO: 37829 - DNA, 567 bp, Artificial Sequence
  chemically treated genomic DNA (Homo sapiens) CpG-island No: 37829
atcgtcgttacgacggttagagattatattcgtcgagatgttcgcggtttagggtttataatttttttcggttagtttttttggtcgcgtaagcgtagtggggtcggcgggaagcgtaggcgtgtgacgttattaggcggcgcgggttagttaggtgtacgtgattaaggttttgggcgcggtaggtggtagttttttcgtttttttggtttttttattttttgttgcgggggatcgcgtaagcgtagtgagtattgtacgttgtcgcgggttagtaacgttattagacgtgtgtgtgtttttgcggcgttaagaaggggagattgaggttgaggttggggaatatcgggtagtatgagcggttgcgggttttttttgcgtattacggttgcggttcgtgtttgtcggggtttggtggtttttatcgcgaatcggcggttattgcgtattagttcgtttgtacgagttttcgttaaagagttttttttaggtaaaattaagaaggtaacgcgagttttgggcgaatttttgttgtttggttttcgttttttatttttagttgtaaga

SEQ ID NO: 37830 - DNA, 567 bp, Artificial Sequence
  chemically treated genomic DNA (Homo sapiens) CpG-island No: 37830
tcttacaactaaaaataaaaaacgaaaaccaaacaacaaaaattcgcccaaaactcgcgttaccttcttaattttacctaaaaaaaactctttaacgaaaactcgtacaaacgaactaatacgcaataaccgccgattcgcgataaaaaccaccaaaccccgacaaacacgaaccgcaaccgtaatacgcaaaaaaaacccgcaaccgctcatactacccgatattccccaacctcaacctcaatctccccttcttaacgccgcaaaaacacacacacgtctaataacgttactaacccgcgacaacgtacaatactcactacgcttacgcgatcccccgcaacaaaaaataaaaaaaccaaaaaaacgaaaaaactaccacctaccgcgcccaaaaccttaatcacgtacacctaactaacccgcgccgcctaataacgtcacacgcctacgcttcccgccgaccccactacgcttacgcgaccaaaaaaactaaccgaaaaaaattataaaccctaaaccgcgaacatctcgacgaatataatctctaaccgtcgtaacgacgat

SEQ ID NO: 37831 - DNA, 567 bp, Artificial Sequence
  chemically treated genomic DNA (Homo sapiens) CpG-island No: 37831
ttttgtagttgagggtgaaaagcgggagttagatagtaagggttcgtttagggttcgcgttatttttttgattttgtttaggaaaagttttttggcgaaagttcgtataggcgggttggtgcgtagtagtcgtcggttcgcggtagagattattagatttcggtaggtacgagtcgtagtcgtggtgcgtaggaagagttcgtagtcgtttatgttgttcgatgttttttagttttagttttagttttttttttttagcgtcgtagggatatatatacgtttgatgacgttattggttcgcgataacgtgtagtatttattgcgtttgcgcggtttttcgtagtaggggatggagaggttagaagggcgggaaggttattatttgtcgcgtttaaggttttagttacgtgtatttggttggttcgcgtcgtttgatgacgttatacgtttacgtttttcgtcggttttattgcgtttgcgcggttaaaggagttggtcggaggaaattgtaggttttgggtcgcgggtatttcggcgggtataatttttggtcgtcgtgacggcggt

SEQ ID NO: 37832 - DNA, 567 bp, Artificial Sequence
  chemically treated genomic DNA (Homo sapiens) CpG-island No: 37832
accgccgtcacgacgaccaaaaattatacccgccgaaatacccgcgacccaaaacctacaatttcctccgaccaactcctttaaccgcgcaaacgcaataaaaccgacgaaaaacgtaaacgtataacgtcatcaaacgacgcgaaccaaccaaatacacgtaactaaaaccttaaacgcgacaaataataaccttcccgcccttctaacctctccatcccctactacgaaaaaccgcgcaaacgcaataaatactacacgttatcgcgaaccaataacgtcatcaaacgtatatatatccctacgacgctaaaaaaaaaaaactaaaactaaaactaaaaaacatcgaacaacataaacgactacgaactcttcctacgcaccacgactacgactcgtacctaccgaaatctaataatctctaccgcgaaccgacgactactacgcaccaacccgcctatacgaactttcgccaaaaaacttttcctaaacaaaatcaaaaaaataacgcgaaccctaaacgaacccttactatctaactcccgcttttcaccctcaactacaaaa

SEQ ID NO: 37833 - DNA, 918 bp, Artificial Sequence
  chemically treated genomic DNA (Homo sapiens) CpG-island No: 37833
ttttcgtggtcggcgcgtatttgtagtgttaggtagcgcgtattattgttttgtagcgcggcgcgtaggttttttattaattcgcgtaagttgttattttttttttttagtcgcgtaacgcgtttatagttaggatcgttgtcggggttaggcgcgtagggcgggcggcggcggcggcgcggacggcgtaggcggatttgcgtttcgatgtgttcgttgagagcgtcgcggggtagtcggggtttcgtacgggtgtcgaagtagttatagaggcgcgcgtggaattggcggaaggtgagtttcggcggttcggcgcgtagcgttaggcgcgtttttttatcggtatttgagttttcgttcgtggttaatttagcggtcgtattttcgggggttatatttttggagttttcgttatttgttgtttgttcggtcgtggtggtttttttcgcgcgtagttttagtatagcgtagagcgttcggaagtcggcgcggggtagacggtcggcgtcgcggtagtttaggtggtggaagattttttgtaggtattggtttaggtcggtggttagtattacgatttcgttttttacgtcgcggtttagttcgtagtggtgcgttagggcgtttagtagttattgcgtgcgtcgcgtaggtcgtcggtacgggttatttttcgcgttttttatgtcggttttcgcgttcgtgttgatcggttttatcgttgcgtcgcgcgtttcgttttttcggtttttttttcggttttttcgtttcgttatttttaggggcggttttagagtttttcgaaaggaggggtttagcggtcgcggtttggttggagcggcgtcggggatcgtgtttagtagttgcgttggttttatagtgcgtttggtttattttagttgttttggaggggtttggggt

SEQ ID NO: 37834 - DNA, 918 bp, Artificial Sequence
  chemically treated genomic DNA (Homo sapiens) CpG-island No: 37834
accccaaacccctccaaaacaactaaaataaaccaaacgcactataaaaccaacgcaactactaaacacgatccccgacgccgctccaaccaaaccgcgaccgctaaacccctcctttcgaaaaactctaaaaccgcccctaaaaataacgaaacgaaaaaaccgaaaaaaaaaccgaaaaaacgaaacgcgcgacgcaacgataaaaccgatcaacacgaacgcgaaaaccgacataaaaaacgcgaaaaataacccgtaccgacgacctacgcgacgcacgcaataactactaaacgccctaacgcaccactacgaactaaaccgcgacgtaaaaaacgaaatcgtaatactaaccaccgacctaaaccaatacctacaaaaaatcttccaccacctaaactaccgcgacgccgaccgtctaccccgcgccgacttccgaacgctctacgctatactaaaactacgcgcgaaaaaaaccaccacgaccgaacaaacaacaaataacgaaaactccaaaaatataacccccgaaaatacgaccgctaaattaaccacgaacgaaaactcaaataccgataaaaaaacgcgcctaacgctacgcgccgaaccgccgaaactcaccttccgccaattccacgcgcgcctctataactacttcgacacccgtacgaaaccccgactaccccgcgacgctctcaacgaacacatcgaaacgcaaatccgcctacgccgtccgcgccgccgccgccgcccgccctacgcgcctaaccccgacaacgatcctaactataaacgcgttacgcgactaaaaaaaaaaaataacaacttacgcgaattaataaaaaacctacgcgccgcgctacaaaacaataatacgcgctacctaacactacaaatacgcgccgaccacgaaaa

SEQ ID NO: 37835 - DNA, 918 bp, Artificial Sequence
  chemically treated genomic DNA (Homo sapiens) CpG-island No: 37835
attttaggtttttttaaagtaattggggtaaattagacgtattgtgaggttagcgtagttgttggatacggttttcggcgtcgttttaattagatcgcgatcgttaagttttttttttcgagaaattttggggtcgtttttggaagtggcggggcgaagggatcggaggagggatcggaggagcgaggcgcgcggcgtagcgatggagtcggttagtacgggcgcggaggtcggtatggagggcgcgggaggtgattcgtatcggcgatttgcgcggcgtacgtagtggttgttgagcgttttggcgtattattacgggttggatcgcggcgtggagaacgagatcgtggtgttggttatcggtttggattagtatttgtaggaggttttttattatttggattgtcgcggcgtcggtcgtttgtttcgcgtcgattttcgagcgttttgcgttgtgttggggttgcgcgcggagggggttattacggtcgggtaggtagtaggtgacgggaattttagagatgtgattttcggggatgcggtcgttgagttggttacggacggggatttagatatcgatgaagaggcgcgtttggcgttgcgcgtcgagtcgtcggagtttatttttcgttagttttacgcgcgtttttgtggttatttcggtattcgtgcggggtttcggttgtttcgcggcgtttttagcgagtatatcgagacgtagattcgtttgcgtcgttcgcgtcgtcgtcgtcgttcgttttgcgcgtttggtttcgatagcggttttgattgtgagcgcgttgcgcggttggaggaggagaatagtagtttgcgcgagttggtggaggatttgcgcgtcgcgttgtagagtagtgatgcgcgttgtttagtattgtaggtgcgcgtcggttacgaagg

SEQ ID NO: 37836 - DNA, 918 bp, Artificial Sequence
  chemically treated genomic DNA (Homo sapiens) CpG-island No: 37836
ccttcgtaaccgacgcgcacctacaatactaaacaacgcgcatcactactctacaacgcgacgcgcaaatcctccaccaactcgcgcaaactactattctcctcctccaaccgcgcaacgcgctcacaatcaaaaccgctatcgaaaccaaacgcgcaaaacgaacgacgacgacgacgcgaacgacgcaaacgaatctacgtctcgatatactcgctaaaaacgccgcgaaacaaccgaaaccccgcacgaataccgaaataaccacaaaaacgcgcgtaaaactaacgaaaaataaactccgacgactcgacgcgcaacgccaaacgcgcctcttcatcgatatctaaatccccgtccgtaaccaactcaacgaccgcatccccgaaaatcacatctctaaaattcccgtcacctactacctacccgaccgtaataaccccctccgcgcgcaaccccaacacaacgcaaaacgctcgaaaatcgacgcgaaacaaacgaccgacgccgcgacaatccaaataataaaaaacctcctacaaatactaatccaaaccgataaccaacaccacgatctcgttctccacgccgcgatccaacccgtaataatacgccaaaacgctcaacaaccactacgtacgccgcgcaaatcgccgatacgaatcacctcccgcgccctccataccgacctccgcgcccgtactaaccgactccatcgctacgccgcgcgcctcgctcctccgatccctcctccgatcccttcgccccgccacttccaaaaacgaccccaaaatttctcgaaaaaaaaaacttaacgatcgcgatctaattaaaacgacgccgaaaaccgtatccaacaactacgctaacctcacaatacgtctaatttaccccaattactttaaaaaaacctaaaat

SEQ ID NO: 37837 - DNA, 557 bp, Artificial Sequence
  chemically treated genomic DNA (Homo sapiens) CpG-island No: 37837
gttcgtcgaggcggtataaatcgtcgtgacgattagcggtttaatgatcgaagttaggttggtaagagtcgcgagcgatttttgaagttgtttttgatggtcgttatttatttgtttggatagtatggtttgtaacgcgggtatttcgatgtcgtcggaagcgagaagaattataatggggaaggttatttagtttcgcgtcgcgaacgttagtaagacgtagtttagcgcgtcggtcgttatgtcggcgataatggtttgtttttcgtcgaaacgtttggtggcgggattagtgacgaaggtttgagcgagggcgtgtaagatttcgaatatcgtaagcgataggtcgattatcgtcgcgttttagcgaaagcggttttcgtcgaaaatgatttagagcgttgtcggtatttgttttacgagttgtatgataaagaagatagttataagtgcggcgacgatagttatgtttcgcgtttatcggaaggagttgattgggttgaaggtttttaagggtatcggtcgatttttgaggaatattttaaatttttaaaaaa

SEQ ID NO: 37838 - DNA, 557 bp, Artificial Sequence
  chemically treated genomic DNA (Homo sapiens) CpG-island No: 37838
ttttttaaaaatttaaaatattcctcaaaaatcgaccgatacccttaaaaaccttcaacccaatcaactccttccgataaacgcgaaacataactatcgtcgccgcacttataactatcttctttatcatacaactcgtaaaacaaataccgacaacgctctaaatcattttcgacgaaaaccgctttcgctaaaacgcgacgataatcgacctatcgcttacgatattcgaaatcttacacgccctcgctcaaaccttcgtcactaatcccgccaccaaacgtttcgacgaaaaacaaaccattatcgccgacataacgaccgacgcgctaaactacgtcttactaacgttcgcgacgcgaaactaaataaccttccccattataattcttctcgcttccgacgacatcgaaatacccgcgttacaaaccatactatccaaacaaataaataacgaccatcaaaaacaacttcaaaaatcgctcgcgactcttaccaacctaacttcgatcattaaaccgctaatcgtcacgacgatttataccgcctcgacgaac

SEQ ID NO: 37839 - DNA, 557 bp, Artificial Sequence
  chemically treated genomic DNA (Homo sapiens) CpG-island No: 37839
ttttttgaaaatttgaaatattttttaggagtcgatcgatgtttttgagagtttttaatttagttagtttttttcggtgggcgcggggtatgattatcgtcgtcgtatttatgattgttttttttattatgtaattcgtaggataggtgtcggtagcgttttgggttattttcggcgaggatcgttttcgttggagcgcgacgatgatcggtttgtcgtttgcggtattcggaattttgtacgttttcgtttaagttttcgttattggtttcgttattaaacgtttcggcgagaagtaggttattatcgtcggtatggcggtcgacgcgttgggttacgttttgttggcgttcgcgacgcgaggttggatggttttttttattatgatttttttcgttttcggcggtatcgggatgttcgcgttgtaggttatgttgtttaggtaggtagatgacgattattagggatagttttaaggatcgttcgcggtttttattagtttaatttcgattattggatcgttgatcgttacggcgatttatgtcgtttcggcgagt

SEQ ID NO: 37840 - DNA, 557 bp, Artificial Sequence
  chemically treated genomic DNA (Homo sapiens) CpG-island No: 37840
actcgccgaaacgacataaatcgccgtaacgatcaacgatccaataatcgaaattaaactaataaaaaccgcgaacgatccttaaaactatccctaataatcgtcatctacctacctaaacaacataacctacaacgcgaacatcccgataccgccgaaaacgaaaaaaatcataataaaaaaaaccatccaacctcgcgtcgcgaacgccaacaaaacgtaacccaacgcgtcgaccgccataccgacgataataacctacttctcgccgaaacgtttaataacgaaaccaataacgaaaacttaaacgaaaacgtacaaaattccgaataccgcaaacgacaaaccgatcatcgtcgcgctccaacgaaaacgatcctcgccgaaaataacccaaaacgctaccgacacctatcctacgaattacataataaaaaaaacaatcataaatacgacgacgataatcataccccgcgcccaccgaaaaaaactaactaaattaaaaactctcaaaaacatcgatcgactcctaaaaaatatttcaaattttcaaaaaa

SEQ ID NO: 37841 - DNA, 669 bp, Artificial Sequence
  chemically treated genomic DNA (Homo sapiens) CpG-island No: 37841
ggttcgggcggggcgcgttaggatcgagcgagcggagggagcgagtcgggcggagttagcgtttttcgttttcgtcggcggtttttttttttcggtcgttgcgtcgttcggttcgcgacgttgtagaggtttcgaggcggcggcggcgatttttttttttttttttttttttttcgttcgttcgttcgttcgcgcgtttgttcgttcggttcggttcggttcgaagtatggtcggcgttagttttagcgttatcgtttggagttgttggcggtttacgaggaggtgattcgagaggagagcgcggtcgattggtgagtttttcgttttcgttttcggtttttttgttttcgcgtcgtcgtcgcgtttttgtttttttttcgtttcgtcgtttcgtcgtcgggaagggagggggatttcgaaatggtgtagcgggtcgggagggtcgggaggggttgtttttgtgcgcgtcgggggaggggtcggcgggttaggcggggtattgcgggtttcgagcgttcggaggcggtttaaggcgcgcggtgggagcggcggtcggacgcggttcggaggcgcggggtttcgatgtggggttcgggtcgcgtggtttgcgggagtttattttttattttatttttcgggttcgggggataggtgtgtacggggcggtt

SEQ ID NO: 37842 - DNA, 669 bp, Artificial Sequence
  chemically treated genomic DNA (Homo sapiens) CpG-island No: 37842
aaccgccccgtacacacctatcccccgaacccgaaaaataaaataaaaaataaactcccgcaaaccacgcgacccgaaccccacatcgaaaccccgcgcctccgaaccgcgtccgaccgccgctcccaccgcgcgccttaaaccgcctccgaacgctcgaaacccgcaataccccgcctaacccgccgacccctcccccgacgcgcacaaaaacaacccctcccgaccctcccgacccgctacaccatttcgaaatccccctcccttcccgacgacgaaacgacgaaacgaaaaaaaaacaaaaacgcgacgacgacgcgaaaacaaaaaaaccgaaaacgaaaacgaaaaactcaccaatcgaccgcgctctcctctcgaatcacctcctcgtaaaccgccaacaactccaaacgataacgctaaaactaacgccgaccatacttcgaaccgaaccgaaccgaacgaacaaacgcgcgaacgaacgaacgaacgaaaaaaaaaaaaaaaaaaaaaaaaatcgccgccgccgcctcgaaacctctacaacgtcgcgaaccgaacgacgcaacgaccgaaaaaaaaaaaccgccgacgaaaacgaaaaacgctaactccgcccgactcgctccctccgctcgctcgatcctaacgcgccccgcccgaacc

SEQ ID NO: 37843 - DNA, 669 bp, Artificial Sequence
  chemically treated genomic DNA (Homo sapiens) CpG-island No: 37843
ggtcgtttcgtgtatatttgtttttcgggttcggggggtagggtgggggatgggttttcgtaggttacgcggttcgggttttatatcgggatttcgcgttttcgggtcgcgttcggtcgtcgtttttatcgcgcgttttgggtcgttttcgggcgttcggggttcgtagtgtttcgtttggttcgtcggtttttttttcggcgcgtataaaggtagtttttttcggttttttcggttcgttgtattatttcggggttttttttttttttcggcggcggggcggcggggcgggagagaaataaaggcgcggcggcggcgcggggataaaggggtcgggggcgggggcggggggtttattagtcggtcgcgtttttttttcggattattttttcgtaagtcgttagtagttttaggcggtggcgttgaagttgacgtcggttatgtttcgggtcggatcgggtcgaacggatagacgcgcggacggacgggcggacggaggaggagggagggaaagagggagtcgtcgtcgtcgtttcggagtttttgtagcgtcgcgagtcgagcgacgtagcggtcgggggaggggagtcgtcggcgggggcggggggcgttggtttcgttcggttcgtttttttcgttcgttcggttttagcgcgtttcgttcggatt

SEQ ID NO: 37844 - DNA, 669 bp, Artificial Sequence
  chemically treated genomic DNA (Homo sapiens) CpG-island No: 37844
aatccgaacgaaacgcgctaaaaccgaacgaacgaaaaaaacgaaccgaacgaaaccaacgccccccgcccccgccgacgactcccctcccccgaccgctacgtcgctcgactcgcgacgctacaaaaactccgaaacgacgacgacgactccctctttccctccctcctcctccgtccgcccgtccgtccgcgcgtctatccgttcgacccgatccgacccgaaacataaccgacgtcaacttcaacgccaccgcctaaaactactaacgacttacgaaaaaataatccgaaaaaaaaacgcgaccgactaataaaccccccgcccccgcccccgacccctttatccccgcgccgccgccgcgcctttatttctctcccgccccgccgccccgccgccgaaaaaaaaaaaaaaccccgaaataatacaacgaaccgaaaaaaccgaaaaaaactacctttatacgcgccgaaaaaaaaaccgacgaaccaaacgaaacactacgaaccccgaacgcccgaaaacgacccaaaacgcgcgataaaaacgacgaccgaacgcgacccgaaaacgcgaaatcccgatataaaacccgaaccgcgtaacctacgaaaacccatcccccaccctaccccccgaacccgaaaaacaaatatacacgaaacgacc

SEQ ID NO: 37845 - DNA, 1767 bp, Artificial Sequence
  chemically treated genomic DNA (Homo sapiens) CpG-island No: 37845
gagttcgtcggtggggttcggggcgtcgcgtttttttatacggttgtagttttttcgaataaggggatggagatcggtagacgttaagtttcgtgttttaggggttcgcggttgttgagttttgagtcggtttagttggggaagattcggcggttacggtcggtttgtaggtagagggttgggtagggcggcgcgggtcgaggggcgttgggtaggtgtagcgtcgaggtgtagtttcggtttaggaagagcggtttgtagttgggaggcggttgtttttgttttttcgttgtcgcggcgatttaggaagggcgtgacgattttgcggtagaggtcgcgcgtgttcgtgagtatttcgttatagggcggcggcggttttgttattagtatcgttttttcgtaatacggtggtttggatatgttcgatttcgttgcggagtgggaggcggtcggaggaggtgaggtcgtcggtttttagttttcgtagagtttcggtagttgtcgcgcgttttagttttagttcgaattcgagttcgtcgtcgttcgtgttttttcggaggttgcggatggaagttttgagggtaagtagcgagttttttaacgttcgtttattttcggcggttcggatagttttttgggggaggtcggtatttattttggcgcgggtagttttagggtcgtggcggtatcgatacggtaaaggcggcgggtgcgggagcgtggtggtgcgggtgtgggtgcgcgtgcgtgcggttgcgcgggttcgtggtgtagtagcgggtgtacgtgtacgtcggatgcgagtgcgcgtgatcggcgtttttagcggttacggtgtggtggtggttgcggtagcgtaggttcggggggtttcggttagattgttttcgagttcgaggggttttagttttagggcgcgtaggttttgttcgcgtagtcgttttttttggcgtcgtttgaggcgcggcgtaggaagttgtagaagtatagagtaggacgatgagattttagatgagttagaagtcggcgaacgacgtgaggaacgtgtaggtgttttgggatattattatggcggcggtacgggcggcgggtttttagacgttttattggatattgggtttcgttgcgtggtttcgggttcgcgttatatttttaggtgtcgttagcgttattcggggattcgcggtcgggggttgttcgtggtaggttttaagtcgtgcgcgcgtcggcgggggatagtagcggcgttcgtttttttttatggcgtcggcggcgtcgggcgtgttttattcggggtcgcgcgggatttgtagggtagatacggggcgtagtgaaggcgcgtcgcggtttttaacgatttttcggttttcgttcgcgttttgcgagttcggggaaagtttttttcgtgggaatttcgcgtttttcgggggttcggtgacgttatcgaggagggtgacgttacgtttcgaggttttttcggtaggttttttcgatttgagtttcggtcgtcgtcgcgagttcgggcgtcgaggggagtcgaggcgggttagtagggggcgcgcgaaggacggattttagttttgagttcgaacgagagattcgttattcgtagtttcggggttaaagggttttaggagtttgtgcgtattaggtttttgaagaggcgtttcggcgtcgttgttgtgcggcggggaaagggtggtatattttttagagttttatagatagttattcgacgttttgtatagacgtttggtagtttttggt

SEQ ID NO: 37846 - DNA, 1767 bp, Artificial Sequence
  chemically treated genomic DNA (Homo sapiens) CpG-island No: 37846
accaaaaactaccaaacgtctatacaaaacgtcgaataactatctataaaactctaaaaaatataccaccctttccccgccgcacaacaacgacgccgaaacgcctcttcaaaaacctaatacgcacaaactcctaaaaccctttaaccccgaaactacgaataacgaatctctcgttcgaactcaaaactaaaatccgtccttcgcgcgccccctactaacccgcctcgactcccctcgacgcccgaactcgcgacgacgaccgaaactcaaatcgaaaaaacctaccgaaaaaacctcgaaacgtaacgtcaccctcctcgataacgtcaccgaacccccgaaaaacgcgaaattcccacgaaaaaaactttccccgaactcgcaaaacgcgaacgaaaaccgaaaaatcgttaaaaaccgcgacgcgccttcactacgccccgtatctaccctacaaatcccgcgcgaccccgaataaaacacgcccgacgccgccgacgccataaaaaaaaacgaacgccgctactatcccccgccgacgcgcgcacgacttaaaacctaccacgaacaacccccgaccgcgaatccccgaataacgctaacgacacctaaaaatataacgcgaacccgaaaccacgcaacgaaacccaatatccaataaaacgtctaaaaacccgccgcccgtaccgccgccataataatatcccaaaacacctacacgttcctcacgtcgttcgccgacttctaactcatctaaaatctcatcgtcctactctatacttctacaacttcctacgccgcgcctcaaacgacgccaaaaaaaacgactacgcgaacaaaacctacgcgccctaaaactaaaacccctcgaactcgaaaacaatctaaccgaaaccccccgaacctacgctaccgcaaccaccaccacaccgtaaccgctaaaaacgccgatcacgcgcactcgcatccgacgtacacgtacacccgctactacaccacgaacccgcgcaaccgcacgcacgcgcacccacacccgcaccaccacgctcccgcacccgccgcctttaccgtatcgataccgccacgaccctaaaactacccgcgccaaaataaataccgacctcccccaaaaaactatccgaaccgccgaaaataaacgaacgttaaaaaactcgctacttaccctcaaaacttccatccgcaacctccgaaaaaacacgaacgacgacgaactcgaattcgaactaaaactaaaacgcgcgacaactaccgaaactctacgaaaactaaaaaccgacgacctcacctcctccgaccgcctcccactccgcaacgaaatcgaacatatccaaaccaccgtattacgaaaaaacgatactaataacaaaaccgccgccgccctataacgaaatactcacgaacacgcgcgacctctaccgcaaaatcgtcacgcccttcctaaatcgccgcgacaacgaaaaaacaaaaacaaccgcctcccaactacaaaccgctcttcctaaaccgaaactacacctcgacgctacacctacccaacgcccctcgacccgcgccgccctacccaaccctctacctacaaaccgaccgtaaccgccgaatcttccccaactaaaccgactcaaaactcaacaaccgcgaacccctaaaacacgaaacttaacgtctaccgatctccatccccttattcgaaaaaactacaaccgtataaaaaaacgcgacgccccgaaccccaccgacgaactc

SEQ ID NO: 37847 - DNA, 1767 bp, Artificial Sequence
  chemically treated genomic DNA (Homo sapiens) CpG-island No: 37847
gttaggggttgttaggcgtttgtatagggcgtcgggtggttgtttgtggggttttaggagatgtattatttttttttcgtcgtatagtaacggcgtcgagacgtttttttagggatttggtgcgtataggtttttgaaattttttggtttcgggattgcggatggcgaatttttcgttcggatttagagttggagttcgtttttcgcgcgttttttgttggttcgtttcggtttttttcggcgttcgggttcgcggcggcggtcggggtttagatcggggaaatttatcggggaaatttcgaggcgtgacgttatttttttcggtgacgttatcgggttttcggggagcgcgaggtttttacggaggaggtttttttcggattcgtagggcgcgggcgggggtcgggaagtcgttgggggtcgcggcgcgtttttattgcgtttcgtgtttgttttataggtttcgcgcggtttcgggtgaggtacgttcggcgtcgtcggcgttatgggaaggagcgggcgtcgttgttgtttttcgtcggcgcgcgtacgatttgagatttgttacgggtagttttcggtcgcgggttttcgagtgacgttggcggtatttgagagtgtggcgcgggttcggggttacgtagcggagtttagtgtttagtgaagcgtttgaggattcgtcgttcgtgtcgtcgttatggtgatgttttagggtatttatacgttttttacgtcgttcgtcggtttttggtttatttggggttttatcgttttgttttgtgtttttgtagttttttgcgtcgcgttttaaacggcgttaggaggagcgattgcgcgagtagaatttgcgcgttttagagttggagtttttcgaattcgagggtagtttggtcgggatttttcgggtttgcgttgtcgtagttattattatatcgtagtcgttggaggcgtcggttacgcgtattcgtattcgacgtgtacgtgtattcgttgttgtattacgggttcgcgtagtcgtacgtacgcgtatttatattcgtattattacgttttcgtattcgtcgtttttatcgtgtcggtgtcgttacggttttggagttattcgcgttaaggtgagtatcgattttttttagggggttattcgggtcgtcggaagtgggcgggcgttggagggttcgttgtttatttttagggtttttattcgtagttttcgggagaatacgggcggcggcgggttcgggttcgggttagggttggggcgcgcggtagttgtcggggttttgcgagggttgggaatcggcggttttatttttttcgatcgttttttatttcgtagcggaatcggatatgtttaaattatcgtgttacgaagaggcggtgttgatggtagagtcgtcgtcgttttatagcgaggtgtttacggatacgcgcggtttttatcgtaagatcgttacgttttttttgagtcgtcgcgatagcggagaagtaggagtagtcgttttttagttataagtcgttttttttggatcggggttatatttcggcgttgtatttgtttagcgtttttcggttcgcgtcgttttgtttagttttttgtttgtaggtcgatcgtggtcgtcgggttttttttagttggatcgatttagagtttagtagtcgcgagtttttggagtacggagtttggcgtttgtcggtttttatttttttgttcgggaggattatagtcgtatagaggggcgcggcgtttcgggttttatcggcggattt

SEQ ID NO: 37848 - DNA, 1767 bp, Artificial Sequence
  chemically treated genomic DNA (Homo sapiens) CpG-island No: 37848
aaatccgccgataaaacccgaaacgccgcgcccctctatacgactataatcctcccgaacaaaaaaataaaaaccgacaaacgccaaactccgtactccaaaaactcgcgactactaaactctaaatcgatccaactaaaaaaaacccgacgaccacgatcgacctacaaacaaaaaactaaacaaaacgacgcgaaccgaaaaacgctaaacaaatacaacgccgaaatataaccccgatccaaaaaaaacgacttataactaaaaaacgactactcctacttctccgctatcgcgacgactcaaaaaaaacgtaacgatcttacgataaaaaccgcgcgtatccgtaaacacctcgctataaaacgacgacgactctaccatcaacaccgcctcttcgtaacacgataatttaaacatatccgattccgctacgaaataaaaaacgatcgaaaaaaataaaaccgccgattcccaaccctcgcaaaaccccgacaactaccgcgcgccccaaccctaacccgaacccgaacccgccgccgcccgtattctcccgaaaactacgaataaaaaccctaaaaataaacaacgaaccctccaacgcccgcccacttccgacgacccgaataaccccctaaaaaaaatcgatactcaccttaacgcgaataactccaaaaccgtaacgacaccgacacgataaaaacgacgaatacgaaaacgtaataatacgaatataaatacgcgtacgtacgactacgcgaacccgtaatacaacaacgaatacacgtacacgtcgaatacgaatacgcgtaaccgacgcctccaacgactacgatataataataactacgacaacgcaaacccgaaaaatcccgaccaaactaccctcgaattcgaaaaactccaactctaaaacgcgcaaattctactcgcgcaatcgctcctcctaacgccgtttaaaacgcgacgcaaaaaactacaaaaacacaaaacaaaacgataaaaccccaaataaaccaaaaaccgacgaacgacgtaaaaaacgtataaataccctaaaacatcaccataacgacgacacgaacgacgaatcctcaaacgcttcactaaacactaaactccgctacgtaaccccgaacccgcgccacactctcaaataccgccaacgtcactcgaaaacccgcgaccgaaaactacccgtaacaaatctcaaatcgtacgcgcgccgacgaaaaacaacaacgacgcccgctccttcccataacgccgacgacgccgaacgtacctcacccgaaaccgcgcgaaacctataaaacaaacacgaaacgcaataaaaacgcgccgcgacccccaacgacttcccgacccccgcccgcgccctacgaatccgaaaaaaacctcctccgtaaaaacctcgcgctccccgaaaacccgataacgtcaccgaaaaaaataacgtcacgcctcgaaatttccccgataaatttccccgatctaaaccccgaccgccgccgcgaacccgaacgccgaaaaaaaccgaaacgaaccaacaaaaaacgcgcgaaaaacgaactccaactctaaatccgaacgaaaaattcgccatccgcaatcccgaaaccaaaaaatttcaaaaacctatacgcaccaaatccctaaaaaaacgtctcgacgccgttactatacgacgaaaaaaaaataatacatctcctaaaaccccacaaacaaccacccgacgccctatacaaacgcctaacaacccctaac

SEQ ID NO: 37849 - DNA, 687 bp, Artificial Sequence
  chemically treated genomic DNA (Homo sapiens) CpG-island No: 37849
gtcgtcgttcgtagtcgtgttgtcggggagcgtaatttcgttgttgtggtaatcgtttttaagcgaattggtggcggttcgcgttcgtttcggttttttcgtttattggcgtttttttttttttcggtgtggattgggggaggggttgttcgcggttcgggcgggggatcggggcggcgattcggggttagggcgttgagcgtcgcggggaagggtttagttttgggattatttttcgttcgcgtttcgtgttcgttcggttcgtagtcgtcgcggtatttacgggtttaggtatttttttcgagttcgtttttttggttcggggcgagtagcgcgggtttagcggatagagtttcgggtttgcggggggaggcggcggcggttcgggggagtagatagtggtagcgaaagcggtttcgagcgttgggttggaggcgcggggcgcgtacgggcgcgtatacggcgggtgttgagttcggcgtgcgcgcgcgcggtagtcggtagagggtttcgtatttttagttatacgtcgcgaggaggttgttttcggagggaaggagggggaggacggttatttatttgcggcgtcgagattcggttttttagttcgtcgggtttatattcgttagggtatttttataggggaggtatacgtcggtcgattcggtttatattttaggttggagt

SEQ ID NO: 37850 - DNA, 687 bp, Artificial Sequence
  chemically treated genomic DNA (Homo sapiens) CpG-island No: 37850
actccaacctaaaatataaaccgaatcgaccgacgtatacctcccctataaaaataccctaacgaatataaacccgacgaactaaaaaaccgaatctcgacgccgcaaataaataaccgtcctccccctccttccctccgaaaacaacctcctcgcgacgtataactaaaaatacgaaaccctctaccgactaccgcgcgcgcgcacgccgaactcaacacccgccgtatacgcgcccgtacgcgccccgcgcctccaacccaacgctcgaaaccgctttcgctaccactatctactcccccgaaccgccgccgcctccccccgcaaacccgaaactctatccgctaaacccgcgctactcgccccgaaccaaaaaaacgaactcgaaaaaaatacctaaacccgtaaataccgcgacgactacgaaccgaacgaacacgaaacgcgaacgaaaaataatcccaaaactaaacccttccccgcgacgctcaacgccctaaccccgaatcgccgccccgatcccccgcccgaaccgcgaacaacccctcccccaatccacaccgaaaaaaaaaaaaacgccaataaacgaaaaaaccgaaacgaacgcgaaccgccaccaattcgcttaaaaacgattaccacaacaacgaaattacgctccccgacaacacgactacgaacgacgac

SEQ ID NO: 37851 - DNA, 687 bp, Artificial Sequence
  chemically treated genomic DNA (Homo sapiens) CpG-island No: 37851
gttttagtttggagtgtggatcgggtcggtcggcgtgtgttttttttgtgagggtgttttggcgggtgtgagttcggcgggttggagaatcgggtttcggcgtcgtaggtgggtgatcgtttttttttttttttttttcgggggtagttttttcgcggcgtgtggttgggggtgcggggttttttgtcggttgtcgcgcgcgcgtacgtcgggtttagtattcgtcgtgtacgcgttcgtgcgcgtttcgcgtttttagtttagcgttcggagtcgttttcgttgttattgtttgttttttcgggtcgtcgtcgttttttttcgtaggttcggggttttgttcgttgggttcgcgttgttcgtttcgagttaggagaacgagttcgaggaggatgtttgggttcgtgagtatcgcggcggttgcgggtcgggcgggtacggagcgcgggcggaagatggttttaggattgagttttttttcgcggcgtttagcgttttggtttcgggtcgtcgtttcggtttttcgttcgggtcgcgagtagttttttttttagtttatatcggagggagggagagcgttagtgagcgagggagtcggaacgggcgcgagtcgttattagttcgtttggaaacggttgttatagtaacggggttgcgtttttcggtaatacgattgcgggcggcgat

SEQ ID NO: 37852 - DNA, 687 bp, Artificial Sequence
  chemically treated genomic DNA (Homo sapiens) CpG-island No: 37852
atcgccgcccgcaatcgtattaccgaaaaacgcaaccccgttactataacaaccgtttccaaacgaactaataacgactcgcgcccgttccgactccctcgctcactaacgctctccctccctccgatataaactaaaaaaaaaactactcgcgacccgaacgaaaaaccgaaacgacgacccgaaaccaaaacgctaaacgccgcgaaaaaaaactcaatcctaaaaccatcttccgcccgcgctccgtacccgcccgacccgcaaccgccgcgatactcacgaacccaaacatcctcctcgaactcgttctcctaactcgaaacgaacaacgcgaacccaacgaacaaaaccccgaacctacgaaaaaaaacgacgacgacccgaaaaaacaaacaataacaacgaaaacgactccgaacgctaaactaaaaacgcgaaacgcgcacgaacgcgtacacgacgaatactaaacccgacgtacgcgcgcgcgacaaccgacaaaaaaccccgcacccccaaccacacgccgcgaaaaaactacccccgaaaaaaaaaaaaaaaaaaacgatcacccacctacgacgccgaaacccgattctccaacccgccgaactcacacccgccaaaacaccctcacaaaaaaaacacacgccgaccgacccgatccacactccaaactaaaac

SEQ ID NO: 37853 - DNA, 580 bp, Artificial Sequence
  chemically treated genomic DNA (Homo sapiens) CpG-island No: 37853
attgtcgcgtaattatttatgaaagcgtttatgtttcgtcgtgcgatagtattttcggaataaatttgtttttttgcgcgattcggaatttcgaggtcgtttttacgcgtcgtcgttcgtttttttatatcggattggattttacgtaaggatgaggcggggtttcgtcgtggcgcgtatgcgtgtagtaaagaatggaggagtcggaattcgaacggaaggtaggagagaggcgagatttcgcgcgtgtgggagcgggcgtgaagaggggagtaggtcgtgtttgattggcgtgtgtttgtagcgggttcgtatcgacgaggtgttgtcggaggaagtcgtttcgaggcggaagatgaggacgacgaggattacgtgttttatgtgtcgttacgtagcgtcggtagttattggtgaggggtacgcgttcggggagggatggggtcgtgatcgcggggtcgtagggggcgggcgtggtttcggttttcgtggggaggagggtagtttgaggagtgagttttagtatattagggcgcggtttttagataaacgagggatcgacggtttgatttgaggggta

SEQ ID NO: 37854 - DNA, 580 bp, Artificial Sequence
  chemically treated genomic DNA (Homo sapiens) CpG-island No: 37854
tacccctcaaatcaaaccgtcgatccctcgtttatctaaaaaccgcgccctaatatactaaaactcactcctcaaactaccctcctccccacgaaaaccgaaaccacgcccgccccctacgaccccgcgatcacgaccccatccctccccgaacgcgtacccctcaccaataactaccgacgctacgtaacgacacataaaacacgtaatcctcgtcgtcctcatcttccgcctcgaaacgacttcctccgacaacacctcgtcgatacgaacccgctacaaacacacgccaatcaaacacgacctactcccctcttcacgcccgctcccacacgcgcgaaatctcgcctctctcctaccttccgttcgaattccgactcctccattctttactacacgcatacgcgccacgacgaaaccccgcctcatccttacgtaaaatccaatccgatataaaaaaacgaacgacgacgcgtaaaaacgacctcgaaattccgaatcgcgcaaaaaaacaaatttattccgaaaatactatcgcacgacgaaacataaacgctttcataaataattacgcgacaat

SEQ ID NO: 37855 - DNA, 580 bp, Artificial Sequence
  chemically treated genomic DNA (Homo sapiens) CpG-island No: 37855
tattttttagattaagtcgtcggtttttcgtttgtttgggggtcgcgttttggtgtattgaagtttattttttagattgtttttttttttacggaggtcgaggttacgttcgttttttgcgatttcgcggttacggttttattttttttcggacgcgtgttttttattagtagttgtcggcgttgcgtaacggtatatagggtacgtagttttcgtcgtttttatttttcgtttcggagcggtttttttcggtagtatttcgtcggtgcgagttcgttgtaagtatacgttagttaggtacggtttgtttttttttttacgttcgtttttatacgcgcggggtttcgttttttttttatttttcgttcgggtttcgatttttttattttttgttgtacgtatgcgcgttacggcgaaatttcgttttatttttgcgtgagatttaattcgatgtgaagaggcgaacgacggcgcgtaggaacgatttcggagtttcggatcgcgtagagggataaatttgtttcggagatattatcgtacggcgaggtatggacgtttttatgggtggttacgcgatagt

SEQ ID NO: 37856 - DNA, 580 bp, Artificial Sequence
  chemically treated genomic DNA (Homo sapiens) CpG-island No: 37856
actatcgcgtaaccacccataaaaacgtccatacctcgccgtacgataatatctccgaaacaaatttatccctctacgcgatccgaaactccgaaatcgttcctacgcgccgtcgttcgcctcttcacatcgaattaaatctcacgcaaaaataaaacgaaatttcgccgtaacgcgcatacgtacaacaaaaaataaaaaaatcgaaacccgaacgaaaaataaaaaaaaaacgaaaccccgcgcgtataaaaacgaacgtaaaaaaaaaaacaaaccgtacctaactaacgtatacttacaacgaactcgcaccgacgaaatactaccgaaaaaaaccgctccgaaacgaaaaataaaaacgacgaaaactacgtaccctatataccgttacgcaacgccgacaactactaataaaaaacacgcgtccgaaaaaaaataaaaccgtaaccgcgaaatcgcaaaaaacgaacgtaacctcgacctccgtaaaaaaaaaaacaatctaaaaaataaacttcaatacaccaaaacgcgacccccaaacaaacgaaaaaccgacgacttaatctaaaaaata

SEQ ID NO: 37857 - DNA, 665 bp, Artificial Sequence
  chemically treated genomic DNA (Homo sapiens) CpG-island No: 37857
ttaatttcgttttattttcgttttcgttcggggaaggtgaaagcgttcgagtcgtcgaagttttttcgttcgtttttatttgcgggtcgggtattaggttgggttcgttattttttttggggtcgtcgtggtcgggtttcgtcggcgttttcggagggtttgtattcgttttcgtttttaggtttggcggcggcgggggttcgggcgtttggggtttttgcggtttcgcggttcgagttcgttcgcgtttgttcgtatcgtcgttcggtttgtttcgttttcgcgttatgtcgtcgttcgcgtcgttttttcgttttatacgtcgcgtcgtcgtcgtcgttatcgtcgtcgtcgtcgtcgtcgttatcgttttttttataggataatagttaatatggcggcgttcggtttttttttttcgtttgttgttaataggttagagggtacgcgtagttcgcgtcgtcgtattagttttcgaggtcgtttgcgttattttgaataaggttattattcggagttcgttgggagaaaaatttggtggggagacgtttttttttttttacgcgggacgggaaggatgtaatttgttggaggaacgcgtgtaatgcggtggtaatcgcgttgtattattttagtatttaataattgtttgttaaatggatgag

SEQ ID NO: 37858 - DNA, 665 bp, Artificial Sequence
  chemically treated genomic DNA (Homo sapiens) CpG-island No: 37858
ctcatccatttaacaaacaattattaaatactaaaataatacaacgcgattaccaccgcattacacgcgttcctccaacaaattacatccttcccgtcccgcgtaaaaaaaaaaaaacgtctccccaccaaatttttctcccaacgaactccgaataataaccttattcaaaataacgcaaacgacctcgaaaactaatacgacgacgcgaactacgcgtaccctctaacctattaacaacaaacgaaaaaaaaaaaccgaacgccgccatattaactattatcctataaaaaaaacgataacgacgacgacgacgacgacgataacgacgacgacgacgcgacgtataaaacgaaaaaacgacgcgaacgacgacataacgcgaaaacgaaacaaaccgaacgacgatacgaacaaacgcgaacgaactcgaaccgcgaaaccgcaaaaaccccaaacgcccgaacccccgccgccgccaaacctaaaaacgaaaacgaatacaaaccctccgaaaacgccgacgaaacccgaccacgacgaccccaaaaaaaataacgaacccaacctaatacccgacccgcaaataaaaacgaacgaaaaaacttcgacgactcgaacgctttcaccttccccgaacgaaaacgaaaataaaacgaaattaa

SEQ ID NO: 37859 - DNA, 665 bp, Artificial Sequence
  chemically treated genomic DNA (Homo sapiens) CpG-island No: 37859
tttatttatttaataggtaattattaagtgttagggtggtgtagcgcgattattatcgtattatacgcgtttttttagtaggttgtatttttttcgtttcgcgtagggggggaagggcgtttttttattaagttttttttttagcgaatttcgggtggtgattttatttaaaatggcgtaggcggtttcgggggttagtgcggcggcgcggattgcgcgtgttttttgatttgttggtagtaggcggagggggggaatcgggcgtcgttatattggttgttgttttgtgaggggagcggtagcggcggcggcggcggcggcggtggcggcggcggcggcgcggcgtgtggagcgagggagcggcgcgagcggcggtatgacgcggaggcggagtaggtcgagcggcggtgcgggtaggcgcgagcgggttcgggtcgcggggtcgtagaagttttaggcgttcgagttttcgtcgtcgttaagtttggaggcgggagcgggtgtaggtttttcggaggcgtcggcggagttcgattacgacggttttagggaggatgacgaatttaatttggtgttcggttcgtaggtaggagcgagcggggagatttcggcggttcgggcgtttttatttttttcgagcgggagcgggagtggggcggggttgg

SEQ ID NO: 37860 - DNA, 665 bp, Artificial Sequence
  chemically treated genomic DNA (Homo sapiens) CpG-island No: 37860
ccaaccccgccccactcccgctcccgctcgaaaaaaataaaaacgcccgaaccgccgaaatctccccgctcgctcctacctacgaaccgaacaccaaattaaattcgtcatcctccctaaaaccgtcgtaatcgaactccgccgacgcctccgaaaaacctacacccgctcccgcctccaaacttaacgacgacgaaaactcgaacgcctaaaacttctacgaccccgcgacccgaacccgctcgcgcctacccgcaccgccgctcgacctactccgcctccgcgtcataccgccgctcgcgccgctccctcgctccacacgccgcgccgccgccgccgccaccgccgccgccgccgccgccgctaccgctcccctcacaaaacaacaaccaatataacgacgcccgattccccccctccgcctactaccaacaaatcaaaaaacacgcgcaatccgcgccgccgcactaacccccgaaaccgcctacgccattttaaataaaatcaccacccgaaattcgctaaaaaaaaaacttaataaaaaaacgcccttccccccctacgcgaaacgaaaaaaatacaacctactaaaaaaacgcgtataatacgataataatcgcgctacaccaccctaacacttaataattacctattaaataaataaa

SEQ ID NO: 37861 - DNA, 795 bp, Artificial Sequence
  chemically treated genomic DNA (Homo sapiens) CpG-island No: 37861
  misc_feature (17)..(17): n is either a, c, g or t
  misc_feature (19)..(19): n is either a, c, g or t
tgggtagttagggcggngncgtttgtatagggcgtcgggtggttgtttgtggggttttaggagatgtattatttttttttcgtcgtatagtaacggcgtcgagacgtttttttagggatttggtgcgtataggtttttgaaattttttggtttcgggattgcggatggcgaatttttcgttcggatttagagttggagttcgtttttcgcgcgttttttgttggttcgtttcggtttttttcggcgttcgggtttcgcggcgggtcggggtttagatcggggaaattttatcggggaaatttcgaggcgtgacgttatttttttcggtgacgttatcgggttttcggggagcgcgaggtttttacggaggaggtttttttcggattgcgtagggcgggcgggggtcgggaagtcgttgggggtcgcggcgttattttattgcgtttcgtgtttgttttataggtttcgcgcggtttcgggtgaggtacgttcgcgcgttcgtcggcgttatgggaaggagcgggcgtcgttgttgtttttcgtcggcgcgcgtacgatttgagatttgttacgggtagttttcggtcgcgggttttcgagtgacgttggcggtatttgagagtgtggcgcgggttcggggttacgtagcggagtttagtgtttagtgaagcgtttgaggattcgtcgttcgtgtcgtcgttatggtgatgttttagggtatttatacgttttttacgtgtttcgtcggtttttggtttatttggggttttatcgttttgttttgttgtttttgta

SEQ ID NO: 37862 - DNA, 795 bp, Artificial Sequence
  chemically treated genomic DNA (Homo sapiens) CpG-island No: 37862
  misc_feature (777)..(777): n is either a, c, g or t
  misc_feature (779)..(779): n is either a, c, g or t
tacaaaaacaacaaaacaaaacgataaaaccccaaataaaccaaaaaccgacgaaacacgtaaaaaacgtataaataccctaaaacatcaccataacgacgacacgaacgacgaatcctcaaacgcttcactaaacactaaactccgctacgtaaccccgaacccgcgccacactctcaaataccgccaacgtcactcgaaaacccgcgaccgaaaactacccgtaacaaatctcaaatcgtacgcgcgccgacgaaaaacaacaacgacgcccgctccttcccataacgccgacgaacgcgcgaacgtacctcacccgaaaccgcgcgaaacctataaaacaaacacgaaacgcaataaaataacgccgcgacccccaacgacttcccgacccccgcccgccctacgcaatccgaaaaaaacctcctccgtaaaaacctcgcgctccccgaaaacccgataacgtcaccgaaaaaaataacgtcacgcctcgaaatttccccgataaaatttccccgatctaaaccccgacccgccgcgaaacccgaacgccgaaaaaaaccgaaacgaaccaacaaaaaacgcgcgaaaaacgaactccaactctaaatccgaacgaaaaattcgccatccgcaatcccgaaaccaaaaaatttcaaaaacctatacgcaccaaatccctaaaaaaacgtctcgacgccgttactatacgacgaaaaaaaaataatacatctcctaaaaccccacaaacaaccacccgacgccctatacaaacgncnccgccctaactaccca

SEQ ID NO: 37863 - DNA, 795 bp, Artificial Sequence
  chemically treated genomic DNA (Homo sapiens) CpG-island No: 37863
  misc_feature (777)..(777): n is either a, c, g or t
  misc_feature (779)..(779): n is either a, c, g or t
tgtagaagtagtagagtaggacgatgagattttagatgagttagaagtcggcgaagtacgtgaggaacgtgtaggtgttttgggatattattatggcggcggtacgggcggcgggtttttagacgttttattggatattgggtttcgttgcgtggtttcgggttcgcgttatatttttaggtgtcgttagcgttattcggggattcgcggtcgggggttgttcgtggtaggttttaagtcgtgcgcgcgtcggcgggggatagtagcggcgttcgtttttttttatggcgtcggcgggcgcgcgggcgtgttttattcggggtcgcgcgggatttgtagggtagatacggggcgtagtgaagtggcgtcgcggtttttaacgatttttcggttttcgttcgttttgcgtagttcggggaaagtttttttcgtgggaatttcgcgtttttcgggggttcggtgacgttatcgaggagggtgacgttacgtttcgaggttttttcggtagggttttttcgatttgagtttcggttcgtcgcggagttcgggcgtcgaggggagtcgaggcgggttagtagggggcgcgcgaaggacggattttagttttgagttcgaacgagagattcgttattcgtagtttcggggttaaagggttttaggagtttgtgcgtattaggtttttgaagaggcgtttcggcgtcgttgttgtgcggcggggaaagggtggtatattttttagagttttatagatagttattcgacgttttgtatagacgntntcgttttggttgttta

SEQ ID NO: 37864 - DNA, 795 bp, Artificial Sequence
  chemically treated genomic DNA (Homo sapiens) CpG-island No: 37864
  misc_feature (17)..(17): n is either a, c, g or t
  misc_feature (19)..(19): n is either a, c, g or t
taaacaaccaaaacganancgtctatacaaaacgtcgaataactatctataaaactctaaaaaatataccaccctttccccgccgcacaacaacgacgccgaaacgcctcttcaaaaacctaatacgcacaaactcctaaaaccctttaaccccgaaactacgaataacgaatctctcgttcgaactcaaaactaaaatccgtccttcgcgcgccccctactaacccgcctcgactcccctcgacgcccgaactccgcgacgaaccgaaactcaaatcgaaaaaaccctaccgaaaaaacctcgaaacgtaacgtcaccctcctcgataacgtcaccgaacccccgaaaaacgcgaaattcccacgaaaaaaactttccccgaactacgcaaaacgaacgaaaaccgaaaaatcgttaaaaaccgcgacgccacttcactacgccccgtatctaccctacaaatcccgcgcgaccccgaataaaacacgcccgcgcgcccgccgacgccataaaaaaaaacgaacgccgctactatcccccgccgacgcgcgcacgacttaaaacctaccacgaacaacccccgaccgcgaatccccgaataacgctaacgacacctaaaaatataacgcgaacccgaaaccacgcaacgaaacccaatatccaataaaacgtctaaaaacccgccgcccgtaccgccgccataataatatcccaaaacacctacacgttcctcacgtacttcgccgacttctaactcatctaaaatctcatcgtcctactctactacttctaca

SEQ ID NO: 37865 - DNA, 1057 bp, Artificial Sequence
  chemically treated genomic DNA (Homo sapiens) CpG-island No: 37865
tttttgcgtcgtcgttttaaacggcgttaggaggagcgattgcgcgacgaaatttgcgcgttttagagttggagtttttcgaattcgagggtagtttggtcgggagtttttcggcgttggcgtcgtcgtagttattattatatcgtagtcgtttggaggttcggtttacgcgtattcgtattcgtacgtgtacgttattcgttgttgtattacgggttcgcgtatcgtacgcgtacggtatttatattcgtattattacgcgttttcgtattcgtcgtttacgtatttgtcggtgtcgttacggttttggagttattcgcgttaaggtgagtatcgattttcgttagggggcgattcgggtcgtcggaagtgggcggcgttggagggttcgttgtttatttttagggtttttattcgtagttttcgggagaatacgggcggcggcgggttcgggttcgggttagggttggggcgcgggaggtttttgtcggggtttttgcgagaggttgggaatcggcggttttatttttttcgatcgttttttatttcgtagcggaatcggatatgtttaaattatcgtgttacgaagaggcggtgttgatggtagagtcgtcgtcgttttatagcgaggtgtttacggatacgcgcggtttttatcgtaagatcgttacgttttttttgagtcgtcgcgatagcgcggagaagtaggagtagtcgttttttagttataagtcgttttttttggatcggggttatatttcggcgttgtatttgtttagcgtttttcggttcgcgtcgttttgtttagttttttgtttgtaggtcgatcgtggtcgtcgggttttttttagttggatcgatttagagtttagtagtcgcgagtttttggagtacggagtttggcgtttgtcggtttttatttttttgttcgggaggattatagtcgtatagaggttcggcgtttcgggttttatcggcggatttttggtttgattgcggggttttttaaatgtttttttggattgcggggaggggcggggggagggagggatttttt

SEQ ID NO: 37866 - DNA, 1057 bp, Artificial Sequence
  chemically treated genomic DNA (Homo sapiens) CpG-island No: 37866
aaaaaatccctccctccccccgcccctccccgcaatccaaaaaaacatttaaaaaaccccgcaatcaaaccaaaaatccgccgataaaacccgaaacgccgaacctctatacgactataatcctcccgaacaaaaaaataaaaaccgacaaacgccaaactccgtactccaaaaactcgcgactactaaactctaaatcgatccaactaaaaaaaacccgacgaccacgatcgacctacaaacaaaaaactaaacaaaacgacgcgaaccgaaaaacgctaaacaaatacaacgccgaaatataaccccgatccaaaaaaaacgacttataactaaaaaacgactactcctacttctccgcgctatcgcgacgactcaaaaaaaacgtaacgatcttacgataaaaaccgcgcgtatccgtaaacacctcgctataaaacgacgacgactctaccatcaacaccgcctcttcgtaacacgataatttaaacatatccgattccgctacgaaataaaaaacgatcgaaaaaaataaaaccgccgattcccaacctctcgcaaaaaccccgacaaaaacctcccgcgccccaaccctaacccgaacccgaacccgccgccgcccgtattctcccgaaaactacgaataaaaaccctaaaaataaacaacgaaccctccaacgccgcccacttccgacgacccgaatcgccccctaacgaaaatcgatactcaccttaacgcgaataactccaaaaccgtaacgacaccgacaaatacgtaaacgacgaatacgaaaacgcgtaataatacgaatataaataccgtacgcgtacgatacgcgaacccgtaatacaacaacgaataacgtacacgtacgaatacgaatacgcgtaaaccgaacctccaaacgactacgatataataataactacgacgacgccaacgccgaaaaactcccgaccaaactaccctcgaattcgaaaaactccaactctaaaacgcgcaaatttcgtcgcgcaatcgctcctcctaacgccgtttaaaacgacgacgcaaaaa

SEQ ID NO: 37867 - DNA, 1057 bp, Artificial Sequence
  chemically treated genomic DNA (Homo sapiens) CpG-island No: 37867
aagaaattttttttttttttcgttttttttcgtagtttagggaagtatttaaaaagtttcgtagttaggttaggagttcgtcggtggggttcggggcgtcgggtttttatacggttgtagttttttcgaataaggggatggagatcggtagacgttaagtttcgtgttttaggggttcgcggttgttgagttttgagtcggtttagttggggaagattcggcggttacggtcggtttgtaggtagagggttgggtagggcggcgcgggtcgaggggcgttgggtaggtgtagcgtcgaggtgtagtttcggtttaggaagagcggtttgtagttgggaggcggttgtttttgttttttcgcgttgtcgcggcgatttaggaagggcgtgacgattttgcggtagaggtcgcgcgtgttcgtgagtatttcgttatagggcggcggcggttttgttattagtatcgttttttcgtaatacggtggtttggatatgttcgatttcgttgcggagtgggaggcggtcggaggaggtgaggtcgtcggtttttagtttttcgtagaggtttcggtaggggtttttcgcgttttagttttagttcgaattcgagttcgtcgtcgttcgtgttttttcggaggttgcggatggaagttttgagggtaagtagcgagttttttaacgtcgtttattttcggcggttcggatcgttttttggcggaggtcggtatttattttggcgcgggtagttttagggtcgtggcggtatcgataggtgcgtaggcggcgggtgcgggagcgcgtggtggtgcgggtgtgggtgtcgtgcgcgtgcggtgcgcgggttcgtggtgtagtagcgggtgacgtgtacgtgcggatgcgagtgcgcgtgagtcgggtttttaggcggttacggtgtggtggtggttgcggcggcgttagcgtcggggggttttcggttagattgttttcgagttcgaggggttttagttttagggcgcgtaggtttcgtcgcgtagtcgttttttttggcgtcgtttgaggcggcggcgtaggaa

SEQ ID NO: 37868 - DNA, 1057 bp, Artificial Sequence
  chemically treated genomic DNA (Homo sapiens) CpG-island No: 37868
ttcctacgccgccgcctcaaacgacgccaaaaaaaacgactacgcgacgaaacctacgcgccctaaaactaaaacccctcgaactcgaaaacaatctaaccgaaaaccccccgacgctaacgccgccgcaaccaccaccacaccgtaaccgcctaaaaacccgactcacgcgcactcgcatccgcacgtacacgtcacccgctactacaccacgaacccgcgcaccgcacgcgcacgacacccacacccgcaccaccacgcgctcccgcacccgccgcctacgcacctatcgataccgccacgaccctaaaactacccgcgccaaaataaataccgacctccgccaaaaaacgatccgaaccgccgaaaataaacgacgttaaaaaactcgctacttaccctcaaaacttccatccgcaacctccgaaaaaacacgaacgacgacgaactcgaattcgaactaaaactaaaacgcgaaaaacccctaccgaaacctctacgaaaaactaaaaaccgacgacctcacctcctccgaccgcctcccactccgcaacgaaatcgaacatatccaaaccaccgtattacgaaaaaacgatactaataacaaaaccgccgccgccctataacgaaatactcacgaacacgcgcgacctctaccgcaaaatcgtcacgcccttcctaaatcgccgcgacaacgcgaaaaaacaaaaacaaccgcctcccaactacaaaccgctcttcctaaaccgaaactacacctcgacgctacacctacccaacgcccctcgacccgcgccgccctacccaaccctctacctacaaaccgaccgtaaccgccgaatcttccccaactaaaccgactcaaaactcaacaaccgcgaacccctaaaacacgaaacttaacgtctaccgatctccatccccttattcgaaaaaactacaaccgtataaaaacccgacgccccgaaccccaccgacgaactcctaacctaactacgaaactttttaaatacttccctaaactacgaaaaaaaacgaaaaaaaaaaaaaatttctt

SEQ ID NO: 37869 - DNA, 523 bp, Artificial Sequence
  chemically treated genomic DNA (Homo sapiens) CpG-island No: 37869
gattttgtcgtagaatagagcgatggtgaagtgttgattattagtcgtatagttattgtttcgtcggtgtttgatttcgggatgcgttgtatttatatttggcgtatcgttgtcgatggttaggttaacgtggcgtttttcggcgagcgttacggcgattattcgtatattatttcgtgtatcggttttattatgggaattaacggcgaatacgattaggtggcgtattacggtcgtggatcgggcgaaaattacgtcgatagttagtagttaatattatcgatatttggcgttatcgtcgatgttatgttcgagaattattttttttcgtagaataacggtaatcgttagtatgttcgttggacggtattgattaatcgttacggtaacggtttgttggtggtttcgtagcgtttaattaattttagcgtttggtattatatttaggaaaatatttacgttgtttagtattgtaacgagttgtagcgtagtgatgatattattttgaatttcgattattagt

SEQ ID NO: 37870 - DNA, 523 bp, Artificial Sequence
  chemically treated genomic DNA (Homo sapiens) CpG-island No: 37870
actaataatcgaaattcaaaataatatcatcactacgctacaactcgttacaatactaaacaacgtaaatattttcctaaatataataccaaacgctaaaattaattaaacgctacgaaaccaccaacaaaccgttaccgtaacgattaatcaataccgtccaacgaacatactaacgattaccgttattctacgaaaaaaaataattctcgaacataacatcgacgataacgccaaatatcgataatattaactactaactatcgacgtaattttcgcccgatccacgaccgtaatacgccacctaatcgtattcgccgttaattcccataataaaaccgatacacgaaataatatacgaataatcgccgtaacgctcgccgaaaaacgccacgttaacctaaccatcgacaacgatacgccaaatataaatacaacgcatcccgaaatcaaacaccgacgaaacaataactatacgactaataatcaacacttcaccatcgctctattctacgacaaaatc

SEQ ID NO: 37871 - DNA, 523 bp, Artificial Sequence
  chemically treated genomic DNA (Homo sapiens) CpG-island No: 37871
gttggtgatcgaggtttagggtgatgttattattgcgttgtagttcgttatagtgttgggtagcgtggatgtttttttgggtatagtgttaggcgttgaagttaattgggcgttgcggaattattagtagatcgttatcgtggcggttagttagtgtcgtttagcggatatgttgacggttatcgttgttttgcgggaagggatagttttcgaatatggtatcgacggtggcgttagatatcgatgatgttagttgttggttgtcggcgtagttttcgttcggtttacgatcgtaatacgttatttgatcgtattcgtcgttaatttttatggtgaaatcgatgtacggaatgatgtgcggatagtcgtcgtaacgttcgtcggaaagcgttacgttaatttggttatcggtagcgatgcgttagatgtaggtgtagcgtatttcgaagttaaatatcggcggggtaataattgtgcggttgatgattagtattttattatcgttttgttttacggtaaagtt

SEQ ID NO: 37872 - DNA, 523 bp, Artificial Sequence
  chemically treated genomic DNA (Homo sapiens) CpG-island No: 37872
aactttaccgtaaaacaaaacgataataaaatactaatcatcaaccgcacaattattaccccgccgatatttaacttcgaaatacgctacacctacatctaacgcatcgctaccgataaccaaattaacgtaacgctttccgacgaacgttacgacgactatccgcacatcattccgtacatcgatttcaccataaaaattaacgacgaatacgatcaaataacgtattacgatcgtaaaccgaacgaaaactacgccgacaaccaacaactaacatcatcgatatctaacgccaccgtcgataccatattcgaaaactatcccttcccgcaaaacaacgataaccgtcaacatatccgctaaacgacactaactaaccgccacgataacgatctactaataattccgcaacgcccaattaacttcaacgcctaacactatacccaaaaaaacatccacgctacccaacactataacgaactacaacgcaataataacatcaccctaaacctcgatcaccaac

SEQ ID NO: 37873 - DNA, 809 bp, Artificial Sequence
  chemically treated genomic DNA (Homo sapiens) CpG-island No: 37873
gtgtgtgcgagtgtgtttgcgtgtttgcgtttgggcggatagttcggagcggtagtgcgattcgtcgggagaggcgttttcgtagaggcgtttcgttcgttgtcgttgcgttgcgggggtcgttttgtaaatttgcggcgagcgtcgttagttttcgcggttttatagtttcgcgatttgtcggtaaaggcgtcgggcgcgcgtgtcgggcgcggtgttcgcggtcggtcggggcggcgggagcgggtcgcgttttcgtttttggtcggcgttttggcgagttttatgtagtttcggcgttcgcggtcgtagttattcggttgttcggttgcgcgcggtaggtttaggattcgaatttcgttttttagcgtttgagcgtttgtaagtcgtcggcgggatgtcgcgcgtcgtttgagagagtcgcgtcggggcgggagtagggagcgggtcggttcgggcgtattcgggagcgtagggcgttttacgtcgtagtcgtagtcgagcgcgtcggcgttcgtttttttcgttcggttcgtaggtttcggttttttaagtttcgagggtcgcggggtcgttagttagttatacgtttcggcgttaggggtatggaggaacggcgggtttcgagtcgcgtttcggagttcgcgaaattttcgagcgggcgttcgttcgttttgtcgtcgtcgtcgtcgtcgtttcgtttgtcggtttgagagcgggattatggatgaaaggtttaataagtggttgttgacgtcggtgtttattttttttttcgtggttattatgtattagtacgtgtttttttt

SEQ ID NO: 37874 - DNA, 809 bp, Artificial Sequence
  chemically treated genomic DNA (Homo sapiens) CpG-island No: 37874
aaaaaaaacacgtactaatacataataaccacgaaaaaaaaaataaacaccgacgtcaacaaccacttattaaacctttcatccataatcccgctctcaaaccgacaaacgaaacgacgacgacgacgacgacaaaacgaacgaacgcccgctcgaaaatttcgcgaactccgaaacgcgactcgaaacccgccgttcctccatacccctaacgccgaaacgtataactaactaacgaccccgcgaccctcgaaacttaaaaaaccgaaacctacgaaccgaacgaaaaaaacgaacgccgacgcgctcgactacgactacgacgtaaaacgccctacgctcccgaatacgcccgaaccgacccgctccctactcccgccccgacgcgactctctcaaacgacgcgcgacatcccgccgacgacttacaaacgctcaaacgctaaaaaacgaaattcgaatcctaaacctaccgcgcgcaaccgaacaaccgaataactacgaccgcgaacgccgaaactacataaaactcgccaaaacgccgaccaaaaacgaaaacgcgacccgctcccgccgccccgaccgaccgcgaacaccgcgcccgacacgcgcgcccgacgcctttaccgacaaatcgcgaaactataaaaccgcgaaaactaacgacgctcgccgcaaatttacaaaacgacccccgcaacgcaacgacaacgaacgaaacgcctctacgaaaacgcctctcccgacgaatcgcactaccgctccgaactatccgcccaaacgcaaacacgcaaacacactcgcacacac

SEQ ID NO: 37875 - DNA, 809 bp, Artificial Sequence
  chemically treated genomic DNA (Homo sapiens) CpG-island No: 37875
gagggggatacgtattggtatatgatgattacgaagaggagagtgagtatcggcgttagtagttatttgttgaattttttatttatggtttcgtttttaggtcggtaggcgaagcggcggcggcggcggcggtagggcggacgggcgttcgttcggaagtttcgcggatttcggggcgcggttcggagttcgtcgtttttttatgtttttgacgtcgaggcgtgtggttggttggcggtttcgcggttttcggggtttgaggagtcggggtttgcgagtcgggcgggggaggcgggcgtcggcgcgttcggttgcggttgcggcgtggggcgttttgcgttttcgggtgcgttcgggtcggttcgttttttgttttcgtttcggcgcggtttttttaggcgacgcgcggtatttcgtcggcggtttgtaggcgtttaggcgttggggagcggggttcgggttttggatttgtcgcgcgtagtcgggtagtcgggtagttgcggtcgcgagcgtcggggttgtatgaggttcgttagggcgtcggttaagggcgaaggcgcggttcgttttcgtcgtttcggtcggtcgcgggtatcgcgttcggtacgcgcgttcggcgtttttgtcggtaggtcgcggggttgtggagtcgcgagggttgacggcgttcgtcgtaagtttgtagagcggttttcgtagcgtagcggtagcgggcgaggcgtttttgcggagacgtttttttcggcgagtcgtattgtcgtttcgggttgttcgtttaggcgtaggtacgtagatatattcgtatatat

SEQ ID NO: 37876 - DNA, 809 bp, Artificial Sequence
  chemically treated genomic DNA (Homo sapiens) CpG-island No: 37876
atatatacgaatatatctacgtacctacgcctaaacgaacaacccgaaacgacaatacgactcgccgaaaaaaacgtctccgcaaaaacgcctcgcccgctaccgctacgctacgaaaaccgctctacaaacttacgacgaacgccgtcaaccctcgcgactccacaaccccgcgacctaccgacaaaaacgccgaacgcgcgtaccgaacgcgatacccgcgaccgaccgaaacgacgaaaacgaaccgcgccttcgcccttaaccgacgccctaacgaacctcatacaaccccgacgctcgcgaccgcaactacccgactacccgactacgcgcgacaaatccaaaacccgaaccccgctccccaacgcctaaacgcctacaaaccgccgacgaaataccgcgcgtcgcctaaaaaaaccgcgccgaaacgaaaacaaaaaacgaaccgacccgaacgcacccgaaaacgcaaaacgccccacgccgcaaccgcaaccgaacgcgccgacgcccgcctcccccgcccgactcgcaaaccccgactcctcaaaccccgaaaaccgcgaaaccgccaaccaaccacacgcctcgacgtcaaaaacataaaaaaacgacgaactccgaaccgcgccccgaaatccgcgaaacttccgaacgaacgcccgtccgccctaccgccgccgccgccgccgcttcgcctaccgacctaaaaacgaaaccataaataaaaaattcaacaaataactactaacgccgatactcactctcctcttcgtaatcatcatataccaatacgtatccccctc

SEQ ID NO: 37877 - DNA, 684 bp, Artificial Sequence
  chemically treated genomic DNA (Homo sapiens) CpG-island No: 37877
cgtttcgggtcgggaaggaaggaggtggtgatgtttagggttagagcgggggcgtttggagaattcgggtgggagttagatattcgttgcgagtacgaagaaagcgcggttgagggtggtagcgcgtttatattcgttcggacgagggttcggttcgtatttattttgtttttagtagtagcggggtttcgggttatttcgcggttaagtgggtagttatcgatttggacgcggcgatcgtttcggagtcgagttgcgaaagttatagcgttgtggagtttagtagtagtcgtattacgttcgtggttttcgttggcgttatggtacggagagaaaagcgcgagtttttcggattcggtatttatagtttgtggtcgttacgtttcggtcggtttttttcgttgcgcggttgtttattttcggtgggaggagttcgagttcgttattgggtgtcgggtttagatcggcgtatgcgtgtttcgtttcggcgcggtttagtgggtgcggtttggagagtttacgttagtcggatattgggttacgtcggagtcgtcggggcggcgtcgggttgttgagcggcgttatagatgttttcgcgggtttatttttaggattttgggttttcggatagaggttttaggatacggggcgggaagttggttttttagatcgaattagggtttt

SEQ ID NO: 37878 - DNA, 684 bp, Artificial Sequence
  chemically treated genomic DNA (Homo sapiens) CpG-island No: 37878
aaaaccctaattcgatctaaaaaaccaacttcccgccccgtatcctaaaacctctatccgaaaacccaaaatcctaaaaataaacccgcgaaaacatctataacgccgctcaacaacccgacgccgccccgacgactccgacgtaacccaatatccgactaacgtaaactctccaaaccgcacccactaaaccgcgccgaaacgaaacacgcatacgccgatctaaacccgacacccaataacgaactcgaactcctcccaccgaaaataaacaaccgcgcaacgaaaaaaaccgaccgaaacgtaacgaccacaaactataaataccgaatccgaaaaactcgcgcttttctctccgtaccataacgccaacgaaaaccacgaacgtaatacgactactactaaactccacaacgctataactttcgcaactcgactccgaaacgatcgccgcgtccaaatcgataactacccacttaaccgcgaaataacccgaaaccccgctactactaaaaacaaaataaatacgaaccgaaccctcgtccgaacgaatataaacgcgctaccaccctcaaccgcgctttcttcgtactcgcaacgaatatctaactcccacccgaattctccaaacgcccccgctctaaccctaaacatcaccacctccttccttcccgacccgaaacg

SEQ ID NO: 37879 - DNA, 684 bp, Artificial Sequence
  chemically treated genomic DNA (Homo sapiens) CpG-island No: 37879
agagttttagttcggtttggagagttagtttttcgtttcgtgttttaaggtttttgttcgagaatttaaagttttgggaatggattcgcgggagtatttgtgacgtcgtttagtaattcggcgtcgtttcggcggtttcgacgtggtttagtgttcggttggcgtgggttttttaggtcgtatttattaaatcgcgtcggagcgggatacgtatgcgtcggtttggattcggtatttagtaacggattcgagttttttttatcggaagtgggtagtcgcgtagcgggaagagtcggtcgaagcgtggcggttatagattgtgggtatcgggttcgagggattcgcgttttttttttcgtgttatggcgttagcgaaagttacgaacgtggtgcggttgttattaggttttatagcgttgtggttttcgtagttcggtttcgggacggtcgtcgcgtttaagtcggtgattgtttatttggtcgcgaagtggttcgagatttcgttgttgttggaggtaaggtgggtgcgggtcgggttttcgttcgggcgggtgtgggcgcgttgttatttttagtcgcgtttttttcgtgttcgtagcgggtgtttggtttttattcgggttttttagacgttttcgttttggttttgagtattattatttttttttttttcgattcggggcg

SEQ ID NO: 37880 - DNA, 684 bp, Artificial Sequence
  chemically treated genomic DNA (Homo sapiens) CpG-island No: 37880
cgccccgaatcgaaaaaaaaaaaaataataatactcaaaaccaaaacgaaaacgtctaaaaaacccgaataaaaaccaaacacccgctacgaacacgaaaaaaacgcgactaaaaataacaacgcgcccacacccgcccgaacgaaaacccgacccgcacccaccttacctccaacaacaacgaaatctcgaaccacttcgcgaccaaataaacaatcaccgacttaaacgcgacgaccgtcccgaaaccgaactacgaaaaccacaacgctataaaacctaataacaaccgcaccacgttcgtaactttcgctaacgccataacacgaaaaaaaaaacgcgaatccctcgaacccgatacccacaatctataaccgccacgcttcgaccgactcttcccgctacgcgactacccacttccgataaaaaaaactcgaatccgttactaaataccgaatccaaaccgacgcatacgtatcccgctccgacgcgatttaataaatacgacctaaaaaacccacgccaaccgaacactaaaccacgtcgaaaccgccgaaacgacgccgaattactaaacgacgtcacaaatactcccgcgaatccattcccaaaactttaaattctcgaacaaaaaccttaaaacacgaaacgaaaaactaactctccaaaccgaactaaaactct

SEQ ID NO: 37881 - DNA, 622 bp, Artificial Sequence
  chemically treated genomic DNA (Homo sapiens) CpG-island No: 37881
ttcgttttttcgttcgttcgagatatttttcggcgttttttttcgatttcggcgatattgcgtttggatacgttaggtaggggggtagggtgggcgagtcgtttttcgacgcgggttagttggggtttttcgtgaatttcgttcgggatatttatagtagtcgcgtttttatttttttttttttaaatcgtttcggtttttgtcgtcgttattttttgttaaatcgtttttatttttttagcggagttaatagcggggtcggcgtatataaagggggtcggagggtggagagtatagaaggagggagagatttcgttagggttcgttggtacgggtttgggagtagttatttattcgatttttttttcgatttttgagatgtttgcgaagatgaggaagattatagagtagcgtgcgtttttagtatttagtttcggaattgtagttgtatggttgggttgcgttcgttagatttaagcggtcgtttcgaggattagtgggtggagtttatttacggatcgatgtttttcgcgtttgtagtttgtgtagatatgttgtttttcgtacgtgtcgttacgtttggtattttttatagtttattgtttgattatatgttgtttta

SEQ ID NO: 37882 - DNA, 622 bp, Artificial Sequence
  chemically treated genomic DNA (Homo sapiens) CpG-island No: 37882
taaaacaacatataatcaaacaataaactataaaaaataccaaacgtaacgacacgtacgaaaaacaacatatctacacaaactacaaacgcgaaaaacatcgatccgtaaataaactccacccactaatcctcgaaacgaccgcttaaatctaacgaacgcaacccaaccatacaactacaattccgaaactaaatactaaaaacgcacgctactctataatcttcctcatcttcgcaaacatctcaaaaatcgaaaaaaaaatcgaataaataactactcccaaacccgtaccaacgaaccctaacgaaatctctccctccttctatactctccaccctccgaccccctttatatacgccgaccccgctattaactccgctaaaaaaataaaaacgatttaacaaaaaataacgacgacaaaaaccgaaacgatttaaaaaaaaaaaaataaaaacgcgactactataaatatcccgaacgaaattcacgaaaaaccccaactaacccgcgtcgaaaaacgactcgcccaccctacccccctacctaacgtatccaaacgcaatatcgccgaaatcgaaaaaaaacgccgaaaaatatctcgaacgaacgaaaaaacgaa

SEQ ID NO: 37883 - DNA, 622 bp, Artificial Sequence
  chemically treated genomic DNA (Homo sapiens) CpG-island No: 37883
tagagtaatatataattaagtagtgaattgtgaaaaatattaagcgtggcgatacgtacggagagtagtatgtttgtatagattgtaggcgcggaggatatcgattcgtagatgagttttatttattgattttcgagacggtcgtttgggtttggcgggcgtaatttaattatgtagttgtagtttcggagttggatgttgagaacgtacgttgttttgtggttttttttattttcgtagatattttagagatcgaagaagaaatcgggtaaatagttgtttttaggttcgtgttaacgagttttggcgggatttttttttttttttgtattttttatttttcgattttttttgtgtgcgtcggtttcgttgttagtttcgttggagagatggggacggtttggtagaaggtggcggcgataggggtcgggacggtttggggagaggagggtgggggcgcggttgttgtgggtgtttcgggcggggtttacgggaagttttagttggttcgcgtcgggaagcgattcgtttattttgtttttttgtttggcgtgtttaagcgtagtgtcgtcggggtcgagggagggcgtcggggagtgtttcgggcgggcggaggggcgag

SEQ ID NO: 37884 - DNA, 622 bp, Artificial Sequence
  chemically treated genomic DNA (Homo sapiens) CpG-island No: 37884
ctcgcccctccgcccgcccgaaacactccccgacgccctccctcgaccccgacgacactacgcttaaacacgccaaacaaaaaaacaaaataaacgaatcgcttcccgacgcgaaccaactaaaacttcccgtaaaccccgcccgaaacacccacaacaaccgcgcccccaccctcctctccccaaaccgtcccgacccctatcgccgccaccttctaccaaaccgtccccatctctccaacgaaactaacaacgaaaccgacgcacacaaaaaaaatcgaaaaataaaaaatacaaaaaaaaaaaaaaatcccgccaaaactcgttaacacgaacctaaaaacaactatttacccgatttcttcttcgatctctaaaatatctacgaaaataaaaaaaaccacaaaacaacgtacgttctcaacatccaactccgaaactacaactacataattaaattacgcccgccaaacccaaacgaccgtctcgaaaatcaataaataaaactcatctacgaatcgatatcctccgcgcctacaatctatacaaacatactactctccgtacgtatcgccacgcttaatatttttcacaattcactacttaattatatattactcta

SEQ ID NO: 37885 - DNA, 1107 bp, Artificial Sequence
  chemically treated genomic DNA (Homo sapiens) CpG-island No: 37885
ggggagtcggcgtgttcggggtatttcggggtacgtggtttgtagggcgtagttattacgttttagtatgtgcgtatttacgagagtcggtaagaaggtttcggtatagtagttttggtgggaatttcgcggcgttttttagtttagatttttttatcgtaaaggttttaaagattcgtagcgatatttattttttgtttagtttcggttcgttgttatttatttttatttcggtcgtttgtacggtcgttattttttcggagggttcgatttaaaagtaaggaggatagtacgttaatttttaggttaaggtgcgaagttttatttttttcgggggagagggggcgggtattttcgatgcgtcgcggttgttgttgcgtaggtttagtgttgcgtttcgcggtagaggcgtttgcggtgatagtttagttagttgagttttgtgtgttaggcgttcgcgagggggtagtttttttagtagtgttcggcgttagatatggcggaggcgatggatttgggtaaagattttaacgggtttatttatttttcgattttgttcgtgagggacgacggtagttttatgtttttttacgtgcggtttagttcggttaagcgtcggttgtcgacgtttattttgtacggcggcggtatcgtgtgtcgagtgtaggagttcggggtcgtgttgttggtttagttcggggaggcgttggtcgaggtttcgggtgattttatttttacgtagtatattttggattgcgtggagcgtaacgagaggttggagttggaggtttatcggttgggtttcgtttcggcggcggatatcggttcggaagtaaagttcggggttttggtcgagggcgtcgcggagtcggagtcgtagcggtacgtcgggcggatcgtttttacggatgcggacgacgtagttatttttatttacgtgaaggaaaatgttcgttcgtttagtttcgttatcggtaacgttttgtggaaagcgatggagaagagttcgtttacgtagtattcgtggtagtttttgaaggatcgttattttaagtatttgcggggttaggagtataagtatttgttgggggacgcgtcggtgagttt

SEQ ID NO: 37886 - DNA, 1107 bp, Artificial Sequence
  chemically treated genomic DNA (Homo sapiens) CpG-island No: 37886
aaactcaccgacgcgtcccccaacaaatacttatactcctaaccccgcaaatacttaaaataacgatccttcaaaaactaccacgaatactacgtaaacgaactcttctccatcgctttccacaaaacgttaccgataacgaaactaaacgaacgaacattttccttcacgtaaataaaaataactacgtcgtccgcatccgtaaaaacgatccgcccgacgtaccgctacgactccgactccgcgacgccctcgaccaaaaccccgaactttacttccgaaccgatatccgccgccgaaacgaaacccaaccgataaacctccaactccaacctctcgttacgctccacgcaatccaaaatatactacgtaaaaataaaatcacccgaaacctcgaccaacgcctccccgaactaaaccaacaacacgaccccgaactcctacactcgacacacgataccgccgccgtacaaaataaacgtcgacaaccgacgcttaaccgaactaaaccgcacgtaaaaaaacataaaactaccgtcgtccctcacgaacaaaatcgaaaaataaataaacccgttaaaatctttacccaaatccatcgcctccgccatatctaacgccgaacactactaaaaaaactaccccctcgcgaacgcctaacacacaaaactcaactaactaaactatcaccgcaaacgcctctaccgcgaaacgcaacactaaacctacgcaacaacaaccgcgacgcatcgaaaatacccgccccctctcccccgaaaaaaataaaacttcgcaccttaacctaaaaattaacgtactatcctccttacttttaaatcgaaccctccgaaaaaataacgaccgtacaaacgaccgaaataaaaataaataacaacgaaccgaaactaaacaaaaaataaatatcgctacgaatctttaaaacctttacgataaaaaaatctaaactaaaaaacgccgcgaaattcccaccaaaactactataccgaaaccttcttaccgactctcgtaaatacgcacatactaaaacgtaataactacgccctacaaaccacgtaccccgaaataccccgaacacgccgactcccc

SEQ ID NO: 37887 - DNA, 1107 bp, Artificial Sequence
  chemically treated genomic DNA (Homo sapiens) CpG-island No: 37887
gggtttatcggcgcgttttttagtaggtatttatgtttttggtttcgtaggtgtttgaggtagcggttttttagggattgttacgagtgttgcgtgagcgagtttttttttatcgttttttataaggcgttatcggtgacggagttgggcgagcgggtatttttttttacgtaggtaaggatggttacgtcgttcgtattcgtgaaggcgattcgttcggcgtgtcgttgcggtttcggtttcgcggcgttttcggttagggtttcgggttttgttttcgagtcggtgttcgtcgtcgaggcggggtttagtcgataggtttttagttttagtttttcgttgcgttttacgtagtttaggatgtattgcgtggagatgaaattattcgaggtttcggttagcgttttttcgggttgggttagtagtacggtttcgggtttttgtattcggtatacggtgtcgtcgtcgtgtaggatgagcgtcgatagtcgacgtttggtcgggttgggtcgtacgtagaaggatatggagttgtcgtcgttttttacgaatagagtcgaggaatgggtgggttcgttggggtttttgtttaaatttatcgttttcgttatgtttgacgtcgagtattattagaagagttattttttcgcgagcgtttggtatatagagtttaattgattgagttgttatcgtagacgtttttgtcgcgaagcgtagtattgggtttgcgtagtagtagtcgcggcgtatcgagagtgttcgttttttttttttcggaagaggtggggtttcgtattttgatttggaaattaacgtattattttttttatttttgggtcgggtttttcgggaagatggcggtcgtgtaggcggtcgaggtgaaagtggatggtagcgagtcgaaattgagtaagaagtgagtgtcgttgcgagtttttaaagtttttgcggtaggagagtttgggttgggaagcgtcgcgaggtttttattaaggttgttgtgtcggggtttttttgtcggttttcgtgggtacgtatatgttgagacgtggtggttgcgttttgtagattacgtatttcgggatatttcgggtacgtcggtttttt

SEQ ID NO: 37888 - DNA, 1107 bp, Artificial Sequence
  chemically treated genomic DNA (Homo sapiens) CpG-island No: 37888
aaaaaaccgacgtacccgaaatatcccgaaatacgtaatctacaaaacgcaaccaccacgtctcaacatatacgtacccacgaaaaccgacaaaaaaaccccgacacaacaaccttaataaaaacctcgcgacgcttcccaacccaaactctcctaccgcaaaaactttaaaaactcgcaacgacactcacttcttactcaatttcgactcgctaccatccactttcacctcgaccgcctacacgaccgccatcttcccgaaaaacccgacccaaaaataaaaaaaataatacgttaatttccaaatcaaaatacgaaaccccacctcttccgaaaaaaaaaaaacgaacactctcgatacgccgcgactactactacgcaaacccaatactacgcttcgcgacaaaaacgtctacgataacaactcaatcaattaaactctatataccaaacgctcgcgaaaaaataactcttctaataatactcgacgtcaaacataacgaaaacgataaatttaaacaaaaaccccaacgaacccacccattcctcgactctattcgtaaaaaacgacgacaactccatatccttctacgtacgacccaacccgaccaaacgtcgactatcgacgctcatcctacacgacgacgacaccgtataccgaatacaaaaacccgaaaccgtactactaacccaacccgaaaaaacgctaaccgaaacctcgaataatttcatctccacgcaatacatcctaaactacgtaaaacgcaacgaaaaactaaaactaaaaacctatcgactaaaccccgcctcgacgacgaacaccgactcgaaaacaaaacccgaaaccctaaccgaaaacgccgcgaaaccgaaaccgcaacgacacgccgaacgaatcgccttcacgaatacgaacgacgtaaccatccttacctacgtaaaaaaaaatacccgctcgcccaactccgtcaccgataacgccttataaaaaacgataaaaaaaaactcgctcacgcaacactcgtaacaatccctaaaaaaccgctacctcaaacacctacgaaaccaaaaacataaatacctactaaaaaacgcgccgataaaccc

SEQ ID NO: 37889 - DNA, 685 bp, Artificial Sequence
  chemically treated genomic DNA (Homo sapiens) CpG-island No: 37889
ttaggtcgatcgttttcggtagcgttacgttcgttaatttcgttttcgttattggtttttttcggtgcggttttgttattggtttttttttgtgagtcgtcggttgtcgtggagatcgaggcgatggtaattaggagaagttaaatttggtttttcggttcgcggagtgtttgcgagcggtgtttatggcgttttatgagttttttttttattcggtcgagcgtagttatcgcgcggggttttgttttaaagtcgcgttgtttttgttgttggtcgttgcgtttacgtatatttcgtcgttgttggtggtttttcggagttacggtgagtttgtttcggtcgttgtgttacgaggtttttcgggcgcgttcggttagggtcggtttttttaatcgtttttttatcgttttttttaatttagggttttggttgaagcggagtagttacgaggagtagtcgatcgtgcgtttttaatattaggtgttgttcgtggttttgttcggattcgaaagcgacgggtttttcgtttggagtacgtttttcgtttttaatcggttgtaaggggatcgtttgcgcgtttcgttcgtttcggtgcgtggttttcgtttgggtttggggtagagtcggggatagggtggggatggggattggaatgaggatgtggggcgagcggtttcggttttgg

SEQ ID NO: 37890 - DNA, 685 bp, Artificial Sequence
  chemically treated genomic DNA (Homo sapiens) CpG-island No: 37890
ccaaaaccgaaaccgctcgccccacatcctcattccaatccccatccccaccctatccccgactctaccccaaacccaaacgaaaaccacgcaccgaaacgaacgaaacgcgcaaacgatccccttacaaccgattaaaaacgaaaaacgtactccaaacgaaaaacccgtcgctttcgaatccgaacaaaaccacgaacaacacctaatattaaaaacgcacgatcgactactcctcgtaactactccgcttcaaccaaaaccctaaattaaaaaaaacgataaaaaaacgattaaaaaaaccgaccctaaccgaacgcgcccgaaaaacctcgtaacacaacgaccgaaacaaactcaccgtaactccgaaaaaccaccaacaacgacgaaatatacgtaaacgcaacgaccaacaacaaaaacaacgcgactttaaaacaaaaccccgcgcgataactacgctcgaccgaataaaaaaaaaactcataaaacgccataaacaccgctcgcaaacactccgcgaaccgaaaaaccaaatttaacttctcctaattaccatcgcctcgatctccacgacaaccgacgactcacaaaaaaaaaccaataacaaaaccgcaccgaaaaaaaccaataacgaaaacgaaattaacgaacgtaacgctaccgaaaacgatcgacctaa

SEQ ID NO: 37891 - DNA, 685 bp, Artificial Sequence
  chemically treated genomic DNA (Homo sapiens) CpG-island No: 37891
ttagggtcggggtcgttcgttttatatttttattttagtttttatttttattttattttcgattttgttttaggtttaggcgggaattacgtatcgaaacgagcgggacgcgtaggcgatttttttgtagtcggttgaaggcggggaacgtgttttaggcgaggaattcgtcgttttcgggttcgagtagggttacgagtagtatttggtgttggaagcgtacggtcggttgtttttcgtagttgtttcgttttagttaaaattttgagttaaagagggcggtagggaggcggttagggaggtcggttttggtcgagcgcgttcggggagtttcgtggtatagcggtcggggtaggtttatcgtggtttcggaaggttattagtagcggcgggatgtacgtgagcgtagcggttagtagtaggaatagcgcggttttggagtagagtttcgcgcggtaattgcgttcgatcgggtgagagaagagtttatagagcgttatgagtatcgttcgtaggtatttcgcgagtcgggggattaagtttggttttttttggttgttatcgtttcggtttttacggtaatcgacggtttatagaaaggagttaatagtaaggtcgtatcgaaaggagttagtggcgggggcggggttagcgggcgtggcgttgtcggggacggtcggtttag

SEQ ID NO: 37892 - DNA, 685 bp, Artificial Sequence
  chemically treated genomic DNA (Homo sapiens) CpG-island No: 37892
ctaaaccgaccgtccccgacaacgccacgcccgctaaccccgcccccgccactaactcctttcgatacgaccttactattaactcctttctataaaccgtcgattaccgtaaaaaccgaaacgataacaaccaaaaaaaaccaaacttaatcccccgactcgcgaaatacctacgaacgatactcataacgctctataaactcttctctcacccgatcgaacgcaattaccgcgcgaaactctactccaaaaccgcgctattcctactactaaccgctacgctcacgtacatcccgccgctactaataaccttccgaaaccacgataaacctaccccgaccgctataccacgaaactccccgaacgcgctcgaccaaaaccgacctccctaaccgcctccctaccgccctctttaactcaaaattttaactaaaacgaaacaactacgaaaaacaaccgaccgtacgcttccaacaccaaatactactcgtaaccctactcgaacccgaaaacgacgaattcctcgcctaaaacacgttccccgccttcaaccgactacaaaaaaatcgcctacgcgtcccgctcgtttcgatacgtaattcccgcctaaacctaaaacaaaatcgaaaataaaataaaaataaaaactaaaataaaaatataaaacgaacgaccccgaccctaa

SEQ ID NO: 37893 - DNA, 509 bp, Artificial Sequence
  chemically treated genomic DNA (Homo sapiens) CpG-island No: 37893
cgtcgattgtttttttttattcgttgggaagaggaaagtgtcgttcggcgttttcgaaattttcgattatttttattagagcgattcggcgtattcgttttttttcgtatatacgcgggcggggacgggtaggacgttatagtaattagcgcgcggggggaagggcgttttttcgtcggttttatcgggggttttcggtcgtttagaaattttttttttcgtttttcgtttttcgtttttttttttttttttttttgttttcgcggttgatggatgagtttcgaatgttgttcgagtttgtgttttttttcgggacgaggaggtcgagagagaaggggttaggggcgcggtcgggtttagcgtgttcgggttggggcggtttttgttttgggggaagcgcgagggagacgtgggtacgagttgcggggattcgtttttttaaacgaggttttttgaattttttagggttttttggaagagttggatttttatttggttttttggttttt

SEQ ID NO: 37894 - DNA, 509 bp, Artificial Sequence
  chemically treated genomic DNA (Homo sapiens) CpG-island No: 37894
aaaaaccaaaaaaccaaataaaaatccaactcttccaaaaaaccctaaaaaattcaaaaaacctcgtttaaaaaaacgaatccccgcaactcgtacccacgtctccctcgcgcttcccccaaaacaaaaaccgccccaacccgaacacgctaaacccgaccgcgcccctaaccccttctctctcgacctcctcgtcccgaaaaaaaacacaaactcgaacaacattcgaaactcatccatcaaccgcgaaaacaaaaaaaaaaaaaaaaaaaaacgaaaaacgaaaaacgaaaaaaaaaatttctaaacgaccgaaaacccccgataaaaccgacgaaaaaacgcccttccccccgcgcgctaattactataacgtcctacccgtccccgcccgcgtatatacgaaaaaaaacgaatacgccgaatcgctctaataaaaataatcgaaaatttcgaaaacgccgaacgacactttcctcttcccaacgaataaaaaaaaacaatcgacg

SEQ ID NO: 37895 - DNA, 509 bp, Artificial Sequence
  chemically treated genomic DNA (Homo sapiens) CpG-island No: 37895
aaagattaaggaattaaatgaaaatttaatttttttagggagttttggaaagtttaaaggatttcgtttgagggagcgagttttcgtagttcgtgtttacgtttttttcgcgttttttttaggataggggtcgttttaattcgggtacgttgagttcggtcgcgtttttagttttttttttttcggttttttcgtttcgaagggaagtataggttcgagtagtattcggggtttatttattagtcgcggaggtaaagggggaggagagaggaggcgggaggcgggaggcgggaggaggagtttttgggcggtcgagagttttcggtggggtcggcggaggagcgttttttttttcgcgcgttgattgttgtggcgttttgttcgttttcgttcgcgtgtgtgcgagggagggcgagtgcgtcgggtcgttttgatgggggtaatcgagggtttcggggacgtcgagcggtatttttttttttttagcgagtgaaggagggtagtcggcg

SEQ ID NO: 37896 - DNA, 509 bp, Artificial Sequence
  chemically treated genomic DNA (Homo sapiens) CpG-island No: 37896
cgccgactaccctccttcactcgctaaaaaaaaaaaaataccgctcgacgtccccgaaaccctcgattacccccatcaaaacgacccgacgcactcgccctccctcgcacacacgcgaacgaaaacgaacaaaacgccacaacaatcaacgcgcgaaaaaaaaaacgctcctccgccgaccccaccgaaaactctcgaccgcccaaaaactcctcctcccgcctcccgcctcccgcctcctctctcctccccctttacctccgcgactaataaataaaccccgaatactactcgaacctatacttcccttcgaaacgaaaaaaccgaaaaaaaaaaaactaaaaacgcgaccgaactcaacgtacccgaattaaaacgacccctatcctaaaaaaaacgcgaaaaaaacgtaaacacgaactacgaaaactcgctccctcaaacgaaatcctttaaactttccaaaactccctaaaaaaattaaattttcatttaattccttaatcttt

SEQ ID NO: 37897 - DNA, 1427 bp, Artificial Sequence
  chemically treated genomic DNA (Homo sapiens) CpG-island No: 37897
tgggtagaaatagtatacgtaagatcgggtgtgtacgaggagatgcgaatatcgggaatagtcgagtgggtagaaatagtatacgtaagattaggtgtgtacgaggagatgcgaatatcgggaatagtcgagtggatagaaatagtatacgtaagatcgggtgtgtacgaggagatgcgaatatcgggaatagtcgagtgggtagaaatagtatacgtaagatcgggtgtgtacgaggagatgtgaatatcgggaatagtcgagtgggtagaaatagtatacgtaaggtcgggtgtgtacgaggagatgtgaatattgggaatagtcgcgtgggtagaaatagtatacgtaaggtcgggtgtgtacgaggagatgtgaatattgggaatagtcgcgtggatagaaatagtatacgtaagatcgggtgtgcgtgaggagatgcgaatatcgggaatagtcgcgtgggtagaaatagtatacgtaagatcgggtgtgcgtgaggagatgcgaatatcgggaatagtcgagtggatagaaatagtatacgtaagatcgggtgtgtacgaggagatgcgaatatcgggaatagtcgcgtgggtagaaatagtatacgtaagatcgggtgtgcgtgaggagatgcgaatatcgggaatagtcgagtggatagaaatagtatacgtaagatcgggtgtgcgtgaggagatgcgaatatcgggaatagtcgagtggatagaaatagtatacgtaagatcgggtgtgcgtgaggagatgcgaatatcgggaatagtcgagtgggtagaaatagtatacgtaagatcgggtgtgcgtgaggagatgcgaatatcgggaatagtcgagtggatagaaatagtatacgtaagatcgggtgtgtacgaggagatgtgaatatcgggaacggtcgagtgggtagaaatagtatacgtaagatcgggtgtgcgtgaggagatgcgaatatcgggaatagtcgtgtgggtagaaatagtatacgtaagatcgggtgtgtacgaggagatgtgaatatcgggaatagtcgagtgggtagaaatagtatacgtaaggtcgggtgtgcgtgaggagatgcgaatatcgggaatagtcgtgtgggtagaaatagtatacgtaagatcgggtgtgtacgaggagatgcgaatatcgggaatagtcgagtgggtagaaatagtatacgtaagatcgggtgtgcgtgaggagatgcgaatatcgggaatagtcgcgtgggtagaaatagtatacgtaagatcgggtgtgcgtgaggagatgcgaatattaggaatagtcgagtgggtagaaatagtatacgtaaggtcgggtgtgcgtgaggagatgcgaatattcgtaggtttttgttttattttattagagggagaagatattgagtgtagattttt

SEQ ID NO: 37898 - DNA, 1427 bp, Artificial Sequence
  chemically treated genomic DNA (Homo sapiens) CpG-island No: 37898
aaaaatctacactcaatatcttctccctctaataaaataaaacaaaaacctacgaatattcgcatctcctcacgcacacccgaccttacgtatactatttctacccactcgactattcctaatattcgcatctcctcacgcacacccgatcttacgtatactatttctacccacgcgactattcccgatattcgcatctcctcacgcacacccgatcttacgtatactatttctacccactcgactattcccgatattcgcatctcctcgtacacacccgatcttacgtatactatttctacccacacgactattcccgatattcgcatctcctcacgcacacccgaccttacgtatactatttctacccactcgactattcccgatattcacatctcctcgtacacacccgatcttacgtatactatttctacccacacgactattcccgatattcgcatctcctcacgcacacccgatcttacgtatactatttctacccactcgaccgttcccgatattcacatctcctcgtacacacccgatcttacgtatactatttctatccactcgactattcccgatattcgcatctcctcacgcacacccgatcttacgtatactatttctacccactcgactattcccgatattcgcatctcctcacgcacacccgatcttacgtatactatttctatccactcgactattcccgatattcgcatctcctcacgcacacccgatcttacgtatactatttctatccactcgactattcccgatattcgcatctcctcacgcacacccgatcttacgtatactatttctacccacgcgactattcccgatattcgcatctcctcgtacacacccgatcttacgtatactatttctatccactcgactattcccgatattcgcatctcctcacgcacacccgatcttacgtatactatttctacccacgcgactattcccgatattcgcatctcctcacgcacacccgatcttacgtatactatttctatccacgcgactattcccaatattcacatctcctcgtacacacccgaccttacgtatactatttctacccacgcgactattcccaatattcacatctcctcgtacacacccgaccttacgtatactatttctacccactcgactattcccgatattcacatctcctcgtacacacccgatcttacgtatactatttctacccactcgactattcccgatattcgcatctcctcgtacacacccgatcttacgtatactatttctatccactcgactattcccgatattcgcatctcctcgtacacacctaatcttacgtatactatttctacccactcgactattcccgatattcgcatctcctcgtacacacccgatcttacgtatactatttctaccca

SEQ ID NO: 37899 - DNA, 1427 bp, Artificial Sequence
  chemically treated genomic DNA (Homo sapiens) CpG-island No: 37899
gagagtttatatttagtgttttttttttttagtggaatgagatagagatttgcgggtgttcgtatttttttacgtatattcgattttacgtgtgttgtttttatttattcgattgtttttggtgttcgtatttttttacgtatattcgattttacgtgtgttgtttttatttacgcgattgttttcggtgttcgtatttttttacgtatattcgattttacgtgtgttgtttttatttattcgattgttttcggtgttcgtattttttcgtgtatattcgattttacgtgtgttgtttttatttatacgattgttttcggtgttcgtatttttttacgtatattcgattttacgtgtgttgtttttatttattcgattgttttcggtgtttatattttttcgtgtatattcgattttacgtgtgttgtttttatttatacgattgttttcggtgttcgtatttttttacgtatattcgattttacgtgtgttgtttttatttattcgatcgttttcggtgtttatattttttcgtgtatattcgattttacgtgtgttgtttttatttattcgattgttttcggtgttcgtatttttttacgtatattcgattttacgtgtgttgtttttatttattcgattgttttcggtgttcgtatttttttacgtatattcgattttacgtgtgttgtttttatttattcgattgttttcggtgttcgtatttttttacgtatattcgattttacgtgtgttgtttttatttattcgattgttttcggtgttcgtatttttttacgtatattcgattttacgtgtgttgtttttatttacgcgattgttttcggtgttcgtattttttcgtgtatattcgattttacgtgtgttgtttttatttattcgattgttttcggtgttcgtatttttttacgtatattcgattttacgtgtgttgtttttatttacgcgattgttttcggtgttcgtatttttttacgtatattcgattttacgtgtgttgtttttatttacgcgattgtttttagtgtttatattttttcgtgtatattcgattttacgtgtgttgtttttatttacgcgattgtttttagtgtttatattttttcgtgtatattcgattttacgtgtgttgtttttatttattcgattgttttcggtgtttatattttttcgtgtatattcgattttacgtgtgttgtttttatttattcgattgttttcggtgttcgtattttttcgtgtatattcgattttacgtgtgttgtttttatttattcgattgttttcggtgttcgtattttttcgtgtatatttgattttacgtgtgttgtttttatttattcgattgttttcggtgttcgtattttttcgtgtatattcgattttacgtgtgttgtttttattta

SEQ ID NO: 37900 - DNA, 1427 bp, Artificial Sequence
  chemically treated genomic DNA (Homo sapiens) CpG-island No: 37900
taaataaaaacaacacacgtaaaatcgaatatacacgaaaaaatacgaacaccgaaaacaatcgaataaataaaaacaacacacgtaaaatcaaatatacacgaaaaaatacgaacaccgaaaacaatcgaataaataaaaacaacacacgtaaaatcgaatatacacgaaaaaatacgaacaccgaaaacaatcgaataaataaaaacaacacacgtaaaatcgaatatacacgaaaaaatataaacaccgaaaacaatcgaataaataaaaacaacacacgtaaaatcgaatatacacgaaaaaatataaacactaaaaacaatcgcgtaaataaaaacaacacacgtaaaatcgaatatacacgaaaaaatataaacactaaaaacaatcgcgtaaataaaaacaacacacgtaaaatcgaatatacgtaaaaaaatacgaacaccgaaaacaatcgcgtaaataaaaacaacacacgtaaaatcgaatatacgtaaaaaaatacgaacaccgaaaacaatcgaataaataaaaacaacacacgtaaaatcgaatatacacgaaaaaatacgaacaccgaaaacaatcgcgtaaataaaaacaacacacgtaaaatcgaatatacgtaaaaaaatacgaacaccgaaaacaatcgaataaataaaaacaacacacgtaaaatcgaatatacgtaaaaaaatacgaacaccgaaaacaatcgaataaataaaaacaacacacgtaaaatcgaatatacgtaaaaaaatacgaacaccgaaaacaatcgaataaataaaaacaacacacgtaaaatcgaatatacgtaaaaaaatacgaacaccgaaaacaatcgaataaataaaaacaacacacgtaaaatcgaatatacacgaaaaaatataaacaccgaaaacgatcgaataaataaaaacaacacacgtaaaatcgaatatacgtaaaaaaatacgaacaccgaaaacaatcgtataaataaaaacaacacacgtaaaatcgaatatacacgaaaaaatataaacaccgaaaacaatcgaataaataaaaacaacacacgtaaaatcgaatatacgtaaaaaaatacgaacaccgaaaacaatcgtataaataaaaacaacacacgtaaaatcgaatatacacgaaaaaatacgaacaccgaaaacaatcgaataaataaaaacaacacacgtaaaatcgaatatacgtaaaaaaatacgaacaccgaaaacaatcgcgtaaataaaaacaacacacgtaaaatcgaatatacgtaaaaaaatacgaacaccaaaaacaatcgaataaataaaaacaacacacgtaaaatcgaatatacgtaaaaaaatacgaacacccgcaaatctctatctcattccactaaaaaaaaaaaacactaaatataaactctc

SEQ ID NO: 37901 - DNA, 939 bp, Artificial Sequence
  chemically treated genomic DNA (Homo sapiens) CpG-island No: 37901
ggaagcgatttttgaattgttggagcgtataaatgaaaaatattattcgtattttcgaaacgtattcgttgatttgcgtttgcgcgatgataaatagttagtgtggttggacgaatatcgtagtaaaacggttacgaaggcgcgcgtaaggcgttgatcgggttgttttcggataaatcgttaattaggtaaaagacgttggtttgaaagggcgcggcggcgcggtttttcgattggtttgaaatggagtttgatgtcgaaagacgaatttagaatattcgttatttgttgtgtaatgtcgatgaaatggagtcgggtattataaagatcgtttgttgatggagtaattgtcgtatttgttggtggaaggatgtttattttcgcgtttgcgttgaaagtttatcgtggttatatttttcgcgtggcgaatatatcgaagcggtagtttatttgcgtcgtgttattgttaagttatcgaagcgggtttgtttggtaaaaatattgatgggaataggttcgatttcgaattgttcgtttatatcggggtagggcgttatatttgcgggaagaaatagcgttaattaattttttggaaggacgtcgtgttaatttacgtcgaagttatttttttcggtaattttcggcgtatggggtaaatcgagtttgttaataacgtcgaaaatttgtgtaacgtttcggcgattttcgttaacgcgtggagtggtattagagtttttcgatgagtaggatgttggtttaagcgatgggttttcggtcgggtgaatattcggattgtgcgattgcggtcggatatcgggcgagatttttagattcgcggggtttttgaggttgattattcgatcgcgcgggatgatttgcgaagttttttgcgggtttagttttaacgggattcggaggcgtatcggatttttacgttgt

SEQ ID NO: 37902 - DNA, 939 bp, Artificial Sequence
  chemically treated genomic DNA (Homo sapiens) CpG-island No: 37902
acaacgtaaaaatccgatacgcctccgaatcccgttaaaactaaacccgcaaaaaacttcgcaaatcatcccgcgcgatcgaataatcaacctcaaaaaccccgcgaatctaaaaatctcgcccgatatccgaccgcaatcgcacaatccgaatattcacccgaccgaaaacccatcgcttaaaccaacatcctactcatcgaaaaactctaataccactccacgcgttaacgaaaatcgccgaaacgttacacaaattttcgacgttattaacaaactcgatttaccccatacgccgaaaattaccgaaaaaaataacttcgacgtaaattaacacgacgtccttccaaaaaattaattaacgctatttcttcccgcaaatataacgccctaccccgatataaacgaacaattcgaaatcgaacctattcccatcaatatttttaccaaacaaacccgcttcgataacttaacaataacacgacgcaaataaactaccgcttcgatatattcgccacgcgaaaaatataaccacgataaactttcaacgcaaacgcgaaaataaacatccttccaccaacaaatacgacaattactccatcaacaaacgatctttataatacccgactccatttcatcgacattacacaacaaataacgaatattctaaattcgtctttcgacatcaaactccatttcaaaccaatcgaaaaaccgcgccgccgcgccctttcaaaccaacgtcttttacctaattaacgatttatccgaaaacaacccgatcaacgccttacgcgcgccttcgtaaccgttttactacgatattcgtccaaccacactaactatttatcatcgcgcaaacgcaaatcaacgaatacgtttcgaaaatacgaataatatttttcatttatacgctccaacaattcaaaaatcgcttcc

SEQ ID NO: 37903 - DNA, 939 bp, Artificial Sequence
  chemically treated genomic DNA (Homo sapiens) CpG-island No: 37903
atagcgtgaaggttcgatgcgttttcgggtttcgttaagattggattcgtaaaaggtttcgtagattatttcgcgcggtcgggtaattagttttaggaatttcgcggatttggggatttcgttcggtgttcgatcgtagtcgtatagttcggatgtttattcgatcgagaatttatcgtttgggttagtattttatttatcgagaggttttgatattattttacgcgttagcgaggatcgtcggaacgttatataggttttcgacgttgttgataagttcggtttattttatgcgtcggagattgtcgggaagggtggtttcgacgtgggttagtacgacgtttttttagggagttgattaacgttgttttttttcgtagatgtagcgttttgtttcggtatggacgaatagttcgaaatcgaatttgtttttattaatgtttttgttaagtagattcgtttcggtggtttggtaatggtacggcgtagatgaattgtcgtttcgatatattcgttacgcggaagatgtagttacggtaagtttttagcgtaaacgcggagatgagtatttttttattagtaggtgcggtagttgttttattaataggcggtttttatggtgttcggttttattttatcggtattatatagtaggtaacggatgttttggattcgtttttcggtattaggttttattttaggttagtcgagaagtcgcgtcgtcgcgtttttttagattagcgttttttatttgattaacgatttgttcggagatagttcggttagcgttttacgcgcgttttcgtaatcgttttgttgcggtattcgtttagttatattggttgtttgttatcgcgtagacgtaggttagcggatgcgtttcgggagtacggataatgttttttatttatacgttttagtagtttagggatcgttttt

SEQ ID NO: 37904 - DNA, 939 bp, Artificial Sequence
  chemically treated genomic DNA (Homo sapiens) CpG-island No: 37904
aaaaacgatccctaaactactaaaacgtataaataaaaaacattatccgtactcccgaaacgcatccgctaacctacgtctacgcgataacaaacaaccaatataactaaacgaataccgcaacaaaacgattacgaaaacgcgcgtaaaacgctaaccgaactatctccgaacaaatcgttaatcaaataaaaaacgctaatctaaaaaaacgcgacgacgcgacttctcgactaacctaaaataaaacctaataccgaaaaacgaatccaaaacatccgttacctactatataataccgataaaataaaaccgaacaccataaaaaccgcctattaataaaacaactaccgcacctactaataaaaaaatactcatctccgcgtttacgctaaaaacttaccgtaactacatcttccgcgtaacgaatatatcgaaacgacaattcatctacgccgtaccattaccaaaccaccgaaacgaatctacttaacaaaaacattaataaaaacaaattcgatttcgaactattcgtccataccgaaacaaaacgctacatctacgaaaaaaaacaacgttaatcaactccctaaaaaaacgtcgtactaacccacgtcgaaaccacccttcccgacaatctccgacgcataaaataaaccgaacttatcaacaacgtcgaaaacctatataacgttccgacgatcctcgctaacgcgtaaaataatatcaaaacctctcgataaataaaatactaacccaaacgataaattctcgatcgaataaacatccgaactatacgactacgatcgaacaccgaacgaaatccccaaatccgcgaaattcctaaaactaattacccgaccgcgcgaaataatctacgaaaccttttacgaatccaatcttaacgaaacccgaaaacgcatcgaaccttcacgctat

SEQ ID NO: 37905 - DNA, 649 bp, Artificial Sequence
  chemically treated genomic DNA (Homo sapiens) CpG-island No: 37905
tgacgacgggtaggttattttaatggatagtcggatgagttgttatttattttcgttagtttgttgttattcgtttaattagcgaagtgattcgttttttttataagggattcgtagattaaaaagacgttatatcgaattggtttggttcgattaggttttagtgatgttacgcgtaatgttaatcgtaagttgtggttatggttcggtcggattgggtatttcggttttcgttttgttaggtaataatttttaggaattaaggggttcggaaaaacggtaaagtacgcggatttttaggaaatcgtaaagtttatataaggttaaaaattatttatgcggcggatagtagttatacgcgaggggtaaaaagggtacggagaatattagcgtagaagcgagttattataagttttcgacgatttagaagttattattagtataatggcgcggtagtacgaaaaagcggagagacggtttattatagagagaaaattcgggtagttgttttatagttattggtttttagtagcggttttggcgtgttggcggtaaggtaggtttgcgatcggtttgtttttcgtttggtagcgttatgtaatttggtaggttttggatagtagttttaggttcgttagtttttgaatat

SEQ ID NO: 37906 - DNA, 649 bp, Artificial Sequence
  chemically treated genomic DNA (Homo sapiens) CpG-island No: 37906
atattcaaaaactaacgaacctaaaactactatccaaaacctaccaaattacataacgctaccaaacgaaaaacaaaccgatcgcaaacctaccttaccgccaacacgccaaaaccgctactaaaaaccaataactataaaacaactacccgaattttctctctataataaaccgtctctccgctttttcgtactaccgcgccattatactaataataacttctaaatcgtcgaaaacttataataactcgcttctacgctaatattctccgtaccctttttacccctcgcgtataactactatccgccgcataaataatttttaaccttatataaactttacgatttcctaaaaatccgcgtactttaccgtttttccgaaccccttaattcctaaaaattattacctaacaaaacgaaaaccgaaatacccaatccgaccgaaccataaccacaacttacgattaacattacgcgtaacatcactaaaacctaatcgaaccaaaccaattcgatataacgtctttttaatctacgaatcccttataaaaaaaacgaatcacttcgctaattaaacgaataacaacaaactaacgaaaataaataacaactcatccgactatccattaaaataacctacccgtcgtca

SEQ ID NO: 37907 - DNA, 649 bp, Artificial Sequence
  chemically treated genomic DNA (Homo sapiens) CpG-island No: 37907
atatttaggggttgacggatttggggttgttgtttagagtttgttaggttatatgacgttgttaagcgagaagtagatcgatcgtaaatttattttatcgttaatacgttaaaatcgttgttgaaggttagtaattatggggtaattattcgaattttttttttatgatggatcgttttttcgttttttcgtgttgtcgcgttattgtgttggtggtgatttttgggtcgtcggggatttgtggtggttcgtttttgcgttggtatttttcgtgttttttttgtttttcgcgtgtagttgttgttcgtcgtatgggtggtttttgattttgtgtgggttttacggttttttggaggttcgcgtgttttgtcgttttttcgggttttttggtttttgagggttgttgtttaataaggcgaagatcgaagtgtttaattcggtcgagttatggttatagtttgcggttggtattacgcgtggtattattgaggtttgatcgaattaggttaattcggtatagcgtttttttaatttgcgggttttttatagaagaagcggattatttcgttggttgggcgggtagtagtaagttggcgggagtgagtagtaatttattcggttgtttattgagataatttgttcgtcgtta

SEQ ID NO: 37908 - DNA, 649 bp, Artificial Sequence
  chemically treated genomic DNA (Homo sapiens) CpG-island No: 37908
taacgacgaacaaattatctcaataaacaaccgaataaattactactcactcccgccaacttactactacccgcccaaccaacgaaataatccgcttcttctataaaaaacccgcaaattaaaaaaacgctataccgaattaacctaattcgatcaaacctcaataataccacgcgtaataccaaccgcaaactataaccataactcgaccgaattaaacacttcgatcttcgccttattaaacaacaaccctcaaaaaccaaaaaacccgaaaaaacgacaaaacacgcgaacctccaaaaaaccgtaaaacccacacaaaatcaaaaaccacccatacgacgaacaacaactacacgcgaaaaacaaaaaaaacacgaaaaataccaacgcaaaaacgaaccaccacaaatccccgacgacccaaaaatcaccaccaacacaataacgcgacaacacgaaaaaacgaaaaaacgatccatcataaaaaaaaaattcgaataattaccccataattactaaccttcaacaacgattttaacgtattaacgataaaataaatttacgatcgatctacttctcgcttaacaacgtcatataacctaacaaactctaaacaacaaccccaaatccgtcaacccctaaatat

SEQ ID NO: 37909 - DNA, 1027 bp, Artificial Sequence
  chemically treated genomic DNA (Homo sapiens) CpG-island No: 37909
gtttatcgagaagcgtattcggaggcggttgaggggcgcgcggggtacgtagtagagtcgtagttcggttcggattcggagcgtcggagtcgtaggaaggcgaggagaaggaaaaaaaggaggttgtcgtcggtttttgttttattttttcgggtagcgttgattcgttggtcgtcgtcggatagggttggtcgtcgggcgcgggatttcgtgcgcgttgtttatgttttcgtttgtcgttggttaggtgtgcgcgtagtttgttggtttttgggcggtattcgggggttttttatgtttcgcgtcggggttcggcgggaggatttcggagaggtagcgcggagggaaagagagagagatagtatgagaacgcgtagagttgtatttcgcgggggtcgggcgttagtagtatcgcgttgttttatttacggcgcgtttgtttttcgcgttgcgcgtttagcggggcgtcgagttttagaaattttagtatatggtcggttcggcggttacggtggtcgtagttgttttgtttttcgagcgttttttattgttttttgttttaagttttagagcgtagtttattagcggcgatcgcgatcgtagcggcggggcgtttattcggtcgtaagtatagtagtgcgtatttgcgggaaaggaggaaggggttggcggcgtcggggtttttataggggaggggtatttcggcggtagtaatcggcgtaggttaaggtattttgggtcggggttgcgcgcgagttaggtggtggtaggtcgggattggggagggtttttgcgtttttcgtttcgcggcgtcgttgttgatgacgcgcgcgggttttttcggtttcgcgtttgcggagttagtttcgttatttagcgattcgtttcggggagttttcgttgacgcgcgttgcgagtcgggttgcggtagtcgaggggcggggagggaggggagggggagttttagtgcggggagggtcggcggttgcgggttaagttttttttttcgttttttttttcgcgttgg

SEQ ID NO: 37910 - DNA, 1027 bp, Artificial Sequence
  chemically treated genomic DNA (Homo sapiens) CpG-island No: 37910
ccaacgcgaaaaaaaaaacgaaaaaaaaaacttaacccgcaaccgccgaccctccccgcactaaaactccccctcccctccctccccgcccctcgactaccgcaacccgactcgcaacgcgcgtcaacgaaaactccccgaaacgaatcgctaaataacgaaactaactccgcaaacgcgaaaccgaaaaaacccgcgcgcgtcatcaacaacgacgccgcgaaacgaaaaacgcaaaaaccctccccaatcccgacctaccaccacctaactcgcgcgcaaccccgacccaaaataccttaacctacgccgattactaccgccgaaatacccctcccctataaaaaccccgacgccgccaaccccttcctcctttcccgcaaatacgcactactatacttacgaccgaataaacgccccgccgctacgatcgcgatcgccgctaataaactacgctctaaaacttaaaacaaaaaacaataaaaaacgctcgaaaaacaaaacaactacgaccaccgtaaccgccgaaccgaccatatactaaaatttctaaaactcgacgccccgctaaacgcgcaacgcgaaaaacaaacgcgccgtaaataaaacaacgcgatactactaacgcccgacccccgcgaaatacaactctacgcgttctcatactatctctctctctttccctccgcgctacctctccgaaatcctcccgccgaaccccgacgcgaaacataaaaaacccccgaataccgcccaaaaaccaacaaactacgcgcacacctaaccaacgacaaacgaaaacataaacaacgcgcacgaaatcccgcgcccgacgaccaaccctatccgacgacgaccaacgaatcaacgctacccgaaaaaataaaacaaaaaccgacgacaacctcctttttttccttctcctcgccttcctacgactccgacgctccgaatccgaaccgaactacgactctactacgtaccccgcgcgcccctcaaccgcctccgaatacgcttctcgataaac

SEQ ID NO: 37911 - DNA, 1027 bp, Artificial Sequence
  chemically treated genomic DNA (Homo sapiens) CpG-island No: 37911
ttaacgcggagagggaagcggagggaggagtttggttcgtagtcgtcggtttttttcgtattggagttttttttttttttttttttcgtttttcggttgtcgtagttcggttcgtagcgcgcgttagcgggggtttttcggagcgagtcgttaggtaacggggttggtttcgtagacgcggggtcggggaagttcgcgcgcgttattagtagcggcgtcgcggggcggggggcgtagagattttttttaatttcggtttgttattatttggttcgcgcgtagtttcggtttagaatgttttaatttgcgtcgattgttgtcgtcgaggtgttttttttttgtagggatttcgacgtcgttagttttttttttttttttcgtaggtgcgtattgttgtgtttgcggtcgggtgggcgtttcgtcgttgcggtcgcggtcgtcgttggtaagttgcgttttggggtttggggtaggaagtagtggggggcgttcgaagagtagggtagttacggttatcgtggtcgtcggatcggttatgtgttaaagtttttggggttcggcgtttcgttgggcgcgtagcgcggggagtagacgcgtcgtgggtggggtagcgcggtgttgttggcgttcggttttcgcggggtgtagttttgcgcgtttttatgttgttttttttttttttttttcgcgttgttttttcgaggttttttcgtcgagtttcggcgcggggtatgaggagttttcgggtgtcgtttagagattagtaggttgcgcgtatatttagttagcggtagacggggatatgagtagcgcgtacggggtttcgcgttcggcggttagttttattcggcggcggttagcgggttaacgttgttcgggagaatgaggtaggagtcggcggtagtttttttttttttttttttttcgtttttttgcggtttcggcgtttcgggttcgggtcgggttgcggttttgttgcgtgtttcgcgcgttttttaatcgttttcggatgcgtttttcggtaagt

SEQ ID NO: 37912 - DNA, 1027 bp, Artificial Sequence
  chemically treated genomic DNA (Homo sapiens) CpG-island No: 37912
acttaccgaaaaacgcatccgaaaacgattaaaaaacgcgcgaaacacgcaacaaaaccgcaacccgacccgaacccgaaacgccgaaaccgcaaaaaaacgaaaaaaaaaaaaaaaaaaaaactaccgccgactcctacctcattctcccgaacaacgttaacccgctaaccgccgccgaataaaactaaccgccgaacgcgaaaccccgtacgcgctactcatatccccgtctaccgctaactaaatatacgcgcaacctactaatctctaaacgacacccgaaaactcctcataccccgcgccgaaactcgacgaaaaaacctcgaaaaaacaacgcgaaaaaaaaaaaaaaaaaacaacataaaaacgcgcaaaactacaccccgcgaaaaccgaacgccaacaacaccgcgctaccccacccacgacgcgtctactccccgcgctacgcgcccaacgaaacgccgaaccccaaaaactttaacacataaccgatccgacgaccacgataaccgtaactaccctactcttcgaacgccccccactacttcctaccccaaaccccaaaacgcaacttaccaacgacgaccgcgaccgcaacgacgaaacgcccacccgaccgcaaacacaacaatacgcacctacgaaaaaaaaaaaaaaaactaacgacgtcgaaatccctacaaaaaaaaaacacctcgacgacaacaatcgacgcaaattaaaacattctaaaccgaaactacgcgcgaaccaaataataacaaaccgaaattaaaaaaaatctctacgccccccgccccgcgacgccgctactaataacgcgcgcgaacttccccgaccccgcgtctacgaaaccaaccccgttacctaacgactcgctccgaaaaacccccgctaacgcgcgctacgaaccgaactacgacaaccgaaaaacgaaaaaaaaaaaaaaaaaaaactccaatacgaaaaaaaccgacgactacgaaccaaactcctccctccgcttccctctccgcgttaa

SEQ ID NO: 37913 - DNA, 588 bp, Artificial Sequence
  chemically treated genomic DNA (Homo sapiens) CpG-island No: 37913
tacgcgaattataaggcgcgtttaatgaagtaatattggttatttcgataagtcgtttagcgacgcgttttttgggggtttggaatttttatcgggtttacgtcgttacggttacgttttttattcggattttatttttcgcgcgcgttttttaattcgggtaggtattcgattcgagtacgttcgggaggttttaattatcgaaatttttacgcgttattattttcgtttagaggaataattttttatttcgttttttcgattacgttttttatatttatcgcgttttcgttttatttagtttttttttttcgtttttcgtcgatttaatttttattattatattatatatgtttttttaatatatttttttataatttttttttattttttttattttttcgtttatattttttattatttattttttttttttttttatttttttttttattttttttttatttttttcgtttttttttttttattttatttcgttattttttttttatatttattttttttgtattttgtttttttttatttttttttttttatttttatttttttttttttattttttttttt

SEQ ID NO: 37914 - DNA, 588 bp, Artificial Sequence
  chemically treated genomic DNA (Homo sapiens) CpG-island No: 37914
aaaaaaaaaaataaaaaaaaaaaaataaaaataaaaaaaaaaaaataaaaaaaaacaaaatacaaaaaaaataaatataaaaaaaaaataacgaaataaaataaaaaaaaaaaaacgaaaaaaataaaaaaaaaataaaaaaaaaaataaaaaaaaaaaaaaaataaataataaaaaatataaacgaaaaaataaaaaaaataaaaaaaaattataaaaaaatatattaaaaaaacatatataatataataataaaaattaaatcgacgaaaaacgaaaaaaaaaaactaaataaaacgaaaacgcgataaatataaaaaacgtaatcgaaaaaacgaaataaaaaattattcctctaaacgaaaataataacgcgtaaaaatttcgataattaaaacctcccgaacgtactcgaatcgaatacctacccgaattaaaaaacgcgcgcgaaaaataaaatccgaataaaaaacgtaaccgtaacgacgtaaacccgataaaaattccaaacccccaaaaaacgcgtcgctaaacgacttatcgaaataaccaatattacttcattaaacgcgccttataattcgcgta

SEQ ID NO: 37915 - DNA, 588 bp, Artificial Sequence
  chemically treated genomic DNA (Homo sapiens) CpG-island No: 37915
gagaaagagagtaaggaggggagagtgaaggtagggaagaaagggtaagagagagtaaggtgtaagaagggtagatgtgaggagagaatggcggggtgggatggaggaggaaagacgagaaagatgagggagggataggaggaggggtgaggggagggaagagatgagtgatgggagatgtgagcggaggagtagggaaggtggagggaagttatgagggagtgtgttggagagatatatatggtatgatggtgagggttgggtcggcggggggcggggggggggagttgggtggagcggaggcgcggtgggtgtggggggcgtgatcgggggggcggggtggggggttatttttttgggcgggggtggtggcgcgtgagggtttcggtggttgggatttttcgggcgtgttcgagtcgagtgtttgttcggattggggggcgcgcgcgaggagtagggttcgagtggagggcgtggtcgtggcggcgtaggttcggtgggggttttaggtttttaagggacgcgtcgttaagcggtttgtcggagtggttagtgttattttattgggcgcgttttgtaattcgcgtg

SEQ ID NO: 37916 - DNA, 588 bp, Artificial Sequence
  chemically treated genomic DNA (Homo sapiens) CpG-island No: 37916
cacgcgaattacaaaacgcgcccaataaaataacactaaccactccgacaaaccgcttaacgacgcgtcccttaaaaacctaaaacccccaccgaacctacgccgccacgaccacgccctccactcgaaccctactcctcgcgcgcgccccccaatccgaacaaacactcgactcgaacacgcccgaaaaatcccaaccaccgaaaccctcacgcgccaccacccccgcccaaaaaaataaccccccaccccgcccccccgatcacgccccccacacccaccgcgcctccgctccacccaactccccccccccgccccccgccgacccaaccctcaccatcataccatatatatctctccaacacactccctcataacttccctccaccttccctactcctccgctcacatctcccatcactcatctcttccctcccctcacccctcctcctatccctccctcatctttctcgtctttcctcctccatcccaccccgccattctctcctcacatctacccttcttacaccttactctctcttaccctttcttccctaccttcactctcccctccttactctctttctc

SEQ ID NO: 37917 - DNA, 677 bp, Artificial Sequence
  chemically treated genomic DNA (Homo sapiens) CpG-island No: 37917
gtttcgcgatttcggcgtcgtttgcggttggattttttggtagcgggcgcggcgttagttaggacgacggtttcggaagtttttcgggcgcgtgagattcgggtcgtttttcgtttacgtacgattttttttttaggcgcgttttttatttcggtttcgcgtttcgtttagttcgggtgattaattatattttattttaaaggtttttacgttcgggcgtgtttttcgttcgttcgcggtaggtgggggtgtagggcggagggcgcgggcggttttagaaggcgttcggattttttcgagaatttcgggtcgcgtaggcgtattgaggtcggcgcgggggcgtgcgagaggcgcgcggcggcgattgagggaaggttgttcgggtcgggttacgagtagggtttgcgcgcgttcgtaggaaggcgcgggggcggggtgtcgcggtaacggcgtatgcgtaggcgcgcggtcgcggcggcggttggggagggttttttcggaaggttcgggaggtttttggaaaaagcgtcgcgcgttgggcgggttcgtcgttatataaggtaggcgcgggggtggcgcgttagttgttttagcgtttcggtgtggttgtgtcgttggttttgtgcggttatttagttaaggtgacgggtggttgtgggggtttgtggaggtggatt

SEQ ID NO: 37918 - DNA, 677 bp, Artificial Sequence
  chemically treated genomic DNA (Homo sapiens) CpG-island No: 37918
aatccacctccacaaacccccacaaccacccgtcaccttaactaaataaccgcacaaaaccaacgacacaaccacaccgaaacgctaaaacaactaacgcgccacccccgcgcctaccttatataacgacgaacccgcccaacgcgcgacgctttttccaaaaacctcccgaaccttccgaaaaaaccctccccaaccgccgccgcgaccgcgcgcctacgcatacgccgttaccgcgacaccccgcccccgcgccttcctacgaacgcgcgcaaaccctactcgtaacccgacccgaacaaccttccctcaatcgccgccgcgcgcctctcgcacgcccccgcgccgacctcaatacgcctacgcgacccgaaattctcgaaaaaatccgaacgccttctaaaaccgcccgcgccctccgccctacacccccacctaccgcgaacgaacgaaaaacacgcccgaacgtaaaaacctttaaaataaaatataattaatcacccgaactaaacgaaacgcgaaaccgaaataaaaaacgcgcctaaaaaaaaaatcgtacgtaaacgaaaaacgacccgaatctcacgcgcccgaaaaacttccgaaaccgtcgtcctaactaacgccgcgcccgctaccaaaaaatccaaccgcaaacgacgccgaaatcgcgaaac

SEQ ID NO: 37919 - DNA, 677 bp, Artificial Sequence
  chemically treated genomic DNA (Homo sapiens) CpG-island No: 37919
agtttatttttataggtttttataattattcgttattttggttaagtgatcgtataggattaacggtatagttatatcgggacgttgaagtaattgacgcgttattttcgcgtttgttttatatagcgacgggttcgtttagcgcgcggcgttttttttagaagtttttcgaatttttcggaagaattttttttagtcgtcgtcgcggtcgcgcgtttacgtatgcgtcgttgtcgcggtatttcgttttcgcgtttttttgcgggcgcgcgtaggttttgttcgtggttcggttcgggtaatttttttttaatcgtcgtcgcgcgtttttcgtacgttttcgcgtcggttttaatgcgtttgcgcggttcggaattttcgggaaggttcgggcgttttttggggtcgttcgcgtttttcgttttgtatttttatttgtcgcgggcgggcggagggtacgttcgggcgtgggggtttttgaagtgaggtgtagttggttattcgggttgagcggaacgcggggtcggggtgggaggcgcgtttggagggagggtcgtgcgtggacggagagcggttcgggttttacgcgttcgggagattttcggagtcgtcgttttgattggcgtcgcgttcgttgttaaagaatttagtcgtaagcggcgtcgggatcgcggggt

SEQ ID NO: 37920 - DNA, 677 bp, Artificial Sequence
  chemically treated genomic DNA (Homo sapiens) CpG-island No: 37920
accccgcgatcccgacgccgcttacgactaaattctttaacaacgaacgcgacgccaatcaaaacgacgactccgaaaatctcccgaacgcgtaaaacccgaaccgctctccgtccacgcacgaccctccctccaaacgcgcctcccaccccgaccccgcgttccgctcaacccgaataaccaactacacctcacttcaaaaacccccacgcccgaacgtaccctccgcccgcccgcgacaaataaaaatacaaaacgaaaaacgcgaacgaccccaaaaaacgcccgaaccttcccgaaaattccgaaccgcgcaaacgcattaaaaccgacgcgaaaacgtacgaaaaacgcgcgacgacgattaaaaaaaaattacccgaaccgaaccacgaacaaaacctacgcgcgcccgcaaaaaaacgcgaaaacgaaataccgcgacaacgacgcatacgtaaacgcgcgaccgcgacgacgactaaaaaaaattcttccgaaaaattcgaaaaacttctaaaaaaaacgccgcgcgctaaacgaacccgtcgctatataaaacaaacgcgaaaataacgcgtcaattacttcaacgtcccgatataactataccgttaatcctatacgatcacttaaccaaaataacgaataattataaaaacctataaaaataaact

SEQ ID NO: 37921 - DNA, 501 bp, Artificial Sequence
  chemically treated genomic DNA (Homo sapiens) CpG-island No: 37921
  misc_feature (14)..(15): n is either a, c, g or t
  misc_feature (41)..(41): n is either a, c, g or t
  misc_feature (444)..(444): n is either a, c, g or t
  misc_feature (480)..(480): n is either a, c, g or t
gcgcgcgtcgcgtnncggtttcgcgtttttttcgtttcggnttttcgcgttcgcgcgcggcgtcgcgttcgcgtcgcggttcgcgcggcgtttcgtttttttttcgttcggcgcgttttcgcgtttttttcgggtcggtcgggttttcgtgttttttcgcgtcggcgcgcgtttttttgtttttttcgtttcgggttttttttttttttttttttttttttttttttttgtttttttttttttcgtttttcgtttttttttgtcgttttttttttttttttttttcgttttttttttgttttttttttttttttttttttttttttttttttttttcgtcgttttcgtgtcgttttttttttcgttttgttcgtcgtgtcgttttcgtgttttatttcgtttttttttttcgttgtgttttcgttttcgttttttcgtcggtgngtttttttttcggcgtttagttttttttgtcgtttncgggtgtttttttcgtcgttg

SEQ ID NO: 37922 - DNA, 501 bp, Artificial Sequence
  chemically treated genomic DNA (Homo sapiens) CpG-island No: 37922
  misc_feature (22)..(22): n is either a, c, g or t
  misc_feature (58)..(58): n is either a, c, g or t
  misc_feature (461)..(461): n is either a, c, g or t
  misc_feature (487)..(488): n is either a, c, g or t
caacgacgaaaaaaacacccgnaaacgacaaaaaaaactaaacgccgaaaaaaaaacncaccgacgaaaaaacgaaaacgaaaacacaacgaaaaaaaaaaacgaaataaaacacgaaaacgacacgacgaacaaaacgaaaaaaaaaacgacacgaaaacgacgaaaaaaaaaaaaaaaaaaaaaaaaaaaaaaaaaaaaaacaaaaaaaaaacgaaaaaaaaaaaaaaaaaaaacgacaaaaaaaaacgaaaaacgaaaaaaaaaaaaacaaaaaaaaaaaaaaaaaaaaaaaaaaaaaaaaaacccgaaacgaaaaaaacaaaaaaacgcgcgccgacgcgaaaaaacacgaaaacccgaccgacccgaaaaaaacgcgaaaacgcgccgaacgaaaaaaaaacgaaacgccgcgcgaaccgcgacgcgaacgcgacgccgcgcgcgaacgcgaaaanccgaaacgaaaaaaacgcgaaaccgnnacgcgacgcgcgc

SEQ ID NO: 37923 - DNA, 501 bp, Artificial Sequence
  chemically treated genomic DNA (Homo sapiens) CpG-island No: 37923
  misc_feature (22)..(22): n is either a, c, g or t
  misc_feature (58)..(58): n is either a, c, g or t
  misc_feature (461)..(461): n is either a, c, g or t
  misc_feature (487)..(488): n is either a, c, g or t
taacgacgggaggggtattcgngggcggtaggaagaattggacgtcggaaaagaggtntatcggcgaggggacgggaacgagggtatagcgaggaaagagagcgaagtggggtacgagggcgatacggcgaataaagcggaagaagaaacgatacgggggcgacgaggaggaggagagggaaaagggagggggagggaaagagtagggggagggcgggagggaaaggggagagaggcgatagagaagaacgggagacgagggaggggagggtagggaggggggagggagggaagaaagagggaagattcggggcggggagagtaagggggcgcgcgtcggcgcgggggggtacgggggttcggtcggttcggggggggcgcgggggcgcgtcgggcgaggggggggcggggcgtcgcgcgggtcgcggcgcgggcgcggcgtcgcgcgcgggcgcgggggntcggggcggggggggcgcggggtcgnngcgcggcgcgcgt

SEQ ID NO: 37924 - DNA, 501 bp, Artificial Sequence
  chemically treated genomic DNA (Homo sapiens) CpG-island No: 37924
  misc_feature (14)..(15): n is either a, c, g or t
  misc_feature (41)..(41): n is either a, c, g or t
  misc_feature (444)..(444): n is either a, c, g or t
  misc_feature (480)..(480): n is either a, c, g or t
acgcgcgccgcgcnncgaccccgcgccccccccgccccgancccccgcgcccgcgcgcgacgccgcgcccgcgccgcgacccgcgcgacgccccgcccccccctcgcccgacgcgcccccgcgccccccccgaaccgaccgaacccccgtacccccccgcgccgacgcgcgcccccttactctccccgccccgaatcttccctctttcttccctccctcccccctccctaccctcccctccctcgtctcccgttcttctctatcgcctctctcccctttccctcccgccctccccctactctttccctccccctcccttttccctctcctcctcctcgtcgcccccgtatcgtttcttcttccgctttattcgccgtatcgccctcgtaccccacttcgctctctttcctcgctataccctcgttcccgtcccctcgccgatanacctcttttccgacgtccaattcttcctaccgcccncgaatacccctcccgtcgtta

SEQ ID NO: 37925 - DNA, 582 bp, Artificial Sequence
  chemically treated genomic DNA (Homo sapiens) CpG-island No: 37925
  misc_feature (107)..(107): n is either a, c, g or t
  misc_feature (302)..(302): n is either a, c, g or t
  misc_feature (373)..(373): n is either a, c, g or t
  misc_feature (444)..(444): n is either a, c, g or t
gtttaagaaaatttcgcgtaggatcgcgttcgttttcgcgttcgcgttcgttttcgttttttcgcgttcgttttttcgcgttcgttttttcgcgttcgtcgtttcgngttcggttttcgcggttttttttttttcgtggtgttttttttcgttttcgtttttgcgttttcggttttgtcgtttttcgtttttcgtttttgtttttcgttttttttttttttcgcgtcgttttttcgttttttcgttgtttttttcgttttttttttttttttttttttttttcgttttgttcgtttcgtttntttcgcgtgttttttgttgtgttttttcgtttcgcgttcggtttcgttttttgtttttggtttttgttttnttttcgttttgcgcgttttttttcgttttttcgcggttcgtcgggcgcggtgtgcgttttttttttttttnttttttttcgtttttgttttttttgtttttttttttttttttttttcgtttgtttttttttgtgtttgttttttttttttttttcgttttttttcgtttttttttttgtttttttttttttgttttgttttttttttt

SEQ ID NO: 37926 - DNA, 582 bp, Artificial Sequence
  chemically treated genomic DNA (Homo sapiens) CpG-island No: 37926
  misc_feature (139)..(139): n is either a, c, g or t
  misc_feature (210)..(210): n is either a, c, g or t
  misc_feature (281)..(281): n is either a, c, g or t
  misc_feature (476)..(476): n is either a, c, g or t
aaaaaaaaaaacaaaacaaaaaaaaaaaaacaaaaaaaaaaacgaaaaaaaacgaaaaaaaaaaaaaaaacaaacacaaaaaaaaacaaacgaaaaaaaaaaaaaaaaaaaaacaaaaaaaacaaaaacgaaaaaaaanaaaaaaaaaaaaaacgcacaccgcgcccgacgaaccgcgaaaaaacgaaaaaaaacgcgcaaaacgaaaanaaaacaaaaaccaaaaacaaaaaacgaaaccgaacgcgaaacgaaaaaacacaacaaaaaacacgcgaaanaaacgaaacgaacaaaacgaaaaaaaaaaaaaaaaaaaaaaaaaacgaaaaaaacaacgaaaaaacgaaaaaacgacgcgaaaaaaaaaaaaaacgaaaaacaaaaacgaaaaacgaaaaacgacaaaaccgaaaacgcaaaaacgaaaacgaaaaaaaacaccacgaaaaaaaaaaaaccgcgaaaaccgaacncgaaacgacgaacgcgaaaaaacgaacgcgaaaaaacgaacgcgaaaaaacgaaaacgaacgcgaacgcgaaaacgaacgcgatcctacgcgaaattttcttaaac

SEQ ID NO: 37927 - DNA, 582 bp, Artificial Sequence
  chemically treated genomic DNA (Homo sapiens) CpG-island No: 37927
  misc_feature (139)..(139): n is either a, c, g or t
  misc_feature (210)..(210): n is either a, c, g or t
  misc_feature (281)..(281): n is either a, c, g or t
  misc_feature (476)..(476): n is either a, c, g or t
gggagaagggataaaataggggggagggggtagagaaggaaacggggaggagcgaggggagaaggaagggtaaatatagaaagggataaacgagagggagaaaggaaaagaggtaaaaaaaataggagcggggggaggnagaaagagaggaaacgtatatcgcgttcgacggatcgcggagagacgagagagaacgcgtagggcgaaganaaaataagagttaggagtaggggacgaaatcgaacgcgaagcggaagggtatagtaaaaagtacgcgaganaagcgaggcgggtagggcggggagggggggagagggaggggagggcggagggagtagcggagaagcggggggacgacgcgaaaaaaaggaaaggcgaaaggtaaggacgggggacgaaagacgatagggtcgagagcgtaggggcgggggcgggaggaaatattacggaaaaaaaaaggtcgcgggggtcgggtncggggcggcgggcgcgagggggcgggcgcgagggggcgggcgcgagggggcgggggcgggcgcgggcgcgggggcgggcgcggttttgcgcggggtttttttaaat

SEQ ID NO: 37928 - DNA, 582 bp, Artificial Sequence
  chemically treated genomic DNA (Homo sapiens) CpG-island No: 37928
  misc_feature (107)..(107): n is either a, c, g or t
  misc_feature (302)..(302): n is either a, c, g or t
  misc_feature (373)..(373): n is either a, c, g or t
  misc_feature (444)..(444): n is either a, c, g or t
atttaaaaaaaccccgcgcaaaaccgcgcccgcccccgcgcccgcgcccgcccccgccccctcgcgcccgccccctcgcgcccgccccctcgcgcccgccgccccgnacccgacccccgcgacctttttttttccgtaatatttcctcccgcccccgcccctacgctctcgaccctatcgtctttcgtcccccgtccttacctttcgcctttcctttttttcgcgtcgtccccccgcttctccgctactccctccgccctcccctccctctccccccctccccgccctacccgcctcgcttntctcgcgtactttttactatacccttccgcttcgcgttcgatttcgtcccctactcctaactcttattttntcttcgccctacgcgttctctctcgtctctccgcgatccgtcgaacgcgatatacgtttcctctctttctncctccccccgctcctattttttttacctcttttcctttctccctctcgtttatccctttctatatttacccttccttctcccctcgctcctccccgtttccttctctaccccctcccccctattttatcccttctccc

SEQ ID NO: 37929 - DNA, 924 bp, Artificial Sequence
  chemically treated genomic DNA (Homo sapiens) CpG-island No: 37929
gtattttcgtgcgttgtttttttgtacgttttcgtttagtttcgatttttcgttttcgggcgtgggtttttttacgtttttattttcgttcgtatttttttaacgttttacgttattttgtttggcggcggttttagtcgattttgggttcggggaaaagaggttcgcgtttttttcgcggtagttttgttttttagtagtcggatagtttttatttaaagttagtcgtttttttagtttttcgttttttaggcggggttttcgtttttattttggcggttgcgcgggcgttcgggggttttatatgtcggggaggagcgttcggcgttggagtaaaagtttgcgcgtcggttgggtttttcgggtcgttgagtagaggattaggagcggcgttttcgtacggggcgtagggcgcggtggtttcggattgcgtttagtcgcgcgcggggcgggaggggcggtatttcgtttttagggttagggttggtcgtcgaggcggaggtagagggcggggaaagttttttttacgtcgtttggagtcggtcgcgcgagtttttttcgggttcgcgttggtttttcgttttttttggtggcgtcgcgcggttgttcggggtattggggtgttcgagttttttattatttttacgttggttcgcgagaggtagcggcgggaggcgtcggtagggagttttcgttggggtagtaaagtcgtgggtggaggcgaaataaataatttacgaaaaaggaaaatagacgtgagtcgagttagagtttttttcgtttttcgttcggggttgcgtttttttcgtcgtcgtcgttagcgtcgttgtagtgatttttcgtttttatttagcgaggttattgtgtattgggcgtttaattatttatttattttggaggtcgaggatttttatttttatgggg

SEQ ID NO: 37930 - DNA, 924 bp, Artificial Sequence
  chemically treated genomic DNA (Homo sapiens) CpG-island No: 37930
ccccataaaaataaaaatcctcgacctccaaaataaataaataattaaacgcccaatacacaataacctcgctaaataaaaacgaaaaatcactacaacgacgctaacgacgacgacgaaaaaaacgcaaccccgaacgaaaaacgaaaaaaactctaactcgactcacgtctattttcctttttcgtaaattatttatttcgcctccacccacgactttactaccccaacgaaaactccctaccgacgcctcccgccgctacctctcgcgaaccaacgtaaaaataataaaaaactcgaacaccccaataccccgaacaaccgcgcgacgccaccaaaaaaaacgaaaaaccaacgcgaacccgaaaaaaactcgcgcgaccgactccaaacgacgtaaaaaaaactttccccgccctctacctccgcctcgacgaccaaccctaaccctaaaaacgaaataccgcccctcccgccccgcgcgcgactaaacgcaatccgaaaccaccgcgccctacgccccgtacgaaaacgccgctcctaatcctctactcaacgacccgaaaaacccaaccgacgcgcaaacttttactccaacgccgaacgctcctccccgacatataaaacccccgaacgcccgcgcaaccgccaaaataaaaacgaaaaccccgcctaaaaaacgaaaaactaaaaaaacgactaactttaaataaaaactatccgactactaaaaaacaaaactaccgcgaaaaaaacgcgaacctcttttccccgaacccaaaatcgactaaaaccgccgccaaacaaaataacgtaaaacgttaaaaaaatacgaacgaaaataaaaacgtaaaaaaacccacgcccgaaaacgaaaaatcgaaactaaacgaaaacgtacaaaaaaacaacgcacgaaaatac

SEQ ID NO: 37931 - DNA, 924 bp, Artificial Sequence
  chemically treated genomic DNA (Homo sapiens) CpG-island No: 37931
ttttatggaagtgggaattttcggtttttagggtgaataaataattaagcgtttaatatataatagtttcgttagatggagacgaggaattattgtagcggcgttggcggcggcggcggggggagcgtaatttcgggcgggaggcgggagaggttttggttcggtttacgtttgtttttttttttcgtggattatttatttcgtttttatttacggttttgttgttttagcgggagttttttgtcggcgtttttcgtcgttgtttttcgcgggttagcgtgagggtagtagagagttcgggtattttagtgtttcgggtagtcgcgcggcgttattaggaaaggcggggagttaacgcgggttcggggagggttcgcgcggtcggttttaggcggcgtggaggagatttttttcgttttttgttttcgtttcggcggttagttttggttttgggagcggggtgtcgtttttttcgtttcgcgcgcggttaggcgtagttcggagttatcgcgttttgcgtttcgtgcgaggacgtcgtttttggttttttgtttagcggttcgggaggtttaatcggcgcgtaaatttttgttttagcgtcgggcgttttttttcggtatgtgaagttttcgggcgttcgcgtagtcgttaaggtgaggacggaggtttcgtttagagggcgggggattggggaggcggttggttttaaatgggggttgttcggttgttgggaaatagagttgtcgcggggggaacgcggatttttttttttcgagtttagggtcggttggggtcgtcgttaggtaaggtagcgtgaggcgttggaagggtgcgggcggagatggaggcgtgggggaatttacgttcgggagcgggagatcggggttgggcggaggcgtgtaaaggggtagcgtacggaggtgt

SEQ ID NO: 37932 - DNA, 924 bp, Artificial Sequence
  chemically treated genomic DNA (Homo sapiens) CpG-island No: 37932
acacctccgtacgctacccctttacacgcctccgcccaaccccgatctcccgctcccgaacgtaaattcccccacgcctccatctccgcccgcacccttccaacgcctcacgctaccttacctaacgacgaccccaaccgaccctaaactcgaaaaaaaaaaatccgcgttccccccgcgacaactctatttcccaacaaccgaacaacccccatttaaaaccaaccgcctccccaatcccccgccctctaaacgaaacctccgtcctcaccttaacgactacgcgaacgcccgaaaacttcacataccgaaaaaaaacgcccgacgctaaaacaaaaatttacgcgccgattaaacctcccgaaccgctaaacaaaaaaccaaaaacgacgtcctcgcacgaaacgcaaaacgcgataactccgaactacgcctaaccgcgcgcgaaacgaaaaaaacgacaccccgctcccaaaaccaaaactaaccgccgaaacgaaaacaaaaaacgaaaaaaatctcctccacgccgcctaaaaccgaccgcgcgaaccctccccgaacccgcgttaactccccgcctttcctaataacgccgcgcgactacccgaaacactaaaatacccgaactctctactaccctcacgctaacccgcgaaaaacaacgacgaaaaacgccgacaaaaaactcccgctaaaacaacaaaaccgtaaataaaaacgaaataaataatccacgaaaaaaaaaaacaaacgtaaaccgaaccaaaacctctcccgcctcccgcccgaaattacgctccccccgccgccgccgccaacgccgctacaataattcctcgtctccatctaacgaaactattatatattaaacgcttaattatttattcaccctaaaaaccgaaaattcccacttccataaaa

SEQ ID NO: 37933 - DNA, 783 bp, Artificial Sequence
  chemically treated genomic DNA (Homo sapiens) CpG-island No: 37933
cgttcgcggaaaaacgaaaacgttttttcgtttcgggtaggaaggggttgggagggggggttggcgtttcgttttagcgtcgtttgttcgatggggtttcgtttttttgcgcgcgtttttcgtttttttttttcggggcggcggcggcggcgtaggggaaggggcgggtaggggtcgtcgtcggtttttttttttatcgtttcgcgttagtttagtcgagtcgagtcgagtcgagcgggcgtcgcgtcgggttttcgtcgtagtcgcgtttttcggtatttagcgagcgagtgggtaggcgggcgggcgaggtagtcgcgggggtcgggttcggcgtttttttcgtcgttcgtagcgttttcgggcgggcgcgggtcgcgatggtagcggcggagtagggttgagttcgttgttcgttcgtagttttcggtttcgttggttttagttatggcgaagtagtacgatgtgttgtttcggttgttgttgatcggggatttcggggtgggtaagatttgtttgttgtgtcgttttatcgataacgagttttatttttcgtatatttttattatcggtaaggggcggtggttcggggcgttttttttttttcgttcgcggttttttttttcgtcgttttcgtttttagttggggaggaattgttagttttttcggttggaggcggtggcgtcggaggtcggagttcgggataaatttcggggtgagtataggttttggtaggtgagggtgtttttgttgtttgtcgttcggattaggggtggggtttt

SEQ ID NO: 37934 - DNA, 783 bp, Artificial Sequence
  chemically treated genomic DNA (Homo sapiens) CpG-island No: 37934
aaaaccccacccctaatccgaacgacaaacaacaaaaacaccctcacctaccaaaacctatactcaccccgaaatttatcccgaactccgacctccgacgccaccgcctccaaccgaaaaaactaacaattcctccccaactaaaaacgaaaacgacgaaaaaaaaaaccgcgaacgaaaaaaaaaaaacgccccgaaccaccgccccttaccgataataaaaatatacgaaaaataaaactcgttatcgataaaacgacacaacaaacaaatcttacccaccccgaaatccccgatcaacaacaaccgaaacaacacatcgtactacttcgccataactaaaaccaacgaaaccgaaaactacgaacgaacaacgaactcaaccctactccgccgctaccatcgcgacccgcgcccgcccgaaaacgctacgaacgacgaaaaaaacgccgaacccgacccccgcgactacctcgcccgcccgcctacccactcgctcgctaaataccgaaaaacgcgactacgacgaaaacccgacgcgacgcccgctcgactcgactcgactcgactaaactaacgcgaaacgataaaaaaaaaaaccgacgacgacccctacccgccccttcccctacgccgccgccgccgccccgaaaaaaaaaaacgaaaaacgcgcgcaaaaaaacgaaaccccatcgaacaaacgacgctaaaacgaaacgccaaccccccctcccaaccccttcctacccgaaacgaaaaaacgttttcgtttttccgcgaacg

SEQ ID NO: 37935 - DNA, 783 bp, Artificial Sequence
  chemically treated genomic DNA (Homo sapiens) CpG-island No: 37935
gagattttatttttggttcggacggtaggtagtagggatatttttatttgttaaaatttatgtttatttcgagatttatttcggatttcggttttcggcgttatcgtttttagtcggaggggttggtaatttttttttagttggggacgggggcggcggggaaaggggtcgcgggcggggagggaggggcgtttcgggttatcgttttttatcgatggtggagatgtgcgaggagtggaattcgttgtcggtgaagcggtatagtaggtaggttttgtttatttcggagttttcgattagtagtagtcggaatagtatatcgtattgtttcgttatgattggggttagcggggtcgggaattgcgggcgggtagcgggtttagttttgtttcgtcgttgttatcgcggttcgcgttcgttcggggacgttgcgggcggcgaggaggacgtcgggttcggttttcgcggttgtttcgttcgttcgtttgtttattcgttcgttgggtgtcgggaagcgcggttgcggcgggagttcggcgcggcgttcgttcggttcggttcggttcggttgggttggcgcgaggcggtgggaggagaaatcggcggcggtttttgttcgtttttttttttgcgtcgtcgtcgtcgtttcggagagagggggcggggagcgcgcgtaggagagcgggattttatcgagtaggcgacgttggggcggggcgttagtttttttttttaatttttttttgttcggggcgggggaacgttttcgttttttcgcggacg

SEQ ID NO: 37936 - DNA, 783 bp, Artificial Sequence
  chemically treated genomic DNA (Homo sapiens) CpG-island No: 37936
cgtccgcgaaaaaacgaaaacgttcccccgccccgaacaaaaaaaaattaaaaaaaaaaactaacgccccgccccaacgtcgcctactcgataaaatcccgctctcctacgcgcgctccccgccccctctctccgaaacgacgacgacgacgcaaaaaaaaaaacgaacaaaaaccgccgccgatttctcctcccaccgcctcgcgccaacccaaccgaaccgaaccgaaccgaacgaacgccgcgccgaactcccgccgcaaccgcgcttcccgacacccaacgaacgaataaacaaacgaacgaacgaaacaaccgcgaaaaccgaacccgacgtcctcctcgccgcccgcaacgtccccgaacgaacgcgaaccgcgataacaacgacgaaacaaaactaaacccgctacccgcccgcaattcccgaccccgctaaccccaatcataacgaaacaatacgatatactattccgactactactaatcgaaaactccgaaataaacaaaacctacctactataccgcttcaccgacaacgaattccactcctcgcacatctccaccatcgataaaaaacgataacccgaaacgcccctccctccccgcccgcgacccctttccccgccgcccccgtccccaactaaaaaaaaattaccaacccctccgactaaaaacgataacgccgaaaaccgaaatccgaaataaatctcgaaataaacataaattttaacaaataaaaatatccctactacctaccgtccgaaccaaaaataaaatctc

SEQ ID NO: 37937 - DNA, 581 bp, Artificial Sequence
  chemically treated genomic DNA (Homo sapiens) CpG-island No: 37937
cgcgttggaattcggcgtttagttgcgtttgggatttacgcgtcgcgttcgaagttcgttagcgacgtttagagagtagggttcgcgtcggttttcgaggagacgttgttttcggtataatttttttttatttttgcggtcgcggcggcgttgagaagtagttgttttttttttatttttagtatttaacgttatttcgtagtattttcgatcgttcggcgcggttttttagggcgtcgaacgaagttttcgcgttagtcgcggtttaagtagttagggttcggtcggtttaacggttttttatgcgttcgcgcggggcgtttatttggtcgggtttacggtttttttttttcgtagcgcgcgcgggttcgacgtttgttatttattcgttttagttcggcgttttcggtttcgagttcgtagttttttttaagttaggtttttagtacgttttttcgtagttatttcgtttttgttttcgttggcgcgtttggaagaagaggcgggagagagcgagagagagcggagacgcgatatagtagggcggatttttttatatatatttttgaaaaaataaaaat

SEQ ID NO: 37938 - DNA, 581 bp, Artificial Sequence
  chemically treated genomic DNA (Homo sapiens) CpG-island No: 37938
atttttattttttcaaaaatatatataaaaaaatccgccctactatatcgcgtctccgctctctctcgctctctcccgcctcttcttccaaacgcgccaacgaaaacaaaaacgaaataactacgaaaaaacgtactaaaaacctaacttaaaaaaaactacgaactcgaaaccgaaaacgccgaactaaaacgaataaataacaaacgtcgaacccgcgcgcgctacgaaaaaaaaaaaccgtaaacccgaccaaataaacgccccgcgcgaacgcataaaaaaccgttaaaccgaccgaaccctaactacttaaaccgcgactaacgcgaaaacttcgttcgacgccctaaaaaaccgcgccgaacgatcgaaaatactacgaaataacgttaaatactaaaaataaaaaaaaaacaactacttctcaacgccgccgcgaccgcaaaaataaaaaaaaattataccgaaaacaacgtctcctcgaaaaccgacgcgaaccctactctctaaacgtcgctaacgaacttcgaacgcgacgcgtaaatcccaaacgcaactaaacgccgaattccaacgcg

SEQ ID NO: 37939 - DNA, 581 bp, Artificial Sequence
  chemically treated genomic DNA (Homo sapiens) CpG-island No: 37939
gtttttatttttttagaaatatgtataagagggttcgttttattatgtcgcgttttcgttttttttcgttttttttcgtttttttttttaggcgcgttagcgggggtaagagcgaggtggttgcgaggaggcgtattgaaagtttgatttggggaaggttgcgggttcggagtcggagacgtcgagttggggcgggtgagtggtaggcgtcgggttcgcgcgcgttgcgggaggggagagtcgtgggttcggttaggtgggcgtttcgcgcgggcgtatggggagtcgttgggtcggtcgagttttggttgtttgagtcgcggttggcgcgggaatttcgttcggcgttttgggagatcgcgtcgagcggtcggaggtgttgcgggatggcgttgggtgttgggaatgggaagggaatagttgttttttagcgtcgtcgcggtcgtagaagtggaaaaaagttgtgtcgggaatagcgttttttcggaagtcggcgcgagttttgttttttgggcgtcgttggcgggtttcggacgcggcgcgtgggttttaggcgtagttgggcgtcgggttttagcgcg

SEQ ID NO: 37940 - DNA, 581 bp, Artificial Sequence
  chemically treated genomic DNA (Homo sapiens) CpG-island No: 37940
cgcgctaaaacccgacgcccaactacgcctaaaacccacgcgccgcgtccgaaacccgccaacgacgcccaaaaaacaaaactcgcgccgacttccgaaaaaacgctattcccgacacaacttttttccacttctacgaccgcgacgacgctaaaaaacaactattcccttcccattcccaacacccaacgccatcccgcaacacctccgaccgctcgacgcgatctcccaaaacgccgaacgaaattcccgcgccaaccgcgactcaaacaaccaaaactcgaccgacccaacgactccccatacgcccgcgcgaaacgcccacctaaccgaacccacgactctcccctcccgcaacgcgcgcgaacccgacgcctaccactcacccgccccaactcgacgtctccgactccgaacccgcaaccttccccaaatcaaactttcaatacgcctcctcgcaaccacctcgctcttacccccgctaacgcgcctaaaaaaaaaaacgaaaaaaaacgaaaaaaaacgaaaacgcgacataataaaacgaaccctcttatacatatttctaaaaaaataaaaac

SEQ ID NO: 37941 - DNA, 582 bp, Artificial Sequence
  chemically treated genomic DNA (Homo sapiens) CpG-island No: 37941
tcggtttttatatttaattttttcggtttcgggtttaagacgcgtgcgcgtatatttcgttgttgtgggcgggtattggggcggggcgatatcgggggtttattgtttggggaggggcgcgcgcgagtttagggttaacggacgcgcgggcggcgcgggggcgcgggggcgcgggggcgttggggttggaggggcggggcgcgcgcgttttttcgttggcggagcggttgggcggcgggtcgggttcggggtcgtttggaatggcgtttttttcgttttcgttttaattgttttttttggtagttttcgcgaggtttttgggttttagcgaggtaaggtgattcgtttttgggaaggtttcggttcgcgagtttaaagcgttttgttaaaagttcgttttggaaggagtggcgcgtcgagggggacgcggagttttttcgttggcgggttgggtttggggagagagagggtagggtttcgtcgcgtttagcgttttaatttttcgttttggatttataggtgatggttggatcggcggaggaggcgggagtttattgtttcgagagtttgtggtttttgttt

SEQ ID NO: 37942 - DNA, 582 bp, Artificial Sequence
  chemically treated genomic DNA (Homo sapiens) CpG-island No: 37942
aaacaaaaaccacaaactctcgaaacaataaactcccgcctcctccgccgatccaaccatcacctataaatccaaaacgaaaaattaaaacgctaaacgcgacgaaaccctaccctctctctccccaaacccaacccgccaacgaaaaaactccgcgtccccctcgacgcgccactccttccaaaacgaacttttaacaaaacgctttaaactcgcgaaccgaaaccttcccaaaaacgaatcaccttacctcgctaaaacccaaaaacctcgcgaaaactaccaaaaaaaacaattaaaacgaaaacgaaaaaaacgccattccaaacgaccccgaacccgacccgccgcccaaccgctccgccaacgaaaaaacgcgcgcgccccgcccctccaaccccaacgcccccgcgcccccgcgcccccgcgccgcccgcgcgtccgttaaccctaaactcgcgcgcgcccctccccaaacaataaacccccgatatcgccccgccccaatacccgcccacaacaacgaaatatacgcgcacgcgtcttaaacccgaaaccgaaaaaattaaatataaaaaccga

SEQ ID NO: 37943 - DNA, 582 bp, Artificial Sequence
  chemically treated genomic DNA (Homo sapiens) CpG-island No: 37943
aggtagaggttataggttttcgggataatgggttttcgtttttttcgtcggtttagttattatttgtgggtttaaagcgaagagttggggcgttggacgcggcgaggttttgttttttttttttttaggtttagttcgttagcggaagaatttcgcgtttttttcggcgcgttattttttttaggacgaatttttggtaaagcgttttgagttcgcgggtcgaggtttttttaggagcgggttattttatttcgttgggatttaggagtttcgcgagggttgttaggagaagtagttggggcgaaggcggaggaggcgttattttaagcggtttcgggttcggttcgtcgtttagtcgtttcgttagcgagggagcgcgcgcgtttcgtttttttagttttagcgttttcgcgttttcgcgttttcgcgtcgttcgcgcgttcgttggttttgggttcgcgcgcgtttttttttagatagtgggttttcggtatcgtttcgttttaatgttcgtttatagtagcggagtgtgcgcgtacgcgttttaaattcgaagtcggaaaagttaagtgtaggagtcgg

SEQ ID NO: 37944 - DNA, 582 bp, Artificial Sequence
  chemically treated genomic DNA (Homo sapiens) CpG-island No: 37944
ccgactcctacacttaacttttccgacttcgaatttaaaacgcgtacgcgcacactccgctactataaacgaacattaaaacgaaacgataccgaaaacccactatctaaaaaaaaacgcgcgcgaacccaaaaccaacgaacgcgcgaacgacgcgaaaacgcgaaaacgcgaaaacgctaaaactaaaaaaacgaaacgcgcgcgctccctcgctaacgaaacgactaaacgacgaaccgaacccgaaaccgcttaaaataacgcctcctccgccttcgccccaactacttctcctaacaaccctcgcgaaactcctaaatcccaacgaaataaaataacccgctcctaaaaaaacctcgacccgcgaactcaaaacgctttaccaaaaattcgtcctaaaaaaaataacgcgccgaaaaaaacgcgaaattcttccgctaacgaactaaacctaaaaaaaaaaaaaacaaaacctcgccgcgtccaacgccccaactcttcgctttaaacccacaaataataactaaaccgacgaaaaaaacgaaaacccattatcccgaaaacctataacctctacct

SEQ ID NO: 37945 - DNA, 532 bp, Artificial Sequence
  chemically treated genomic DNA (Homo sapiens) CpG-island No: 37945
  misc_feature (76)..(76): n is either a, c, g or t
  misc_feature (310)..(310): n is either a, c, g or t
  misc_feature (312)..(312): n is either a, c, g or t
  misc_feature (399)..(399): n is either a, c, g or t
cgtagcgtcgttttaagttgtgtttgtggttatgtcgttttatttcgttcggttttttgttatttagggttgtagncgttttcgttagcgtttttcggggagagttcggggtttttagttttaagtcggggcggtttttcgttataggcgcggcggttttttttatggttaagcgcggggcgagtcgggttatagagggtaagaacgggtatagggttgggatggcggggtttttatcgagggaagtcggtggacgtttaagggcggtttcgtaataatagggaaggggttcggaatcggtcggaatgtngnttggttattggcggtcggcggggattggatatattggcgcgtcgcggggcggtaagggtcggggatacggtttttcgggtcgcgggngagattgtgggaaacgtttcggtttagaggtggtcggcgcgtgtgtataggggaaagtcgcgtggtggttttttatagaaaggagaggggagaagaggtgtgttttttatacgtatagaggggggagatgtgt

SEQ ID NO: 37946 - DNA, 532 bp, Artificial Sequence
  chemically treated genomic DNA (Homo sapiens) CpG-island No: 37946
  misc_feature (134)..(134): n is either a, c, g or t
  misc_feature (221)..(221): n is either a, c, g or t
  misc_feature (223)..(223): n is either a, c, g or t
  misc_feature (457)..(457): n is either a, c, g or t
acacatctcccccctctatacgtataaaaaacacacctcttctcccctctcctttctataaaaaaccaccacgcgactttcccctatacacacgcgccgaccacctctaaaccgaaacgtttcccacaatctcncccgcgacccgaaaaaccgtatccccgacccttaccgccccgcgacgcgccaatatatccaatccccgccgaccgccaataaccaancnacattccgaccgattccgaaccccttccctattattacgaaaccgcccttaaacgtccaccgacttccctcgataaaaaccccgccatcccaaccctatacccgttcttaccctctataacccgactcgccccgcgcttaaccataaaaaaaaccgccgcgcctataacgaaaaaccgccccgacttaaaactaaaaaccccgaactctccccgaaaaacgctaacgaaaacgnctacaaccctaaataacaaaaaaccgaacgaaataaaacgacataaccacaaacacaacttaaaacgacgctacg

SEQ ID NO: 37947 - DNA, 532 bp, Artificial Sequence
  chemically treated genomic DNA (Homo sapiens) CpG-island No: 37947
  misc_feature (134)..(134): n is either a, c, g or t
  misc_feature (221)..(221): n is either a, c, g or t
  misc_feature (223)..(223): n is either a, c, g or t
  misc_feature (457)..(457): n is either a, c, g or t
atatattttttttttttgtgcgtgtggagagtatattttttttttttttttttttttgtggaaaattattacgcggtttttttttgtgtatacgcgtcggttatttttgggtcggagcgttttttatagttttnttcgcgattcggggggtcgtgttttcgatttttgtcgtttcgcggcgcgttaatatgtttagttttcgtcggtcgttagtgattaantngtatttcgatcggtttcgggttttttttttgttgttgcggggtcgtttttgagcgtttatcggtttttttcggtggggatttcgttattttagttttgtgttcgtttttgttttttgtagttcggttcgtttcgcgtttggttatggaaggggtcgtcgcgtttgtggcgggggatcgtttcgatttggggttgggggtttcgggtttttttcgagaggcgttggcgggggcgnttgtagttttggataataggaagtcgaacggggtgaagcggtataattataagtataatttgaagcggcgttacg

SEQ ID NO: 37948 - DNA, 532 bp, Artificial Sequence
  chemically treated genomic DNA (Homo sapiens) CpG-island No: 37948
  misc_feature (76)..(76): n is either a, c, g or t
  misc_feature (310)..(310): n is either a, c, g or t
  misc_feature (312)..(312): n is either a, c, g or t
  misc_feature (399)..(399): n is either a, c, g or t
cgtaacgccgcttcaaattatacttataattataccgcttcaccccgttcgacttcctattatccaaaactacaancgcccccgccaacgcctctcgaaaaaaacccgaaacccccaaccccaaatcgaaacgatcccccgccacaaacgcgacgaccccttccataaccaaacgcgaaacgaaccgaactacaaaaaacaaaaacgaacacaaaactaaaataacgaaatccccaccgaaaaaaaccgataaacgctcaaaaacgaccccgcaacaacaaaaaaaaaacccgaaaccgatcgaaatacnanttaatcactaacgaccgacgaaaactaaacatattaacgcgccgcgaaacgacaaaaatcgaaaacacgaccccccgaatcgcgaanaaaactataaaaaacgctccgacccaaaaataaccgacgcgtatacacaaaaaaaaaccgcgtaataattttccacaaaaaaaaaaaaaaaaaaaaaatatactctccacacgcacaaaaaaaaaaaatatat

SEQ ID NO: 37949 - DNA, 1091 bp, Artificial Sequence
  chemically treated genomic DNA (Homo sapiens) CpG-island No: 37949
ggcggttgcgatcgttcggtcgcgtttatcgtttttataaacggaaaggcgcgtcggggttttttcggttatttatttgttagggtcgtaggagtttacgtttggcgtacgttagttttaggtcggggtagcgggacggggaggtttcgagggttaggtcgcggaggtaggattcggcggagtttcggttcggagtttgcggatttcggtaaagatagagatttttttcgttttaaaaagtatttttcgatttcgtatttagagtcgggttaagtttttatttttcgtttttcgtttgaagcgggtagttttttcgcgttttttcgcgtttgttgtttcggaatttaggattagtcggcgtatttggttacgtatttttcggcgggaggtgattatacgggaacgcgaggcgggggttttttcgcgtttcgtcggtcggacgtagggttataagcgtagtcggaaggaggcgttcgcgtcgcggcggttttcggtttcggtattgttcgggcgggaggttcggcgcgcgttcgttcgcggggttattcgttttagaatcgttcgtcggaattagttcggtgttcgagatttcgagttcgggcgcgagtaggatgcggtttttcggggacggttggcgcgggtcggagtttcgaagtttcgtttttatttttgttttatattgcggtgtttttcggcgtcggcgtcgttgtggcgggttagtgtcgttttgtttcgtagttcgagcgttcggcgcggtaggtagtagtcggagaagcggcgtagtcgggggatgggcgggtatatggaagggcgggggttgtggttttcgggtcggattacgggattttagtttcgggggcgagatattttagtatatttcgaaaattggtaagcggttttcgtttttagggattttattgttatttgtacgtttagttttgttagaattttacgggatatgtgtaaaaggtaaagaaataagttgtcgttacgtttttcgtttttttcgtttttttgtaggatttatatggtatattttttaaagtttaacgggagacgggaaagaattgattggttgggaattttggaag

SEQ ID NO: 37950 - DNA, 1091 bp, Artificial Sequence
  chemically treated genomic DNA (Homo sapiens) CpG-island No: 37950
cttccaaaattcccaaccaatcaattctttcccgtctcccgttaaactttaaaaaatataccatataaatcctacaaaaaaacgaaaaaaacgaaaaacgtaacgacaacttatttctttaccttttacacatatcccgtaaaattctaacaaaactaaacgtacaaataacaataaaatccctaaaaacgaaaaccgcttaccaattttcgaaatatactaaaatatctcgcccccgaaactaaaatcccgtaatccgacccgaaaaccacaacccccgcccttccatatacccgcccatcccccgactacgccgcttctccgactactacctaccgcgccgaacgctcgaactacgaaacaaaacgacactaacccgccacaacgacgccgacgccgaaaaacaccgcaatataaaacaaaaataaaaacgaaacttcgaaactccgacccgcgccaaccgtccccgaaaaaccgcatcctactcgcgcccgaactcgaaatctcgaacaccgaactaattccgacgaacgattctaaaacgaataaccccgcgaacgaacgcgcgccgaacctcccgcccgaacaataccgaaaccgaaaaccgccgcgacgcgaacgcctccttccgactacgcttataaccctacgtccgaccgacgaaacgcgaaaaaacccccgcctcgcgttcccgtataatcacctcccgccgaaaaatacgtaaccaaatacgccgactaatcctaaattccgaaacaacaaacgcgaaaaaacgcgaaaaaactacccgcttcaaacgaaaaacgaaaaataaaaacttaacccgactctaaatacgaaatcgaaaaatactttttaaaacgaaaaaaatctctatctttaccgaaatccgcaaactccgaaccgaaactccgccgaatcctacctccgcgacctaaccctcgaaacctccccgtcccgctaccccgacctaaaactaacgtacgccaaacgtaaactcctacgaccctaacaaataaataaccgaaaaaaccccgacgcgcctttccgtttataaaaacgataaacgcgaccgaacgatcgcaaccgcc

SEQ ID NO: 37951 - DNA, 1091 bp, Artificial Sequence
  chemically treated genomic DNA (Homo sapiens) CpG-island No: 37951
tttttaagatttttaattaattagttttttttcgtttttcgttgggttttgaggaatgtattatatggattttgtagggggacggagaggacgaagggcgtggcgatagtttatttttttgttttttgtatatatttcgtgagattttggtaagattgagcgtgtaagtagtaatggagtttttgaggacgggggtcgtttgttagttttcgaggtgtattgagatatttcgttttcgaggttggggtttcgtggttcggttcgagggttataattttcgtttttttatgtgttcgtttatttttcggttgcgtcgttttttcggttgttatttatcgcgtcggacgttcgggttgcggaatagggcggtattggttcgttatagcgacgtcggcgtcgagggatatcgtagtatgaggtagaggtaagaacggggtttcgggatttcgattcgcgttaatcgttttcggggagtcgtattttgttcgcgttcgagttcggggtttcgggtatcgggttggtttcggcgggcggttttggagcgggtggtttcgcgagcggacgcgcgtcgagtttttcgttcgggtagtgtcgaagtcgggagtcgtcgcggcgcgggcgttttttttcggttgcgtttataattttgcgttcggtcggcggggcgcgaggaagttttcgtttcgcgttttcgtgtggttatttttcgtcggaggatgcgtggttaggtgcgtcggttggttttgagtttcggggtagtaggcgcggggaagcgcggggaggttgttcgttttaggcgggaggcggagggtgggggtttagttcggttttgggtgcggggtcggggggtgttttttggggcgggggaggtttttgtttttatcggagttcgtaggtttcgggtcgaggtttcgtcgggttttgttttcgcggtttggttttcggggttttttcgtttcgttgtttcggtttggagttagcgtgcgttaagcgtgggtttttgcgattttggtaggtaggtggtcgagaggatttcggcgcgttttttcgtttgtgggggcggtgggcgcggtcgggcgatcgtagtcgtt

SEQ ID NO: 37952 - DNA, 1091 bp, Artificial Sequence
  chemically treated genomic DNA (Homo sapiens) CpG-island No: 37952
aacgactacgatcgcccgaccgcgcccaccgcccccacaaacgaaaaaacgcgccgaaatcctctcgaccacctacctaccaaaatcgcaaaaacccacgcttaacgcacgctaactccaaaccgaaacaacgaaacgaaaaaaccccgaaaaccaaaccgcgaaaacaaaacccgacgaaacctcgacccgaaacctacgaactccgataaaaacaaaaacctcccccgccccaaaaaacaccccccgaccccgcacccaaaaccgaactaaacccccaccctccgcctcccgcctaaaacgaacaacctccccgcgcttccccgcgcctactaccccgaaactcaaaaccaaccgacgcacctaaccacgcatcctccgacgaaaaataaccacacgaaaacgcgaaacgaaaacttcctcgcgccccgccgaccgaacgcaaaattataaacgcaaccgaaaaaaaacgcccgcgccgcgacgactcccgacttcgacactacccgaacgaaaaactcgacgcgcgtccgctcgcgaaaccacccgctccaaaaccgcccgccgaaaccaacccgatacccgaaaccccgaactcgaacgcgaacaaaatacgactccccgaaaacgattaacgcgaatcgaaatcccgaaaccccgttcttacctctacctcatactacgatatccctcgacgccgacgtcgctataacgaaccaataccgccctattccgcaacccgaacgtccgacgcgataaataacaaccgaaaaaacgacgcaaccgaaaaataaacgaacacataaaaaaacgaaaattataaccctcgaaccgaaccacgaaaccccaacctcgaaaacgaaatatctcaatacacctcgaaaactaacaaacgacccccgtcctcaaaaactccattactacttacacgctcaatcttaccaaaatctcacgaaatatatacaaaaaacaaaaaaataaactatcgccacgcccttcgtcctctccgtccccctacaaaatccatataatacattcctcaaaacccaacgaaaaacgaaaaaaaactaattaattaaaaatcttaaaaa

SEQ ID NO: 37953 - DNA, 720 bp, Artificial Sequence
  chemically treated genomic DNA (Homo sapiens) CpG-island No: 37953
tttgtattcgttgtcgttaatttttttttcgggaaagtgatcggtttgattggttataacggttttggtaaatttatttgtttaaaatgtttggtcgttattagtcgtcgtcggaaggggagatttttttgatgtttaatcgttggaaagttggagtagtaaagcgtttgttcgtaagtggtttatttgtcgtagtagtttttttcggtagaagggatgatcgtcgtgaattggtggcgattggtcgttattcgtggtatggcgcgttggggtttttggggcggtagatcgcgaaaaagtcgaggaagttatttcgttggttgtttaaaatcgttggcgtatcggttggtcgatagtttttttggcggcgacgttagcgggcgtggatcgttatgttggtggcgtaggatagtcgttgtcgttgttgcgacgaatcgatttcggcgttggatatcgtttattaggttgagtgttgtcgttggtgtatcgtttaagttaggagcgtggtttgacggttatgtcgtgttgtacgatattaatatggcggtacgttattgtgattatttgtcgttttgcgcggcggtgaaatgattgtttagggaacgtttgcggaaatatgcgcggcgaaattttcgaaatgatttatggtatttcgatgggtatttgtcgtattcggcgggtgttgtatttgtgagttttgtttattgatgagcgtttatt

SEQ ID NO: 37954 - DNA, 720 bp, Artificial Sequence
  chemically treated genomic DNA (Homo sapiens) CpG-island No: 37954
aataaacgctcatcaataaacaaaactcacaaatacaacacccgccgaatacgacaaatacccatcgaaataccataaatcatttcgaaaatttcgccgcgcatatttccgcaaacgttccctaaacaatcatttcaccgccgcgcaaaacgacaaataatcacaataacgtaccgccatattaatatcgtacaacacgacataaccgtcaaaccacgctcctaacttaaacgatacaccaacgacaacactcaacctaataaacgatatccaacgccgaaatcgattcgtcgcaacaacgacaacgactatcctacgccaccaacataacgatccacgcccgctaacgtcgccgccaaaaaaactatcgaccaaccgatacgccaacgattttaaacaaccaacgaaataacttcctcgactttttcgcgatctaccgccccaaaaaccccaacgcgccataccacgaataacgaccaatcgccaccaattcacgacgatcatcccttctaccgaaaaaaactactacgacaaataaaccacttacgaacaaacgctttactactccaactttccaacgattaaacatcaaaaaaatctccccttccgacgacgactaataacgaccaaacattttaaacaaataaatttaccaaaaccgttataaccaatcaaaccgatcactttcccgaaaaaaaaattaacgacaacgaatacaaa

SEQ ID NO: 37955 - DNA, 720 bp, Artificial Sequence
  chemically treated genomic DNA (Homo sapiens) CpG-island No: 37955
ggtaagcgtttattaataaataaaatttataggtgtagtattcgtcggatgcggtaaatatttatcgggatgttataaattatttcgagggtttcgtcgcgtatattttcgtaggcgttttttgagtaattattttatcgtcgcgtagggcgatagataattatagtagcgtgtcgttatattgatatcgtgtaatacggtatgatcgttaggttacgtttttgatttaaacggtgtattagcgatagtatttaatttggtgggcgatatttagcgtcgaggtcggttcgtcgtagtaacgataacggttattttgcgttattagtatggcgatttacgttcgttgacgtcgtcgttagagagattatcgattagtcgatgcgttagcggttttaagtaattagcgagatagttttttcgattttttcgcgatttgtcgttttaaaggttttagcgcgttatgttacgggtaacgattaatcgttattagtttacgacggttattttttttgtcggaggaagttgttgcggtaaataagttatttgcgggtaaacgttttgttgttttagttttttagcggttgggtattaagagaattttttttttcgacggcggttgatgacggttaagtattttgagtaggtggatttattagaatcgttgtgattaattagatcggttattttttcggaggaaaggttaacgatagcggatgtaaa

SEQ ID NO: 37956 - DNA, 720 bp, Artificial Sequence
  chemically treated genomic DNA (Homo sapiens) CpG-island No: 37956
tttacatccgctatcgttaacctttcctccgaaaaaataaccgatctaattaatcacaacgattctaataaatccacctactcaaaatacttaaccgtcatcaaccgccgtcgaaaaaaaaaattctcttaatacccaaccgctaaaaaactaaaacaacaaaacgtttacccgcaaataacttatttaccgcaacaacttcctccgacaaaaaaaataaccgtcgtaaactaataacgattaatcgttacccgtaacataacgcgctaaaacctttaaaacgacaaatcgcgaaaaaatcgaaaaaactatctcgctaattacttaaaaccgctaacgcatcgactaatcgataatctctctaacgacgacgtcaacgaacgtaaatcgccatactaataacgcaaaataaccgttatcgttactacgacgaaccgacctcgacgctaaatatcgcccaccaaattaaatactatcgctaatacaccgtttaaatcaaaaacgtaacctaacgatcataccgtattacacgatatcaatataacgacacgctactataattatctatcgccctacgcgacgataaaataattactcaaaaaacgcctacgaaaatatacgcgacgaaaccctcgaaataatttataacatcccgataaatatttaccgcatccgacgaatactacacctataaattttatttattaataaacgcttacc

SEQ ID NO: 37957 - DNA, 918 bp, Artificial Sequence
  chemically treated genomic DNA (Homo sapiens) CpG-island No: 37957
  misc_feature (29)..(29): n is either a, c, g or t
taatcgcgcgcggcgattgttttattttncgggattttagtaggtagagttataatgtcgatagaggcgggaggaagagcgcgtttttatttttgggtgtgagcgtcgataggagtataatagttatttcgttgtttattttagatggtttgaatgatattattcggaatagttagacggcgcgatgaaagtgaaagacgcgatcgtcgatgtttttacgcggaaaatttgtcgcgtgtaaatgttgatcgcgatgcgtcggatattcgcgttacgtttggttggtataaagaaacgttagtatcgtttttgatttgagtggtatggtttatagtttgcgtggttatcgcgatcgtgttggtattgcgtcgataaagaaattttggtaggcgttattgtgatgcgattcgggttggtagtcggaatatcggtgttcgattcgatgtgtggtttcggtacgttgttgatggagtagcgatgttggggatcgatcgcgtattaggtttgtatcgtgggcgtggggttttagtcggttgggcgtagtatgatgaagttatttggtaggaaggaaagcggaagcgtaaattcgcgttcgtaaaggtttggttgagtatagttttatttttacggttcggatagcgacgtacgggtgatttaacgtgtacgattaacgttcgttttgcggggattggtgaattgattatttttgaggtgaagatgtcgcgtaattgattaattcgttgtcgaaagggtcgtacggtatatgttgagtaattcgttatacggggaacgtttggatagcgaatcggcgttattgcgttgtatagtttgttgggtcggattatgaaaaattagtttggtgttggaatttttttttgtttagtgtttcgtcggatttgttaagttgtttgagttgcg

SEQ ID NO: 37958 - DNA, 918 bp, Artificial Sequence
  chemically treated genomic DNA (Homo sapiens) CpG-island No: 37958
  misc_feature (890)..(890): n is either a, c, g or t
cgcaactcaaacaacttaacaaatccgacgaaacactaaacaaaaaaaaattccaacaccaaactaatttttcataatccgacccaacaaactatacaacgcaataacgccgattcgctatccaaacgttccccgtataacgaattactcaacatataccgtacgaccctttcgacaacgaattaatcaattacgcgacatcttcacctcaaaaataatcaattcaccaatccccgcaaaacgaacgttaatcgtacacgttaaatcacccgtacgtcgctatccgaaccgtaaaaataaaactatactcaaccaaacctttacgaacgcgaatttacgcttccgctttccttcctaccaaataacttcatcatactacgcccaaccgactaaaaccccacgcccacgatacaaacctaatacgcgatcgatccccaacatcgctactccatcaacaacgtaccgaaaccacacatcgaatcgaacaccgatattccgactaccaacccgaatcgcatcacaataacgcctaccaaaatttctttatcgacgcaataccaacacgatcgcgataaccacgcaaactataaaccataccactcaaatcaaaaacgatactaacgtttctttataccaaccaaacgtaacgcgaatatccgacgcatcgcgatcaacatttacacgcgacaaattttccgcgtaaaaacatcgacgatcgcgtctttcactttcatcgcgccgtctaactattccgaataatatcattcaaaccatctaaaataaacaacgaaataactattatactcctatcgacgctcacacccaaaaataaaaacgcgctcttcctcccgcctctatcgacattataactctacctactaaaatcccgnaaaataaaacaatcgccgcgcgcgatta

SEQ ID NO: 37959 - DNA, 918 bp, Artificial Sequence
  chemically treated genomic DNA (Homo sapiens) CpG-island No: 37959
  misc_feature (890)..(890): n is either a, c, g or t
cgtagtttaagtagtttagtagattcggcgaggtattaaataaagagagattttagtattaaattggttttttatgattcgatttagtaggttatgtagcgtaatagcgtcggttcgttgtttagacgtttttcgtatggcgggttgtttaatatgtgtcgtacggttttttcggtagcggattggttagttgcgcgatatttttattttaaaggtgattagtttattaattttcgtaagacgggcgttagtcgtgtacgttgaattattcgtgcgtcgttgttcgaatcgtaaaaatgaggttatatttagttaggtttttacgggcgcgagtttgcgttttcgtttttttttttgttagatagttttattatgttgcgtttagtcgattaaagttttacgtttacggtgtaagtttggtgcgcgatcggtttttagtatcgttgttttattagtaacgtatcggaattatatatcggatcgagtatcggtgtttcggttgttagttcggatcgtattataatagcgtttgttagggtttttttgtcggcgtaatattagtacgatcgcgatagttacgtagattgtaaattatattatttagattaagagcgatattggcgtttttttatgttagttagacgtaacgcggatattcggcgtatcgcgattaatatttgtacgcggtagatttttcgcgtgaaagtatcgacgatcgcgttttttatttttatcgcgtcgtttgattgtttcggatggtgttatttaaattatttgaagtggatagcgaaatagttgttgtgtttttgtcggcgtttatatttagaggtgggggcgcgttttttttttcgtttttgtcgatattataattttgtttgttggaatttcgnagagtgagataatcgtcgcgcgcggttg

SEQ ID NO: 37960 - DNA, 918 bp, Artificial Sequence
  chemically treated genomic DNA (Homo sapiens) CpG-island No: 37960
  misc_feature (29)..(29): n is either a, c, g or t
caaccgcgcgcgacgattatctcactctncgaaattccaacaaacaaaattataatatcgacaaaaacgaaaaaaaaaacgcgcccccacctctaaatataaacgccgacaaaaacacaacaactatttcgctatccacttcaaataatttaaataacaccatccgaaacaatcaaacgacgcgataaaaataaaaaacgcgatcgtcgatactttcacgcgaaaaatctaccgcgtacaaatattaatcgcgatacgccgaatatccgcgttacgtctaactaacataaaaaaacgccaatatcgctcttaatctaaataatataatttacaatctacgtaactatcgcgatcgtactaatattacgccgacaaaaaaaccctaacaaacgctattataatacgatccgaactaacaaccgaaacaccgatactcgatccgatatataattccgatacgttactaataaaacaacgatactaaaaaccgatcgcgcaccaaacttacaccgtaaacgtaaaactttaatcgactaaacgcaacataataaaactatctaacaaaaaaaaaaacgaaaacgcaaactcgcgcccgtaaaaacctaactaaatataacctcatttttacgattcgaacaacgacgcacgaataattcaacgtacacgactaacgcccgtcttacgaaaattaataaactaatcacctttaaaataaaaatatcgcgcaactaaccaatccgctaccgaaaaaaccgtacgacacatattaaacaacccgccatacgaaaaacgtctaaacaacgaaccgacgctattacgctacataacctactaaatcgaatcataaaaaaccaatttaatactaaaatctctctttatttaatacctcgccgaatctactaaactacttaaactacg

SEQ ID NO: 37961 - DNA, 802 bp, Artificial Sequence
  chemically treated genomic DNA (Homo sapiens) CpG-island No: 37961
gtagacgcgtatcgtgacgcgatcggagtagtttagacgttgattgttaataatttggaatttttatggtttttgttcgcgattagtattatattattttttttagttgtataacggcgtaagttatcgttttagtacggttttttattattttggatgttcggtatttaatattttcgttagaatatcgttgatgatggtacgcgtttttcggtacgcgggttatcgttcgttattatcgttacgttagtaaattttcggtaattgcgtttattagtggacgtttattttatcgcgatcgttttatagttaaagatatattatagtttgttcgtatagtgtagacgcgttgttgtaaggttttttttagtgtattcggcgtatgcgcgtaatttattatttcgtcgtttgtttggcgtagttagttaataaggtaaatcgtattcgttaggcggataattttcgggattaaaagttattaattcggcgcgaatatacggagttttcggatcgaattttaggtatagggaagtattaatcggtataaaggtgatagtttttaatttaatgcgaaaggtattttttatcgaatattgtttataatgcgttcgagagtaatttaagattatcgttagtgttgtatcggtggtaattaaatttaatgttttgttcgtttttcggtcggagttatacggatcgttagagacgtcgtaattattagaaaatcgtatgtgtaaaagttatattaatgcgattgattattagacggtaaagttttacgataaaaacgatagtacgtggt

SEQ ID NO: 37962 - DNA, 802 bp, Artificial Sequence
  chemically treated genomic DNA (Homo sapiens) CpG-island No: 37962
accacgtactatcgtttttatcgtaaaactttaccgtctaataatcaatcgcattaatataacttttacacatacgattttctaataattacgacgtctctaacgatccgtataactccgaccgaaaaacgaacaaaacattaaatttaattaccaccgatacaacactaacgataatcttaaattactctcgaacgcattataaacaatattcgataaaaaatacctttcgcattaaattaaaaactatcacctttataccgattaatacttccctatacctaaaattcgatccgaaaactccgtatattcgcgccgaattaataacttttaatcccgaaaattatccgcctaacgaatacgatttaccttattaactaactacgccaaacaaacgacgaaataataaattacgcgcatacgccgaatacactaaaaaaaaccttacaacaacgcgtctacactatacgaacaaactataatatatctttaactataaaacgatcgcgataaaataaacgtccactaataaacgcaattaccgaaaatttactaacgtaacgataataacgaacgataacccgcgtaccgaaaaacgcgtaccatcatcaacgatattctaacgaaaatattaaataccgaacatccaaaataataaaaaaccgtactaaaacgataacttacgccgttatacaactaaaaaaaataatataatactaatcgcgaacaaaaaccataaaaattccaaattattaacaatcaacgtctaaactactccgatcgcgtcacgatacgcgtctac

SEQ ID NO: 37963 - DNA, 802 bp, Artificial Sequence
  chemically treated genomic DNA (Homo sapiens) CpG-island No: 37963
gttacgtattgtcgtttttgtcgtggagttttatcgtttggtgattagtcgtattggtgtggtttttgtatatgcgattttttggtgattacggcgtttttggcgattcgtatggtttcggtcgggaagcgagtaaggtattgagtttaattgttatcggtatagtattggcgatggttttaggttattttcgggcgtattgtgggtagtattcggtggggaatgtttttcgtattggattgggggttattatttttgtgtcgattagtatttttttatgtttgagattcggttcggaagtttcgtatgttcgcgtcgggttagtggtttttggtttcgggggttgttcgtttaacgggtacgatttattttgttaattgattgcgttaggtaaacgacggggtggtggattacgcgtatacgtcggatgtattggaaaaagttttatagtagcgcgtttgtattgtgcgggtaagttgtggtgtgtttttggttgtggggcgatcgcgataaggtaagcgtttattgatgggcgtaattgtcgaagatttgttgacgtggcggtggtgacggacgataattcgcgtatcgaagaacgcgtgttattattaacgatattttggcgggaatgttagatgtcggatatttaaagtgatggaaggtcgtgttgaagcggtgatttgcgtcgttatgtagttaaagagaatgatgtggtattggtcgcgggtaaaggttatgaagattttagattgttggtaattagcgtttggattatttcgatcgcgttacggtgcgcgtttgt

SEQ ID NO: 37964 - DNA, 802 bp, Artificial Sequence
  chemically treated genomic DNA (Homo sapiens) CpG-island No: 37964
acaaacgcgcaccgtaacgcgatcgaaataatccaaacgctaattaccaacaatctaaaatcttcataacctttacccgcgaccaataccacatcattctctttaactacataacgacgcaaatcaccgcttcaacacgaccttccatcactttaaatatccgacatctaacattcccgccaaaatatcgttaataataacacgcgttcttcgatacgcgaattatcgtccgtcaccaccgccacgtcaacaaatcttcgacaattacgcccatcaataaacgcttaccttatcgcgatcgccccacaaccaaaaacacaccacaacttacccgcacaatacaaacgcgctactataaaactttttccaatacatccgacgtatacgcgtaatccaccaccccgtcgtttacctaacgcaatcaattaacaaaataaatcgtacccgttaaacgaacaacccccgaaaccaaaaaccactaacccgacgcgaacatacgaaacttccgaaccgaatctcaaacataaaaaaatactaatcgacacaaaaataataacccccaatccaatacgaaaaacattccccaccgaatactacccacaatacgcccgaaaataacctaaaaccatcgccaatactataccgataacaattaaactcaataccttactcgcttcccgaccgaaaccatacgaatcgccaaaaacgccgtaatcaccaaaaaatcgcatatacaaaaaccacaccaatacgactaatcaccaaacgataaaactccacgacaaaaacgacaatacgtaac

SEQ ID NO: 37965 - DNA, 812 bp, Artificial Sequence
  chemically treated genomic DNA (Homo sapiens) CpG-island No: 37965
atgcgatttttgtgcggggcgcgaaacggttttgtttgtgttgagaattgttcggcggacgcgttgtaattggttttgacgtcgtatttttcggtatggcgaaatttcgtcgtttgcgtatcgtcgttaggaatattaatcgtggtatgttagtatcgcggcgtaagaaatgcggtaatgagtaaagtcgaataaatgtaggtaacgttcgcgcgtggcgagcggataaattggcgattgaagcgcgtaaaatcggttttgatgaaatttattgttatttcgcgtcgattaggtataacgggaagtttcgcgttgttttagtgcggcgagtatagcgtttgtgaatggatttgttcgttgtataattattatcgtagtggattgaattggtgaaagtcggaaatatcgacgtcgtcgtgagtttttttattagattaatattttgtcggaaattatcggacgcgtttttcgtaagatcgtttgtgtgaaggtgtttgtattattcgcgatgagtacgcgcggtaattatcggtaatattgaacgttatattttagattaggcgttgcgaaaggttggcgttttgatttaagttatgttattaaagtggataagcggtggcgattatcggcgtaggttcggtaggtttggcgtgtgcggatgtttgacgcgtaacggcgtaaaagtcgttgttttcgatcgttatttagaaatggcgggttgttgattttcggtatttcggtttttaagttggaaaaagaggaatgacgcgtcgtcgtgaaatttttatcggtatgggtattgaatttaaatt

SEQ ID NO: 37966 - DNA, 812 bp, Artificial Sequence
  chemically treated genomic DNA (Homo sapiens) CpG-island No: 37966
aatttaaattcaatacccataccgataaaaatttcacgacgacgcgtcattcctctttttccaacttaaaaaccgaaataccgaaaatcaacaacccgccatttctaaataacgatcgaaaacaacgacttttacgccgttacgcgtcaaacatccgcacacgccaaacctaccgaacctacgccgataatcgccaccgcttatccactttaataacataacttaaatcaaaacgccaacctttcgcaacgcctaatctaaaatataacgttcaatattaccgataattaccgcgcgtactcatcgcgaataatacaaacaccttcacacaaacgatcttacgaaaaacgcgtccgataatttccgacaaaatattaatctaataaaaaaactcacgacgacgtcgatatttccgactttcaccaattcaatccactacgataataattatacaacgaacaaatccattcacaaacgctatactcgccgcactaaaacaacgcgaaacttcccgttatacctaatcgacgcgaaataacaataaatttcatcaaaaccgattttacgcgcttcaatcgccaatttatccgctcgccacgcgcgaacgttacctacatttattcgactttactcattaccgcatttcttacgccgcgatactaacataccacgattaatattcctaacgacgatacgcaaacgacgaaatttcgccataccgaaaaatacgacgtcaaaaccaattacaacgcgtccgccgaacaattctcaacacaaacaaaaccgtttcgcgccccgcacaaaaatcgcat

SEQ ID NO: 37967 - DNA, 812 bp, Artificial Sequence
  chemically treated genomic DNA (Homo sapiens) CpG-island No: 37967
gatttgaatttaatatttatgtcggtgaagattttacggcgacgcgttatttttttttttttagtttgaaggtcggaatatcgaaggttagtagttcgttatttttggatgacggtcgaagataacggtttttacgtcgttacgcgttagatattcgtatacgttagatttgtcgggtttgcgtcgataatcgttatcgtttgtttattttggtgatatggtttaagttaggacgttaatttttcgtaacgtttgatttgaaatgtagcgtttaatgttgtcgatagttatcgcgcgtgtttatcgcgaatagtataggtatttttatataaacggttttgcggaaaacgcgttcggtaattttcggtagggtgttggtttggtgagaaagtttacggcggcgtcgatgttttcggtttttattagtttaatttattgcggtaatggttatgtagcgggtaggtttatttataaacgttgtgttcgtcgtattaaggtagcgcgaggtttttcgttgtgtttggtcggcgcgaaatggtagtaaattttattaaaatcggttttgcgcgttttaatcgttagtttattcgttcgttacgcgcgggcgttgtttgtatttgttcgattttatttattatcgtattttttgcgtcgcggtattggtatgttacggttgatgtttttgacggcggtgcgtaagcggcgggatttcgttatgtcggagagtgcgacgttaggattagttgtagcgcgttcgtcgggtaatttttaatataggtaggatcgtttcgcgtttcgtataaaggtcgtat

SEQ ID NO: 37968 - DNA, 812 bp, Artificial Sequence
  chemically treated genomic DNA (Homo sapiens) CpG-island No: 37968
atacgacctttatacgaaacgcgaaacgatcctacctatattaaaaattacccgacgaacgcgctacaactaatcctaacgtcgcactctccgacataacgaaatcccgccgcttacgcaccgccgtcaaaaacatcaaccgtaacataccaataccgcgacgcaaaaaatacgataataaataaaatcgaacaaatacaaacaacgcccgcgcgtaacgaacgaataaactaacgattaaaacgcgcaaaaccgattttaataaaatttactaccatttcgcgccgaccaaacacaacgaaaaacctcgcgctaccttaatacgacgaacacaacgtttataaataaacctacccgctacataaccattaccgcaataaattaaactaataaaaaccgaaaacatcgacgccgccgtaaactttctcaccaaaccaacaccctaccgaaaattaccgaacgcgttttccgcaaaaccgtttatataaaaatacctatactattcgcgataaacacgcgcgataactatcgacaacattaaacgctacatttcaaatcaaacgttacgaaaaattaacgtcctaacttaaaccatatcaccaaaataaacaaacgataacgattatcgacgcaaacccgacaaatctaacgtatacgaatatctaacgcgtaacgacgtaaaaaccgttatcttcgaccgtcatccaaaaataacgaactactaaccttcgatattccgaccttcaaactaaaaaaaaaaaaataacgcgtcgccgtaaaatcttcaccgacataaatattaaattcaaatc

SEQ ID NO: 37969 - DNA, 789 bp, Artificial Sequence
  chemically treated genomic DNA (Homo sapiens) CpG-island No: 37969
gtcgcgacgtatagttggacgatttgttgagtgatacgatgtcgtgttttttggcgtcgggatttattagttaatgcgcggcggttggaaaacgaagacgtcgatggcgtgtacgtagcgttgtcgtttttttcgttaatattaaatagttaatgggttttggtgaaattcgcgacgaattttcgttagtatggaaggtaaacgcgtggtggtttttggcggtggcgatatgcgatggattgcgtgcgtacgttcgtgcgttagggagcgaagtacgtttttgtgtttatcgtcgtgatgaagagaatatgtcgggttttcgtcgcgagtgaaaaacgcgcgggaagaaggcgtagagtttaaatttaacgtttagcgttgggtattgaagtgaacggtaacggtaaagttagcggcgtaaaaatgtgcgtatcgaaatgggcgaatcggacgttaagggcgtttcgcgcggagacgtgtaggttcgaatatatgttcggtagatgcgggatatggcgtaggttcggttaataatatggatggtggtaaattaggtcgattggatttaaggacgttacgttgtggtagtatttggtagttagtttgacgcgtattatgttgcgttatttgtagcggtgttgttcggtatttcggtcgggatcgcgatggatttagttttacggtacgcggtattttggattcgataatcgagttttatgttcggtgtcgtcgttggtttatttgtcgttgatggtgatttggtttggattggtgaaatttcgaagattt

SEQ ID NO: 37970 - DNA, 789 bp, Artificial Sequence
  chemically treated genomic DNA (Homo sapiens) CpG-island No: 37970
aaatcttcgaaatttcaccaatccaaaccaaatcaccatcaacgacaaataaaccaacgacgacaccgaacataaaactcgattatcgaatccaaaataccgcgtaccgtaaaactaaatccatcgcgatcccgaccgaaataccgaacaacaccgctacaaataacgcaacataatacgcgtcaaactaactaccaaatactaccacaacgtaacgtccttaaatccaatcgacctaatttaccaccatccatattattaaccgaacctacgccatatcccgcatctaccgaacatatattcgaacctacacgtctccgcgcgaaacgcccttaacgtccgattcgcccatttcgatacgcacatttttacgccgctaactttaccgttaccgttcacttcaatacccaacgctaaacgttaaatttaaactctacgccttcttcccgcgcgtttttcactcgcgacgaaaacccgacatattctcttcatcacgacgataaacacaaaaacgtacttcgctccctaacgcacgaacgtacgcacgcaatccatcgcatatcgccaccgccaaaaaccaccacgcgtttaccttccatactaacgaaaattcgtcgcgaatttcaccaaaacccattaactatttaatattaacgaaaaaaacgacaacgctacgtacacgccatcgacgtcttcgttttccaaccgccgcgcattaactaataaatcccgacgccaaaaaacacgacatcgtatcactcaacaaatcgtccaactatacgtcgcgac

SEQ ID NO: 37971 - DNA, 789 bp, Artificial Sequence
  chemically treated genomic DNA (Homo sapiens) CpG-island No: 37971
agattttcgaggttttattaatttaaattagattattattagcggtaaataagttagcggcggtatcggatataaagttcgattatcggatttagaatgtcgcgtatcgtagggttaagtttatcgcgatttcgatcggaatatcgaataatatcgttgtaaatagcgtagtataatgcgcgttagattggttgttagatgttgttatagcgtggcgtttttggatttagtcgatttggtttgttattatttatgttgttgatcgaatttacgttatgtttcgtatttgtcggatatatgttcggatttgtacgttttcgcgcgggacgtttttggcgttcggttcgtttatttcggtacgtatatttttacgtcgttgattttgtcgttatcgtttattttaatatttagcgttggacgttgaatttgaattttacgtttttttttcgcgcgttttttattcgcggcgggaattcggtatgttttttttattacgacgataggtataggaacgtgtttcgttttttggcgtacggacgtacgtacgtagtttatcgtatgtcgttatcgttaaggattattacgcgtttgttttttatgttgacgaaggttcgtcgcgggttttattaaagtttattaattgtttggtgttggcgagaggaacggtagcgttgcgtatacgttatcggcgttttcgttttttagtcgtcgcgtattgattgataagtttcgacgttaaggaatacggtatcgtattatttagtagatcgtttagttgtacgtcgcggt

SEQ ID NO: 37972 - DNA, 789 bp, Artificial Sequence
  chemically treated genomic DNA (Homo sapiens) CpG-island No: 37972
accgcgacgtacaactaaacgatctactaaataatacgataccgtattccttaacgtcgaaacttatcaatcaatacgcgacgactaaaaaacgaaaacgccgataacgtatacgcaacgctaccgttcctctcgccaacaccaaacaattaataaactttaataaaacccgcgacgaaccttcgtcaacataaaaaacaaacgcgtaataatccttaacgataacgacatacgataaactacgtacgtacgtccgtacgccaaaaaacgaaacacgttcctatacctatcgtcgtaataaaaaaaacataccgaattcccgccgcgaataaaaaacgcgcgaaaaaaaaacgtaaaattcaaattcaacgtccaacgctaaatattaaaataaacgataacgacaaaatcaacgacgtaaaaatatacgtaccgaaataaacgaaccgaacgccaaaaacgtcccgcgcgaaaacgtacaaatccgaacatatatccgacaaatacgaaacataacgtaaattcgatcaacaacataaataataacaaaccaaatcgactaaatccaaaaacgccacgctataacaacatctaacaaccaatctaacgcgcattatactacgctatttacaacgatattattcgatattccgatcgaaatcgcgataaacttaaccctacgatacgcgacattctaaatccgataatcgaactttatatccgataccgccgctaacttatttaccgctaataataatctaatttaaattaataaaacctcgaaaatct

SEQ ID NO: 37973 - DNA, 889 bp, Artificial Sequence
  chemically treated genomic DNA (Homo sapiens) CpG-island No: 37973
gagattttattacgtttggatgttatcgatttaacgcgttttgttattttttttattagtttaagggtacgcggatgtagtttttcgtgtttttgtgtacgaatagtgatatcggtatattttaggtgcgtgacgggagatatattagttaggacggttagtaattatcgattcgatatcgtttggttttagttcgggatttattgtacgtttttgattttttttagtattgcgtacgtagatttttttgatttatgttgacgaattattgcggcgtgcgcggaagatgatcggcgttttgtgacgttagtagtacggatagttgtttgtatttttttaacgtgtagtagcgcgttttttttttgtagtagcgtacgacgatgtcgttcgttttgaagacgtttacgttatttagcgtcggatagtgttcggtagataagtgtcgttcgggttaatcgggttagcggtttttagtcgtatttttgatcgattatatagtcgttcgggtcgtggttaggcgcgtgtgaacggtatcggtatcggtatttagggtaacgtgatcgtcgaggatgtcggaacgtcgaagtttataaacggatgggtaaagcgtagtagtttaatttcgtattttttatcgtgtcgagaatggtgtaatcggttacgtcgatagttgtattacgtttttaattagatttttcgttagaattacggtttgatttcgatttgtattagcgtatagtcgaaatttggtgtaatagagattgcgcgttggtaggtagagtttacggcgtggtggtttagattattagcgagattggtcgttaacgttgtttacggtaaattttgtttttagtgtattttgattattgtttggaaagtaacgtcgatg

SEQ ID NO: 37974 - DNA, 889 bp, Artificial Sequence
  chemically treated genomic DNA (Homo sapiens) CpG-island No: 37974
catcgacgttactttccaaacaataatcaaaatacactaaaaacaaaatttaccgtaaacaacgttaacgaccaatctcgctaataatctaaaccaccacgccgtaaactctacctaccaacgcgcaatctctattacaccaaatttcgactatacgctaatacaaatcgaaatcaaaccgtaattctaacgaaaaatctaattaaaaacgtaatacaactatcgacgtaaccgattacaccattctcgacacgataaaaaatacgaaattaaactactacgctttacccatccgtttataaacttcgacgttccgacatcctcgacgatcacgttaccctaaataccgataccgataccgttcacacgcgcctaaccacgacccgaacgactatataatcgatcaaaaatacgactaaaaaccgctaacccgattaacccgaacgacacttatctaccgaacactatccgacgctaaataacgtaaacgtcttcaaaacgaacgacatcgtcgtacgctactacaaaaaaaaaacgcgctactacacgttaaaaaaatacaaacaactatccgtactactaacgtcacaaaacgccgatcatcttccgcgcacgccgcaataattcgtcaacataaatcaaaaaaatctacgtacgcaatactaaaaaaaatcaaaaacgtacaataaatcccgaactaaaaccaaacgatatcgaatcgataattactaaccgtcctaactaatatatctcccgtcacgcacctaaaatataccgatatcactattcgtacacaaaaacacgaaaaactacatccgcgtacccttaaactaataaaaaaaataacaaaacgcgttaaatcgataacatccaaacgtaataaaatctc

SEQ ID NO: 37975 - DNA, 889 bp, Artificial Sequence
  chemically treated genomic DNA (Homo sapiens) CpG-island No: 37975
tatcgacgttgttttttaggtagtgattaggatgtattgaaagtaaaatttgtcgtaagtaacgttaacggttaatttcgttggtaatttggattattacgtcgtggattttgtttgttaacgcgtaatttttattgtattagatttcgattatgcgttggtgtagatcgaggttaggtcgtgattttggcgaaagatttggttgaaagcgtaatgtagttatcggcgtgatcgattatattattttcggtacggtaaaaggtgcggagttgagttgttgcgttttatttattcgtttatgggtttcgacgtttcggtattttcggcgattacgttattttggatgtcggtatcggtgtcgtttatacgcgtttggttacggttcggacgattatgtgatcggttagaaatacggttggaaatcgttaattcggttggttcggacggtatttatttgtcgggtattattcgacgttggatggcgtgaacgtttttaaagcgaacgatatcgtcgtgcgttgttgtaggaaaaaggcgcgttgttgtacgttgagaaaatgtagatagttattcgtgttgttggcgttataaaacgtcgattatttttcgcgtacgtcgtagtggttcgttagtatggattagaaaggtttgcgtgcgtagtattgaaagagattaaaggcgtgtagtggatttcggattggggttaggcggtatcgagtcgatggttgttaatcgttttgattggtgtatttttcgttacgtatttggggtgtatcgatgttattgttcgtgtataaagatacggaaggttgtattcgcgtatttttgaattgatggaagaagtggtaaaacgcgttaagtcgatggtatttaggcgtggtgggatttt

SEQ ID NO: 37976 - DNA, 889 bp, Artificial Sequence
  chemically treated genomic DNA (Homo sapiens) CpG-island No: 37976
aaaatcccaccacgcctaaataccatcgacttaacgcgttttaccacttcttccatcaattcaaaaatacgcgaatacaaccttccgtatctttatacacgaacaataacatcgatacaccccaaatacgtaacgaaaaatacaccaatcaaaacgattaacaaccatcgactcgataccgcctaaccccaatccgaaatccactacacgcctttaatctctttcaatactacgcacgcaaacctttctaatccatactaacgaaccactacgacgtacgcgaaaaataatcgacgttttataacgccaacaacacgaataactatctacattttctcaacgtacaacaacgcgcctttttcctacaacaacgcacgacgatatcgttcgctttaaaaacgttcacgccatccaacgtcgaataatacccgacaaataaataccgtccgaaccaaccgaattaacgatttccaaccgtatttctaaccgatcacataatcgtccgaaccgtaaccaaacgcgtataaacgacaccgataccgacatccaaaataacgtaatcgccgaaaataccgaaacgtcgaaacccataaacgaataaataaaacgcaacaactcaactccgcaccttttaccgtaccgaaaataatataatcgatcacgccgataactacattacgctttcaaccaaatctttcgccaaaatcacgacctaacctcgatctacaccaacgcataatcgaaatctaatacaataaaaattacgcgttaacaaacaaaatccacgacgtaataatccaaattaccaacgaaattaaccgttaacgttacttacgacaaattttactttcaatacatcctaatcactacctaaaaaacaacgtcgata

SEQ ID NO: 37977 - DNA, 699 bp, Artificial Sequence
  chemically treated genomic DNA (Homo sapiens) CpG-island No: 37977
gttaattacgttaaaatatattagtatttagaatacgttataaaggtaggcgatagaatatcgttagcgttttgtggcgtaatagttgcggatcgatggtttgtaaggtttgtattgcgttatttaagtcgtagcggtatgtattacgttaataagtagtataacggtgttaattagtatttaagtttttgtatggtgtcgtttagtacgttggcgcgaaagttattaaagcggtatataacgtaatgttgatattaaaaattagtagttcggttttataggaatattcgtcgcggtttttagtaggcgcgtatcgtcgataaattgtcggttatcgtattaacgaacgtaattagtaaatttaaattcgttagttaattagaagacgattttggtagcgggtaaatagtatatcgtttagcgttatgtattgtagcggcgcgtaagaatcgtaaattttttgtcgagaatatcggtgaaagttagattgtaggaagttgaattatcgttagtaatatttagttagttcgtattattagtagtttttggtttcgtcgataacgaacgggattgtataggtcgcggtgagcgtttcgttagtcgaaaacggttaataagcggggcgaggaaatattttaagggacggtgtcgtgtttcgtaattttcgtataacgagaaacgaaattatattaatatgtt

SEQ ID NO: 37978 - DNA, 699 bp, Artificial Sequence
  chemically treated genomic DNA (Homo sapiens) CpG-island No: 37978
aacatattaatataatttcgtttctcgttatacgaaaattacgaaacacgacaccgtcccttaaaatatttcctcgccccgcttattaaccgttttcgactaacgaaacgctcaccgcgacctatacaatcccgttcgttatcgacgaaaccaaaaactactaataatacgaactaactaaatattactaacgataattcaacttcctacaatctaactttcaccgatattctcgacaaaaaatttacgattcttacgcgccgctacaatacataacgctaaacgatatactatttacccgctaccaaaatcgtcttctaattaactaacgaatttaaatttactaattacgttcgttaatacgataaccgacaatttatcgacgatacgcgcctactaaaaaccgcgacgaatattcctataaaaccgaactactaatttttaatatcaacattacgttatataccgctttaataactttcgcgccaacgtactaaacgacaccatacaaaaacttaaatactaattaacaccgttatactacttattaacgtaatacataccgctacgacttaaataacgcaatacaaaccttacaaaccatcgatccgcaactattacgccacaaaacgctaacgatattctatcgcctacctttataacgtattctaaatactaatatattttaacgtaattaac

SEQ ID NO: 37979 - DNA, 699 bp, Artificial Sequence
  chemically treated genomic DNA (Homo sapiens) CpG-island No: 37979
ggtatattggtgtggtttcgtttttcgttatgcgagggttacggagtacggtatcgttttttagagtattttttcgtttcgtttattggtcgttttcggttggcgagacgtttatcgcgatttatatagtttcgttcgttatcggcggggttaggagttgttaataatacgggttggttgggtattgttggcgatgatttagttttttgtagtttggtttttatcggtattttcggtaagaagtttgcgatttttgcgcgtcgttataatgtatgacgttgaacgatatgttgtttgttcgttattagagtcgttttttggttggttggcgagtttgagtttgttggttgcgttcgttggtgcgatgatcggtagtttatcggcggtgcgcgtttgttggaaatcgcggcgggtatttttatgaaatcgggttgttgatttttggtattagtattgcgttatatatcgttttggtggttttcgcgttagcgtgttgaacgatattatgtaagggtttggatgttgattggtatcgttgtgttgtttattggcgtagtatatgtcgttgcggtttaagtaacgtagtatagattttgtaaattatcgattcgtaattgttacgttataaggcgttgacgatattttgtcgtttgtttttatgacgtgttttgggtattggtgtgttttggcgtgattggt

SEQ ID NO: 37980 - DNA, 699 bp, Artificial Sequence
  chemically treated genomic DNA (Homo sapiens) CpG-island No: 37980
accaatcacgccaaaacacaccaatacccaaaacacgtcataaaaacaaacgacaaaatatcgtcaacgccttataacgtaacaattacgaatcgataatttacaaaatctatactacgttacttaaaccgcaacgacatatactacgccaataaacaacacaacgataccaatcaacatccaaacccttacataatatcgttcaacacgctaacgcgaaaaccaccaaaacgatatataacgcaatactaataccaaaaatcaacaacccgatttcataaaaatacccgccgcgatttccaacaaacgcgcaccgccgataaactaccgatcatcgcaccaacgaacgcaaccaacaaactcaaactcgccaaccaaccaaaaaacgactctaataacgaacaaacaacatatcgttcaacgtcatacattataacgacgcgcaaaaatcgcaaacttcttaccgaaaataccgataaaaaccaaactacaaaaaactaaatcatcgccaacaatacccaaccaacccgtattattaacaactcctaaccccgccgataacgaacgaaactatataaatcgcgataaacgtctcgccaaccgaaaacgaccaataaacgaaacgaaaaaatactctaaaaaacgataccgtactccgtaaccctcgcataacgaaaaacgaaaccacaccaatatacc

SEQ ID NO: 37981 - DNA, 575 bp, Artificial Sequence
  chemically treated genomic DNA (Homo sapiens) CpG-island No: 37981
tggcgagggttcgagcgcgttagatcgcgtattagattcggagcgtggggtttaaaggttggcggttatttcggagttcggcgttttaatcgggaagtgatcgtagtagtttattttttgacgttagcggaagtgcgagttcgggtcgagtttgtttcgtcgtcggcgttcgggaaggggcgggtacggggcggggttgggggcgggcgaggcgggtcggcggcggggcggggtttggtcgtagttgtttttatttaggtttcgcgtttaggcgtttcgtcgaggttgattttcgtttaagtgtgagttgcgttgagtttagcgttcgaggcgcgaggtagttaggagggttcgtgcggcgggggagttagcgagcgtcgttttttcggttaattatgcgtataggtacgcgaatgttagtttagtgttgtgcgggttaggtgagcgaggtcgggcgtacgcgggggttgttagatcggagaatcgggttaggagtttaggcgtggagatttgtttgggtagcgttatttaggttatcgatcgtgttatcgtaattatcgggttaaagggggggg

SEQ ID NO: 37982 - DNA, 575 bp, Artificial Sequence
  chemically treated genomic DNA (Homo sapiens) CpG-island No: 37982
cccccccctttaacccgataattacgataacacgatcgataacctaaataacgctacccaaacaaatctccacgcctaaactcctaacccgattctccgatctaacaacccccgcgtacgcccgacctcgctcacctaacccgcacaacactaaactaacattcgcgtacctatacgcataattaaccgaaaaaacgacgctcgctaactcccccgccgcacgaaccctcctaactacctcgcgcctcgaacgctaaactcaacgcaactcacacttaaacgaaaatcaacctcgacgaaacgcctaaacgcgaaacctaaataaaaacaactacgaccaaaccccgccccgccgccgacccgcctcgcccgcccccaaccccgccccgtacccgccccttcccgaacgccgacgacgaaacaaactcgacccgaactcgcacttccgctaacgtcaaaaaataaactactacgatcacttcccgattaaaacgccgaactccgaaataaccgccaacctttaaaccccacgctccgaatctaatacgcgatctaacgcgctcgaaccctcgcca

SEQ ID NO: 37983 - DNA, 575 bp, Artificial Sequence
  chemically treated genomic DNA (Homo sapiens) CpG-island No: 37983
tttttttttttaattcggtgattgcggtggtacggtcggtagtttgggtagcgttatttaggtaggtttttacgtttggatttttggttcggtttttcgatttgataattttcgcgtgcgttcggtttcgtttatttggttcgtatagtattgagttgatattcgcgtgtttgtgcgtataattggtcggaagggcggcgttcgttggttttttcgtcgtacgggtttttttggttgtttcgcgtttcgagcgttgggtttagcgtagtttatatttgaacgaagattagtttcggcgaagcgtttaggcgcgaggtttgggtaaaaataattgcggttaagtttcgtttcgtcgtcggttcgtttcgttcgtttttagtttcgtttcgtgttcgttttttttcgggcgtcggcggcggagtaggttcgattcgggttcgtattttcgttggcgttagggggtgggttgttgcgattatttttcggttggggcgtcgagtttcggagtggtcgttagtttttgggttttacgtttcgggtttggtgcgcggtttggcgcgttcgggttttcgtta

SEQ ID NO: 37984 - DNA, 575 bp, Artificial Sequence
  chemically treated genomic DNA (Homo sapiens) CpG-island No: 37984
taacgaaaacccgaacgcgccaaaccgcgcaccaaacccgaaacgtaaaacccaaaaactaacgaccactccgaaactcgacgccccaaccgaaaaataatcgcaacaacccaccccctaacgccaacgaaaatacgaacccgaatcgaacctactccgccgccgacgcccgaaaaaaaacgaacacgaaacgaaactaaaaacgaacgaaacgaaccgacgacgaaacgaaacttaaccgcaattatttttacccaaacctcgcgcctaaacgcttcgccgaaactaatcttcgttcaaatataaactacgctaaacccaacgctcgaaacgcgaaacaaccaaaaaaacccgtacgacgaaaaaaccaacgaacgccgcccttccgaccaattatacgcacaaacacgcgaatatcaactcaatactatacgaaccaaataaacgaaaccgaacgcacgcgaaaattatcaaatcgaaaaaccgaaccaaaaatccaaacgtaaaaacctacctaaataacgctacccaaactaccgaccgtaccaccgcaatcaccgaattaaaaaaaaaaa

SEQ ID NO: 37985 - DNA, 617 bp, Artificial Sequence
  chemically treated genomic DNA (Homo sapiens) CpG-island No: 37985
gacgcgggaaagacgtttttttggatcggtgttgggacgcgggaaagacgtttttttggatcggtgaatttttagttttatagatttcggtcgcgcgtatattagtttagttttattttttgtcgttcgcgttttttttaagacggagttatgatattattttagatattgcgtagttattttggtaacgcgcgattattttttttcggacgattttaattggttggttagtttcggagtttcgttttttcgcgtagtagtttcgggtatttgttgttaatcgggttaggtgggagcgatgattggtcgtcggtcggttttttagaaagttcgcggttcgcgtaggttgtaggttcggggagggagggtagcgcgtcgcgtcggagtcgcgtcgtttcgtttttcgttcgtcgtttatcggtgtttttgtagtacgttgttgggaggtcggcgcgcgtatttggagttttacgatattatcgttagtatttgtggtatgatacgtgaggttcgtagtagggggaggcggcgttgttcgggagtacggacggcgagggagagattacgtagtttcggcgttttcgtttatggtgacgtcgttcgcgggcgatggttgg

SEQ ID NO: 37986 - DNA, 617 bp, Artificial Sequence
  chemically treated genomic DNA (Homo sapiens) CpG-island No: 37986
ccaaccatcgcccgcgaacgacgtcaccataaacgaaaacgccgaaactacgtaatctctccctcgccgtccgtactcccgaacaacgccgcctccccctactacgaacctcacgtatcataccacaaatactaacgataatatcgtaaaactccaaatacgcgcgccgacctcccaacaacgtactacaaaaacaccgataaacgacgaacgaaaaacgaaacgacgcgactccgacgcgacgcgctaccctccctccccgaacctacaacctacgcgaaccgcgaactttctaaaaaaccgaccgacgaccaatcatcgctcccacctaacccgattaacaacaaatacccgaaactactacgcgaaaaaacgaaactccgaaactaaccaaccaattaaaatcgtccgaaaaaaaataatcgcgcgttaccaaaataactacgcaatatctaaaataatatcataactccgtcttaaaaaaaacgcgaacgacaaaaaataaaactaaactaatatacgcgcgaccgaaatctataaaactaaaaattcaccgatccaaaaaaacgtctttcccgcgtcccaacaccgatccaaaaaaacgtctttcccgcgtc

SEQ ID NO: 37987 - DNA, 617 bp, Artificial Sequence
  chemically treated genomic DNA (Homo sapiens) CpG-island No: 37987
ttaattatcgttcgcgggcgacgttattatgagcgagaacgtcgaggttgcgtggtttttttttcgtcgttcgtgttttcgagtagcgtcgtttttttttgttgcgggttttacgtgttatattataggtgttggcgatgatgtcgtaggattttagatgcgcgcgtcggttttttagtagcgtgttgtagaggtatcgatgggcggcgggcggaggacgggacggcgcggtttcgacgcggcgcgttgtttttttttttcgagtttgtagtttacgcgagtcgcgggttttttggagggtcggtcggcggttaattatcgtttttatttggttcgattgatagtaggtgttcggggttgttgcgcgaaggggcggggtttcggagttggttagttaattgaggtcgttcggaaaaaagtggtcgcgcgttgttaaggtagttgcgtagtgtttgggatgatgttatggtttcgttttaaaggggacgcgggcggtagaaagtggagttgggttggtgtgcgcgcggtcggagtttgtggagttggaaatttatcggtttaggaagacgtttttttcgcgttttagtatcggtttagaaagacgtttttttcgcgtt

SEQ ID NO: 37988 - DNA, 617 bp, Artificial Sequence
  chemically treated genomic DNA (Homo sapiens) CpG-island No: 37988
aacgcgaaaaaaacgtctttctaaaccgatactaaaacgcgaaaaaaacgtcttcctaaaccgataaatttccaactccacaaactccgaccgcgcgcacaccaacccaactccactttctaccgcccgcgtcccctttaaaacgaaaccataacatcatcccaaacactacgcaactaccttaacaacgcgcgaccacttttttccgaacgacctcaattaactaaccaactccgaaaccccgccccttcgcgcaacaaccccgaacacctactatcaatcgaaccaaataaaaacgataattaaccgccgaccgaccctccaaaaaacccgcgactcgcgtaaactacaaactcgaaaaaaaaaaacaacgcgccgcgtcgaaaccgcgccgtcccgtcctccgcccgccgcccatcgatacctctacaacacgctactaaaaaaccgacgcgcgcatctaaaatcctacgacatcatcgccaacacctataatataacacgtaaaacccgcaacaaaaaaaaacgacgctactcgaaaacacgaacgacgaaaaaaaaaccacgcaacctcgacgttctcgctcataataacgtcgcccgcgaacgataattaa

SEQ ID NO: 37989 - DNA, 780 bp, Artificial Sequence
  chemically treated genomic DNA (Homo sapiens) CpG-island No: 37989
gcgtaggcgttgatcgttatttacggtcgtgatcgtgattttggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgttggggtcggatcgtgaaacgttgttgtgcggtgtgaaagcgttgtttgtcggttatgaggtttttgggttggtgatcggatttgtgggggttggggtgcgtatcgggtttgtgtttttcggttagggtggttagtggttggggatgggtcgggggttttatcgggttttttcggtgttcggttgttgttttgacgaatttgttcggattggatgatatttgggttaggaatcggggttt

SEQ ID NO: 37990 - DNA, 780 bp, Artificial Sequence
  chemically treated genomic DNA (Homo sapiens) CpG-island No: 37990
aaaccccgattcctaacccaaatatcatccaatccgaacaaattcgtcaaaacaacaaccgaacaccgaaaaaacccgataaaacccccgacccatccccaaccactaaccaccctaaccgaaaaacacaaacccgatacgcaccccaacccccacaaatccgatcaccaacccaaaaacctcataaccgacaaacaacgctttcacaccgcacaacaacgtttcacgatccgaccccaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgaccaaaatcacgatcacgaccgtaaataacgatcaacgcctacgc

SEQ ID NO: 37991 - DNA, 780 bp, Artificial Sequence
  chemically treated genomic DNA (Homo sapiens) CpG-island No: 37991
gaatttcgatttttggtttagatgttatttagttcgaataagttcgttaaagtagtagtcgaatatcggaaaagttcggtaaagttttcggtttatttttagttattgattattttgatcggaaaatataaattcgatgcgtattttagtttttatagattcggttattaatttagaagttttatgatcggtagatagcgtttttatatcgtataataacgttttacggttcgattttagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggttaggattacgattacggtcgtaggtggcgattagcgtttgcgt

SEQ ID NO: 37992 - DNA, 780 bp, Artificial Sequence
  chemically treated genomic DNA (Homo sapiens) CpG-island No: 37992
acgcaaacgctaatcgccacctacgaccgtaatcgtaatcctaaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatactaaaatcgaaccgtaaaacgttattatacgatataaaaacgctatctaccgatcataaaacttctaaattaataaccgaatctataaaaactaaaatacgcatcgaatttatattttccgatcaaaataatcaataactaaaaataaaccgaaaactttaccgaacttttccgatattcgactactactttaacgaacttattcgaactaaataacatctaaaccaaaaatcgaaattc

SEQ ID NO: 37993 - DNA, 687 bp, Artificial Sequence
  chemically treated genomic DNA (Homo sapiens) CpG-island No: 37993
gagttttgcggggtaggggtttcgtttgcgttgtttattcggagtttcgtttgatagaatcggtttttcggtgaggttcgaggcggcgtttgcgagttcggtcgcgatattacgcgcgtttagaacgtggagtttagatgggggtcggtttggttagtttaggtattttcgggggcgtttgcggggtttgaacgagataaggaaggagcggacgttcgcgtaggcggaagttacgcggcggagcgcggtttcgcggggcgatcgaggttgacggcgattttcgtatttcggtggatttataggtcgttcggaaggtttagtgtcggttttagtttcggtcgttcgttttcgcgttttcggttcggcgcgcgagttttcgagtcgtgtcgtttgcggtttttttattttaagtcgtagattcgtcgcgttttgtttagtacgaatttttcgtcgttttcgtcgattcgtaattcggtagcggcgtcggttttttcgtattttgtagtatggagtttttttattggttcggaggcgacgaggaggggcgggacgagtggtaacgcgaggcgcggggcggaggttacgttagtttcgcgttttttcgggaatgtcgggagttgtggtttagcgtttttaaggtattttgggagttggagttttttagcggtaaagggagattttcgtttt

SEQ ID NO: 37994 - DNA, 687 bp, Artificial Sequence
  chemically treated genomic DNA (Homo sapiens) CpG-island No: 37994
aaaacgaaaatctccctttaccgctaaaaaactccaactcccaaaataccttaaaaacgctaaaccacaactcccgacattcccgaaaaaacgcgaaactaacgtaacctccgccccgcgcctcgcgttaccactcgtcccgcccctcctcgtcgcctccgaaccaataaaaaaactccatactacaaaatacgaaaaaaccgacgccgctaccgaattacgaatcgacgaaaacgacgaaaaattcgtactaaacaaaacgcgacgaatctacgacttaaaataaaaaaaccgcaaacgacacgactcgaaaactcgcgcgccgaaccgaaaacgcgaaaacgaacgaccgaaactaaaaccgacactaaaccttccgaacgacctataaatccaccgaaatacgaaaatcgccgtcaacctcgatcgccccgcgaaaccgcgctccgccgcgtaacttccgcctacgcgaacgtccgctccttccttatctcgttcaaaccccgcaaacgcccccgaaaatacctaaactaaccaaaccgacccccatctaaactccacgttctaaacgcgcgtaatatcgcgaccgaactcgcaaacgccgcctcgaacctcaccgaaaaaccgattctatcaaacgaaactccgaataaacaacgcaaacgaaacccctaccccgcaaaactc

SEQ ID NO: 37995 - DNA, 687 bp, Artificial Sequence
  chemically treated genomic DNA (Homo sapiens) CpG-island No: 37995
aggacggggatttttttttgtcgttaagagattttaatttttaggatgttttgggagcgttggattatagttttcggtattttcggggaggcgcggggttagcgtagttttcgtttcgcgtttcgcgttattattcgtttcgttttttttcgtcgttttcgagttaatgggaaggttttatattgtagggtgcgaaggggtcggcgtcgttgtcgagttacgagtcggcgaaagcggcgggaagttcgtattgggtagaacgcgacgggtttgcggtttagggtagggaggtcgtaggcgatacggttcgaggattcgcgcgtcgagtcgggggcgcggaggcgggcggtcggggttggggtcggtattgggtttttcgggcggtttgtgggtttatcggggtgcgggagtcgtcgttagtttcggtcgtttcgcgggatcgcgtttcgtcgcgtggttttcgtttgcgcgggcgttcgttttttttttgtttcgtttaggtttcgtaggcgttttcggggatgtttggattggttaggtcggtttttatttgagttttacgttttggacgcgcgtggtgtcgcggtcgagttcgtaaacgtcgtttcgggttttatcgggaagtcggttttgttaggcggggtttcgggtgaatagcgtaggcgaggtttttgtttcgtagagttt

SEQ ID NO: 37996 - DNA, 687 bp, Artificial Sequence
  chemically treated genomic DNA (Homo sapiens) CpG-island No: 37996
aaactctacgaaacaaaaacctcgcctacgctattcacccgaaaccccgcctaacaaaaccgacttcccgataaaacccgaaacgacgtttacgaactcgaccgcgacaccacgcgcgtccaaaacgtaaaactcaaataaaaaccgacctaaccaatccaaacatccccgaaaacgcctacgaaacctaaacgaaacaaaaaaaaaacgaacgcccgcgcaaacgaaaaccacgcgacgaaacgcgatcccgcgaaacgaccgaaactaacgacgactcccgcaccccgataaacccacaaaccgcccgaaaaacccaataccgaccccaaccccgaccgcccgcctccgcgcccccgactcgacgcgcgaatcctcgaaccgtatcgcctacgacctccctaccctaaaccgcaaacccgtcgcgttctacccaatacgaacttcccgccgctttcgccgactcgtaactcgacaacgacgccgaccccttcgcaccctacaatataaaaccttcccattaactcgaaaacgacgaaaaaaaacgaaacgaataataacgcgaaacgcgaaacgaaaactacgctaaccccgcgcctccccgaaaataccgaaaactataatccaacgctcccaaaacatcctaaaaattaaaatctcttaacgacaaaaaaaaatccccgtcct

SEQ ID NO: 37997 - DNA, 570 bp, Artificial Sequence
  chemically treated genomic DNA (Homo sapiens) CpG-island No: 37997
gtcgtcggcgtatattgttgaggtatgatgcgacgttggggttggtatataattacgtggcgttgtttgtcgttttgtttcgtttgttgcgatgtcgtcgttgttgttgtatggtcgttataagcgttataagcggcggatatttcggtgttggcgaaattattggggtaggttatagttcggtgtttattatttattgtcggatgcggcgtgaacgttttattcgtttacgcggttttggtatattttgtaggtttgataagacgcggtaagcgtgtattaggtatcggagtatttatagtcggatgcggcgtgaacgttttatcggattacggttttggtattttttgtaggtttgataagacgcgggtagttcgtattaggtttgatgcgttaattggttacggtttttatttttggtggataagtaagtaggagtcggtaagtcgatggaatatcggggtcggtttagatcgggtttaattcgcgcgtataaatggttattcgggtaacggtgttaaggtaatgtatcggttaggaaattcggcgaattaaaggtatatgaatata

SEQ ID NO: 37998 - DNA, 570 bp, Artificial Sequence
  chemically treated genomic DNA (Homo sapiens) CpG-island No: 37998
tatattcatatacctttaattcgccgaatttcctaaccgatacattaccttaacaccgttacccgaataaccatttatacgcgcgaattaaacccgatctaaaccgaccccgatattccatcgacttaccgactcctacttacttatccaccaaaaataaaaaccgtaaccaattaacgcatcaaacctaatacgaactacccgcgtcttatcaaacctacaaaaaataccaaaaccgtaatccgataaaacgttcacgccgcatccgactataaatactccgatacctaatacacgcttaccgcgtcttatcaaacctacaaaatataccaaaaccgcgtaaacgaataaaacgttcacgccgcatccgacaataaataataaacaccgaactataacctaccccaataatttcgccaacaccgaaatatccgccgcttataacgcttataacgaccatacaacaacaacgacgacatcgcaacaaacgaaacaaaacgacaaacaacgccacgtaattatataccaaccccaacgtcgcatcatacctcaacaatatacgccgacgac

SEQ ID NO: 37999 - DNA, 570 bp, Artificial Sequence
  chemically treated genomic DNA (Homo sapiens) CpG-island No: 37999
tgtgtttatgtatttttaattcgtcgagttttttggtcggtgtattattttaatatcgttgttcggatgattatttgtgcgcgcgaattaaattcggtttaagtcgatttcggtattttatcggtttatcggtttttgtttgtttatttattaagagtaaaaatcgtagttaattggcgtattaagtttgatgcgagttgttcgcgttttattaggtttataaaaggtgttagaatcgtagttcgataaggcgtttacgtcgtattcggttataagtgtttcgatgtttgatgtacgtttgtcgcgttttattaggtttgtaaaatgtgttagaatcgcgtaggcggataaggcgtttacgtcgtattcggtaataagtaatgagtatcgagttataatttattttagtggtttcgttagtatcggagtattcgtcgtttgtggcgtttatagcgattatatagtagtaacgacgatatcgtagtaaacgaagtagggcggtaggtagcgttacgtaattatatgttagttttagcgtcgtattatattttagtaatatgcgtcgacggt

SEQ ID NO: 38000 - DNA, 570 bp, Artificial Sequence
  chemically treated genomic DNA (Homo sapiens) CpG-island No: 38000
accgtcgacgcatattactaaaatataatacgacgctaaaactaacatataattacgtaacgctacctaccgccctacttcgtttactacgatatcgtcgttactactatataatcgctataaacgccacaaacgacgaatactccgatactaacgaaaccactaaaataaattataactcgatactcattacttattaccgaatacgacgtaaacgccttatccgcctacgcgattctaacacattttacaaacctaataaaacgcgacaaacgtacatcaaacatcgaaacacttataaccgaatacgacgtaaacgccttatcgaactacgattctaacaccttttataaacctaataaaacgcgaacaactcgcatcaaacttaatacgccaattaactacgatttttactcttaataaataaacaaacaaaaaccgataaaccgataaaataccgaaatcgacttaaaccgaatttaattcgcgcgcacaaataatcatccgaacaacgatattaaaataatacaccgaccaaaaaactcgacgaattaaaaatacataaacaca

SEQ ID NO: 38001 - DNA, 805 bp, Artificial Sequence
  chemically treated genomic DNA (Homo sapiens) CpG-island No: 38001
tgttggttttttgttggaacgaatatattttgaagtcggatatatttcgttgtaggattttaacgataattttttcgttaatatttagaagacggtatttattcggtgatttcgcgtttttcgggcggtgaaattattcggaagggttgatggcggtaggtcgtatcgcgcgtgaatttaatttttaattaagattattggtttttagcgtttggcgatgtttggcgtatagaaagcgatttgtcggagatttggcgttagttgattgaagtcggtttcgaaatcgttatgtttatgcgaaagtattgcgtatggcgaaaatttgcgtgggtagatttggtgtcgttacggcgttggcgatagcgtcggtttcggcgtggaacggaaaatcgttataaaggtattcgtacgtcgtataaaatgaagttcggtttttcggttggtatcgtgaatgttagaagtttcggtaagattgggttttggtttggaacggcgatcgtttttgcgttcgcggttgattcgttgggttcgggggattatttatagcggttattttatcgtcgaggtaatcgtgcgtagtttttcggttatttaggggttcggacgttgtacgggtttcgaaagggtttttagagtaaagtttatttatattttgattgagtacggcgtatattagagattcgtattagggggattatcgaagagtgcgaataagtcggttttttagtttttgatcgtttgttgatttttgatatttagtttcgttggagatgaatagtgtgtaacgttttcgattttttatttg

SEQ ID NO: 38002 - DNA, 805 bp, Artificial Sequence
  chemically treated genomic DNA (Homo sapiens) CpG-island No: 38002
caaataaaaaatcgaaaacgttacacactattcatctccaacgaaactaaatatcaaaaatcaacaaacgatcaaaaactaaaaaaccgacttattcgcactcttcgataatccccctaatacgaatctctaatatacgccgtactcaatcaaaatataaataaactttactctaaaaaccctttcgaaacccgtacaacgtccgaacccctaaataaccgaaaaactacgcacgattacctcgacgataaaataaccgctataaataatcccccgaacccaacgaatcaaccgcgaacgcaaaaacgatcgccgttccaaaccaaaacccaatcttaccgaaacttctaacattcacgataccaaccgaaaaaccgaacttcattttatacgacgtacgaatacctttataacgattttccgttccacgccgaaaccgacgctatcgccaacgccgtaacgacaccaaatctacccacgcaaattttcgccatacgcaatactttcgcataaacataacgatttcgaaaccgacttcaatcaactaacgccaaatctccgacaaatcgctttctatacgccaaacatcgccaaacgctaaaaaccaataatcttaattaaaaattaaattcacgcgcgatacgacctaccgccatcaacccttccgaataatttcaccgcccgaaaaacgcgaaatcaccgaataaataccgtcttctaaatattaacgaaaaaattatcgttaaaatcctacaacgaaatatatccgacttcaaaatatattcgttccaacaaaaaaccaaca

SEQ ID NO: 38003 - DNA, 805 bp, Artificial Sequence
  chemically treated genomic DNA (Homo sapiens) CpG-island No: 38003
tagatggagagtcgggaacgttgtatattgtttatttttagcggaattaagtattagagattagtaaacgattagaagttagaaggtcggtttgttcgtatttttcgatgatttttttggtacggatttttgatatgcgtcgtatttagttagagtatggataagttttgttttaagagttttttcgaggttcgtgtagcgttcggatttttgggtaatcggggagttgcgtacggttatttcgacggtggaatgatcgttgtggatgatttttcgaatttagcgggttaatcgcggacgtaaaaacggtcgtcgttttaggttaaaatttagttttatcggaatttttgatatttacggtattagtcggagaatcgaattttattttgtgcggcgtacgaatgtttttgtagcggtttttcgttttacgtcgaggtcgacgttgtcgttaacgtcgtagcggtattaggtttatttacgtaggttttcgttatacgtagtgttttcgtataggtatgacggtttcgaagtcggttttaattagttgacgttagattttcggtagatcgttttttgtgcgttaaatatcgttagacgttgggagttagtgattttggttagagattaaatttacgcgcgatacgatttatcgttattagttttttcgggtgattttatcgttcggagaacgcgggattatcgagtaggtgtcgttttttggatgttagcgaggaagttgtcgttagaattttgtagcggagtatgttcggttttagaatgtattcgttttagtaggaggttagta

SEQ ID NO: 38004 - DNA, 805 bp, Artificial Sequence
  chemically treated genomic DNA (Homo sapiens) CpG-island No: 38004
tactaacctcctactaaaacgaatacattctaaaaccgaacatactccgctacaaaattctaacgacaacttcctcgctaacatccaaaaaacgacacctactcgataatcccgcgttctccgaacgataaaatcacccgaaaaaactaataacgataaatcgtatcgcgcgtaaatttaatctctaaccaaaatcactaactcccaacgtctaacgatatttaacgcacaaaaaacgatctaccgaaaatctaacgtcaactaattaaaaccgacttcgaaaccgtcatacctatacgaaaacactacgtataacgaaaacctacgtaaataaacctaataccgctacgacgttaacgacaacgtcgacctcgacgtaaaacgaaaaaccgctacaaaaacattcgtacgccgcacaaaataaaattcgattctccgactaataccgtaaatatcaaaaattccgataaaactaaattttaacctaaaacgacgaccgtttttacgtccgcgattaacccgctaaattcgaaaaatcatccacaacgatcattccaccgtcgaaataaccgtacgcaactccccgattacccaaaaatccgaacgctacacgaacctcgaaaaaactcttaaaacaaaacttatccatactctaactaaatacgacgcatatcaaaaatccgtaccaaaaaaatcatcgaaaaatacgaacaaaccgaccttctaacttctaatcgtttactaatctctaatacttaattccgctaaaaataaacaatatacaacgttcccgactctccatcta

SEQ ID NO: 38005 - DNA, 1773 bp, Artificial Sequence
  chemically treated genomic DNA (Homo sapiens) CpG-island No: 38005
gtcgagtagggtgcgggtagtgtggcggatacgggatagtgcgaggtaaggtagaggagaggagagggataggggaggttaagtcgttcgtgatcgtttaggttaggtcgggttaaggattcggggtggggttcggcgcggaggggagggcggaggggagggtacggcgcggtgggtattgggggcgttgttacggggcgagcggtaagggggtaacgcgcgagcggagtggagtgagggttagggtagcgttacgggaggtgaggtgcgacgcgtcggaggtataagggtaaagacgtgggggttcgcggtgcggggggcggagtataagtgtggagcggggcgtagggttcggggatggggtcggtgggtgaggcggtcgagtaatgggggtggggggggggggttaggtaggggcggcggagggggggattgcgggggggggggggggagcgcgggttgtgcggggtgcgagtagggagaggggtaataaatgcgcgagggcgttgcgtagcgatggcggtgttaggtaagagcgggcggggggtgagatcgggtaaggtgcggacgagtcgtgagggtgtgggttcggaagggggtgaggtcgacggggggggggttacggatgacgggcggtaataggcgtcgatggtttaaggatgggataaggggacgcgcgaagggttgaggggagggttcggagttaggtagaagcggggttaggcgtgcggcgttcgagggcgtcggcgcggatgaggggggggggttacgcgatgggtggttgttcggcggttgcgggggggggacggggttgtagcgtggggcgtcggcgcgggcgaaggtcgtcggtcgagagggtggaataagcggatcgtttgtaaaaagaagtgcgatttgatggtttgggtcggtgttgattcgtttgaatgaatcgataggttcgaaggtgatgattttgcgtatatggacgaagtgggatttatggtgcgtagtatttttcgcgaagggcgattgatgtgttgtcggttggtaacgtacgtatggttgttcgttattgtagtcggtgcgtattattattcgtgaagagtgtaaaattttaggtcgtttgacggcgatcggtaggggaatgacgttagcgttatgcgcgtggatttggtgcgcgtttttatgacgaagtgatgtaggcgggaattcgtttcgggatcgcgttacgtttgatattattttttaggtttttttttattagcgaggatggggaaagtttttgatgatcgtttcggttgttatttgttggtgacgtattgcgcgaattgtacgacgtcgaattatttgcggaagtgtggttggtgtaagttttagcgaagaggtgggattacgcggcgggtaaattgttatttcgcggtgtcgtcggacgtcgttattgtgtttgatatcgtttgttgggcgaaaattttgattatggcgcggttaattatcgttagattggtaacgggttatgttggtgtaagcgataagtcgttgattgcgtcggtaaaatttatcgttgggtcgaaatcgtggcgttagaaattggcgtgtcgttgtaggtagatagtttagtaacggcggtacggacgtcgggtcggtgtatttaatcggtatcgcgtgtttatagtggtgatggggttagtaattcgttatggatattgcgcgtatcgattgtcgattgtcgcgatattttgtagatgtagtaatttttattgtttttatttaacgttttacgcgtgagacggt

SEQ ID NO: 38006 - DNA, 1773 bp, Artificial Sequence
  chemically treated genomic DNA (Homo sapiens) CpG-island No: 38006
accgtctcacgcgtaaaacgttaaataaaaacaataaaaattactacatctacaaaatatcgcgacaatcgacaatcgatacgcgcaatatccataacgaattactaaccccatcaccactataaacacgcgataccgattaaatacaccgacccgacgtccgtaccgccgttactaaactatctacctacaacgacacgccaatttctaacgccacgatttcgacccaacgataaattttaccgacgcaatcaacgacttatcgcttacaccaacataacccgttaccaatctaacgataattaaccgcgccataatcaaaattttcgcccaacaaacgatatcaaacacaataacgacgtccgacgacaccgcgaaataacaatttacccgccgcgtaatcccacctcttcgctaaaacttacaccaaccacacttccgcaaataattcgacgtcgtacaattcgcgcaatacgtcaccaacaaataacaaccgaaacgatcatcaaaaactttccccatcctcgctaataaaaaaaaacctaaaaaataatatcaaacgtaacgcgatcccgaaacgaattcccgcctacatcacttcgtcataaaaacgcgcaccaaatccacgcgcataacgctaacgtcattcccctaccgatcgccgtcaaacgacctaaaattttacactcttcacgaataataatacgcaccgactacaataacgaacaaccatacgtacgttaccaaccgacaacacatcaatcgcccttcgcgaaaaatactacgcaccataaatcccacttcgtccatatacgcaaaatcatcaccttcgaacctatcgattcattcaaacgaatcaacaccgacccaaaccatcaaatcgcacttctttttacaaacgatccgcttattccaccctctcgaccgacgaccttcgcccgcgccgacgccccacgctacaaccccgtcccccccccgcaaccgccgaacaaccacccatcgcgtaacccccccccctcatccgcgccgacgccctcgaacgccgcacgcctaaccccgcttctacctaactccgaaccctcccctcaacccttcgcgcgtccccttatcccatccttaaaccatcgacgcctattaccgcccgtcatccgtaaccccccccccgtcgacctcacccccttccgaacccacaccctcacgactcgtccgcaccttacccgatctcaccccccgcccgctcttacctaacaccgccatcgctacgcaacgccctcgcgcatttattacccctctccctactcgcaccccgcacaacccgcgctcccccccccccccccgcaatccccccctccgccgcccctacctaaccccccccccccacccccattactcgaccgcctcacccaccgaccccatccccgaaccctacgccccgctccacacttatactccgccccccgcaccgcgaacccccacgtctttacccttatacctccgacgcgtcgcacctcacctcccgtaacgctaccctaaccctcactccactccgctcgcgcgttacccccttaccgctcgccccgtaacaacgcccccaatacccaccgcgccgtaccctcccctccgccctcccctccgcgccgaaccccaccccgaatccttaacccgacctaacctaaacgatcacgaacgacttaacctcccctatccctctcctctcctctaccttacctcgcactatcccgtatccgccacactacccgcaccctactcgac

SEQ ID NO: 38007 - DNA, 1773 bp, Artificial Sequence
  chemically treated genomic DNA (Homo sapiens) CpG-island No: 38007
atcgttttacgcgtaagacgttgaataagggtaataaaagttgttgtatttgtaaaatgtcgcggtaatcggtaatcgatgcgcgtaatgtttatggcgggttgttggttttattattattgtgggtacgcggtgtcggttaagtgtatcgattcgacgttcgtgtcgtcgttgttgaattatttgtttgtaacggtacgttaatttttggcgttacggtttcgatttagcggtaagttttgtcggcgtaattagcgatttgtcgtttatattagtatggttcgttattaatttggcgatggttagtcgcgttataattaaagttttcgtttagtaggcggtattaagtataatggcgacgttcggcgatatcgcggggtggtagtttgttcgtcgcgtaattttattttttcgttggaatttgtattagttatattttcgtaggtagttcggcgtcgtgtagttcgcgtagtacgttattagtagatagtaatcgaggcggttattaaaggttttttttattttcgttggtgagggagaatttgaaaagtggtattaaacgtgacgcgatttcgggacgaattttcgtttgtattatttcgttataggagcgcgtattaagtttacgcgtatggcgttgacgttatttttttgtcggtcgtcgttaagcggtttggaattttgtattttttacgggtggtgatgcgtatcggttgtagtggcgggtagttatgcgtacgttgttaatcggtagtatattaatcgtttttcgcgggagatgttgcgtattataaattttatttcgtttatatgcgtaagattattattttcggatttgtcgatttatttaggcggattagtatcgatttagattattaaatcgtatttttttttgtaggcgattcgtttattttattttttcggtcggcggttttcgttcgcgtcggcgttttacgttgtaatttcgtttttttttcgtaatcgtcgagtagttatttatcgcgtaattttttttttttattcgcgtcggcgttttcgaacgtcgtacgtttggtttcgtttttatttgatttcgggttttttttttaatttttcgcgcgtttttttgttttatttttggattatcggcgtttattgtcgttcgttattcgtgatttttttttcgtcggttttattttttttcgggtttatatttttacggttcgttcgtattttgttcggttttatttttcgttcgtttttatttggtatcgttatcgttgcgtagcgttttcgcgtatttgttgtttttttttttattcgtatttcgtatagttcgcgttttttttttttttttcgtaattttttttttcgtcgtttttatttggttttttttttttatttttattgttcggtcgttttatttatcggttttattttcgagttttgcgtttcgttttatatttgtatttcgtttttcgtatcgcgggtttttacgtttttgtttttgtgttttcggcgcgtcgtattttatttttcgtggcgttgttttaatttttattttatttcgttcgcgcgttgtttttttatcgttcgtttcgtggtagcgtttttagtgtttatcgcgtcgtgttttttttttcgttttttttttcgcgtcgaattttatttcggatttttgattcgatttggtttggacggttacgggcggtttggttttttttgtttttttttttttttttgttttgtttcgtattatttcgtgttcgttatattgttcgtattttgttcgat

SEQ ID NO: 38008 - DNA, 1773 bp, Artificial Sequence
  chemically treated genomic DNA (Homo sapiens) CpG-island No: 38008
atcgaacaaaatacgaacaatataacgaacacgaaataatacgaaacaaaacaaaaaaaaaaaaaaaaacaaaaaaaaccaaaccgcccgtaaccgtccaaaccaaatcgaatcaaaaatccgaaataaaattcgacgcgaaaaaaaaaacgaaaaaaaaaacacgacgcgataaacactaaaaacgctaccacgaaacgaacgataaaaaaacaacgcgcgaacgaaataaaataaaaattaaaacaacgccacgaaaaataaaatacgacgcgccgaaaacacaaaaacaaaaacgtaaaaacccgcgatacgaaaaacgaaatacaaatataaaacgaaacgcaaaactcgaaaataaaaccgataaataaaacgaccgaacaataaaaataaaaaaaaaaaaccaaataaaaacgacgaaaaaaaaaattacgaaaaaaaaaaaaaaaacgcgaactatacgaaatacgaataaaaaaaaaaacaacaaatacgcgaaaacgctacgcaacgataacgataccaaataaaaacgaacgaaaaataaaaccgaacaaaatacgaacgaaccgtaaaaatataaacccgaaaaaaaataaaaccgacgaaaaaaaaatcacgaataacgaacgacaataaacgccgataatccaaaaataaaacaaaaaaacgcgcgaaaaattaaaaaaaaaacccgaaatcaaataaaaacgaaaccaaacgtacgacgttcgaaaacgccgacgcgaataaaaaaaaaaaattacgcgataaataactactcgacgattacgaaaaaaaaacgaaattacaacgtaaaacgccgacgcgaacgaaaaccgccgaccgaaaaaataaaataaacgaatcgcctacaaaaaaaaatacgatttaataatctaaatcgatactaatccgcctaaataaatcgacaaatccgaaaataataatcttacgcatataaacgaaataaaatttataatacgcaacatctcccgcgaaaaacgattaatatactaccgattaacaacgtacgcataactacccgccactacaaccgatacgcatcaccacccgtaaaaaatacaaaattccaaaccgcttaacgacgaccgacaaaaaaataacgtcaacgccatacgcgtaaacttaatacgcgctcctataacgaaataatacaaacgaaaattcgtcccgaaatcgcgtcacgtttaataccacttttcaaattctccctcaccaacgaaaataaaaaaaacctttaataaccgcctcgattactatctactaataacgtactacgcgaactacacgacgccgaactacctacgaaaatataactaatacaaattccaacgaaaaaataaaattacgcgacgaacaaactaccaccccgcgatatcgccgaacgtcgccattatacttaataccgcctactaaacgaaaactttaattataacgcgactaaccatcgccaaattaataacgaaccatactaatataaacgacaaatcgctaattacgccgacaaaacttaccgctaaatcgaaaccgtaacgccaaaaattaacgtaccgttacaaacaaataattcaacaacgacgacacgaacgtcgaatcgatacacttaaccgacaccgcgtacccacaataataataaaaccaacaacccgccataaacattacgcgcatcgattaccgattaccgcgacattttacaaatacaacaacttttattacccttattcaacgtcttacgcgtaaaacgat

SEQ ID NO: 38009 - DNA, 746 bp, Artificial Sequence
  chemically treated genomic DNA (Homo sapiens) CpG-island No: 38009
tttttttttagggggggggtttttttttggttttgatatttttcgggtagttcgtgcgacgcgattgttgcgggaggggtggtacggttgtttgagtgacgtaatgcgaggacgggaagaacggagtggagagggggcgaagagaaagagagaaagggcgggaggggcgacgtaaacggggaggttgcgttcgggggatgacgtcggacgttggttgagaaatcgacggcgttgtgaggggtagtggagtgggggataggagggaggggtaaaggggattgtaattagttaaagcgggtgggatgcgtgacggacgggggcggaggagcgtagcggcgtgtttcgtataggcgggcgtgcggggggcgagcgcgaagagggggcgtaaagggcgtgagcggggatcgtacgggacgagggtgagttagaggaattgtatatcggtcgaggggcgtcgtagcggttggtgaaagggcgcgaggaaggaagcgaaaaatgaggagttgggatgtgggaatgcgggttgggacggatatgagggcgagggggtgggaggatgtgagtgagagttgagtagaggaattgtcggtacggggacgcgggcgaagataaggggagcgagagcggcgcgcgaaatagggtattacgtgcgtaatgttgttgagtcgggttagggaaaaaaagggggaaaggggggagtcgatcgtttatatttatgatttataggatttggtgaaattcgtttt

SEQ ID NO: 38010 - DNA, 746 bp, Artificial Sequence
  chemically treated genomic DNA (Homo sapiens) CpG-island No: 38010
aaaacgaatttcaccaaatcctataaatcataaatataaacgatcgactcccccctttccccctttttttccctaacccgactcaacaacattacgcacgtaataccctatttcgcgcgccgctctcgctccccttatcttcgcccgcgtccccgtaccgacaattcctctactcaactctcactcacatcctcccaccccctcgccctcatatccgtcccaacccgcattcccacatcccaactcctcatttttcgcttccttcctcgcgccctttcaccaaccgctacgacgcccctcgaccgatatacaattcctctaactcaccctcgtcccgtacgatccccgctcacgccctttacgccccctcttcgcgctcgccccccgcacgcccgcctatacgaaacacgccgctacgctcctccgcccccgtccgtcacgcatcccacccgctttaactaattacaatcccctttacccctccctcctatcccccactccactacccctcacaacgccgtcgatttctcaaccaacgtccgacgtcatcccccgaacgcaacctccccgtttacgtcgcccctcccgccctttctctctttctcttcgccccctctccactccgttcttcccgtcctcgcattacgtcactcaaacaaccgtaccacccctcccgcaacaatcgcgtcgcacgaactacccgaaaaatatcaaaaccaaaaaaaaaccccccccctaaaaaaaaa

SEQ ID NO: 38011 - DNA, 746 bp, Artificial Sequence
  chemically treated genomic DNA (Homo sapiens) CpG-island No: 38011
aaggcgggttttattaaattttgtaagttataggtgtagacggtcggtttttttttttttttttttttttttttggttcggtttaatagtattacgtacgtggtgttttatttcgcgcgtcgttttcgttttttttattttcgttcgcgttttcgtgtcggtagtttttttgtttagtttttatttatatttttttattttttcgtttttatattcgttttaattcgtatttttatattttaattttttatttttcgttttttttttcgcgtttttttattagtcgttgcggcgtttttcggtcgatatgtagtttttttggtttattttcgtttcgtgcggttttcgtttacgttttttgcgtttttttttcgcgttcgtttttcgtacgttcgtttgtacgaggtacgtcgttacgttttttcgttttcgttcgttacgtattttattcgttttggttggttgtaattttttttgttttttttttttgttttttattttattattttttatagcgtcgtcggttttttagttagcgttcggcgttatttttcgggcgtagttttttcgtttgcgtcgtttttttcgtttttttttttttttttttcgttttttttttatttcgtttttttcgttttcgtattacgttatttaggtagtcgtattatttttttcgtagtaatcgcgtcgtacgagttattcgggggatattagagttaagggggaattttttttttgaggggaaa

SEQ ID NO: 38012 - DNA, 746 bp, Artificial Sequence
  chemically treated genomic DNA (Homo sapiens) CpG-island No: 38012
tttcccctcaaaaaaaaaattcccccttaactctaatatcccccgaataactcgtacgacgcgattactacgaaaaaaataatacgactacctaaataacgtaatacgaaaacgaaaaaaacgaaataaaaaaaaaacgaaaaaaaaaaaaaaaaaaacgaaaaaaacgacgcaaacgaaaaaactacgcccgaaaaataacgccgaacgctaactaaaaaaccgacgacgctataaaaaataataaaataaaaaacaaaaaaaaaaaacaaaaaaaattacaaccaaccaaaacgaataaaatacgtaacgaacgaaaacgaaaaaacgtaacgacgtacctcgtacaaacgaacgtacgaaaaacgaacgcgaaaaaaaaacgcaaaaaacgtaaacgaaaaccgcacgaaacgaaaataaaccaaaaaaactacatatcgaccgaaaaacgccgcaacgactaataaaaaaacgcgaaaaaaaaaacgaaaaataaaaaattaaaatataaaaatacgaattaaaacgaatataaaaacgaaaaaataaaaaaatataaataaaaactaaacaaaaaaactaccgacacgaaaacgcgaacgaaaataaaaaaaacgaaaacgacgcgcgaaataaaacaccacgtacgtaatactattaaaccgaaccaaaaaaaaaaaaaaaaaaaaaaaaaaaccgaccgtctacacctataacttacaaaatttaataaaacccgcctt

SEQ ID NO: 38013 - DNA, 879 bp, Artificial Sequence
  chemically treated genomic DNA (Homo sapiens) CpG-island No: 38013
gtgtggtcgttttcgttattcggttaacgagataatatgattttggggaaaggacgtagcgtggtcgttttcgttattcggttaacgagataatacgattttggggaaaggatatagggtggtcgttttcgttattcggttaacgagagagtataattttggggaaaggacgtagtgtggtcgtttttattatttatttaacgagagagtacgattttggggaaaggatgtagtgtggtcgttttcgttattcggttaacgagagagtataattttggggaaaggacgtagtgtggtcgtttttattattcggttaacgagagagtacgattttggggaaaggatgtagtgtggtcgttttcgttatttagttaacgagagagtacgattttggggaaaggacgtagtgtggtcgttttcgttatttagttaacgagagagtacgattttggggaaaggatgtagtgtggtcgttttcgttatttagttaacgagagagtacgattttggggaaaggatgtagtgtggtcgttttcgttatttagttaacgagagagtacgattttggggaaaggatgtagtgtggtcgttttcgttattcggttaacgagagagtacgattttggggaaaggacgtagtgtggtcgttttcgttattcggttaacgagagagtacgattttggggaaaggatgtagtgtggtcgttttcgttattcggttaacgagagagtacgattttggggaaaggacgtagtgtggtcgttttcgttatttagttaacgagagagtacgattttggggaaaggacgtagtgtggtcgtttttttttcggagttgatgttttagaattagattagttagggacggtgaggagttag

SEQ ID NO: 38014 - DNA, 879 bp, Artificial Sequence
  chemically treated genomic DNA (Homo sapiens) CpG-island No: 38014
ctaactcctcaccgtccctaactaatctaattctaaaacatcaactccgaaaaaaaaacgaccacactacgtcctttccccaaaatcgtactctctcgttaactaaataacgaaaacgaccacactacgtcctttccccaaaatcgtactctctcgttaaccgaataacgaaaacgaccacactacatcctttccccaaaatcgtactctctcgttaaccgaataacgaaaacgaccacactacgtcctttccccaaaatcgtactctctcgttaaccgaataacgaaaacgaccacactacatcctttccccaaaatcgtactctctcgttaactaaataacgaaaacgaccacactacatcctttccccaaaatcgtactctctcgttaactaaataacgaaaacgaccacactacatcctttccccaaaatcgtactctctcgttaactaaataacgaaaacgaccacactacgtcctttccccaaaatcgtactctctcgttaactaaataacgaaaacgaccacactacatcctttccccaaaatcgtactctctcgttaaccgaataataaaaacgaccacactacgtcctttccccaaaattatactctctcgttaaccgaataacgaaaacgaccacactacatcctttccccaaaatcgtactctctcgttaaataaataataaaaacgaccacactacgtcctttccccaaaattatactctctcgttaaccgaataacgaaaacgaccaccctatatcctttccccaaaatcgtattatctcgttaaccgaataacgaaaacgaccacgctacgtcctttccccaaaatcatattatctcgttaaccgaataacgaaaacgaccacac

SEQ ID NO: 38015 - DNA, 879 bp, Artificial Sequence
  chemically treated genomic DNA (Homo sapiens) CpG-island No: 38015
ttaattttttatcgtttttggttggtttggttttagaatattagtttcgagaggagagcggttatattgcgttttttttttagggtcgtgttttttcgttgattgagtgacgagagcggttatattgcgttttttttttagggtcgtgttttttcgttgatcgagtgacgagagcggttatattgtattttttttttagggtcgtgttttttcgttgatcgagtgacgagagcggttatattgcgttttttttttagggtcgtgttttttcgttgatcgagtgacgagagcggttatattgtattttttttttagggtcgtgttttttcgttgattgagtgacgagagcggttatattgtattttttttttagggtcgtgttttttcgttgattgagtgacgagagcggttatattgtattttttttttagggtcgtgttttttcgttgattgagtgacgagagcggttatattgcgttttttttttagggtcgtgttttttcgttgattgagtgacgagagcggttatattgtattttttttttagggtcgtgttttttcgttgatcgagtgatgagagcggttatattgcgttttttttttagggttgtgttttttcgttgatcgagtgacgagagcggttatattgtattttttttttagggtcgtgttttttcgttgaatgagtgatgagagcggttatattgcgttttttttttagggttgtgttttttcgttgatcgagtgacgagggcggttattttgtgttttttttttagggtcgtgttgtttcgttgatcgagtgacgagagcggttacgttgcgttttttttttagggttatgttgtttcgttgatcgagtgacgagagcggttatat

SEQ ID NO: 38016 - DNA, 879 bp, Artificial Sequence
  chemically treated genomic DNA (Homo sapiens) CpG-island No: 38016
atataaccgctctcgtcactcgatcaacgaaacaacataaccctaaaaaaaaaacgcaacgtaaccgctctcgtcactcgatcaacgaaacaacacgaccctaaaaaaaaaacacaaaataaccgccctcgtcactcgatcaacgaaaaaacacaaccctaaaaaaaaaacgcaatataaccgctctcatcactcattcaacgaaaaaacacgaccctaaaaaaaaaatacaatataaccgctctcgtcactcgatcaacgaaaaaacacaaccctaaaaaaaaaacgcaatataaccgctctcatcactcgatcaacgaaaaaacacgaccctaaaaaaaaaatacaatataaccgctctcgtcactcaatcaacgaaaaaacacgaccctaaaaaaaaaacgcaatataaccgctctcgtcactcaatcaacgaaaaaacacgaccctaaaaaaaaaatacaatataaccgctctcgtcactcaatcaacgaaaaaacacgaccctaaaaaaaaaatacaatataaccgctctcgtcactcaatcaacgaaaaaacacgaccctaaaaaaaaaatacaatataaccgctctcgtcactcgatcaacgaaaaaacacgaccctaaaaaaaaaacgcaatataaccgctctcgtcactcgatcaacgaaaaaacacgaccctaaaaaaaaaatacaatataaccgctctcgtcactcgatcaacgaaaaaacacgaccctaaaaaaaaaacgcaatataaccgctctcgtcactcaatcaacgaaaaaacacgaccctaaaaaaaaaacgcaatataaccgctctcctctcgaaactaatattctaaaaccaaaccaaccaaaaacgataaaaaattaa

SEQ ID NO: 38017 - DNA, 671 bp, Artificial Sequence
  chemically treated genomic DNA (Homo sapiens) CpG-island No: 38017
gtcggcggcggcggggttgtggttacgggggagcgggtggcggtcgcggggtttcggtgagtcgggtcggggtgtacgggggtcgaggcggttttcgagtcgggtcggagttgtcgggagtttgggaaatacggtttaggcgattttttttcgggagttgtagttttgttttgggggcggcgcgcggttcggttttcggggcgagttttttcgcggggcgggcggcgcgcgcggaggttgagggggagggggagtatgttcggttggagttcggtttcggggcgcgtttcggtcgtcgtttttattttcgtttttttttttttttttttcgttttttttttttttttttttagtttcgtcgtcgcggtagttaatattggttgcgtttcggagttcgggaggcggtcgttgttgagcgtcgttcgtcgtttcgggtttttagttcgtttaggtttcggtttatggttttcgtcgttttacggttttcggcgttttagggttgttgtcgaggtgttcgtttgttcgttcgtcggtttcggggggttcgggaggcgttcggcggggcggggcggcgcggttcgttattatggagttttagcgtcgggagttgttcgtttagtgttagtagagtttggtttaggttatgacggaggtggaagtcgtgttcgggt

SEQ ID NO: 38018 - DNA, 671 bp, Artificial Sequence
  chemically treated genomic DNA (Homo sapiens) CpG-island No: 38018
acccgaacacgacttccacctccgtcataacctaaaccaaactctactaacactaaacgaacaactcccgacgctaaaactccataataacgaaccgcgccgccccgccccgccgaacgcctcccgaaccccccgaaaccgacgaacgaacaaacgaacacctcgacaacaaccctaaaacgccgaaaaccgtaaaacgacgaaaaccataaaccgaaacctaaacgaactaaaaacccgaaacgacgaacgacgctcaacaacgaccgcctcccgaactccgaaacgcaaccaatattaactaccgcgacgacgaaactaaaaaaaaaaaaaaaaaaaacgaaaaaaaaaaaaaaaaaaacgaaaataaaaacgacgaccgaaacgcgccccgaaaccgaactccaaccgaacatactccccctccccctcaacctccgcgcgcgccgcccgccccgcgaaaaaactcgccccgaaaaccgaaccgcgcgccgcccccaaaacaaaactacaactcccgaaaaaaaatcgcctaaaccgtatttcccaaactcccgacaactccgacccgactcgaaaaccgcctcgacccccgtacaccccgacccgactcaccgaaaccccgcgaccgccacccgctcccccgtaaccacaaccccgccgccgccgac

SEQ ID NO: 38019 - DNA, 671 bp, Artificial Sequence
  chemically treated genomic DNA (Homo sapiens) CpG-island No: 38019
gttcgagtacggtttttattttcgttatggtttgggttaggttttgttgatattgggcgagtagttttcggcgttggggttttatggtggcgggtcgcgtcgtttcgtttcgtcggacgtttttcgggtttttcgaggtcggcgggcgggtaggcgagtatttcggtagtagttttagggcgtcgggagtcgtgaggcggcgggagttatgggtcggggtttgggcgggttgggggttcggggcggcgggcggcgtttagtagcggtcgtttttcgggtttcggagcgtagttaatgttggttgtcgcggcggcgggattggaagaggaggaggaggagacggaggaggagaaggaggaggcggaggtggggacggcggtcggggcgcgtttcgaggtcgggttttagtcgggtatgtttttttttttttttagttttcgcgcgcgtcgttcgtttcgcgagaaaattcgtttcgaaagtcgggtcgcgcgtcgtttttagagtaagattataattttcgggagaaagtcgtttgggtcgtgttttttaggttttcgatagtttcggttcggttcggaggtcgtttcggttttcgtgtatttcggttcggtttatcggggtttcgcggtcgttattcgttttttcgtggttatagtttcgtcgtcgtcggt

SEQ ID NO: 38020 - DNA, 671 bp, Artificial Sequence
  chemically treated genomic DNA (Homo sapiens) CpG-island No: 38020
accgacgacgacgaaactataaccacgaaaaaacgaataacgaccgcgaaaccccgataaaccgaaccgaaatacacgaaaaccgaaacgacctccgaaccgaaccgaaactatcgaaaacctaaaaaacacgacccaaacgactttctcccgaaaattataatcttactctaaaaacgacgcgcgacccgactttcgaaacgaattttctcgcgaaacgaacgacgcgcgcgaaaactaaaaaaaaaaaaaaacatacccgactaaaacccgacctcgaaacgcgccccgaccgccgtccccacctccgcctcctccttctcctcctccgtctcctcctcctcctcttccaatcccgccgccgcgacaaccaacattaactacgctccgaaacccgaaaaacgaccgctactaaacgccgcccgccgccccgaacccccaacccgcccaaaccccgacccataactcccgccgcctcacgactcccgacgccctaaaactactaccgaaatactcgcctacccgcccgccgacctcgaaaaacccgaaaaacgtccgacgaaacgaaacgacgcgacccgccaccataaaaccccaacgccgaaaactactcgcccaatatcaacaaaacctaacccaaaccataacgaaaataaaaaccgtactcgaac

SEQ ID NO: 38021 - DNA, 576 bp, Artificial Sequence
  chemically treated genomic DNA (Homo sapiens) CpG-island No: 38021
ttcgaggattgtagattatgatgcgggtgggtgtcgttttcgttagatttgtttacgttcggtgatgcgcggggtgtatcgttgaggagattatgcggcgtttcggggggttgtagttcggtatttgtcggtgggtttttcggttacggcgggttaggattgattattcgtagttaggtgtttttttttcgggtggttagtgtagtgcgagtatttttcggggagaagagtatgtttcggaattaggtggggttcgttcgtcgtggggtcgtattattaatttgtggcggtcgggttggggttgatcgcgcgggtcgttttcgaagcgtttttatatcgtcggggtcgttcgtgcgttgtgttgcgttttaggcgttatttggtttttcgcgggttcgtgacggggttagggtttataggttcgagtcggtaatcggtgcgagtagtcgggcggtcgatcggcggttttttaggtcggtcgtttatgcgtttttcgtaggttacgtgttggtttgtggcgtggagttaggagtttttgggtcgtttttttaagtttgtagtgggttcggtgttgtg

SEQ ID NO: 38022 - DNA, 576 bp, Artificial Sequence
  chemically treated genomic DNA (Homo sapiens) CpG-island No: 38022
cacaacaccgaacccactacaaacttaaaaaaacgacccaaaaactcctaactccacgccacaaaccaacacgtaacctacgaaaaacgcataaacgaccgacctaaaaaaccgccgatcgaccgcccgactactcgcaccgattaccgactcgaacctataaaccctaaccccgtcacgaacccgcgaaaaaccaaataacgcctaaaacgcaacacaacgcacgaacgaccccgacgatataaaaacgcttcgaaaacgacccgcgcgatcaaccccaacccgaccgccacaaattaataatacgaccccacgacgaacgaaccccacctaattccgaaacatactcttctccccgaaaaatactcgcactacactaaccacccgaaaaaaaaacacctaactacgaataatcaatcctaacccgccgtaaccgaaaaacccaccgacaaataccgaactacaaccccccgaaacgccgcataatctcctcaacgatacaccccgcgcatcaccgaacgtaaacaaatctaacgaaaacgacacccacccgcatcataatctacaatcctcgaa

SEQ ID NO: 38023 - DNA, 576 bp, Artificial Sequence
  chemically treated genomic DNA (Homo sapiens) CpG-island No: 38023
tatagtatcggatttattgtaggtttgagggagcgatttagaaatttttggttttacgttatagattagtacgtgatttacgaggggcgtatgggcggtcggtttgagggatcgtcgatcgatcgttcgattgttcgtatcggttgtcggttcgaatttatggattttggtttcgttacggattcgcggaagattaggtaacgtttggggcgtagtatagcgtacggacggtttcgacggtgtgggaacgtttcggaagcgattcgcgcggttagttttaattcgatcgttataggttggtgatgcggttttacggcgaacgggttttatttgatttcgggatatattttttttttcgaaagatgttcgtattgtattaattattcgggggaaaggtatttggttgcgaatgattagttttggttcgtcgtgatcgggaagtttatcggtaggtgtcgggttataatttttcgaagcgtcgtatgatttttttagcgatatatttcgcgtattatcggacgtaagtagatttggcggaaacgatatttattcgtattataatttatagttttcgaa

SEQ ID NO: 38024 - DNA, 576 bp, Artificial Sequence
  chemically treated genomic DNA (Homo sapiens) CpG-island No: 38024
ttcgaaaactataaattataatacgaataaatatcgtttccgccaaatctacttacgtccgataatacgcgaaatatatcgctaaaaaaatcatacgacgcttcgaaaaattataacccgacacctaccgataaacttcccgatcacgacgaaccaaaactaatcattcgcaaccaaatacctttcccccgaataattaatacaatacgaacatctttcgaaaaaaaaaatatatcccgaaatcaaataaaacccgttcgccgtaaaaccgcatcaccaacctataacgatcgaattaaaactaaccgcgcgaatcgcttccgaaacgttcccacaccgtcgaaaccgtccgtacgctatactacgccccaaacgttacctaatcttccgcgaatccgtaacgaaaccaaaatccataaattcgaaccgacaaccgatacgaacaatcgaacgatcgatcgacgatccctcaaaccgaccgcccatacgcccctcgtaaatcacgtactaatctataacgtaaaaccaaaaatttctaaatcgctccctcaaacctacaataaatccgatactata

SEQ ID NO: 38025 - DNA, 881 bp, Artificial Sequence
  chemically treated genomic DNA (Homo sapiens) CpG-island No: 38025
tttagcggtgtcggggtttagcgcgtaggacggttggggggtttcggagcgggcggttaggattcgcgtagttagttggtgttagcgagcgtcgcggtcgttggggattttagtttttagtaggtatcgtttttgcggtcgacgcgcgtggcggcggtgtcggttgggattcgtagtgcggttcgggtaggagagagtagggggttacgttggttttatttacgtacgtttcggaaatcgggttcggaggggattacgttcgtttattcgtgttcggcgtttttcggagttggggttagaggagtcgggtcggtcgtagcgggaagaggttataggcggtcgcgtacgtggggggtggttagcgcggaggaattcggaagttttttgtatcgtttatcgtcgcggtgacgggttaacgttttttttggtggaggtaggggcgggcggggcggaaggcggggacgttttagttaatattttcgaggatcgttcgcgagtcgttttttttatttttacggacgcgacgtagcgcgggtttcgttttttcggtcgcggcgtttgcgtaaaagtttcgttttttcgttcgagttttatttttatatcgtagtttttatcgtcgttatttttttttttttttttgttttttttttttgttttttttttttttttttttttggttttcgcgtttttttttatttcggcgttgacgttcgcgtaggggttttggcgttagacgcgcgggggcggggcgagtgcggcgcggggtataagtagagggtgtaggaggcggtgttttttttttttttcggcggttagtgttgagagtgcggagtgtgtgtttcgggttcggaatatatatttattattaaaaaatttaaaaa

SEQ ID NO: 38026 - DNA, 881 bp, Artificial Sequence
  chemically treated genomic DNA (Homo sapiens) CpG-island No: 38026
tttttaaattttttaataataaatatatattccgaacccgaaacacacactccgcactctcaacactaaccgccgaaaaaaaaaaaaaacaccgcctcctacaccctctacttataccccgcgccgcactcgccccgcccccgcgcgtctaacgccaaaacccctacgcgaacgtcaacgccgaaataaaaaaaaacgcgaaaaccaaaaaaaaaaaaaaaaaaaaaacaaaaaaaaaaaacaaaaaaaaaaaaaaaaataacgacgataaaaactacgatataaaaataaaactcgaacgaaaaaacgaaacttttacgcaaacgccgcgaccgaaaaaacgaaacccgcgctacgtcgcgtccgtaaaaataaaaaaaacgactcgcgaacgatcctcgaaaatattaactaaaacgtccccgccttccgccccgcccgcccctacctccaccaaaaaaaacgttaacccgtcaccgcgacgataaacgatacaaaaaacttccgaattcctccgcgctaaccaccccccacgtacgcgaccgcctataacctcttcccgctacgaccgacccgactcctctaaccccaactccgaaaaacgccgaacacgaataaacgaacgtaatcccctccgaacccgatttccgaaacgtacgtaaataaaaccaacgtaaccccctactctctcctacccgaaccgcactacgaatcccaaccgacaccgccgccacgcgcgtcgaccgcaaaaacgatacctactaaaaactaaaatccccaacgaccgcgacgctcgctaacaccaactaactacgcgaatcctaaccgcccgctccgaaaccccccaaccgtcctacgcgctaaaccccgacaccgctaaa

SEQ ID NO: 38027 - DNA, 881 bp, Artificial Sequence
  chemically treated genomic DNA (Homo sapiens) CpG-island No: 38027
tttttggattttttaataataaatgtgtgtttcgagttcggagtatatatttcgtatttttagtattaatcgtcggggagaaggggaagtatcgttttttgtattttttatttatatttcgcgtcgtattcgtttcgttttcgcgcgtttgacgttagggtttttacgcgagcgttagcgtcggagtaggaggagacgcggaggttagggggaggagggaagagaaaataggaggaaagagtagagaggaagggagaggtggcggcggtggaggttgcggtgtgggggtggggttcgggcgaaggggcggggtttttgcgtaggcgtcgcggtcggggaagcggagttcgcgttgcgtcgcgttcgtgggggtggggaggacggttcgcgggcggttttcgggggtgttggttgaggcgttttcgtttttcgtttcgttcgtttttgtttttattaggaggagcgttaattcgttatcgcggcggtgggcggtgtaaagggttttcgggttttttcgcgttaattattttttacgtgcgcggtcgtttgtggttttttttcgttgcggtcggttcggtttttttagttttagtttcgggggacgtcgggtacgggtgagcgggcgtggtttttttcgggttcggttttcgaaacgtgcgtagatggagttagcgtggttttttgtttttttttattcggatcgtattacgagttttagtcggtatcgtcgttacgcgcgtcggtcgtagaagcggtgtttgttgggagttggagtttttaacggtcgcggcgttcgttgatattaattggttgcgcgggttttggtcgttcgtttcgggattttttaatcgttttgcgcgttggatttcggtatcgttgga

SEQ ID NO: 38028 - DNA, 881 bp, Artificial Sequence
  chemically treated genomic DNA (Homo sapiens) CpG-island No: 38028
tccaacgataccgaaatccaacgcgcaaaacgattaaaaaatcccgaaacgaacgaccaaaacccgcgcaaccaattaatatcaacgaacgccgcgaccgttaaaaactccaactcccaacaaacaccgcttctacgaccgacgcgcgtaacgacgataccgactaaaactcgtaatacgatccgaataaaaaaaaacaaaaaaccacgctaactccatctacgcacgtttcgaaaaccgaacccgaaaaaaaccacgcccgctcacccgtacccgacgtcccccgaaactaaaactaaaaaaaccgaaccgaccgcaacgaaaaaaaaccacaaacgaccgcgcacgtaaaaaataattaacgcgaaaaaacccgaaaaccctttacaccgcccaccgccgcgataacgaattaacgctcctcctaataaaaacaaaaacgaacgaaacgaaaaacgaaaacgcctcaaccaacacccccgaaaaccgcccgcgaaccgtcctccccacccccacgaacgcgacgcaacgcgaactccgcttccccgaccgcgacgcctacgcaaaaaccccgccccttcgcccgaaccccacccccacaccgcaacctccaccgccgccacctctcccttcctctctactctttcctcctattttctcttccctcctccccctaacctccgcgtctcctcctactccgacgctaacgctcgcgtaaaaaccctaacgtcaaacgcgcgaaaacgaaacgaatacgacgcgaaatataaataaaaaatacaaaaaacgatacttccccttctccccgacgattaatactaaaaatacgaaatatatactccgaactcgaaacacacatttattattaaaaaatccaaaaa

SEQ ID NO: 38029 - DNA, 902 bp, Artificial Sequence
  chemically treated genomic DNA (Homo sapiens) CpG-island No: 38029
gttcgcggtttcgtagtagttttaagaaggaattaagagatcgaggttttttcgttgttcggattcgatatcgttattttcgtttttcgtcggtagtcggtagttagcggtagtggatcgatttcgttttgcggtcgttgagtagtttttaatttcggttgatttttgtttttttgcgtttgtttttcgttttttttttttcggtttcggtttttagtttcggtattcgtttttttttttttacggaaaggtcgcggtttgtggttttgcgggtagtcgtgtcgagatgaattttagtgtttttagttattttatggtttcgttttacgtgggggatttttatttcgacgtgatcgaggcgatgttttacgagaagtttagttcggtcgggtttattttttttattcgggtttgtagggatatgattattcgtcgttttttgggttacgcgtatgtgaatttttagtagtcggcggacggtgagcgtcgggtttcgcggtcggtcgggcgggcgggcggttatgaggttcgggcggcggcggcgggcggggtaggtcggcgggttcggggaggggggcgggagggtatgttatttcgcgacggtcggcgggaaggcgtcggggtttttggagtcgcgtttttcgagtcggcggggattcgcgttgtcggtagttatacgttcggttatttttttttttgcgattattttttcggttttagacgtttttaaattttagggtgatgacgcgtcgggagggtgggtgagattcggttttttcgcggcgttttcgttagtggtttcgggattttggggcgttgaacgttgagtttttttcgtgggtaagaggtggaggcgtttttattattcggagtttttgtcggcgttttagtttggggaggaa

SEQ ID NO: 38030 - DNA, 902 bp, Artificial Sequence
  chemically treated genomic DNA (Homo sapiens) CpG-island No: 38030
ttcctccccaaactaaaacgccgacaaaaactccgaataataaaaacgcctccacctcttacccacgaaaaaaactcaacgttcaacgccccaaaatcccgaaaccactaacgaaaacgccgcgaaaaaaccgaatctcacccaccctcccgacgcgtcatcaccctaaaatttaaaaacgtctaaaaccgaaaaaataatcgcaaaaaaaaaaataaccgaacgtataactaccgacaacgcgaatccccgccgactcgaaaaacgcgactccaaaaaccccgacgccttcccgccgaccgtcgcgaaataacataccctcccgcccccctccccgaacccgccgacctaccccgcccgccgccgccgcccgaacctcataaccgcccgcccgcccgaccgaccgcgaaacccgacgctcaccgtccgccgactactaaaaattcacatacgcgtaacccaaaaaacgacgaataatcatatccctacaaacccgaataaaaaaaataaacccgaccgaactaaacttctcgtaaaacatcgcctcgatcacgtcgaaataaaaatcccccacgtaaaacgaaaccataaaataactaaaaacactaaaattcatctcgacacgactacccgcaaaaccacaaaccgcgacctttccgtaaaaaaaaaaaaacgaataccgaaactaaaaaccgaaaccgaaaaaaaaaaaacgaaaaacaaacgcaaaaaaacaaaaatcaaccgaaattaaaaactactcaacgaccgcaaaacgaaatcgatccactaccgctaactaccgactaccgacgaaaaacgaaaataacgatatcgaatccgaacaacgaaaaaacctcgatctcttaattccttcttaaaactactacgaaaccgcgaac

SEQ ID NO: 38031 - DNA, 902 bp, Artificial Sequence
  chemically treated genomic DNA (Homo sapiens) CpG-island No: 38031
tttttttttaggttggggcgtcggtaggagtttcgggtggtgggagcgtttttattttttatttacggaaggagtttagcgtttaacgttttagaatttcggggttattggcgggagcgtcgcggaggaatcgaattttatttattttttcggcgcgttattattttaaagtttgagagcgtttgaggtcgagaaaatggtcgtaaaggaggaagtagtcgggcgtgtggttgtcggtagcgcgggttttcgtcggttcgggaaacgcggttttagggatttcggcgttttttcgtcggtcgtcgcggggtgatatgttttttcgttttttttttcgggttcgtcggtttatttcgttcgtcgtcgtcgttcgagttttatggtcgttcgttcgttcggtcgatcgcggagttcggcgtttatcgttcgtcggttgttggaagtttatatacgcgtagtttaaggagcggcgggtgattatgtttttgtagattcggatggagaggatgggttcggtcgggttgaatttttcgtagagtatcgtttcggttacgtcggggtggaggttttttacgtagagcgaggttatggggtagttgggggtattggggtttatttcggtacggttgttcgtagggttataggtcgcgattttttcgtgagaggaggagagcgagtgtcggggttgggggtcggagtcggggggaggggagcggggagtaagcgtagagggataaaaattaatcggaattgaaaattatttaacggtcgtagaacggggtcgatttattgtcgttggttgtcggttgtcggcggggagcgagggtggcggtgtcgggttcgggtagcgggaaggtttcggttttttggtttttttttggagttgttgcggggtcgcgggt

SEQ ID NO: 38032 - DNA, 902 bp, Artificial Sequence
  chemically treated genomic DNA (Homo sapiens) CpG-island No: 38032
acccgcgaccccgcaacaactccaaaaaaaaaccaaaaaaccgaaaccttcccgctacccgaacccgacaccgccaccctcgctccccgccgacaaccgacaaccaacgacaataaatcgaccccgttctacgaccgttaaataattttcaattccgattaatttttatccctctacgcttactccccgctcccctccccccgactccgacccccaaccccgacactcgctctcctcctctcacgaaaaaatcgcgacctataaccctacgaacaaccgtaccgaaataaaccccaatacccccaactaccccataacctcgctctacgtaaaaaacctccaccccgacgtaaccgaaacgatactctacgaaaaattcaacccgaccgaacccatcctctccatccgaatctacaaaaacataatcacccgccgctccttaaactacgcgtatataaacttccaacaaccgacgaacgataaacgccgaactccgcgatcgaccgaacgaacgaacgaccataaaactcgaacgacgacgacgaacgaaataaaccgacgaacccgaaaaaaaaaacgaaaaaacatatcaccccgcgacgaccgacgaaaaaacgccgaaatccctaaaaccgcgtttcccgaaccgacgaaaacccgcgctaccgacaaccacacgcccgactacttcctcctttacgaccattttctcgacctcaaacgctctcaaactttaaaataataacgcgccgaaaaaataaataaaattcgattcctccgcgacgctcccgccaataaccccgaaattctaaaacgttaaacgctaaactccttccgtaaataaaaaataaaaacgctcccaccacccgaaactcctaccgacgccccaacctaaaaaaaaa

SEQ ID NO: 38033 - DNA, 561 bp, Artificial Sequence
  chemically treated genomic DNA (Homo sapiens) CpG-island No: 38033
attttacgcgtgcggtttgtagggacgcgtgtgggcgtggtgtagtatagttacgagggtatttttgaggttatttagttggacgacgaacgtatcgattttttgtcgagttttaaggaggttgttaagaatttcgagtggattgcgggcggtatttggatatttttagtttttaagtttgtttacgatcgttttattaaggagagtcggcgttagaagatacgtgtgtttgcggtggttattacggacgggcgttacgattttcgggacgatgattttaatttgcgggcgttgtgcgatcgcgacgttatagtgacggttatcggtatcggggatatgttttacgagaagtacgagagtgaaaatttttattttatcgtttgcgataagttatagtaggtgcgtaatatgacgttgtttttcgatttggtcgttgagaagtttatcgatgatatggaggacgttttttgttcgggtgagcgtgtgggcgcggggtagtcggtcgaggagtagtaggttttagtcgttgtttagcgtgagttttagggatattttttattt

SEQ ID NO: 38034 - DNA, 561 bp, Artificial Sequence
  chemically treated genomic DNA (Homo sapiens) CpG-island No: 38034
aaataaaaaatatccctaaaactcacgctaaacaacgactaaaacctactactcctcgaccgactaccccgcgcccacacgctcacccgaacaaaaaacgtcctccatatcatcgataaacttctcaacgaccaaatcgaaaaacaacgtcatattacgcacctactataacttatcgcaaacgataaaataaaaattttcactctcgtacttctcgtaaaacatatccccgataccgataaccgtcactataacgtcgcgatcgcacaacgcccgcaaattaaaatcatcgtcccgaaaatcgtaacgcccgtccgtaataaccaccgcaaacacacgtatcttctaacgccgactctccttaataaaacgatcgtaaacaaacttaaaaactaaaaatatccaaataccgcccgcaatccactcgaaattcttaacaacctccttaaaactcgacaaaaaatcgatacgttcgtcgtccaactaaataacctcaaaaataccctcgtaactatactacaccacgcccacacgcgtccctacaaaccgcacgcgtaaaat

SEQ ID NO: 38035 - DNA, 561 bp, Artificial Sequence
  chemically treated genomic DNA (Homo sapiens) CpG-island No: 38035
aggtgaggggtgtttttggggtttacgttagatagcggttggggtttgttgtttttcggtcgattgtttcgcgtttatacgtttattcgggtagaggacgttttttatgttatcgatgaattttttagcgattaggtcggagaatagcgttatgttgcgtatttgttgtggtttgtcgtaggcgatggagtagaggtttttattttcgtgtttttcgtggaatatgttttcgatgtcgatggtcgttattgtgacgtcgcggtcgtatagcgttcgtaagttgaggttatcgtttcgagggtcgtggcgttcgttcgtgatgattatcgtaaatatacgtgttttttggcgtcggttttttttgatgaggcggtcgtaggtaaatttgagggttgagggtgtttaggtgtcgttcgtaatttattcgaggtttttgatagtttttttgaagttcgatagggagtcgatacgttcgtcgtttagttggatggttttaaaggtgttttcgtggttgtattgtattacgtttatacgcgtttttgtaagtcgtacgcgtgaggt

SEQ ID NO: 38036 - DNA, 561 bp, Artificial Sequence
  chemically treated genomic DNA (Homo sapiens) CpG-island No: 38036
acctcacgcgtacgacttacaaaaacgcgtataaacgtaatacaatacaaccacgaaaacacctttaaaaccatccaactaaacgacgaacgtatcgactccctatcgaacttcaaaaaaactatcaaaaacctcgaataaattacgaacgacacctaaacaccctcaaccctcaaatttacctacgaccgcctcatcaaaaaaaaccgacgccaaaaaacacgtatatttacgataatcatcacgaacgaacgccacgaccctcgaaacgataacctcaacttacgaacgctatacgaccgcgacgtcacaataacgaccatcgacatcgaaaacatattccacgaaaaacacgaaaataaaaacctctactccatcgcctacgacaaaccacaacaaatacgcaacataacgctattctccgacctaatcgctaaaaaattcatcgataacataaaaaacgtcctctacccgaataaacgtataaacgcgaaacaatcgaccgaaaaacaacaaaccccaaccgctatctaacgtaaaccccaaaaacacccctcacct

SEQ ID NO: 38037 - DNA, 505 bp, Artificial Sequence
  chemically treated genomic DNA (Homo sapiens) CpG-island No: 38037
ttttttttcgtacgtgggcgtaggcgtggtgtacgttattaatgttatcgtgcgtagttcgcgtggcggggttcggaggtacgtagagttgtttttcgtgttttttacggacggcgttacgggtaacgatagtttgtacgagtcggcgtattttatgcgtaagtagaacgtggtatttatcgtgttggttttgggtagcgacgtggatatggacgtgtttattacgtttagtttgggtgatcgcgtcgtcgtgttttacgagaaggattatgatagtttggcgtaattcggttttttcgatcgttttattcgttggatttgttagttcgtcgttcgggtttcgtagtcgagggtcgtgagtttatttcgtttatggtgttaagcgggttcgggttttatacggttagtatcgttgtttattcggacgacgttttgggtttgtatttttttagttttttttacggggttttcgtagtttcggttttcgtttagttttaggtttttt

SEQ ID NO: 38038 - DNA, 505 bp, Artificial Sequence
  chemically treated genomic DNA (Homo sapiens) CpG-island No: 38038
aaaaaacctaaaactaaacgaaaaccgaaactacgaaaaccccgtaaaaaaaactaaaaaaatacaaacccaaaacgtcgtccgaataaacaacgatactaaccgtataaaacccgaacccgcttaacaccataaacgaaataaactcacgaccctcgactacgaaacccgaacgacgaactaacaaatccaacgaataaaacgatcgaaaaaaccgaattacgccaaactatcataatccttctcgtaaaacacgacgacgcgatcacccaaactaaacgtaataaacacgtccatatccacgtcgctacccaaaaccaacacgataaataccacgttctacttacgcataaaatacgccgactcgtacaaactatcgttacccgtaacgccgtccgtaaaaaacacgaaaaacaactctacgtacctccgaaccccgccacgcgaactacgcacgataacattaataacgtacaccacgcctacgcccacgtacgaaaaaaaa

SEQ ID NO: 38039 - DNA, 505 bp, Artificial Sequence
  chemically treated genomic DNA (Homo sapiens) CpG-island No: 38039
gggagatttggggttgggcgggggtcggggttacggggatttcgtgggaggagttggagaggtgtaggtttagggcgtcgttcgagtgagtagcggtgttggtcgtgtgggattcgggttcgtttagtattatggacggggtgggtttacgattttcgattgcggggttcgggcggcgggttagtagatttagcggatgaagcggtcgaagaagtcgggttgcgttaggttgttatagtttttttcgtggaatacggcggcgcggttatttaggttgagcgtggtgagtacgtttatgtttacgtcgttgtttaaggttagtacggtgggtattacgttttgtttgcgtatggagtgcgtcgattcgtgtagattgtcgttgttcgtgacgtcgttcgtgaggaatacgaaggatagttttgcgtgttttcgggtttcgttacgcgggttgcgtacgatggtattgatggcgtgtattacgtttgcgtttacgtgcgagaaggag

SEQ ID NO: 38040 - DNA, 505 bp, Artificial Sequence
  chemically treated genomic DNA (Homo sapiens) CpG-island No: 38040
ctccttctcgcacgtaaacgcaaacgtaatacacgccatcaataccatcgtacgcaacccgcgtaacgaaacccgaaaacacgcaaaactatccttcgtattcctcacgaacgacgtcacgaacaacgacaatctacacgaatcgacgcactccatacgcaaacaaaacgtaatacccaccgtactaaccttaaacaacgacgtaaacataaacgtactcaccacgctcaacctaaataaccgcgccgccgtattccacgaaaaaaactataacaacctaacgcaacccgacttcttcgaccgcttcatccgctaaatctactaacccgccgcccgaaccccgcaatcgaaaatcgtaaacccaccccgtccataatactaaacgaacccgaatcccacacgaccaacaccgctactcactcgaacgacgccctaaacctacacctctccaactcctcccacgaaatccccgtaaccccgacccccgcccaaccccaaatctccc

SEQ ID NO: 38041 - DNA, 1001 bp, Artificial Sequence
  chemically treated genomic DNA (Homo sapiens) CpG-island No: 38041
ggtagttagaatcgcggtagaaagggcgcgagcggggaattgcgggaacgtagcggttcgggaagttggagggggcggattcggtcggcgagcgtaggcgttttttggtttacgcgcgtatttcggttttattatttatttttacgtcgcggttcgtttttcggggcgggtaagagagcgcgcgagtagcggtcgttaggatacgttttttcgttttcgcgagttggcgggcgggttggtatcgtcgggaggcggggtcgcggtagtcggttgggtgcgattgggcggtttcggagttcgtagacgttcgggggaatatggcggttgcggagtcggcggtttttgcgttttttaatagcggcgtcgggggcgcgggggcgtcgtcgggtatagtttcggtgtttttttgttttttagttttcgcgcgattttcgtcggtgttatacggggcgggttacgagttgtttatttagaagttttttagtttgtacggcgattagatcgatatgtatcgtaaattcgtggtgtagttgttcgtcgaggagtggggttagtacgtggatttgtttaagggtttcgcggtgagcgagcgttgtaaggtgcgtttcgtgtcgttgtagatttaggtgggttttgcgggaggtcgcgcgtttttttgttttcgagtcgttttcgttttcgtttttgttttcgttttcgtcgcgttttttaggtgtttcgagtcgttcgggattcgggttttgcgcgagtggttgagttcgaagggttgcgcgtttttcgtaagtttcggggtcggttggggaatgtttttgtttaaaggtgatggttattagttgttttcggcgggggcgtgggtttcgtagttggttttagcgttcgcgaacgtttttacgtgtgtggttttcggtcgttcgtattcgttttttatgttaggattaggttttagttttttgcgtaattaaagggttgtgttgtagtagttgtttttattttggggtgat

SEQ ID NO: 38042 - DNA, 1001 bp, Artificial Sequence
  chemically treated genomic DNA (Homo sapiens) CpG-island No: 38042
atcaccccaaaataaaaacaactactacaacacaaccctttaattacgcaaaaaactaaaacctaatcctaacataaaaaacgaatacgaacgaccgaaaaccacacacgtaaaaacgttcgcgaacgctaaaaccaactacgaaacccacgcccccgccgaaaacaactaataaccatcacctttaaacaaaaacattccccaaccgaccccgaaacttacgaaaaacgcgcaacccttcgaactcaaccactcgcgcaaaacccgaatcccgaacgactcgaaacacctaaaaaacgcgacgaaaacgaaaacaaaaacgaaaacgaaaacgactcgaaaacaaaaaaacgcgcgacctcccgcaaaacccacctaaatctacaacgacacgaaacgcaccttacaacgctcgctcaccgcgaaacccttaaacaaatccacgtactaaccccactcctcgacgaacaactacaccacgaatttacgatacatatcgatctaatcgccgtacaaactaaaaaacttctaaataaacaactcgtaacccgccccgtataacaccgacgaaaatcgcgcgaaaactaaaaaacaaaaaaacaccgaaactatacccgacgacgcccccgcgcccccgacgccgctattaaaaaacgcaaaaaccgccgactccgcaaccgccatattcccccgaacgtctacgaactccgaaaccgcccaatcgcacccaaccgactaccgcgaccccgcctcccgacgataccaacccgcccgccaactcgcgaaaacgaaaaaacgtatcctaacgaccgctactcgcgcgctctcttacccgccccgaaaaacgaaccgcgacgtaaaaataaataataaaaccgaaatacgcgcgtaaaccaaaaaacgcctacgctcgccgaccgaatccgccccctccaacttcccgaaccgctacgttcccgcaattccccgctcgcgccctttctaccgcgattctaactacc

SEQ ID NO: 38043 - DNA, 1001 bp, Artificial Sequence
  chemically treated genomic DNA (Homo sapiens) CpG-island No: 38043
attattttaaaataaaaatagttattatagtatagttttttggttacgtaggaggttgggatttgattttggtataaaaagcggatgcgggcgatcgaggattatatacgtgggggcgttcgcgggcgttgaaattagttacgaggtttacgttttcgtcggggatagttggtgattattatttttggataggggtattttttagtcggtttcggaatttgcgaaagacgcgtagtttttcggatttagttattcgcgtagggttcgggtttcgggcggttcggggtatttgaggagcgcggcgaaggcggggatagggacggggacggggacgattcgggaatagggaagcgcgcggtttttcgtaggatttatttggatttgtaacggtacgaggcgtattttgtagcgttcgtttatcgcgaagtttttgggtaagtttacgtattggttttatttttcggcgaatagttgtattacgaatttgcggtgtatgtcgatttggtcgtcgtataggttgaggaatttttggatgagtagttcgtagttcgtttcgtgtggtatcgacgagggtcgcgcgaagattgagaaatagaagagtatcgggattgtgttcgacggcgttttcgcgttttcggcgtcgttgttggggagcgtaaggatcgtcggtttcgtagtcgttatgttttttcgagcgtttgcgagtttcgaggtcgtttagtcgtatttagtcggttgtcgcggtttcgtttttcggcgatgttagttcgttcgttagttcgcggaggcgaaggggcgtgttttgacgatcgttgttcgcgcgtttttttattcgtttcggagggcgggtcgcggcgtaagggtgggtggtggggtcggggtgcgcgcgtgagttagggagcgtttgcgttcgtcggtcgggttcgttttttttagtttttcgggtcgttgcgttttcgtagtttttcgttcgcgttttttttgtcgcggttttgattgtt

SEQ ID NO: 38044 - DNA, 1001 bp, Artificial Sequence
  chemically treated genomic DNA (Homo sapiens) CpG-island No: 38044
aacaatcaaaaccgcgacaaaaaaaacgcgaacgaaaaactacgaaaacgcaacgacccgaaaaactaaaaaaaacgaacccgaccgacgaacgcaaacgctccctaactcacgcgcgcaccccgaccccaccacccacccttacgccgcgacccgccctccgaaacgaataaaaaaacgcgcgaacaacgatcgtcaaaacacgccccttcgcctccgcgaactaacgaacgaactaacatcgccgaaaaacgaaaccgcgacaaccgactaaatacgactaaacgacctcgaaactcgcaaacgctcgaaaaaacataacgactacgaaaccgacgatccttacgctccccaacaacgacgccgaaaacgcgaaaacgccgtcgaacacaatcccgatactcttctatttctcaatcttcgcgcgaccctcgtcgataccacacgaaacgaactacgaactactcatccaaaaattcctcaacctatacgacgaccaaatcgacatacaccgcaaattcgtaatacaactattcgccgaaaaataaaaccaatacgtaaacttacccaaaaacttcgcgataaacgaacgctacaaaatacgcctcgtaccgttacaaatccaaataaatcctacgaaaaaccgcgcgcttccctattcccgaatcgtccccgtccccgtccctatccccgccttcgccgcgctcctcaaataccccgaaccgcccgaaacccgaaccctacgcgaataactaaatccgaaaaactacgcgtctttcgcaaattccgaaaccgactaaaaaatacccctatccaaaaataataatcaccaactatccccgacgaaaacgtaaacctcgtaactaatttcaacgcccgcgaacgcccccacgtatataatcctcgatcgcccgcatccgctttttataccaaaatcaaatcccaacctcctacgtaaccaaaaaactatactataataactatttttattttaaaataat

SEQ ID NO: 38045 - DNA, 503 bp, Artificial Sequence
  chemically treated genomic DNA (Homo sapiens) CpG-island No: 38045
agggggcggcgaggttttaatttttgcgttcggcgcgacgcgtgtgtggaggagtgttaattaagtaatgagtggaaggcggggttttttagagggggtcggaggcgggggtgcgtgtcgcgtaggaagttgtgcgtgcgtttaaggttttcgcggagtttaggtggtcgaatttgtgggtgggtttttaggtttcgttgtcgaagttgtggtgtggttaattaacgtgtgcggttttatatattaatttgtgttgtatttaggtagtgtcgtgcgcgtttaaatttttcggggtgcgtacgtggttgtggagaaaagttgttgtaggagatagtggttattgtggttgtggggagcgtttgttagttcgtcgtggggttgcgtagtgcgtagtttcgtgtaacgtgtcgtagtagggggattgttgtggtgttagggtcgtgtatttggtcgcgttgtaggtaatttgagtgttgtcgaagtaggttatagtggttatgtga

SEQ ID NO: 38046 - DNA, 503 bp, Artificial Sequence
  chemically treated genomic DNA (Homo sapiens) CpG-island No: 38046
tcacataaccactataacctacttcgacaacactcaaattacctacaacgcgaccaaatacacgaccctaacaccacaacaatccccctactacgacacgttacacgaaactacgcactacgcaaccccacgacgaactaacaaacgctccccacaaccacaataaccactatctcctacaacaacttttctccacaaccacgtacgcaccccgaaaaatttaaacgcgcacgacactacctaaatacaacacaaattaatatataaaaccgcacacgttaattaaccacaccacaacttcgacaacgaaacctaaaaacccacccacaaattcgaccacctaaactccgcgaaaaccttaaacgcacgcacaacttcctacgcgacacgcacccccgcctccgaccccctctaaaaaaccccgccttccactcattacttaattaacactcctccacacacgcgtcgcgccgaacgcaaaaattaaaacctcgccgccccct

SEQ ID NO: 38047 - DNA, 503 bp, Artificial Sequence
  chemically treated genomic DNA (Homo sapiens) CpG-island No: 38047
ttatatggttattatagtttatttcgatagtatttaggttatttgtaacgcggttaagtgtacggttttggtattatagtaatttttttattacggtacgttatacgggattacgtattacgtaattttacggcgaattaataagcgttttttataattatagtggttattgttttttgtagtaatttttttttatagttacgtgcgtatttcgggggatttgggcgcgtacggtattatttggatgtaatataaattagtgtgtagaatcgtatacgttagttggttatattatagtttcggtaacgaggtttaaaagtttatttataggttcggttatttgggtttcgcgggaattttaaacgtacgtataattttttacgcggtacgtattttcgttttcggttttttttggggaatttcgttttttatttattatttggttaatatttttttatatacgcgtcgcgtcgaacgtaagagttgggatttcgtcgtttttt

SEQ ID NO: 38048 - DNA, 503 bp, Artificial Sequence
  chemically treated genomic DNA (Homo sapiens) CpG-island No: 38048
aaaaaacgacgaaatcccaactcttacgttcgacgcgacgcgtatataaaaaaatattaaccaaataataaataaaaaacgaaattccccaaaaaaaaccgaaaacgaaaatacgtaccgcgtaaaaaattatacgtacgtttaaaattcccgcgaaacccaaataaccgaacctataaataaacttttaaacctcgttaccgaaactataatataaccaactaacgtatacgattctacacactaatttatattacatccaaataataccgtacgcgcccaaatcccccgaaatacgcacgtaactataaaaaaaaattactacaaaaaacaataaccactataattataaaaaacgcttattaattcgccgtaaaattacgtaatacgtaatcccgtataacgtaccgtaataaaaaaattactataataccaaaaccgtacacttaaccgcgttacaaataacctaaatactatcgaaataaactataataaccatataa

SEQ ID NO: 38049 - DNA, 522 bp, Artificial Sequence
  chemically treated genomic DNA (Homo sapiens) CpG-island No: 38049
gttttcgcgtgttgtttcgggtttttttgcgcgtcgggtttcggtttttttttttgtgtcgttgaagaataatcggaagtatagggcgatttggaatattaagaattttcgtcggtggtatgtgggaatagcggaagtttatacgtgcgtttttaaagggtttttttgcgtcgttttttcggggggaatatggaataatttcgggtcgggtttgtttaaaatcgtaagaacgtttcggtttgtgggggaattgtttcgtaagcggtgtaaaaataaggtatcgcggggaaattggggtttttcgaggggggatacgtttataaggaatttatatagcgggtatttcggtttttaagggggcgtacggaacggtttttaagggttcgaggtttttagtttttggtagaatagcggtgattggtttatcgggcgagtttttagggattttttaagattttgtagtcgacgagtggttaagtattaacgtacgattaacgaatattttgttatagtttttgaaat

SEQ ID NO: 38050 - DNA, 522 bp, Artificial Sequence
  chemically treated genomic DNA (Homo sapiens) CpG-island No: 38050
atttcaaaaactataacaaaatattcgttaatcgtacgttaatacttaaccactcgtcgactacaaaatcttaaaaaatccctaaaaactcgcccgataaaccaatcaccgctattctaccaaaaactaaaaacctcgaacccttaaaaaccgttccgtacgcccccttaaaaaccgaaatacccgctatataaattccttataaacgtatcccccctcgaaaaaccccaatttccccgcgataccttatttttacaccgcttacgaaacaattcccccacaaaccgaaacgttcttacgattttaaacaaacccgacccgaaattattccatattccccccgaaaaaacgacgcaaaaaaaccctttaaaaacgcacgtataaacttccgctattcccacataccaccgacgaaaattcttaatattccaaatcgccctatacttccgattattcttcaacgacacaaaaaaaaaaaccgaaacccgacgcgcaaaaaaacccgaaacaacacgcgaaaac

SEQ ID NO: 38051 - DNA, 522 bp, Artificial Sequence
  chemically treated genomic DNA (Homo sapiens) CpG-island No: 38051
attttaaaggttgtaataagatattcgttggtcgtacgttggtatttggttattcgtcgattatagggttttagaaggtttttaggagttcgttcggtgaattaattatcgttgttttgttaagagttaaaagtttcgggtttttggaaatcgtttcgtgcgtttttttggaaatcggggtgttcgttatgtgagttttttatgggcgtgttttttttcggggggttttagttttttcgcggtgttttatttttatatcgtttacggggtaatttttttataaatcggggcgtttttgcggttttgggtaaattcggttcggggttattttatatttttttcggggaggcggcgtaaaggggttttttaggggcgtacgtgtaggttttcgttgtttttatatgttatcggcgggggtttttaatattttaaatcgttttgtgttttcgattgttttttaacggtataggaagagaaatcggggttcgacgcgtaagagaattcggaataatacgcgggggt

SEQ ID NO: 38052 - DNA, 522 bp, Artificial Sequence
  chemically treated genomic DNA (Homo sapiens) CpG-island No: 38052
acccccgcgtattattccgaattctcttacgcgtcgaaccccgatttctcttcctataccgttaaaaaacaatcgaaaacacaaaacgatttaaaatattaaaaacccccgccgataacatataaaaacaacgaaaacctacacgtacgcccctaaaaaacccctttacgccgcctccccgaaaaaaatataaaataaccccgaaccgaatttacccaaaaccgcaaaaacgccccgatttataaaaaaattaccccgtaaacgatataaaaataaaacaccgcgaaaaaactaaaaccccccgaaaaaaaacacgcccataaaaaactcacataacgaacaccccgatttccaaaaaaacgcacgaaacgatttccaaaaacccgaaacttttaactcttaacaaaacaacgataattaattcaccgaacgaactcctaaaaaccttctaaaaccctataatcgacgaataaccaaataccaacgtacgaccaacgaatatcttattacaacctttaaaat

SEQ ID NO: 38053 - DNA, 660 bp, Artificial Sequence
  chemically treated genomic DNA (Homo sapiens) CpG-island No: 38053
tcggtggatgaaatcgacgaacggtttttacgttttgattggagcgtcgtataaaggatttcgttggttgtcgcgatgatcgaaataggtgttgggatttcgtcgatgtgtttgttcgtatatcgtcgttttttttttggtagtcgtgacgaggtagtgcgcgaacgggcgcgggttattatgagtaaagcgattcgtttggcgcgcgatttcggtattcgtattatttagttggtaggttatgacgtttattacgaagattacgacgaaggttattcggtaacgtttgttgaagggttggcgtggtagtcgtataggcgttggtattataagtaatgttggcggtggagattatggatatcgcgtttatgaattttattagtaaatggatagaatggtacgagatgttcgttttatcgtggtttatcgtttattcggacgtcggtaattttagcgtttggggtaatgatgttttcgtcgaattgaaattgggtattgatcgtatcgtcgcgatttatttgaaagatatttagttagttatcgggtaaagtttcggatagtttcgcgacgtgtcgtttggcgaaggttgcgtcgatttcgttgtatttttaaaacgttgtataaattgaattatcgcgtttttttttgattgagatgtgg

SEQ ID NO: 38054 - DNA, 660 bp, Artificial Sequence
  chemically treated genomic DNA (Homo sapiens) CpG-island No: 38054
ccacatctcaatcaaaaaaaaacgcgataattcaatttatacaacgttttaaaaatacaacgaaatcgacgcaaccttcgccaaacgacacgtcgcgaaactatccgaaactttacccgataactaactaaatatctttcaaataaatcgcgacgatacgatcaatacccaatttcaattcgacgaaaacatcattaccccaaacgctaaaattaccgacgtccgaataaacgataaaccacgataaaacgaacatctcgtaccattctatccatttactaataaaattcataaacgcgatatccataatctccaccgccaacattacttataataccaacgcctatacgactaccacgccaacccttcaacaaacgttaccgaataaccttcgtcgtaatcttcgtaataaacgtcataacctaccaactaaataatacgaataccgaaatcgcgcgccaaacgaatcgctttactcataataacccgcgcccgttcgcgcactacctcgtcacgactaccaaaaaaaaaacgacgatatacgaacaaacacatcgacgaaatcccaacacctatttcgatcatcgcgacaaccaacgaaatcctttatacgacgctccaatcaaaacgtaaaaaccgttcgtcgatttcatccaccga

SEQ ID NO: 38055 - DNA, 660 bp, Artificial Sequence
  chemically treated genomic DNA (Homo sapiens) CpG-island No: 38055
ttatattttaattaggaaagaacgcgatagtttagtttatgtagcgttttgaagatgtaacgaaatcgacgtagttttcgttaaacggtacgtcgcggaattgttcgggattttgttcggtgattggttgggtgttttttaggtggatcgcggcgatacggttaatgtttagttttagttcggcgggaatattattgttttaggcgttgaggttgtcgacgttcgggtagacggtgaattacggtgaggcgagtatttcgtgttattttgtttatttgttgatggagtttataaacgcggtatttataatttttatcgttagtattatttgtgatgttagcgtttgtgcgattgttacgttagttttttagtaaacgttgtcgggtagttttcgtcgtggttttcgtaatagacgttataatttgttagttggatggtgcgaatgtcgagatcgcgcgttaggcgaatcgttttatttatgatggttcgcgttcgttcgcgtattgtttcgttacggttattaaagggaaagcgacgatgtgcggataggtatatcgacgggattttaatatttgtttcgattatcgcggtaattagcgaagttttttgtgcggcgttttagttaagacgtgagagtcgttcgtcggttttatttatcga

SEQ ID NO: 38056 - DNA, 660 bp, Artificial Sequence
  chemically treated genomic DNA (Homo sapiens) CpG-island No: 38056
tcgataaataaaaccgacgaacgactctcacgtcttaactaaaacgccgcacaaaaaacttcgctaattaccgcgataatcgaaacaaatattaaaatcccgtcgatatacctatccgcacatcgtcgctttccctttaataaccgtaacgaaacaatacgcgaacgaacgcgaaccatcataaataaaacgattcgcctaacgcgcgatctcgacattcgcaccatccaactaacaaattataacgtctattacgaaaaccacgacgaaaactacccgacaacgtttactaaaaaactaacgtaacaatcgcacaaacgctaacatcacaaataatactaacgataaaaattataaataccgcgtttataaactccatcaacaaataaacaaaataacacgaaatactcgcctcaccgtaattcaccgtctacccgaacgtcgacaacctcaacgcctaaaacaataatattcccgccgaactaaaactaaacattaaccgtatcgccgcgatccacctaaaaaacacccaaccaatcaccgaacaaaatcccgaacaattccgcgacgtaccgtttaacgaaaactacgtcgatttcgttacatcttcaaaacgctacataaactaaactatcgcgttctttcctaattaaaatataa

SEQ ID NO: 38057 - DNA, 630 bp, Artificial Sequence
  chemically treated genomic DNA (Homo sapiens) CpG-island No: 38057
tgtgtttgattagtatggtagtatttaattggcgggtaagcgtattgagggatcgggagtagagcgtggcgtagttttttagaatgaagggttattatcgtggcgtaatgtataggataacgtggcgttcggtttgtaattggtaggtataaggaggaaaaattgttaggcggattggaaatcgcgtattaatgttgaaaaagtgggtggaaggcgtagaaaacgttatatttggtagtttttcggtggttaacgttagcgggtggggattgttcgtgcgttggcggcgaatttttagttgttattattcgacgaatcgtttggtgcgttggacgtttttattcgcgattagatgtaaattttgttgttgaaattttggtaggagacgggtaagtaggtgttgttgattatttacgatatagaagaagcggtgtttatggcgattgaattggttttgtttttattcggttttggtcgtgtgttggagcggttgtcgtttaattttgttcgtcgttttgttgcgggagagtcgagtcgtagtattaagttcgatttataatttatcgttatgcgcgaatatgttttaagtcgcgtatttgagtaacgggaggcgtttttatgagtgtgttt

SEQ ID NO: 38058 - DNA, 630 bp, Artificial Sequence
  chemically treated genomic DNA (Homo sapiens) CpG-island No: 38058
aaacacactcataaaaacgcctcccgttactcaaatacgcgacttaaaacatattcgcgcataacgataaattataaatcgaacttaatactacgactcgactctcccgcaacaaaacgacgaacaaaattaaacgacaaccgctccaacacacgaccaaaaccgaataaaaacaaaaccaattcaatcgccataaacaccgcttcttctatatcgtaaataatcaacaacacctacttacccgtctcctaccaaaatttcaacaacaaaatttacatctaatcgcgaataaaaacgtccaacgcaccaaacgattcgtcgaataataacaactaaaaattcgccgccaacgcacgaacaatccccacccgctaacgttaaccaccgaaaaactaccaaatataacgttttctacgccttccacccactttttcaacattaatacgcgatttccaatccgcctaacaatttttcctccttatacctaccaattacaaaccgaacgccacgttatcctatacattacgccacgataataacccttcattctaaaaaactacgccacgctctactcccgatccctcaatacgcttacccgccaattaaatactaccatactaatcaaacaca

SEQ ID NO: 38059 - DNA, 630 bp, Artificial Sequence
  chemically treated genomic DNA (Homo sapiens) CpG-island No: 38059
gagtatatttatgagaacgtttttcgttgtttaaatacgcggtttaaaatatattcgcgtatggcgatgaattgtggatcggatttgatgttgcggttcgattttttcgtaataaagcggcgagtaaagttgagcggtagtcgttttagtatacggttagggtcggatgaaagtagaattagtttagtcgttataaatatcgttttttttatatcgtgggtaattaatagtatttgtttgttcgttttttgttagagttttagtagtagggtttgtatttggtcgcgggtgaaggcgtttagcgtattaaacggttcgtcgagtaataatagttggggattcgtcgttagcgtacgagtaatttttattcgttgacgttgattatcggaaagttgttagatgtagcgttttttgcgttttttatttatttttttagtattggtgcgcgatttttagttcgtttggtaattttttttttttatatttgttaattgtaggtcgaacgttacgttgttttgtatattgcgttacggtagtagttttttattttgaaaaattacgttacgttttgttttcggttttttaatacgtttattcgttagttgaatgttgttatgttgattaggtata

SEQ ID NO: 38060 - DNA, 630 bp, Artificial Sequence
  chemically treated genomic DNA (Homo sapiens) CpG-island No: 38060
tatacctaatcaacataacaacattcaactaacgaataaacgtattaaaaaaccgaaaacaaaacgtaacgtaatttttcaaaataaaaaactactaccgtaacgcaatatacaaaacaacgtaacgttcgacctacaattaacaaatataaaaaaaaaaaattaccaaacgaactaaaaatcgcgcaccaatactaaaaaaataaataaaaaacgcaaaaaacgctacatctaacaactttccgataatcaacgtcaacgaataaaaattactcgtacgctaacgacgaatccccaactattattactcgacgaaccgtttaatacgctaaacgccttcacccgcgaccaaatacaaaccctactactaaaactctaacaaaaaacgaacaaacaaatactattaattacccacgatataaaaaaaacgatatttataacgactaaactaattctactttcatccgaccctaaccgtatactaaaacgactaccgctcaactttactcgccgctttattacgaaaaaatcgaaccgcaacatcaaatccgatccacaattcatcgccatacgcgaatatattttaaaccgcgtatttaaacaacgaaaaacgttctcataaatatactc

SEQ ID NO: 38061 - DNA, 1313 bp, Artificial Sequence
  chemically treated genomic DNA (Homo sapiens) CpG-island No: 38061
ttttttcgttttttcgggattatttttttttttttttatgttatcgtcgtcgttagtttattagtcgggttttttcgttttgatcgtcgttggatttaattaggttttgacggtttgttttttttggatagcggtgtcgattttttttagttcggcgtcgaagagcgtaaagttattgttcgttttgttatcgattatgtcgatcgtcgcgtttcggtgttgatcggtatcggcggtattaacgttcgggaaattatcgaatttagttagtacgcgtagtaggcgggcgcggacggtatcgtggtgattaatttttattattggaaagtgtcggaagcgaatttgattcgttatttcgagtaggtggtcgatagcgttacgttgtcggtgatgttttataatttttcggcgttgatcgggtaggatttgatttcggcgttggtgaaaattttcgtcgattcgcgtagtaatattatcggtattaaagatattatcgatttcgtcgtttatttgcgtagtatgatttatatcgttaaaggtgtttattcgtattttatcgtgttttgcggttacgacgattatttgtttaatattttgttgttcggcggcgacggggcgatatcggcgagcggtaattttgtttcgtaggtgtcggtgaattttttgaaagtttggcgcgacggggacgtggcgaaagcggtcgggtattattagattttgttgtaaatttcgtagatgtattagttggatacgtcgtttgtgaacgtgattaaagaggcgatcgtgttttgcggtcgttttgtttttacgtacgtgttgtcgttcgtttcgtcgttggacgagtcgcgtaaggcgtagttgaaaattttgttgtaatagtttaagttttgttgagtcggacgataacgatgattattgagaaaatttttatttcgtaggacgacgcgttttatgcggtgattatttacgcggcggggtcgtagggcgttttgtcgttgatttcgtagatgttgatggaattttttagcggtaatttgttcggtatgacgtagaacgtcgggatgggttgggacgttaataagtttatcggtaaagaggtgttgattatcggtatttagggcggtattcgcgtcggagacggacgtttaatcgcgttgggttattatatcgggtattgggagatcggtatgtagatgtaggcggcggcgaaggagattattcgtaatggcgggatttcgttcgcggttttcgttagcgattcgtgcgacgggcgttcgtagggtacgtacgggatgttcgattttttgtcgtat

SEQ ID NO: 38062 - DNA, 1313 bp, Artificial Sequence
  chemically treated genomic DNA (Homo sapiens) CpG-island No: 38062
atacgacaaaaaatcgaacatcccgtacgtaccctacgaacgcccgtcgcacgaatcgctaacgaaaaccgcgaacgaaatcccgccattacgaataatctccttcgccgccgcctacatctacataccgatctcccaatacccgatataataacccaacgcgattaaacgtccgtctccgacgcgaataccgccctaaataccgataatcaacacctctttaccgataaacttattaacgtcccaacccatcccgacgttctacgtcataccgaacaaattaccgctaaaaaattccatcaacatctacgaaatcaacgacaaaacgccctacgaccccgccgcgtaaataatcaccgcataaaacgcgtcgtcctacgaaataaaaattttctcaataatcatcgttatcgtccgactcaacaaaacttaaactattacaacaaaattttcaactacgccttacgcgactcgtccaacgacgaaacgaacgacaacacgtacgtaaaaacaaaacgaccgcaaaacacgatcgcctctttaatcacgttcacaaacgacgtatccaactaatacatctacgaaatttacaacaaaatctaataatacccgaccgctttcgccacgtccccgtcgcgccaaactttcaaaaaattcaccgacacctacgaaacaaaattaccgctcgccgatatcgccccgtcgccgccgaacaacaaaatattaaacaaataatcgtcgtaaccgcaaaacacgataaaatacgaataaacacctttaacgatataaatcatactacgcaaataaacgacgaaatcgataatatctttaataccgataatattactacgcgaatcgacgaaaattttcaccaacgccgaaatcaaatcctacccgatcaacgccgaaaaattataaaacatcaccgacaacgtaacgctatcgaccacctactcgaaataacgaatcaaattcgcttccgacactttccaataataaaaattaatcaccacgataccgtccgcgcccgcctactacgcgtactaactaaattcgataatttcccgaacgttaataccgccgataccgatcaacaccgaaacgcgacgatcgacataatcgataacaaaacgaacaataactttacgctcttcgacgccgaactaaaaaaaatcgacaccgctatccaaaaaaaacaaaccgtcaaaacctaattaaatccaacgacgatcaaaacgaaaaaacccgactaataaactaacgacgacgataacataaaaaaaaaaaaaaataatcccgaaaaaacgaaaaaa

SEQ ID NO: 38063 - DNA, 1313 bp, Artificial Sequence
  chemically treated genomic DNA (Homo sapiens) CpG-island No: 38063
gtacggtagggaatcgaatatttcgtgcgtgttttgcgagcgttcgtcgtacggatcgttgacgaaggtcgcgaacgggatttcgttattgcgggtgatttttttcgtcgtcgtttgtatttgtatgtcgattttttaatgttcggtgtggtagtttagcgcgattgggcgttcgttttcggcgcggatgtcgttttgagtgtcgataattagtatttttttgtcggtgagtttgttggcgttttagtttatttcggcgttttgcgttatgtcgaataggttgtcgttgggagattttattagtatttgcggggttagcggtagagcgttttgcggtttcgtcgcgtgggtgattatcgtataaaacgcgtcgttttgcggggtgaaaatttttttaatggttatcgttatcgttcggtttagtaaagtttgagttgttgtagtagggtttttagttgcgttttgcgcggttcgtttagcggcgaggcgggcggtagtacgtgcgtggagataggacgatcgtagagtacgatcgtttttttaattacgtttataaacggcgtatttagttgatatatttgcggaatttgtagtaaggtttgatgatattcggtcgttttcgttacgttttcgtcgcgttaggtttttagaagatttatcgatatttgcggggtaaagttgtcgttcgtcgatatcgtttcgtcgtcgtcgagtagtagggtattgaatagatgatcgtcgtagtcgtagagtacggtgaagtgcggatgggtatttttgacggtatggattatgttgcgtaggtgggcgacggagtcgatggtgtttttgatgtcgataatattgttgcgcgagtcggcgagggtttttattagcgtcggagttagattttgttcggttagcgtcgggaagttatagagtattatcggtagcgtgacgttgtcggttatttgttcgaaatagcggattaggttcgttttcgatattttttagtagtaggggttgattattacgatgtcgttcgcgttcgtttgttgcgcgtgttggttgagttcgatggtttttcgggcgttggtgtcgtcggtgtcgattagtatcgggacgcgacgatcgatatgatcgatagtaaagcgggtaatggttttacgtttttcggcgtcgagttgggagaaatcggtatcgttgtttaggaagaataggtcgttaaagtttggttgagtttaacggcgattagggcgagggggttcggttaataagttggcggcggcggtaatatggggggaagggggaataatttcggaaaagcggagagg

SEQ ID NO: 38064 - DNA, 1313 bp, Artificial Sequence
  chemically treated genomic DNA (Homo sapiens) CpG-island No: 38064
cctctccgcttttccgaaattattcccccttccccccatattaccgccgccgccaacttattaaccgaaccccctcgccctaatcgccgttaaactcaaccaaactttaacgacctattcttcctaaacaacgataccgatttctcccaactcgacgccgaaaaacgtaaaaccattacccgctttactatcgatcatatcgatcgtcgcgtcccgatactaatcgacaccgacgacaccaacgcccgaaaaaccatcgaactcaaccaacacgcgcaacaaacgaacgcgaacgacatcgtaataatcaacccctactactaaaaaatatcgaaaacgaacctaatccgctatttcgaacaaataaccgacaacgtcacgctaccgataatactctataacttcccgacgctaaccgaacaaaatctaactccgacgctaataaaaaccctcgccgactcgcgcaacaatattatcgacatcaaaaacaccatcgactccgtcgcccacctacgcaacataatccataccgtcaaaaatacccatccgcacttcaccgtactctacgactacgacgatcatctattcaataccctactactcgacgacgacgaaacgatatcgacgaacgacaactttaccccgcaaatatcgataaatcttctaaaaacctaacgcgacgaaaacgtaacgaaaacgaccgaatatcatcaaaccttactacaaattccgcaaatatatcaactaaatacgccgtttataaacgtaattaaaaaaacgatcgtactctacgatcgtcctatctccacgcacgtactaccgcccgcctcgccgctaaacgaaccgcgcaaaacgcaactaaaaaccctactacaacaactcaaactttactaaaccgaacgataacgataaccattaaaaaaattttcaccccgcaaaacgacgcgttttatacgataatcacccacgcgacgaaaccgcaaaacgctctaccgctaaccccgcaaatactaataaaatctcccaacgacaacctattcgacataacgcaaaacgccgaaataaactaaaacgccaacaaactcaccgacaaaaaaatactaattatcgacactcaaaacgacatccgcgccgaaaacgaacgcccaatcgcgctaaactaccacaccgaacattaaaaaatcgacatacaaatacaaacgacgacgaaaaaaatcacccgcaataacgaaatcccgttcgcgaccttcgtcaacgatccgtacgacgaacgctcgcaaaacacgcacgaaatattcgattccctaccgtac

SEQ ID NO: 38065 - DNA, 743 bp, Artificial Sequence
  chemically treated genomic DNA (Homo sapiens) CpG-island No: 38065
ttaacgtcggtattcgtttcgtgatgatttttggtattttttattatatcgatgaaatcggtagcgatgtttggcgggaagatggattggtggcgcgtatgtcgcgtatttgtaagtagatcgtgttagaaatgatcgttatgttagatatttgtttttgtgaatatattttttacggttattgcggtgtgttgtgcgagtatggcgtcgataacgacgcgattttggaaaatttaggtaagtaagtcgtggttgtagttgttgtaggtgtagattttatcgtttttttcgtcgcgatggacggttaggtataggcgattcgttaggcgttggacgttgcgggatttaaagatacggcgattatgtcgtattcgattaagttcgttttttttttttatggttcgtttcgtgaagttgtcggaagcgtattaaaaggcgatcgtaaaagttattagatgaatttaatgaatcgtcgtgaggcgattcgtgaattattgttggatgaagtttagggcgtagattgtttgatggttaaatttgttggagcgtatttcgatatcgtgcgtgagttgcgtgaacgtattgaattgtcgattggcgcgtattaggtgagcggtgagtatgcgatgattaagttcgtcgcgttggcgggtgttatagatgaagagaaagtcgtgttcgaaagtttaggttcgatttaagcgtgcgggtgcggatttgatttttagttattttgcgttgga

SEQ ID NO: 38066 - DNA, 743 bp, Artificial Sequence
  chemically treated genomic DNA (Homo sapiens) CpG-island No: 38066
tccaacgcaaaataactaaaaatcaaatccgcacccgcacgcttaaatcgaacctaaactttcgaacacgactttctcttcatctataacacccgccaacgcgacgaacttaatcatcgcatactcaccgctcacctaatacgcgccaatcgacaattcaatacgttcacgcaactcacgcacgatatcgaaatacgctccaacaaatttaaccatcaaacaatctacgccctaaacttcatccaacaataattcacgaatcgcctcacgacgattcattaaattcatctaataacttttacgatcgccttttaatacgcttccgacaacttcacgaaacgaaccataaaaaaaaaaaacgaacttaatcgaatacgacataatcgccgtatctttaaatcccgcaacgtccaacgcctaacgaatcgcctatacctaaccgtccatcgcgacgaaaaaaacgataaaatctacacctacaacaactacaaccacgacttacttacctaaattttccaaaatcgcgtcgttatcgacgccatactcgcacaacacaccgcaataaccgtaaaaaatatattcacaaaaacaaatatctaacataacgatcatttctaacacgatctacttacaaatacgcgacatacgcgccaccaatccatcttcccgccaaacatcgctaccgatttcatcgatataataaaaaataccaaaaatcatcacgaaacgaataccgacgttaa

SEQ ID NO: 38067 - DNA, 743 bp, Artificial Sequence
  chemically treated genomic DNA (Homo sapiens) CpG-island No: 38067
tttagcgtaaagtagttgaaaattagattcgtattcgtacgtttaagtcgaatttaagttttcgagtacgattttttttttatttatagtattcgttagcgcggcgaatttaattatcgtatatttatcgtttatttgatacgcgttaatcggtaatttagtacgtttacgtagtttacgtacgatgtcgaggtacgttttagtaggtttaattattaggtagtttgcgttttgggttttatttagtagtgatttacgaatcgttttacgacggtttattgggtttatttgatagtttttgcggtcgttttttaatgcgttttcggtagttttacggaacgggttataaaaggaggaggcgaatttggtcgaatacgatataatcgtcgtatttttaaatttcgtagcgtttagcgtttgacgaatcgtttgtatttggtcgtttatcgcggcggaaggggcgatgaagtttgtatttgtagtagttgtaattacggtttgtttgtttaaattttttagagtcgcgtcgttgtcgacgttatgttcgtatagtatatcgtagtgatcgtgagaagtgtatttatagaagtaggtgtttgatataacgattatttttggtacggtttgtttgtagatgcgcgatatacgcgttattagtttattttttcgttaggtatcgttgtcggttttatcggtatggtgagagatgttaaaagttattacggaacgaatatcggcgttgg

SEQ ID NO: 38068 - DNA, 743 bp, Artificial Sequence
  chemically treated genomic DNA (Homo sapiens) CpG-island No: 38068
ccaacgccgatattcgttccgtaataacttttaacatctctcaccataccgataaaaccgacaacgatacctaacgaaaaaataaactaataacgcgtatatcgcgcatctacaaacaaaccgtaccaaaaataatcgttatatcaaacacctacttctataaatacacttctcacgatcactacgatatactatacgaacataacgtcgacaacgacgcgactctaaaaaatttaaacaaacaaaccgtaattacaactactacaaatacaaacttcatcgccccttccgccgcgataaacgaccaaatacaaacgattcgtcaaacgctaaacgctacgaaatttaaaaatacgacgattatatcgtattcgaccaaattcgcctcctccttttataacccgttccgtaaaactaccgaaaacgcattaaaaaacgaccgcaaaaactatcaaataaacccaataaaccgtcgtaaaacgattcgtaaatcactactaaataaaacccaaaacgcaaactacctaataattaaacctactaaaacgtacctcgacatcgtacgtaaactacgtaaacgtactaaattaccgattaacgcgtatcaaataaacgataaatatacgataattaaattcgccgcgctaacgaatactataaataaaaaaaaaatcgtactcgaaaacttaaattcgacttaaacgtacgaatacgaatctaattttcaactactttacgctaaa

SEQ ID NO: 38069 - DNA, 532 bp, Artificial Sequence
  chemically treated genomic DNA (Homo sapiens) CpG-island No: 38069
gtgcgttttagttttagacgttgcgtagcgtttttaggttcggtaattacgtcgttggttttttttagtacgcgtataattaattgatatttattttcgttttttagggcgataatcgttgcggtaggcggcgttttaggtttcggtaaaataatatttggtaatgatagttgtagtacgttatcgcgtgttagtaatatcgcgcgtttaatgacgttttttagttcgcgtacgttattcggttattttatgttgtttaaggtgcgtagcgtttcggtaggaatgttgtcgatattgcgttttagacgacgggtaattttgaaggtaaaggttttcgttagtagcggaatatttttcggacgttcgcgtagtggcggtaggtgaatcgggaatacgtttaggcggtaatagagatcgttacggaatttacggtcggcgattattttttttagatcgcggttagtcgcggcgattagacgtacgttcgtttgaatgattttgttgttgtcgagacgtttaaatttttgttttt

SEQ ID NO: 38070 - DNA, 532 bp, Artificial Sequence
  chemically treated genomic DNA (Homo sapiens) CpG-island No: 38070
aaaaacaaaaatttaaacgtctcgacaacaacaaaatcattcaaacgaacgtacgtctaatcgccgcgactaaccgcgatctaaaaaaaataatcgccgaccgtaaattccgtaacgatctctattaccgcctaaacgtattcccgattcacctaccgccactacgcgaacgtccgaaaaatattccgctactaacgaaaacctttaccttcaaaattacccgtcgtctaaaacgcaatatcgacaacattcctaccgaaacgctacgcaccttaaacaacataaaataaccgaataacgtacgcgaactaaaaaacgtcattaaacgcgcgatattactaacacgcgataacgtactacaactatcattaccaaatattattttaccgaaacctaaaacgccgcctaccgcaacgattatcgccctaaaaaacgaaaataaatatcaattaattatacgcgtactaaaaaaaaccaacgacgtaattaccgaacctaaaaacgctacgcaacgtctaaaactaaaacgcac

SEQ ID NO: 38071 - DNA, 532 bp, Artificial Sequence
  chemically treated genomic DNA (Homo sapiens) CpG-island No: 38071
aggaataggagtttgaacgtttcggtagtaataaaattatttagacggacgtgcgtttaatcgtcgcgattaatcgcgatttgaaaaaaatggtcgtcgatcgtgagtttcgtagcgatttttattatcgtttgaacgtattttcgatttatttgtcgttattacgcgagcgttcggaagatatttcgttgttggcgaaagtttttatttttaaaattgttcgtcgtttggggcgtaatatcgatagtatttttgtcgagacgttgcgtattttgagtaatatggagtggtcgggtaacgtacgcgaattggaaaacgttattgagcgcgcggtattgttaatacgcggtaacgtgttgtagttgttattgttagatattgttttatcggaatttgaaacgtcgtttgtcgtaacggttgtcgttttggagggcgaagatgaatattagttgattgtgcgcgtgttgaaagaaattaacggcgtggttgtcgggtttaaaggcgttgcgtaacgtttggggttgaaacgtat

SEQ ID NO: 38072 - DNA, 532 bp, Artificial Sequence
  chemically treated genomic DNA (Homo sapiens) CpG-island No: 38072
atacgtttcaaccccaaacgttacgcaacgcctttaaacccgacaaccacgccgttaatttctttcaacacgcgcacaatcaactaatattcatcttcgccctccaaaacgacaaccgttacgacaaacgacgtttcaaattccgataaaacaatatctaacaataacaactacaacacgttaccgcgtattaacaataccgcgcgctcaataacgttttccaattcgcgtacgttacccgaccactccatattactcaaaatacgcaacgtctcgacaaaaatactatcgatattacgccccaaacgacgaacaattttaaaaataaaaactttcgccaacaacgaaatatcttccgaacgctcgcgtaataacgacaaataaatcgaaaatacgttcaaacgataataaaaatcgctacgaaactcacgatcgacgaccatttttttcaaatcgcgattaatcgcgacgattaaacgcacgtccgtctaaataattttattactaccgaaacgttcaaactcctattcct

SEQ ID NO: 38073 - DNA, 925 bp, Artificial Sequence
  chemically treated genomic DNA (Homo sapiens) CpG-island No: 38073
atattttgatgtgttgtattcgtatttgtggcgcgaaggaaaggatttttcgtttttattcgcgcggatggatgttttgttgaaagttcggtatattgcgtttgtcgttgatttttaatttcgcgtatgcgtagtaaaaaatcgttagcggcgattgtttgtaagtagttagttttggttttcgcgaggggatgatggtaacgttatttttattatttttgttacgcgaatgttagtgttgcggcgaaggtagttgttatttttgtttttattcgatgcgtaattgcgtaaagtagatttcgttgtttggggcgatttttttgttttcgattcgtaaaaattgtttgacgggtagcgcgaattattgcgattaagaatgtcgtaggatttgtcgtcggtattggttgaatcgtacgtaggttgggtaaatgcgttggaataagaatggttatatcgttacggtacgtattaatttttttgttgtgggcgatggtggcggtgatttatgtatcgttgatttcggtagtttttacgttgatatcgtttgttttgtcgttgatatattggtaggcgttatttgtcgatttatagttatcgtaggtattattggtaacgttggtgtcgataattatcgcggcggtcggggtattgttgattgttttgttggtgattgtggcgttgtggtttgggtcgaaatggtagcgtatgtgcgttcgtttgtcgtggttgttcgttattttttatgtggtttttgttattagcgtttttttgttttttgttgacggagggttgttttatgattatttttcgtattttatttcgttaatggatcgatttggtatcggtttgggttttatttttgtagtgaaagaaagcgtatttttgttgtggattttagtagtagtattgagcgaaaaatggttgt

SEQ ID NO: 38074 - DNA, 925 bp, Artificial Sequence
  chemically treated genomic DNA (Homo sapiens) CpG-island No: 38074
acaaccatttttcgctcaatactactactaaaatccacaacaaaaatacgctttctttcactacaaaaataaaacccaaaccgataccaaatcgatccattaacgaaataaaatacgaaaaataatcataaaacaaccctccgtcaacaaaaaacaaaaaaacgctaataacaaaaaccacataaaaaataacgaacaaccacgacaaacgaacgcacatacgctaccatttcgacccaaaccacaacgccacaatcaccaacaaaacaatcaacaataccccgaccgccgcgataattatcgacaccaacgttaccaataatacctacgataactataaatcgacaaataacgcctaccaatatatcaacgacaaaacaaacgatatcaacgtaaaaactaccgaaatcaacgatacataaatcaccgccaccatcgcccacaacaaaaaaattaatacgtaccgtaacgatataaccattcttattccaacgcatttacccaacctacgtacgattcaaccaataccgacgacaaatcctacgacattcttaatcgcaataattcgcgctacccgtcaaacaatttttacgaatcgaaaacaaaaaaatcgccccaaacaacgaaatctactttacgcaattacgcatcgaataaaaacaaaaataacaactaccttcgccgcaacactaacattcgcgtaacaaaaataataaaaataacgttaccatcatcccctcgcgaaaaccaaaactaactacttacaaacaatcgccgctaacgattttttactacgcatacgcgaaattaaaaatcaacgacaaacgcaatataccgaactttcaacaaaacatccatccgcgcgaataaaaacgaaaaatcctttccttcgcgccacaaatacgaatacaacacatcaaaatat

SEQ ID NO: 38075 - DNA, 925 bp, Artificial Sequence
  chemically treated genomic DNA (Homo sapiens) CpG-island No: 38075
atagttatttttcgtttaatattgttgttaagatttatagtagaaatgcgtttttttttattgtaagggtgaggtttagatcgatgttaaatcggtttattggcggagtgaaatacgggaaatagttataaagtagtttttcgttagtaaagagtagaagggcgttggtggtaaaagttatatggggaatggcgagtagttacggtagacgggcgtatatacgttgttatttcggtttaggttatagcgttataattattagtagggtaattaataatgtttcgatcgtcgcgatggttgtcgatattagcgttgttagtaatgtttgcggtaattgtggatcggtaaataacgtttgttagtgtgttaacgataaagtaggcgatattagcgtgagagttgtcgggattagcggtgtataaattatcgttattatcgtttatagtaaaaagattaatgcgtatcgtaacggtgtagttatttttgttttagcgtatttatttaatttgcgtgcggtttagttagtatcggcggtagattttgcggtatttttgatcgtaatgattcgcgttgttcgttaggtagtttttgcggatcgagaatagaaggatcgttttagatagcgggatttgttttacgtagttgcgtatcgggtgagagtaggaatggtaattattttcgtcgtagtattggtattcgcgtggtaggaatggtgaaaatgacgttgttattattttttcgcgaaagttaaaattgattgtttgtaggtaatcgtcgttggcgattttttgttgcgtatgcgcggggttaaaggttagcgataggcgtaatgtgtcgggtttttagtagagtatttattcgcgcgggtgaaggcgggaaattttttttttcgcgttataaatacggatgtagtatattaagatat

SEQ ID NO: 38076 - DNA, 925 bp, Artificial Sequence
  chemically treated genomic DNA (Homo sapiens) CpG-island No: 38076
atatcttaatatactacatccgtatttataacgcgaaaaaaaaaatttcccgccttcacccgcgcgaataaatactctactaaaaacccgacacattacgcctatcgctaacctttaaccccgcgcatacgcaacaaaaaatcgccaacgacgattacctacaaacaatcaattttaactttcgcgaaaaaataataacaacgtcattttcaccattcctaccacgcgaataccaatactacgacgaaaataattaccattcctactctcacccgatacgcaactacgtaaaacaaatcccgctatctaaaacgatccttctattctcgatccgcaaaaactacctaacgaacaacgcgaatcattacgatcaaaaataccgcaaaatctaccgccgatactaactaaaccgcacgcaaattaaataaatacgctaaaacaaaaataactacaccgttacgatacgcattaatctttttactataaacgataataacgataatttatacaccgctaatcccgacaactctcacgctaatatcgcctactttatcgttaacacactaacaaacgttatttaccgatccacaattaccgcaaacattactaacaacgctaatatcgacaaccatcgcgacgatcgaaacattattaattaccctactaataattataacgctataacctaaaccgaaataacaacgtatatacgcccgtctaccgtaactactcgccattccccatataacttttaccaccaacgcccttctactctttactaacgaaaaactactttataactatttcccgtatttcactccgccaataaaccgatttaacatcgatctaaacctcacccttacaataaaaaaaaacgcatttctactataaatcttaacaacaatattaaacgaaaaataactat

SEQ ID NO: 38077 - DNA, 543 bp, Artificial Sequence
  chemically treated genomic DNA (Homo sapiens) CpG-island No: 38077
acgcgggcgaacgatgcggttaatcgttataaattgttgaaaaaagatgcgcgtattatcgtcgtttagtaggtagtaaggttggaattcgttatgtgtttgcgtcgtcgttggtcgttggaaaatttttagttttttttggttgagtattcgttggttcgttatttaattcgtcgtttgatttggggcgtttatagcgtcgaaaattagttattggtttgttttcgcgtagtagaagataatagttttagtatcgttgacgatgatttttttattttgtcggaaggcgatatttttatcggtattttttacgttttggaaatattattaacggatgttgtcgtttttggttagttttttgtcgattacgaattggtattatcgtttcgttagttcgatcgtaatagttacgttttgatagaagtcgagcgtaatgttagtgaattgagtcgttgggtaggtagaaaatgtcgagtggtcgggttaggggttgggaatacggtggtaaggggaatttagatgaggggtcgatggtgttatttt

SEQ ID NO: 38078 - DNA, 543 bp, Artificial Sequence
  chemically treated genomic DNA (Homo sapiens) CpG-island No: 38078
aaaataacaccatcgacccctcatctaaattccccttaccaccgtattcccaacccctaacccgaccactcgacattttctacctacccaacgactcaattcactaacattacgctcgacttctatcaaaacgtaactattacgatcgaactaacgaaacgataataccaattcgtaatcgacaaaaaactaaccaaaaacgacaacatccgttaataatatttccaaaacgtaaaaaataccgataaaaatatcgccttccgacaaaataaaaaaatcatcgtcaacgatactaaaactattatcttctactacgcgaaaacaaaccaataactaattttcgacgctataaacgccccaaatcaaacgacgaattaaataacgaaccaacgaatactcaaccaaaaaaaactaaaaattttccaacgaccaacgacgacgcaaacacataacgaattccaaccttactacctactaaacgacgataatacgcgcatcttttttcaacaatttataacgattaaccgcatcgttcgcccgcgt

SEQ ID NO: 38079 - DNA, 543 bp, Artificial Sequence
  chemically treated genomic DNA (Homo sapiens) CpG-island No: 38079
aaggtgatattatcgattttttatttgggttttttttattatcgtatttttagtttttgattcgattattcggtattttttgtttgtttagcggtttagtttattggtattgcgttcggtttttgttagggcgtagttgttacggtcgagttggcggaacggtggtattagttcgtagtcggtaaaaagttgattaaaggcggtagtattcgttggtgatatttttagaacgtgaggagtgtcgatagagatatcgtttttcggtagggtgaaaagattatcgttagcggtgttggagttgttattttttgttacgcgaaagtaagttagtagttggttttcggcgttataaacgttttaaattagacggcgggttaagtgacgaattagcggatgtttaattaggaagagttggaagttttttagcgattagcggcggcgtaggtatatggcggattttagttttgttatttgttgggcggcgatggtacgcgtatttttttttagtaatttgtagcggttaatcgtatcgttcgttcgcgt

SEQ ID NO: 38080 - DNA, 543 bp, Artificial Sequence
  chemically treated genomic DNA (Homo sapiens) CpG-island No: 38080
acgcgaacgaacgatacgattaaccgctacaaattactaaaaaaaaatacgcgtaccatcgccgcccaacaaataacaaaactaaaatccgccatatacctacgccgccgctaatcgctaaaaaacttccaactcttcctaattaaacatccgctaattcgtcacttaacccgccgtctaatttaaaacgtttataacgccgaaaaccaactactaacttactttcgcgtaacaaaaaataacaactccaacaccgctaacgataatcttttcaccctaccgaaaaacgatatctctatcgacactcctcacgttctaaaaatatcaccaacgaatactaccgcctttaatcaactttttaccgactacgaactaataccaccgttccgccaactcgaccgtaacaactacgccctaacaaaaaccgaacgcaataccaataaactaaaccgctaaacaaacaaaaaataccgaataatcgaatcaaaaactaaaaatacgataataaaaaaaacccaaataaaaaatcgataatatcacctt

SEQ ID NO: 38081 - DNA, 992 bp, Artificial Sequence
  chemically treated genomic DNA (Homo sapiens) CpG-island No: 38081
  misc_feature (920)..(920): n is either a, c, g or t
gggcgttgattagaatattaattagggtatcgatattacgataattaagatttattttttgtttcgttagcggatggatggtatgcgcggtatcgtttattagcgtaagttttggttgtacgtattgtaacgtatggcgacgcgttagcggaaacgtattagcggtaagcggtgtaacgtaatttagacgcgacgggaaatgtttcgcgattttcgtttggagttgtgttatatttatattttgtaattggcgaatacgcgtcggagagttatattatattagcgatgtttagttattaaataacggtagaaacgtacgcggttcgttcggagtaaattgttgttaggtgttgtcgtcgggatcgttttcgtattggacgttaattaatatgtacgattgcgtatattgttatgtatgaacgttaattttcgttatttgtcgtatttgcgaatttgcgtcgtcggtattaattattagtttcgcgcgaattattttagcgttttttagttttagtttttgaagattattatggcgatgtagcgtaattagcgagtttggtatacgtaacgttattttcggatgcgtttttagcgtttgttataacgtttgtggtaggatagtgttttttattatatagttaagtagcggtagtttaagtttagcggcgttaaatattatatgcgtcgttttttatttttacgtttttagtttgcggtaaggatggtaacgtatagtttgtattgtattttagatttttaattttttaagtaatgatatcgaagtcgcgttgatcgtcgagattcgtacgttcggttggttattagcgataaacggcgttggttttgcgtgttcgattatcgttatcgtaaattcgtgttgtgttagttttagcgttagtgcgtcgtcgattatttttttnggtcgataatggggtaatttttcgttggttgattgttatggttaattattttgtagtaatatgttttaagtt

SEQ ID NO: 38082 - DNA, 992 bp, Artificial Sequence
  chemically treated genomic DNA (Homo sapiens) CpG-island No: 38082
  misc_feature (73)..(73): n is either a, c, g or t
aacttaaaacatattactacaaaataattaaccataacaatcaaccaacgaaaaattaccccattatcgaccnaaaaaaataatcgacgacgcactaacgctaaaactaacacaacacgaatttacgataacgataatcgaacacgcaaaaccaacgccgtttatcgctaataaccaaccgaacgtacgaatctcgacgatcaacgcgacttcgatatcattacttaaaaaattaaaaatctaaaatacaatacaaactatacgttaccatccttaccgcaaactaaaaacgtaaaaataaaaaacgacgcatataatatttaacgccgctaaacttaaactaccgctacttaactatataataaaaaacactatcctaccacaaacgttataacaaacgctaaaaacgcatccgaaaataacgttacgtataccaaactcgctaattacgctacatcgccataataatcttcaaaaactaaaactaaaaaacgctaaaataattcgcgcgaaactaataattaataccgacgacgcaaattcgcaaatacgacaaataacgaaaattaacgttcatacataacaatatacgcaatcgtacatattaattaacgtccaatacgaaaacgatcccgacgacaacacctaacaacaatttactccgaacgaaccgcgtacgtttctaccgttatttaataactaaacatcgctaatataatataactctccgacgcgtattcgccaattacaaaatataaatataacacaactccaaacgaaaatcgcgaaacatttcccgtcgcgtctaaattacgttacaccgcttaccgctaatacgtttccgctaacgcgtcgccatacgttacaatacgtacaaccaaaacttacgctaataaacgataccgcgcataccatccatccgctaacgaaacaaaaaataaatcttaattatcgtaatatcgataccctaattaatattctaatcaacgccc

SEQ ID NO: 38083 - DNA, 992 bp, Artificial Sequence
  chemically treated genomic DNA (Homo sapiens) CpG-island No: 38083
  misc_feature (73)..(73): n is either a, c, g or t
aatttaaagtatattgttataggatgattgattatgataattaattaacgggaaattgttttattgtcggttnggaggaatggtcggcggcgtattggcgttggggttggtatagtacggatttgcggtaacggtgatcgagtacgtagaattagcgtcgtttgtcgttgatagttaatcggacgtgcggatttcggcgattagcgcggtttcggtattattgtttaaagggttaggggtttgggatgtagtataggttatgcgttgttatttttatcgtagattggaaacgtgggagtgggaaacggcgtatgtggtgtttgacgtcgttgaatttaagttatcgttgtttggttatatggtggaaaatattgttttgttataggcgttgtggtaggcgttggaagcgtattcgaaagtaacgttacgtgtgttaggttcgttgattgcgttgtatcgttatgatgatttttaggagttggagttgaaaggcgttgaagtgattcgcgcgaagttggtgattggtgtcgacggcgtaaattcgtaggtgcggtagatggcgggaattggcgtttatgtatggtagtatgcgtagtcgtgtatgttgattagcgtttagtgcgagaacgatttcggcgatagtatttggtagtaatttatttcggacggatcgcgtgcgtttttgtcgttgtttgataattgggtatcgttggtgtggtatgatttttcggcgcgtattcgttagttgtagaatatgaatatggtatagttttaggcggaaatcgcgaagtatttttcgtcgcgtttgggttacgttatatcgtttgtcgttggtgcgttttcgttgacgcgtcgttatgcgttgtagtacgtgtagttagggtttgcgttggtgggcgatgtcgcgtatattatttattcgttggcggggtagggagtgaattttggttatcgtgatgtcgatgttttgattgatgttttggttaacgttt

SEQ ID NO: 38084 - DNA, 992 bp, Artificial Sequence
  chemically treated genomic DNA (Homo sapiens) CpG-island No: 38084
  misc_feature (920)..(920): n is either a, c, g or t
aaacgttaaccaaaacatcaatcaaaacatcgacatcacgataaccaaaattcactccctaccccgccaacgaataaataatatacgcgacatcgcccaccaacgcaaaccctaactacacgtactacaacgcataacgacgcgtcaacgaaaacgcaccaacgacaaacgatataacgtaacccaaacgcgacgaaaaatacttcgcgatttccgcctaaaactataccatattcatattctacaactaacgaatacgcgccgaaaaatcataccacaccaacgatacccaattatcaaacaacgacaaaaacgcacgcgatccgtccgaaataaattactaccaaatactatcgccgaaatcgttctcgcactaaacgctaatcaacatacacgactacgcatactaccatacataaacgccaattcccgccatctaccgcacctacgaatttacgccgtcgacaccaatcaccaacttcgcgcgaatcacttcaacgcctttcaactccaactcctaaaaatcatcataacgatacaacgcaatcaacgaacctaacacacgtaacgttactttcgaatacgcttccaacgcctaccacaacgcctataacaaaacaatattttccaccatataaccaaacaacgataacttaaattcaacgacgtcaaacaccacatacgccgtttcccactcccacgtttccaatctacgataaaaataacaacgcataacctatactacatcccaaacccctaaccctttaaacaataataccgaaaccgcgctaatcgccgaaatccgcacgtccgattaactatcaacgacaaacgacgctaattctacgtactcgatcaccgttaccgcaaatccgtactataccaaccccaacgccaatacgccgccgaccattcctccnaaccgacaataaaacaatttcccgttaattaattatcataatcaatcatcctataacaatatactttaaatt

SEQ ID NO: 38085 - DNA, 667 bp, Artificial Sequence
  chemically treated genomic DNA (Homo sapiens) CpG-island No: 38085
ttacgttacgtagcggcgtatcgtcgtttaggtgttcgttgtcgcgtagggtaaatgagaattacgttcgcgtacgcggatatgcggttaatagttcggttaacgttttaatttcggaaaaattcggtagggtttcgtaggttagtagatcggtttcggtatttagtaaggtttttacgcgcgggcgatgaaacgtttgaaatgttttaacgttataatgataatcgttacggtatttagagttattcgttagatacgcgtcgtaaggttcgacggatttcgttattagaagcgttttcgtttgcgggttttttgttagatacgttttacgggttttacgcgttagttttacgtttttgttaattagcgttttcgattgcgttttatttagatttcgcgcggcgaagttcgtcggcgtcgtttgatagttggtagtgatcgcgtattgcgttttcgttcggtagtaattaagatgtatttcgcggataagtttcgggttttttattagtattttggttgattataggttgtcggttaagttatattttcgcgtttttagtttcgtcgttatcgcgttatttagtagtaggatattttgtttattaagaagagcgcgtaacggattattttgcgatatgttttggtttttgttttgcgtttcggggtt

SEQ ID NO: 38086 - DNA, 667 bp, Artificial Sequence
  chemically treated genomic DNA (Homo sapiens) CpG-island No: 38086
aaccccgaaacgcaaaacaaaaaccaaaacatatcgcaaaataatccgttacgcgctcttcttaataaacaaaatatcctactactaaataacgcgataacgacgaaactaaaaacgcgaaaatataacttaaccgacaacctataatcaaccaaaatactaataaaaaacccgaaacttatccgcgaaatacatcttaattactaccgaacgaaaacgcaatacgcgatcactaccaactatcaaacgacgccgacgaacttcgccgcgcgaaatctaaataaaacgcaatcgaaaacgctaattaacaaaaacgtaaaactaacgcgtaaaacccgtaaaacgtatctaacaaaaaacccgcaaacgaaaacgcttctaataacgaaatccgtcgaaccttacgacgcgtatctaacgaataactctaaataccgtaacgattatcattataacgttaaaacatttcaaacgtttcatcgcccgcgcgtaaaaaccttactaaataccgaaaccgatctactaacctacgaaaccctaccgaatttttccgaaattaaaacgttaaccgaactattaaccgcatatccgcgtacgcgaacgtaattctcatttaccctacgcgacaacgaacacctaaacgacgatacgccgctacgtaacgtaa

SEQ ID NO: 38087 - DNA, 667 bp, Artificial Sequence
  chemically treated genomic DNA (Homo sapiens) CpG-island No: 38087
aatttcgaaacgtaaaataggagttagaatatgtcgtagaataattcgttacgcgttttttttgataaataggatattttgttgttggatggcgcgatggcgacggagttggaagcgcgagggtgtaatttagtcgatagtttgtggttagttaaagtgttggtagaaaattcggagtttattcgcgaagtgtattttgattattatcgggcgggggcgtaatgcgcgattattgttagttattaggcgacgtcggcgggtttcgtcgcgcgaggtttggatgaagcgtagtcgaaagcgttgattggtaaaagcgtggagttggcgcgtaaagttcgtgaagcgtatttggtagagaattcgtaggcgggaacgtttttggtggcgggattcgtcgggttttacggcgcgtatttggcggatggttttgaatatcgtggcgattattattgtagcgttgaggtattttaggcgttttatcgttcgcgcgtggaagttttgttggatgtcggggtcgatttgttggtttgcgaaattttgtcgaattttttcgagattgaggcgttggtcgagttgttgatcgtatattcgcgtgcgcgggcgtggtttttatttattttgcgcgatagcgaatatttgagcgacggtacgtcgttgcgtgacgtgg

SEQ ID NO: 38088 - DNA, 667 bp, Artificial Sequence
  chemically treated genomic DNA (Homo sapiens) CpG-island No: 38088
ccacgtcacgcaacgacgtaccgtcgctcaaatattcgctatcgcgcaaaataaataaaaaccacgcccgcgcacgcgaatatacgatcaacaactcgaccaacgcctcaatctcgaaaaaattcgacaaaatttcgcaaaccaacaaatcgaccccgacatccaacaaaacttccacgcgcgaacgataaaacgcctaaaatacctcaacgctacaataataatcgccacgatattcaaaaccatccgccaaatacgcgccgtaaaacccgacgaatcccgccaccaaaaacgttcccgcctacgaattctctaccaaatacgcttcacgaactttacgcgccaactccacgcttttaccaatcaacgctttcgactacgcttcatccaaacctcgcgcgacgaaacccgccgacgtcgcctaataactaacaataatcgcgcattacgcccccgcccgataataatcaaaatacacttcgcgaataaactccgaattttctaccaacactttaactaaccacaaactatcgactaaattacaccctcgcgcttccaactccgtcgccatcgcgccatccaacaacaaaatatcctatttatcaaaaaaaacgcgtaacgaattattctacgacatattctaactcctattttacgtttcgaaatt

SEQ ID NO: 38089 - DNA, 696 bp, Artificial Sequence
  chemically treated genomic DNA (Homo sapiens) CpG-island No: 38089
  misc_feature (48)..(49): n is either a, c, g or t
  misc_feature (250)..(250): n is either a, c, g or t
  misc_feature (266)..(267): n is either a, c, g or t
  misc_feature (291)..(291): n is either a, c, g or t
  misc_feature (384)..(384): n is either a, c, g or t
agggtagtcgttagagattgtatcgtcgcgtaggtgatttagatatannaggttcggataggattttttttgatttgtttttagcgtattaacgatgttttggatttgtcggattttggttatagcgttttggtatagtgattaatatgttttcggcggtattatcggtaatgttcgataacgacgtattatttatatttttcgtgtttttataaacgtgggttttttacggttaacggaacgggtttgngcgtacgtatcgtgtnntttattttcgggttacgtatattngcgcgtttagttataagcgtaacgttagaatgatttttattttatatttagcgcggcgcgtattacgacgcggtacgataatttttttttttnggcggtaatatcgtcgaagaagacgacgttggcgttagtcgtttttagttcgttttgtatcgaacgcgttagtttttcgttatattgttgtttgtcgtgaatgatggcgatgcgttggggttttatcgttttaagaatgtattttgtcgtcgttggtttttgggaagagtttagttcggtagtacgtataatgtgttgataatcgcgttgggttagtttcgggttggtcgttttcggcgagattattagaatattttcgtttttatagatatttgacgtaggttgggtagaagaagaatatagatgattaat

SEQ ID NO: 38090 - DNA, 696 bp, Artificial Sequence
  chemically treated genomic DNA (Homo sapiens) CpG-island No: 38090
  misc_feature (313)..(313): n is either a, c, g or t
  misc_feature (406)..(406): n is either a, c, g or t
  misc_feature (430)..(431): n is either a, c, g or t
  misc_feature (447)..(447): n is either a, c, g or t
  misc_feature (648)..(649): n is either a, c, g or t
attaatcatctatattcttcttctacccaacctacgtcaaatatctataaaaacgaaaatattctaataatctcgccgaaaacgaccaacccgaaactaacccaacgcgattatcaacacattatacgtactaccgaactaaactcttcccaaaaaccaacgacgacaaaatacattcttaaaacgataaaaccccaacgcatcgccatcattcacgacaaacaacaatataacgaaaaactaacgcgttcgatacaaaacgaactaaaaacgactaacgccaacgtcgtcttcttcgacgatattaccgccnaaaaaaaaaaattatcgtaccgcgtcgtaatacgcgccgcgctaaatataaaataaaaatcattctaacgttacgcttataactaaacgcgcnaatatacgtaacccgaaaataaannacacgatacgtacgcncaaacccgttccgttaaccgtaaaaaacccacgtttataaaaacacgaaaaatataaataatacgtcgttatcgaacattaccgataataccgccgaaaacatattaatcactataccaaaacgctataaccaaaatccgacaaatccaaaacatcgttaatacgctaaaaacaaatcaaaaaaaatcctatccgaacctnntatatctaaatcacctacgcgacgatacaatctctaacgactaccct

SEQ ID NO: 38091 - DNA, 696 bp, Artificial Sequence
  chemically treated genomic DNA (Homo sapiens) CpG-island No: 38091
  misc_feature (313)..(313): n is either a, c, g or t
  misc_feature (406)..(406): n is either a, c, g or t
  misc_feature (430)..(431): n is either a, c, g or t
  misc_feature (447)..(447): n is either a, c, g or t
  misc_feature (648)..(649): n is either a, c, g or t
attggttatttgtgttttttttttatttagtttgcgttagatatttatgaagacgaaggtattttgatgatttcgtcgggagcgattaattcggagttgatttaacgcggttattaatatattatgcgtattgtcgggttggattttttttaggggttaacggcggtaaaatatatttttgagacggtgaagttttagcgtatcgttattatttacgataaataatagtatggcgaagggttggcgcgttcggtgtaggacgggttgaaagcggttaacgttaacgtcgtttttttcgacggtattatcgttnggggagaaagattgtcgtgtcgcgtcgtgatgcgcgtcgcgttgaatataaagtaagaattattttgacgttgcgtttgtagttgagcgcgtnggtgtacgtagttcggaaatgggnngtacgatgcgtgcgtntaggttcgtttcgttggtcgtgaaaagtttacgtttataggggtacggaaggtgtgggtaatgcgtcgttgtcgaatattgtcggtgatgtcgtcgaaggtatgttggttattatgttaaaacgttatgattaggattcggtaaatttagggtatcgttgatgcgttgaaagtagattaagaaagattttgttcgggtttnntatgtttggattatttacgcggcggtgtaatttttggcgattgtttt

SEQ ID NO: 38092 - DNA, 696 bp, Artificial Sequence
  chemically treated genomic DNA (Homo sapiens) CpG-island No: 38092
  misc_feature (48)..(49): n is either a, c, g or t
  misc_feature (250)..(250): n is either a, c, g or t
  misc_feature (266)..(267): n is either a, c, g or t
  misc_feature (291)..(291): n is either a, c, g or t
  misc_feature (384)..(384): n is either a, c, g or t
aaaacaatcgccaaaaattacaccgccgcgtaaataatccaaacatannaaacccgaacaaaatctttcttaatctactttcaacgcatcaacgataccctaaatttaccgaatcctaatcataacgttttaacataataaccaacataccttcgacgacatcaccgacaatattcgacaacgacgcattacccacaccttccgtacccctataaacgtaaacttttcacgaccaacgaaacgaacctanacgcacgcatcgtacnncccatttccgaactacgtacaccnacgcgctcaactacaaacgcaacgtcaaaataattcttactttatattcaacgcgacgcgcatcacgacgcgacacgacaatctttctccccnaacgataataccgtcgaaaaaaacgacgttaacgttaaccgctttcaacccgtcctacaccgaacgcgccaacccttcgccatactattatttatcgtaaataataacgatacgctaaaacttcaccgtctcaaaaatatattttaccgccgttaacccctaaaaaaaatccaacccgacaatacgcataatatattaataaccgcgttaaatcaactccgaattaatcgctcccgacgaaatcatcaaaataccttcgtcttcataaatatctaacgcaaactaaataaaaaaaaaacacaaataaccaat

SEQ ID NO: 38093 - DNA, 548 bp, Artificial Sequence
  chemically treated genomic DNA (Homo sapiens) CpG-island No: 38093
ttttgcgcggttttttgattttatttcgtatgaaatttgtagagcgatcgttttaaggattagcgagcgttaattagattcgtttgtgtttgtagagttttatttgaggtttgggttttcgagggcggatgagcgggtcggttttcgggttcgggttgggggattcgtagttcgcggtcggcggggatggggaggggtggtcgtttgtcgcgcggttttcgcgggtcgtcgttaggtgtacggtttttttggtttttcgtagggaggacgttttttggtgttttcgtcgtcgtcgggtttgggagttttagagcgggcgggaggcggggtcggcggggttggattttgacgttagtttaaggtcgggtgattattggggtttgttcgcgtcgcggacgcgtcgagtttttttagtgtggcgttgttcggcggcgaggggggtgtggaacgaagtacggttaagatagaaaataaagttagtaggttatttggtaggttttgggcgaattatgtaacgaaagtaggggaatgtttgatgcgttttattt

SEQ ID NO: 38094 - DNA, 548 bp, Artificial Sequence
  chemically treated genomic DNA (Homo sapiens) CpG-island No: 38094
aaataaaacgcatcaaacattcccctactttcgttacataattcgcccaaaacctaccaaataacctactaactttattttctatcttaaccgtacttcgttccacacccccctcgccgccgaacaacgccacactaaaaaaactcgacgcgtccgcgacgcgaacaaaccccaataatcacccgaccttaaactaacgtcaaaatccaaccccgccgaccccgcctcccgcccgctctaaaactcccaaacccgacgacgacgaaaacaccaaaaaacgtcctccctacgaaaaaccaaaaaaaccgtacacctaacgacgacccgcgaaaaccgcgcgacaaacgaccacccctccccatccccgccgaccgcgaactacgaatcccccaacccgaacccgaaaaccgacccgctcatccgccctcgaaaacccaaacctcaaataaaactctacaaacacaaacgaatctaattaacgctcgctaatccttaaaacgatcgctctacaaatttcatacgaaataaaatcaaaaaaccgcgcaaaa

SEQ ID NO: 38095 - DNA, 548 bp, Artificial Sequence
  chemically treated genomic DNA (Homo sapiens) CpG-island No: 38095
gagtgggacgtattaaatatttttttgttttcgttgtataattcgtttagaatttgttaggtgatttgttgattttgttttttgttttgatcgtgtttcgttttatatttttttcgtcgtcgggtagcgttatattgagagggttcggcgcgttcgcggcgcgggtagattttagtagttattcggttttggattggcgttaagatttagtttcgtcgatttcgtttttcgttcgttttggagtttttaggttcggcggcggcgggggtattagggggcgttttttttgcgggggattagggggatcgtgtatttggcgacggttcgcgggagtcgcgcggtaggcggttatttttttttattttcgtcgatcgcggattgcgggttttttagttcgggttcgagagtcggttcgtttattcgttttcggggatttaggttttaggtgaagttttgtagatatagacggatttgattagcgttcgttggtttttggggcggtcgttttgtagattttatgcgaaatggggttaaaaggtcgcgtagaa

SEQ ID NO: 38096 - DNA, 548 bp, Artificial Sequence
  chemically treated genomic DNA (Homo sapiens) CpG-island No: 38096
ttctacgcgaccttttaaccccatttcgcataaaatctacaaaacgaccgccccaaaaaccaacgaacgctaatcaaatccgtctatatctacaaaacttcacctaaaacctaaatccccgaaaacgaataaacgaaccgactctcgaacccgaactaaaaaacccgcaatccgcgatcgacgaaaataaaaaaaaataaccgcctaccgcgcgactcccgcgaaccgtcgccaaatacacgatccccctaatcccccgcaaaaaaaacgccccctaatacccccgccgccgccgaacctaaaaactccaaaacgaacgaaaaacgaaatcgacgaaactaaatcttaacgccaatccaaaaccgaataactactaaaatctacccgcgccgcgaacgcgccgaaccctctcaatataacgctacccgacgacgaaaaaaatataaaacgaaacacgatcaaaacaaaaaacaaaatcaacaaatcacctaacaaattctaaacgaattatacaacgaaaacaaaaaaatatttaatacgtcccactc

SEQ ID NO: 38097 - DNA, 528 bp, Artificial Sequence
  chemically treated genomic DNA (Homo sapiens) CpG-island No: 38097
gtcgaggtttttttcgcggtaggcggcgaaagggtttgcgcgttttttttttttttatagtttttcgtttttcgcgggttcgtttttttaggcgaggttaattttcgcgttcgtcgttcgagttttagcggttcgggaggagttttcggcggcgttcggtagagttttcggtcggtgtttcgcggtcgtcgcgtttttagggttattggcgtagcgtacggagaattcggttttcggcgcggtgcgtcgtgttgggttttcgcgtcgggttatttgaagttagaggatttggggcgtattgaagggattgcgttttttagttcgaattcggtttaagtggggtcgggagcgaggtcgggaaagttttattcgtttaaagttttattatcgagaggtatttaaaaaggaaagcgtagagggattttgtttacgcgcgtgtatatatatatttttttatatatatataagtaaatacgagtttttcgttattttttttttagggtttttttaaggttaaatattgttttt

SEQ ID NO: 38098 - DNA, 528 bp, Artificial Sequence
  chemically treated genomic DNA (Homo sapiens) CpG-island No: 38098
aaaaacaatatttaaccttaaaaaaaccctaaaaaaaaaataacgaaaaactcgtatttacttatatatatataaaaaaatatatatatacacgcgcgtaaacaaaatccctctacgctttcctttttaaatacctctcgataataaaactttaaacgaataaaactttcccgacctcgctcccgaccccacttaaaccgaattcgaactaaaaaacgcaatcccttcaatacgccccaaatcctctaacttcaaataacccgacgcgaaaacccaacacgacgcaccgcgccgaaaaccgaattctccgtacgctacgccaataaccctaaaaacgcgacgaccgcgaaacaccgaccgaaaactctaccgaacgccgccgaaaactcctcccgaaccgctaaaactcgaacgacgaacgcgaaaattaacctcgcctaaaaaaacgaacccgcgaaaaacgaaaaactataaaaaaaaaaaaaacgcgcaaaccctttcgccgcctaccgcgaaaaaaacctcgac

SEQ ID NO: 38099 - DNA, 528 bp, Artificial Sequence
  chemically treated genomic DNA (Homo sapiens) CpG-island No: 38099
gggagtaatatttggttttgaggagattttggggaggaagtggcggggagttcgtgtttgtttgtgtgtgtgtgggggggtgtgtgtgtatacgcgcgtgggtagggtttttttgcgtttttttttttaagtgtttttcggtggtgaggttttgggcgggtgagattttttcgatttcgttttcggttttatttaagtcgggttcgagttgggagacgtagtttttttagtgcgttttaaattttttggttttaggtggttcggcgcgggggtttagtacgacgtatcgcgtcgagaatcgggtttttcgtgcgttgcgttagtagttttgggagcgcggcggtcgcggggtatcggtcgagggttttgtcgagcgtcgtcgggagtttttttcggatcgttgaggttcgggcggcgggcgcggaggttggtttcgtttggaggggcgggttcgcgaggggcggggggttgtggaggaggggagggcgcgtaagttttttcgtcgtttgtcgcgggaggggtttcggt

SEQ ID NO: 38100 - DNA, 528 bp, Artificial Sequence
  chemically treated genomic DNA (Homo sapiens) CpG-island No: 38100
accgaaacccctcccgcgacaaacgacgaaaaaacttacgcgccctcccctcctccacaaccccccgcccctcgcgaacccgcccctccaaacgaaaccaacctccgcgcccgccgcccgaacctcaacgatccgaaaaaaactcccgacgacgctcgacaaaaccctcgaccgataccccgcgaccgccgcgctcccaaaactactaacgcaacgcacgaaaaacccgattctcgacgcgatacgtcgtactaaacccccgcgccgaaccacctaaaaccaaaaaatttaaaacgcactaaaaaaactacgtctcccaactcgaacccgacttaaataaaaccgaaaacgaaatcgaaaaaatctcacccgcccaaaacctcaccaccgaaaaacacttaaaaaaaaaaacgcaaaaaaaccctacccacgcgcgtatacacacacacccccccacacacacacaaacaaacacgaactccccgccacttcctccccaaaatctcctcaaaaccaaatattactccc

SEQ ID NO: 38101 - DNA, 533 bp, Artificial Sequence
  chemically treated genomic DNA (Homo sapiens) CpG-island No: 38101
gagatagtttggacgggaattttatcggggagataagttagatatttagtcggagtagtagcggcgttttaggttcgcgttttttagttcggatgttatatttatttagttttcgggtcgggtttcgcgttttttttttttttttttttttttttgttttttcgtattttttttttttttttttttttttttcgtttttttttttttttttttttttttttttttcggcggttttttttttttttttttttttttcgttcgtttttttttttggggatgggagtttcgtttatatttttttttttagtcgttcgatttcgtttagtaggttcgggtttcggaagtttaggtagcgttcgagttcgtagttgtcgtcggagttgggacgtcgttgtttttagttttgggaagcggttggggtttatttggggattacgtgcggaggtattagaaagtatgtatcgattagtcgtcgtattttttaaaaatatttatgggagtttgggtttttttgagtttagtgtaattgttgt

SEQ ID NO: 38102 - DNA, 533 bp, Artificial Sequence
  chemically treated genomic DNA (Homo sapiens) CpG-island No: 38102
acaacaattacactaaactcaaaaaaacccaaactcccataaatatttttaaaaaatacgacgactaatcgatacatactttctaatacctccgcacgtaatccccaaataaaccccaaccgcttcccaaaactaaaaacaacgacgtcccaactccgacgacaactacgaactcgaacgctacctaaacttccgaaacccgaacctactaaacgaaatcgaacgactaaaaaaaaaaatataaacgaaactcccatccccaaaaaaaaaaacgaacgaaaaaaaaaaaaaaaaaaaaaaaaccgccgaaaaaaaaaaaaaaaaaaaaaaaaaaaaaaacgaaaaaaaaaaaaaaaaaaaaaaaaaatacgaaaaaacaaaaaaaaaaaaaaaaaaaaaaaaaacgcgaaacccgacccgaaaactaaataaatataacatccgaactaaaaaacgcgaacctaaaacgccgctactactccgactaaatatctaacttatctccccgataaaattcccgtccaaactatctc

SEQ ID NO: 38103 - DNA, 533 bp, Artificial Sequence
  chemically treated genomic DNA (Homo sapiens) CpG-island No: 38103
gtagtagttatattaaatttagggaagtttagatttttatgggtatttttggaaggtacggcgattagtcggtgtatgttttttagtattttcgtacgtggtttttaggtgagttttagtcgttttttagagttggaggtagcggcgttttagtttcgacggtagttgcggattcgggcgttgtttgggttttcgggattcgggtttgttaggcgaggtcgggcggttggaggggaggatgtgggcggggtttttatttttagaaagggaggcgagcgagggaggagggaaggagggaggggtcgtcggggaagaggaggaggaaggaaagaaagaaagcgagggagggaaagaggaggaaggaagatgcgagaaggtagaggaggagggagggagggaaggagcgcggagttcggttcggaagttaggtgagtgtggtattcgagttgagggacgcgagtttgagacgtcgttgttgtttcggttgagtatttagtttgttttttcgatgggattttcgtttaagttatttt

SEQ ID NO: 38104 - DNA, 533 bp, Artificial Sequence
  chemically treated genomic DNA (Homo sapiens) CpG-island No: 38104
aaaataacttaaacgaaaatcccatcgaaaaaacaaactaaatactcaaccgaaacaacaacgacgtctcaaactcgcgtccctcaactcgaataccacactcacctaacttccgaaccgaactccgcgctccttccctccctccctcctcctctaccttctcgcatcttccttcctcctctttccctccctcgctttctttctttccttcctcctcctcttccccgacgacccctccctccttccctcctccctcgctcgcctccctttctaaaaataaaaaccccgcccacatcctcccctccaaccgcccgacctcgcctaacaaacccgaatcccgaaaacccaaacaacgcccgaatccgcaactaccgtcgaaactaaaacgccgctacctccaactctaaaaaacgactaaaactcacctaaaaaccacgtacgaaaatactaaaaaacatacaccgactaatcgccgtaccttccaaaaatacccataaaaatctaaacttccctaaatttaatataactactac

SEQ ID NO: 38105 - DNA, 566 bp, Artificial Sequence
  chemically treated genomic DNA (Homo sapiens) CpG-island No: 38105
cgatcgttcggcgttcgattttattcggtcggatggagacgcggaattttcggtcgagtttttcgcggttagtgtttttgtcgtgcgtacgcgcggaggggtttgggtttgggagaagggcgacgcggtgcgcgggcgtcgtttgcgggtcgcggcggggagggcgtacgtacgaggggcggacggcgggcgttgagagtggttgaggattcggaaacgcgtcgtagagggtgcggtttagaggaggtcgcgggtcgggaaaggtcggggcgggatcggaaacgttaggttagcggttttcggggtgaagggggtcgagcggacgggtagggtttcgagggcgaattttggtcggatgagtaatatagtagtggggtaggcgcgtgcgtttttagcgtagttggtaggtgggttgcgcgcgggttcggtcgtagcggggcggggcgcggcggttcggtttgcgggtcgcgggcgggttaatttatagtttttgggtggcggtgtcggtagcgtttggggttttcgggtagttgggatggggtttataattttgttgtggttttggt

SEQ ID NO: 38106 - DNA, 566 bp, Artificial Sequence
  chemically treated genomic DNA (Homo sapiens) CpG-island No: 38106
accaaaaccacaacaaaattataaaccccatcccaactacccgaaaaccccaaacgctaccgacaccgccacccaaaaactataaattaacccgcccgcgacccgcaaaccgaaccgccgcgccccgccccgctacgaccgaacccgcgcgcaacccacctaccaactacgctaaaaacgcacgcgcctaccccactactatattactcatccgaccaaaattcgccctcgaaaccctacccgtccgctcgacccccttcaccccgaaaaccgctaacctaacgtttccgatcccgccccgacctttcccgacccgcgacctcctctaaaccgcaccctctacgacgcgtttccgaatcctcaaccactctcaacgcccgccgtccgcccctcgtacgtacgccctccccgccgcgacccgcaaacgacgcccgcgcaccgcgtcgcccttctcccaaacccaaacccctccgcgcgtacgcacgacaaaaacactaaccgcgaaaaactcgaccgaaaattccgcgtctccatccgaccgaataaaatcgaacgccgaacgatcg

SEQ ID NO: 38107 - DNA, 566 bp, Artificial Sequence
  chemically treated genomic DNA (Homo sapiens) CpG-island No: 38107
attaaaattataataaggttgtaggttttattttagttattcgaaagttttaggcgttgtcgatatcgttatttaagggttgtggattagttcgttcgcggttcgtaggtcgggtcgtcgcgtttcgtttcgttacggtcgggttcgcgcgtagtttatttgttagttgcgttgggggcgtacgcgtttgttttattgttatgttatttattcggttagagttcgttttcggggttttgttcgttcgttcggttttttttatttcgggggtcgttgatttaacgttttcggtttcgtttcggtttttttcggttcgcggttttttttgggtcgtattttttgcggcgcgttttcggatttttagttatttttagcgttcgtcgttcgtttttcgtgcgtgcgtttttttcgtcgcggttcgtaagcggcgttcgcgtatcgcgtcgttttttttttaagtttaggttttttcgcgcgtgcgtacggtagaggtattggtcgcgagaggttcggtcgggagtttcgcgtttttattcggtcgggtagaatcgagcgtcgagcgatcg

SEQ ID NO: 38108 - DNA, 566 bp, Artificial Sequence
  chemically treated genomic DNA (Homo sapiens) CpG-island No: 38108
cgatcgctcgacgctcgattctacccgaccgaataaaaacgcgaaactcccgaccgaacctctcgcgaccaatacctctaccgtacgcacgcgcgaaaaaacctaaacttaaaaaaaaaacgacgcgatacgcgaacgccgcttacgaaccgcgacgaaaaaaacgcacgcacgaaaaacgaacgacgaacgctaaaaataactaaaaatccgaaaacgcgccgcaaaaaatacgacccaaaaaaaaccgcgaaccgaaaaaaaccgaaacgaaaccgaaaacgttaaatcaacgacccccgaaataaaaaaaaccgaacgaacgaacaaaaccccgaaaacgaactctaaccgaataaataacataacaataaaacaaacgcgtacgcccccaacgcaactaacaaataaactacgcgcgaacccgaccgtaacgaaacgaaacgcgacgacccgacctacgaaccgcgaacgaactaatccacaacccttaaataacgatatcgacaacgcctaaaactttcgaataactaaaataaaacctacaaccttattataattttaat

SEQ ID NO: 38109 - DNA, 635 bp, Artificial Sequence
  chemically treated genomic DNA (Homo sapiens) CpG-island No: 38109
  misc_feature (346)..(346): n is either a, c, g or t
  misc_feature (398)..(398): n is either a, c, g or t
  misc_feature (410)..(410): n is either a, c, g or t
  misc_feature (451)..(451): n is either a, c, g or t
  misc_feature (472)..(472): n is either a, c, g or t
  misc_feature (492)..(492): n is either a, c, g or t
  misc_feature (509)..(509): n is either a, c, g or t
  misc_feature (532)..(532): n is either a, c, g or t
  misc_feature (567)..(567): n is either a, c, g or t
cggtcgcgtagtcgggcggcgattattcgtttttcggtcgttgattttagcgtttcggtttcgtcgtagtttttggtttttcggcgttcgtttttttattcgttatttggttttcgtcgtcgtcgttcgggaagttttcggtattttttagaatagagagtagttgttaacgttaggttgtcgtttgtcgcggggtttcggatacgcggggtttgggcggagaggacgtgatttcgcgttggtttttcgtttttttttttcggtcgggaaattgaggttcgggatcgggaattattttttcgcgagtacggttcgcgagggttcggttaatttcggttttagcgtntcgattttcgcgcgcgatttttcgattatacgcgttcgtcggttattttaanaagcgtggcggngaagcggttttaaagcgagcgtacggtttcggaacgcgtanggcgttagttttcggttaatngttttgcgaaaagtgtgttnttagtttgggtttgttntaatttcgggatatatttttcgnttgttttgtagtacgtattaatatcggttattttngtaatattttttcgcgttatgaggttttttttttaaaatttcgggttttcggtttttgggtaaaaaaa

SEQ ID NO: 38110 - DNA, 635 bp, Artificial Sequence
  chemically treated genomic DNA (Homo sapiens) CpG-island No: 38110
  misc_feature (69)..(69): n is either a, c, g or t
  misc_feature (104)..(104): n is either a, c, g or t
  misc_feature (127)..(127): n is either a, c, g or t
  misc_feature (144)..(144): n is either a, c, g or t
  misc_feature (164)..(164): n is either a, c, g or t
  misc_feature (185)..(185): n is either a, c, g or t
  misc_feature (226)..(226): n is either a, c, g or t
  misc_feature (238)..(238): n is either a, c, g or t
  misc_feature (290)..(290): n is either a, c, g or t
tttttttacccaaaaaccgaaaacccgaaattttaaaaaaaaaacctcataacgcgaaaaaatattacnaaaataaccgatattaatacgtactacaaaacaancgaaaaatatatcccgaaattanaacaaacccaaactaanaacacacttttcgcaaaacnattaaccgaaaactaacgccntacgcgttccgaaaccgtacgctcgctttaaaaccgcttcnccgccacgcttnttaaaataaccgacgaacgcgtataatcgaaaaatcgcgcgcgaaaatcganacgctaaaaccgaaattaaccgaaccctcgcgaaccgtactcgcgaaaaaataattcccgatcccgaacctcaatttcccgaccgaaaaaaaaaaacgaaaaaccaacgcgaaatcacgtcctctccgcccaaaccccgcgtatccgaaaccccgcgacaaacgacaacctaacgttaacaactactctctattctaaaaaataccgaaaacttcccgaacgacgacgacgaaaaccaaataacgaataaaaaaacgaacgccgaaaaaccaaaaactacgacgaaaccgaaacgctaaaatcaacgaccgaaaaacgaataatcgccgcccgactacgcgaccg

SEQ ID NO: 38111 - DNA, 635 bp, Artificial Sequence
  chemically treated genomic DNA (Homo sapiens) CpG-island No: 38111
  misc_feature (69)..(69): n is either a, c, g or t
  misc_feature (104)..(104): n is either a, c, g or t
  misc_feature (127)..(127): n is either a, c, g or t
  misc_feature (144)..(144): n is either a, c, g or t
  misc_feature (164)..(164): n is either a, c, g or t
  misc_feature (185)..(185): n is either a, c, g or t
  misc_feature (226)..(226): n is either a, c, g or t
  misc_feature (238)..(238): n is either a, c, g or t
  misc_feature (290)..(290): n is either a, c, g or t
tttttttatttaagggtcggaaattcggggttttgaaggaaaggttttataacgcggaaaggtgttgtnaaagtgatcgatgttagtgcgtgttgtagggtaancggaaagtgtgtttcgaggttanagtaggtttaggttggnagtatatttttcgtaaagtnattggtcgggggttggcgttntgcgcgtttcggggtcgtgcgttcgttttgagatcgttttntcgttacgtttnttgaggtgatcgacgggcgcgtgtggtcgaaggatcgcgcgcgggagtcggnacgttaggatcggggttggtcgggttttcgcggatcgtgttcgcggggaagtggttttcggtttcgggttttagtttttcgatcggggagggaaggcggaaggttagcgcggagttacgtttttttcgtttagatttcgcgtgttcggaatttcgcggtaggcggtagtttgacgttggtagttgttttttattttgggaagtgtcgagggtttttcgggcggcggcggcgaaagttaggtggcgggtggggaaacgaacgtcgaggggttagggattgcggcgaggtcggagcgttggggttagcggtcgggggacggatggtcgtcgttcggttgcgcggtcg

SEQ ID NO: 38112 - DNA, 635 bp, Artificial Sequence
  chemically treated genomic DNA (Homo sapiens) CpG-island No: 38112
  misc_feature (346)..(346): n is either a, c, g or t
  misc_feature (398)..(398): n is either a, c, g or t
  misc_feature (410)..(410): n is either a, c, g or t
  misc_feature (451)..(451): n is either a, c, g or t
  misc_feature (472)..(472): n is either a, c, g or t
  misc_feature (492)..(492): n is either a, c, g or t
  misc_feature (509)..(509): n is either a, c, g or t
  misc_feature (532)..(532): n is either a, c, g or t
  misc_feature (567)..(567): n is either a, c, g or t
cgaccgcgcaaccgaacgacgaccatccgtcccccgaccgctaaccccaacgctccgacctcgccgcaatccctaacccctcgacgttcgtttccccacccgccacctaactttcgccgccgccgcccgaaaaaccctcgacacttcccaaaataaaaaacaactaccaacgtcaaactaccgcctaccgcgaaattccgaacacgcgaaatctaaacgaaaaaaacgtaactccgcgctaaccttccgccttccctccccgatcgaaaaactaaaacccgaaaccgaaaaccacttccccgcgaacacgatccgcgaaaacccgaccaaccccgatcctaacgtnccgactcccgcgcgcgatccttcgaccacacgcgcccgtcgatcacctcaanaaacgtaacganaaaacgatctcaaaacgaacgcacgaccccgaaacgcgcanaacgccaacccccgaccaatnactttacgaaaaatatactnccaacctaaacctactntaacctcgaaacacactttccgnttaccctacaacacgcactaacatcgatcactttnacaacacctttccgcgttataaaacctttccttcaaaaccccgaatttccgacccttaaataaaaaaa

SEQ ID NO: 38113 - DNA, 597 bp, Artificial Sequence
  chemically treated genomic DNA (Homo sapiens) CpG-island No: 38113
ttttttttcggggtaggttttcgggtttcgagcgttttaggttggcgcgtagtatatttcggttttatgtattcgtcgttcgcggttttgttaatgtttgttttttttggggtgattaggattttttaattttttttcgcgttgaaagtttggtcgtaaagatcgtattttcggggcgggttgagacgtagagaagtcggggcgtttttttgtcggttcgtcgggagttttcgggttcgtagtaggttgaggatacggcgggattcgttgtatttggttagggaggggcggggcgggcgcgttagtgtagttgggggaggtttcgtttcggttttattttttcggtcgttcggtggggaaattcgggagttatttcgcggcgcggttgcggttttgtttcggcgcgataggtaagcggtagaaggagttcgcgatttttttttcgggagggtttttttgagtttttcgattgttcggattttttttcggcggatttcgtttttgtcgagttttcgtttttattttttttttcgttagttttcgtttttttttttttttttttattattttcgatagtaaaatgaaggggttgggtta

SEQ ID NO: 38114 - DNA, 597 bp, Artificial Sequence
  chemically treated genomic DNA (Homo sapiens) CpG-island No: 38114
taacccaaccccttcattttactatcgaaaataataaaaaaaaaaaaaaaaaaacgaaaactaacgaaaaaaaaaataaaaacgaaaactcgacaaaaacgaaatccgccgaaaaaaaatccgaacaatcgaaaaactcaaaaaaaccctcccgaaaaaaaaatcgcgaactccttctaccgcttacctatcgcgccgaaacaaaaccgcaaccgcgccgcgaaataactcccgaatttccccaccgaacgaccgaaaaaataaaaccgaaacgaaacctcccccaactacactaacgcgcccgccccgcccctccctaaccaaatacaacgaatcccgccgtatcctcaacctactacgaacccgaaaactcccgacgaaccgacaaaaaaacgccccgacttctctacgtctcaacccgccccgaaaatacgatctttacgaccaaactttcaacgcgaaaaaaaattaaaaaatcctaatcaccccaaaaaaaacaaacattaacaaaaccgcgaacgacgaatacataaaaccgaaatatactacgcgccaacctaaaacgctcgaaacccgaaaacctaccccgaaaaaaaa

SEQ ID NO: 38115 - DNA, 597 bp, Artificial Sequence
  chemically treated genomic DNA (Homo sapiens) CpG-island No: 38115
tggtttagtttttttattttattgtcgggggtagtgaggaggaagaggaagaggcgaaggttggcggaggaggaggtgagagcgaggattcggtagaagcgagattcgtcgaagggaagttcgagtagtcggggagtttaggggggttttttcggggagagggtcgcgggttttttttgtcgtttatttgtcgcgtcgaggtaaagtcgtagtcgcgtcgcggggtggttttcgggtttttttatcggacggtcgggagggtgggatcggggcgggattttttttagttgtattaacgcgttcgtttcgtttttttttggttaggtgtagcgggtttcgtcgtgtttttagtttgttgcgggttcgggaattttcggcggatcggtagaggggcgtttcggtttttttgcgttttagttcgtttcgggggtgcggtttttgcggttaggtttttagcgcggaaaaagattggagggttttagttattttaaagaggataggtattagtagagtcgcgggcggcgggtgtatggaatcggaatgtgttgcgcgttagtttggagcgttcggagttcggaggtttgtttcggaggggga

SEQ ID NO: 38116 - DNA, 597 bp, Artificial Sequence
  chemically treated genomic DNA (Homo sapiens) CpG-island No: 38116
tccccctccgaaacaaacctccgaactccgaacgctccaaactaacgcgcaacacattccgattccatacacccgccgcccgcgactctactaatacctatcctctttaaaataactaaaaccctccaatctttttccgcgctaaaaacctaaccgcaaaaaccgcacccccgaaacgaactaaaacgcaaaaaaaccgaaacgcccctctaccgatccgccgaaaattcccgaacccgcaacaaactaaaaacacgacgaaacccgctacacctaaccaaaaaaaaacgaaacgaacgcgttaatacaactaaaaaaaatcccgccccgatcccaccctcccgaccgtccgataaaaaaacccgaaaaccaccccgcgacgcgactacgactttacctcgacgcgacaaataaacgacaaaaaaaacccgcgaccctctccccgaaaaaacccccctaaactccccgactactcgaacttcccttcgacgaatctcgcttctaccgaatcctcgctctcacctcctcctccgccaaccttcgcctcttcctcttcctcctcactacccccgacaataaaataaaaaaactaaacca

SEQ ID NO: 38117 - DNA, 718 bp, Artificial Sequence
  chemically treated genomic DNA (Homo sapiens) CpG-island No: 38117
cgtagtagtcgggtcgggatcgggaggcgacggtcgtgggtcgttttttggttcgtttcggacgttgggacgtcggattggtcgtttttttcgggtttgttttcgtcgtttagggcgcggttcgcgtatagtttgttaagttttattgggttttagttcgcgtttcgcgtttcggagattttcgacgtttttgcgaacgcggggtggacgcgacgggttgggttggttttcgtttcgcggtttcgttttcgttttcgttttcgtttcgagtttttcgcgttattagtattcgcggagcgttgcgttgggggcggtcggtgcgtcggggagcggcgtttttagtcgtcgcgattttttgttttagcggagcgttgagtttcggtcgtttcgggtttcggtttttgttacggtcgaggtggttgcggcgaatgtgggcgatcggtttttcggcgttttcgttttttttttcgtgtttatttttttagtcggacgggttgttggtgaagggtcggcgtcgtttcgcgcgtttttttgaatttaacgggggcgggtatcgcggagtcgcggaggttagtagaggtcgaacgaggatttcgagcggaggaagtcgcgggtggcgcgcggggttggcgtagaggtcggagggggtggggggtaggtcgacggggtgggataggaaaagcggagagaaatcgttttttgtaggtttttttggttt

SEQ ID NO: 38118 - DNA, 718 bp, Artificial Sequence
  chemically treated genomic DNA (Homo sapiens) CpG-island No: 38118
aaaccaaaaaaacctacaaaaaacgatttctctccgcttttcctatcccaccccgtcgacctaccccccaccccctccgacctctacgccaaccccgcgcgccacccgcgacttcctccgctcgaaatcctcgttcgacctctactaacctccgcgactccgcgatacccgcccccgttaaattcaaaaaaacgcgcgaaacgacgccgacccttcaccaacaacccgtccgactaaaaaaataaacacgaaaaaaaaaacgaaaacgccgaaaaaccgatcgcccacattcgccgcaaccacctcgaccgtaacaaaaaccgaaacccgaaacgaccgaaactcaacgctccgctaaaacaaaaaatcgcgacgactaaaaacgccgctccccgacgcaccgaccgcccccaacgcaacgctccgcgaatactaataacgcgaaaaactcgaaacgaaaacgaaaacgaaaacgaaaccgcgaaacgaaaaccaacccaacccgtcgcgtccaccccgcgttcgcaaaaacgtcgaaaatctccgaaacgcgaaacgcgaactaaaacccaataaaacttaacaaactatacgcgaaccgcgccctaaacgacgaaaacaaacccgaaaaaaacgaccaatccgacgtcccaacgtccgaaacgaaccaaaaaacgacccacgaccgtcgcctcccgatcccgacccgactactacg

SEQ ID NO: 38119 - DNA, 718 bp, Artificial Sequence
  chemically treated genomic DNA (Homo sapiens) CpG-island No: 38119
gagttaaggggatttgtagagggcggttttttttcgttttttttgttttatttcgtcggtttgttttttatttttttcggtttttgcgttaatttcgcgcgttattcgcggtttttttcgttcggggttttcgttcggtttttgttggttttcgcgatttcgcggtgttcgttttcgttgagtttaaaaggacgcgcggagcggcgtcggttttttattagtagttcgttcgattggaaaggtgagtacgagggaaggggcgggggcgtcggagagtcggtcgtttatattcgtcgtagttatttcggtcgtggtaggaatcgaaattcggagcggtcgaagtttagcgtttcgttggggtagagggtcgcggcggttgggaacgtcgtttttcgacgtatcggtcgtttttagcgtagcgtttcgcgggtgttggtaacgcggggggttcggggcgggggcggggacgggggcggggtcgcggggcgaggattaatttagttcgtcgcgtttatttcgcgttcgtaggggcgtcgaggattttcggggcgcggggcgcgggttggggtttagtgaggtttggtaggttgtgcgcggatcgcgttttggacggcgaaagtaggttcggagggggcggttagttcggcgttttagcgttcgaggcgagttagaaggcggtttacggtcgtcgtttttcggtttcggttcggttattgcg

SEQ ID NO: 38120 - DNA, 718 bp, Artificial Sequence
  chemically treated genomic DNA (Homo sapiens) CpG-island No: 38120
cgcaataaccgaaccgaaaccgaaaaacgacgaccgtaaaccgccttctaactcgcctcgaacgctaaaacgccgaactaaccgccccctccgaacctactttcgccgtccaaaacgcgatccgcgcacaacctaccaaacctcactaaaccccaacccgcgccccgcgccccgaaaatcctcgacgcccctacgaacgcgaaataaacgcgacgaactaaattaatcctcgccccgcgaccccgcccccgtccccgcccccgccccgaaccccccgcgttaccaacacccgcgaaacgctacgctaaaaacgaccgatacgtcgaaaaacgacgttcccaaccgccgcgaccctctaccccaacgaaacgctaaacttcgaccgctccgaatttcgattcctaccacgaccgaaataactacgacgaatataaacgaccgactctccgacgcccccgccccttccctcgtactcacctttccaatcgaacgaactactaataaaaaaccgacgccgctccgcgcgtccttttaaactcaacgaaaacgaacaccgcgaaatcgcgaaaaccaacaaaaaccgaacgaaaaccccgaacgaaaaaaaccgcgaataacgcgcgaaattaacgcaaaaaccgaaaaaaataaaaaacaaaccgacgaaataaaacaaaaaaaacgaaaaaaaaccgccctctacaaatccccttaactc

SEQ ID NO: 38121 - DNA, 543 bp, Artificial Sequence
  chemically treated genomic DNA (Homo sapiens) CpG-island No: 38121
ggcgtatcgttattcgcgcggcgtttattgtttttacggtattaatggtattacgtttaatgtacgggatttgtatttgttcggtaatcggatcgtaggttagttttaagttatgtttatcgcgattttttcggattggattttgcgtcggatgtcgttagtatttcgttaatcgtcgtcgtattttagtcggtatttttgacgtatcgagttacggttgtttatcggtttgtcgttattaaaattagcgtgtttttcggatttatatcgcgaatattaatttgtcggttatttttacgttgattattggtggagttatcggttaggttaacgtttggtatggtacggatgattttcgatatatcgcgggtaatcgggtttttgcggattttatttgcggtgatggtcgaaacgttaggcgtttgtaagttttgttcggcggcggtaacgataatagtatcgttatgtgaaataggagtatcggtcggtttttgtgtttgcgttattttataaatttttagattgattaataaggttagggaa

SEQ ID NO: 38122 - DNA, 543 bp, Artificial Sequence
  chemically treated genomic DNA (Homo sapiens) CpG-island No: 38122
ttccctaaccttattaatcaatctaaaaatttataaaataacgcaaacacaaaaaccgaccgatactcctatttcacataacgatactattatcgttaccgccgccgaacaaaacttacaaacgcctaacgtttcgaccatcaccgcaaataaaatccgcaaaaacccgattacccgcgatatatcgaaaatcatccgtaccataccaaacgttaacctaaccgataactccaccaataatcaacgtaaaaataaccgacaaattaatattcgcgatataaatccgaaaaacacgctaattttaataacgacaaaccgataaacaaccgtaactcgatacgtcaaaaataccgactaaaatacgacgacgattaacgaaatactaacgacatccgacgcaaaatccaatccgaaaaaatcgcgataaacataacttaaaactaacctacgatccgattaccgaacaaatacaaatcccgtacattaaacgtaataccattaataccgtaaaaacaataaacgccgcgcgaataacgatacgcc

SEQ ID NO: 38123 - DNA, 543 bp, Artificial Sequence
  chemically treated genomic DNA (Homo sapiens) CpG-island No: 38123
ttttttggttttgttggttaatttggggatttatggggtagcgtaggtataagagtcgatcgatatttttgttttatatgacgatattattgtcgttatcgtcgtcgagtagaatttataggcgtttggcgtttcgattattatcgtagatgaaattcgtaaaaattcggttgttcgcgatgtgtcgaagattattcgtattatgttaggcgttaatttgatcggtaattttattagtggttagcgtgggaataatcgatagattgatattcgcggtatgggttcggaaaatacgttgattttgatgacggtaagtcggtaagtagtcgtaattcggtacgttaggggtatcgattggaatgcggcgacggttaacggaatattggcgatattcggcgtaggatttaattcggggaaatcgcgatggatataatttggggttgatttgcgattcggttgtcgagtaggtataaatttcgtgtattgaacgtaatgttattaatgtcgtgaaagtagtaaacgtcgcgcggatggcgatgcgtt

SEQ ID NO: 38124 - DNA, 543 bp, Artificial Sequence
  chemically treated genomic DNA (Homo sapiens) CpG-island No: 38124
aacgcatcgccatccgcgcgacgtttactactttcacgacattaataacattacgttcaatacacgaaatttatacctactcgacaaccgaatcgcaaatcaaccccaaattatatccatcgcgatttccccgaattaaatcctacgccgaatatcgccaatattccgttaaccgtcgccgcattccaatcgatacccctaacgtaccgaattacgactacttaccgacttaccgtcatcaaaatcaacgtattttccgaacccataccgcgaatatcaatctatcgattattcccacgctaaccactaataaaattaccgatcaaattaacgcctaacataatacgaataatcttcgacacatcgcgaacaaccgaatttttacgaatttcatctacgataataatcgaaacgccaaacgcctataaattctactcgacgacgataacgacaataatatcgtcatataaaacaaaaatatcgatcgactcttatacctacgctaccccataaatccccaaattaaccaacaaaaccaaaaaa

SEQ ID NO: 38125 - DNA, 508 bp, Artificial Sequence
  chemically treated genomic DNA (Homo sapiens) CpG-island No: 38125
tgagggcgaattttttgatgtgaaatatcgtttttttcgtaagttttgttagtattgcgattatgcgtcgtgcgttgacgtttgttcgatcggtgcgttttttcgcgatgttgttagtgggattgtcgatgttaattcggatttttgcgtcggttgttagtattgtatcgtcgtttgttcgtatcgcgtgcgttttatttattcggttacgaagacggcggataaatgcgatttttgtcgtaagattaatttgtaggtcggtaagttgttcgcgtgcgttgaagtttgttcgattaaggcgttgacgtttggtaatttggacgattttaatagtgagatttcgtaattgttgcgttagaagtttatttatcgttataagttggcgttgggaattaaatcgaagttgtatcgcgtatcgtttaaatacggggaggtgagttaatgacgtagattttcgtattttattttgaatcgttggtgtgggattggtcgattgttatttatttgt

SEQ ID NO: 38126 - DNA, 508 bp, Artificial Sequence
  chemically treated genomic DNA (Homo sapiens) CpG-island No: 38126
acaaataaataacaatcgaccaatcccacaccaacgattcaaaataaaatacgaaaatctacgtcattaactcacctccccgtatttaaacgatacgcgatacaacttcgatttaattcccaacgccaacttataacgataaataaacttctaacgcaacaattacgaaatctcactattaaaatcgtccaaattaccaaacgtcaacgccttaatcgaacaaacttcaacgcacgcgaacaacttaccgacctacaaattaatcttacgacaaaaatcgcatttatccgccgtcttcgtaaccgaataaataaaacgcacgcgatacgaacaaacgacgatacaatactaacaaccgacgcaaaaatccgaattaacatcgacaatcccactaacaacatcgcgaaaaaacgcaccgatcgaacaaacgtcaacgcacgacgcataatcgcaatactaacaaaacttacgaaaaaaacgatatttcacatcaaaaaattcgccctca

SEQ ID NO: 38127 - DNA, 508 bp, Artificial Sequence
  chemically treated genomic DNA (Homo sapiens) CpG-island No: 38127
ataggtagatggtaatcggttagttttatattagcgatttaaaatgaaatgcggaagtttgcgttattggtttattttttcgtatttaaacggtacgcggtatagtttcggtttggtttttagcgttagtttgtagcggtaagtgggtttttggcgtagtagttgcgaaattttattgttgggatcgtttagattgttaaacgttagcgttttggtcgggtaagttttaacgtacgcgggtaatttatcggtttgtaaattggttttacggtagaaatcgtatttgttcgtcgttttcgtgatcggatggataaagcgtacgcggtacggataggcggcgatgtagtattgataatcgacgtagagattcggattaatatcgataattttattggtagtatcgcgaaaagacgtatcggtcgggtagacgttaacgtacggcgtatgatcgtagtgttggtaagatttacggaagaagcgatattttatattaggaaattcgttttta

SEQ ID NO: 38128 - DNA, 508 bp, Artificial Sequence
  chemically treated genomic DNA (Homo sapiens) CpG-island No: 38128
taaaaacgaatttcctaatataaaatatcgcttcttccgtaaatcttaccaacactacgatcatacgccgtacgttaacgtctacccgaccgatacgtcttttcgcgatactaccaataaaattatcgatattaatccgaatctctacgtcgattatcaatactacatcgccgcctatccgtaccgcgtacgctttatccatccgatcacgaaaacgacgaacaaatacgatttctaccgtaaaaccaatttacaaaccgataaattacccgcgtacgttaaaacttacccgaccaaaacgctaacgtttaacaatctaaacgatcccaacaataaaatttcgcaactactacgccaaaaacccacttaccgctacaaactaacgctaaaaaccaaaccgaaactataccgcgtaccgtttaaatacgaaaaaataaaccaataacgcaaacttccgcatttcattttaaatcgctaatataaaactaaccgattaccatctacctat

SEQ ID NO: 38129 - DNA, 702 bp, Artificial Sequence
  chemically treated genomic DNA (Homo sapiens) CpG-island No: 38129
ggagtcgaagttcgcgttggggttgggttttggtcggatcgtaggttgggcggtttttgatttttcgcgtttttcgtttatagtcggagttcggtagttggaagtattcgttatttcggggagcgtttttaggtcgcggttttcggttttcgtcgagcgaggcgggcgggaaggtagggtcgcggtggagcgggtacggtttttcgttttagttcggagttttttcgtttcgtcgggtttcgcggtcgttttttttttattcggaaaatcgtggggaggcgcggcgtagcggtcggatttttggttttcgcgtcgggttgcgttacgtggtagtttttagcgttttttcgtttcggtttcgtatgttgtcgggggagcgtttcgttttatttaggtcgaaattttaggaaggaaattattttgggttggggacgcggtttttttgttcgcggttgttgggtgatgtgttcgaggtttttttgttttttttcgggcgtaggtcgtttattcgcgtcgtcgtttttgagggtcgttgggcgtagaatcgtttcggtcgcggttcggttttaggcgcggtttcgcgtatttttgcgttcgttatagtcggcgggaggcggggaagggagtagttcgggtggtttggagaatattgaatttttaattgggttataaattagataggggagtgcggtggagtttatg

SEQ ID NO: 38130 - DNA, 702 bp, Artificial Sequence
  chemically treated genomic DNA (Homo sapiens) CpG-island No: 38130
cataaactccaccgcactcccctatctaatttataacccaattaaaaattcaatattctccaaaccacccgaactactcccttccccgcctcccgccgactataacgaacgcaaaaatacgcgaaaccgcgcctaaaaccgaaccgcgaccgaaacgattctacgcccaacgaccctcaaaaacgacgacgcgaataaacgacctacgcccgaaaaaaaacaaaaaaacctcgaacacatcacccaacaaccgcgaacaaaaaaaccgcgtccccaacccaaaataatttccttcctaaaatttcgacctaaataaaacgaaacgctcccccgacaacatacgaaaccgaaacgaaaaaacgctaaaaactaccacgtaacgcaacccgacgcgaaaaccaaaaatccgaccgctacgccgcgcctccccacgattttccgaataaaaaaaaaacgaccgcgaaacccgacgaaacgaaaaaactccgaactaaaacgaaaaaccgtacccgctccaccgcgaccctaccttcccgcccgcctcgctcgacgaaaaccgaaaaccgcgacctaaaaacgctccccgaaataacgaatacttccaactaccgaactccgactataaacgaaaaacgcgaaaaatcaaaaaccgcccaacctacgatccgaccaaaacccaaccccaacgcgaacttcgactcc

SEQ ID NO: 38131 - DNA, 702 bp, Artificial Sequence
  chemically treated genomic DNA (Homo sapiens) CpG-island No: 38131
tataaattttatcgtatttttttgtttgatttatagtttaattaaaggtttagtgttttttaagttattcgggttgttttttttttcgtttttcgtcggttgtggcgagcgtaggaatgcgcgaggtcgcgtttaaggtcgggtcgcggtcgaggcggttttgcgtttagcgatttttaggagcggcggcgcgaatgaacggtttgcgttcggagaagggtagagaaatttcgggtatattatttaatagtcgcgagtagaaaggtcgcgtttttagtttagagtgattttttttttggggtttcggtttgagtgggacgaggcgttttttcgatagtatgcgaggtcgggacgggagggcgttgggagttgttacgtggcgtagttcgacgcggaggttaggggttcggtcgttacgtcgcgtttttttacgatttttcgggtgaggaaggggcggtcgcggggttcggcggggcggagaggtttcgggttggggcgggaggtcgtgttcgttttatcgcggttttattttttcgttcgtttcgttcggcgaaggtcggagatcgcggtttggagacgtttttcggggtagcgggtgtttttagttgtcgggtttcggttgtgggcgggaggcgcggggggttaaagatcgtttagtttgcgattcggttagagtttagttttagcgcgggtttcggtttt

SEQ ID NO: 38132 - DNA, 702 bp, Artificial Sequence
  chemically treated genomic DNA (Homo sapiens) CpG-island No: 38132
aaaaccgaaacccgcgctaaaactaaactctaaccgaatcgcaaactaaacgatctttaaccccccgcgcctcccgcccacaaccgaaacccgacaactaaaaacacccgctaccccgaaaaacgtctccaaaccgcgatctccgaccttcgccgaacgaaacgaacgaaaaaataaaaccgcgataaaacgaacacgacctcccgccccaacccgaaacctctccgccccgccgaaccccgcgaccgccccttcctcacccgaaaaatcgtaaaaaaacgcgacgtaacgaccgaacccctaacctccgcgtcgaactacgccacgtaacaactcccaacgccctcccgtcccgacctcgcatactatcgaaaaaacgcctcgtcccactcaaaccgaaaccccaaaaaaaaaatcactctaaactaaaaacgcgacctttctactcgcgactattaaataatatacccgaaatttctctacccttctccgaacgcaaaccgttcattcgcgccgccgctcctaaaaatcgctaaacgcaaaaccgcctcgaccgcgacccgaccttaaacgcgacctcgcgcattcctacgctcgccacaaccgacgaaaaacgaaaaaaaaaacaacccgaataacttaaaaaacactaaacctttaattaaactataaatcaaacaaaaaaatacgataaaatttata

SEQ ID NO: 38133 - DNA, 526 bp, Artificial Sequence
  chemically treated genomic DNA (Homo sapiens) CpG-island No: 38133
gtcgggtcggcgcgggagcggtcgggcgtagttgattacgggtatagataggttaatttttatatggagttgtagaaattttattcgcgggttgcgaagcgtgggttagttaaggtatgttaatttgtttagtatgtgcgtcgcgcggaggagttagattatcggggcgtaggaggcgcggtcgtagtcggcgtttttttgggggagttaataaagagtttaaggtaggtaagtaagtgtatggaggttgcgagcggttttttgcgggcggttcgggggagggcgaggttcggttgtttgcgttcgcgtttttaggttttcggaatcgcgcgttttcgaggtcgagcgagtttcgtcgcgtcgagtttttcgggcgttcgtaggtttggcgtatatcgaagcggggggcgtagtattgttttttcgtttttcggagtcgagttttttcgcgttcgtatcgtgaaaggaggggagcgaggggttagttatttcgaatatttttaattaattaaaatatttgttgatg

SEQ ID NO: 38134 - DNA, 526 bp, Artificial Sequence
  chemically treated genomic DNA (Homo sapiens) CpG-island No: 38134
catcaacaaatattttaattaattaaaaatattcgaaataactaacccctcgctcccctcctttcacgatacgaacgcgaaaaaactcgactccgaaaaacgaaaaaacaatactacgccccccgcttcgatatacgccaaacctacgaacgcccgaaaaactcgacgcgacgaaactcgctcgacctcgaaaacgcgcgattccgaaaacctaaaaacgcgaacgcaaacaaccgaacctcgccctcccccgaaccgcccgcaaaaaaccgctcgcaacctccatacacttacttacctaccttaaactctttattaactcccccaaaaaaacgccgactacgaccgcgcctcctacgccccgataatctaactcctccgcgcgacgcacatactaaacaaattaacataccttaactaacccacgcttcgcaacccgcgaataaaatttctacaactccatataaaaattaacctatctatacccgtaatcaactacgcccgaccgctcccgcgccgacccgac

SEQ ID NO: 38135 - DNA, 526 bp, Artificial Sequence
  chemically treated genomic DNA (Homo sapiens) CpG-island No: 38135
tattagtaaatattttgattagttaaaaatgttcgagatggttaatttttcgtttttttttttttacggtgcgaacgcgaagaggttcggtttcggggggcgggagagtagtattgcgtttttcgtttcggtgtgcgttaggtttgcggacgttcgggaggttcggcgcggcggggttcgttcggtttcgagggcgcgcggtttcgagggtttgggaacgcgagcgtaggtagtcgggtttcgttttttttcgggtcgttcgtaagaagtcgttcgtagtttttatatatttatttgtttgttttaagttttttattaatttttttagaggagcgtcggttgcggtcgcgttttttgcgtttcggtggtttggttttttcgcgcggcgtatatgttaaatagattaatatgttttggttgatttacgtttcgtaattcgcggatagggtttttgtagttttatgtggaaattaatttatttgtattcgtggttagttgcgttcggtcgttttcgcgtcggttcggt

SEQ ID NO: 38136 - DNA, 526 bp, Artificial Sequence
  chemically treated genomic DNA (Homo sapiens) CpG-island No: 38136
accgaaccgacgcgaaaacgaccgaacgcaactaaccacgaatacaaataaattaatttccacataaaactacaaaaaccctatccgcgaattacgaaacgtaaatcaaccaaaacatattaatctatttaacatatacgccgcgcgaaaaaaccaaaccaccgaaacgcaaaaaacgcgaccgcaaccgacgctcctctaaaaaaattaataaaaaacttaaaacaaacaaataaatatataaaaactacgaacgacttcttacgaacgacccgaaaaaaaacgaaacccgactacctacgctcgcgttcccaaaccctcgaaaccgcgcgccctcgaaaccgaacgaaccccgccgcgccgaacctcccgaacgtccgcaaacctaacgcacaccgaaacgaaaaacgcaatactactctcccgccccccgaaaccgaacctcttcgcgttcgcaccgtaaaaaaaaaaaaacgaaaaattaaccatctcgaacatttttaactaatcaaaatatttactaata

SEQ ID NO: 38137 - DNA, 523 bp, Artificial Sequence
  chemically treated genomic DNA (Homo sapiens) CpG-island No: 38137
ttcgtcgcgaggtggaggttgagatagcgtcgtttcgtttttagggtagtcgtttttggttcgatttcgttttcgagagttagtttgagcgggtgcgtttgttcgtcgtatcgtttttttttttttttttgttttgtttttttttgtttcgtttttttagggaatttttcgttttcgttttcgtttttttattacgtcgtcgtttagagtttttttgtattttgtcggagcgaataaggggtcgcgcgggggattagggttggtgtttaaggggtttcgggtggattatttgagattaggcgtatatacgcggggacgtaagatggtagttaaagggaggtcggaagtgatataaggttattttttttaagagttaggaaattgatttcgtcgcgaattcggtttttttttgcgtacgcgcgatagcgtttgtgatggtttagcgagtttttatttttttttttttgttttagcggttgtcggttgtaggttttacgagagattgttggtttggggcgtagtt

SEQ ID NO: 38138 - DNA, 523 bp, Artificial Sequence
  chemically treated genomic DNA (Homo sapiens) CpG-island No: 38138
aactacgccccaaaccaacaatctctcgtaaaacctacaaccgacaaccgctaaaacaaaaaaaaaaaaataaaaactcgctaaaccatcacaaacgctatcgcgcgtacgcaaaaaaaaaccgaattcgcgacgaaatcaatttcctaactcttaaaaaaaataaccttatatcacttccgacctccctttaactaccatcttacgtccccgcgtatatacgcctaatctcaaataatccacccgaaaccccttaaacaccaaccctaatcccccgcgcgaccccttattcgctccgacaaaatacaaaaaaactctaaacgacgacgtaataaaaaaacgaaaacgaaaacgaaaaattccctaaaaaaacgaaacaaaaaaaaacaaaacaaaaaaaaaaaaaaaaacgatacgacgaacaaacgcacccgctcaaactaactctcgaaaacgaaatcgaaccaaaaacgactaccctaaaaacgaaacgacgctatctcaacctccacctcgcgacgaa

SEQ ID NO: 38139 - DNA, 523 bp, Artificial Sequence
  chemically treated genomic DNA (Homo sapiens) CpG-island No: 38139
ggttgcgttttaagttagtagtttttcgtagggtttatagtcggtagtcgttggagtaggaggaggagaatagggattcgttggattattataaacgttgtcgcgcgtgcgtagggaggaatcgagttcgcggcgaagttagttttttgatttttgaaggaagtggttttgtgttattttcggtttttttttagttgttattttgcgttttcgcgtgtgtgcgtttaattttaggtggtttattcgagattttttgagtattaattttagtttttcgcgcggttttttattcgtttcgataaggtataaaaaggttttggacggcggcgtggtaggaggacgggagcgggggcgggaagttttttgaaggagcgagatagggagggatagggtagaggaggagaggaaggcgatgcgacggataggcgtattcgtttaggttgattttcgggggcgaggtcgagttaggggcggttgttttgggggcgaggcgacgttgttttaatttttatttcgcggcgga

SEQ ID NO: 38140 - DNA, 523 bp, Artificial Sequence
  chemically treated genomic DNA (Homo sapiens) CpG-island No: 38140
tccgccgcgaaataaaaattaaaacaacgtcgcctcgcccccaaaacaaccgcccctaactcgacctcgcccccgaaaatcaacctaaacgaatacgcctatccgtcgcatcgccttcctctcctcctctaccctatccctccctatctcgctccttcaaaaaacttcccgcccccgctcccgtcctcctaccacgccgccgtccaaaacctttttataccttatcgaaacgaataaaaaaccgcgcgaaaaactaaaattaatactcaaaaaatctcgaataaaccacctaaaattaaacgcacacacgcgaaaacgcaaaataacaactaaaaaaaaaccgaaaataacacaaaaccacttccttcaaaaatcaaaaaactaacttcgccgcgaactcgattcctccctacgcacgcgcgacaacgtttataataatccaacgaatccctattctcctcctcctactccaacgactaccgactataaaccctacgaaaaactactaacttaaaacgcaacc

SEQ ID NO: 38141 - DNA, 721 bp, Artificial Sequence
  chemically treated genomic DNA (Homo sapiens) CpG-island No: 38141
cggggagtttttagtaggcggggttagtaggatgttatcgtcgtttttttttttttttagattttttagttcgtttttttcggcgtacgagcgtcgtcgtcgtcgtcgttgcgcggggatagttagtcggggttcgttatcgtcgttttcgtcgtcgtttttttttttttcgtttttttcgttttcgtttttttttattacgtcgatgtttgttttttcggcgaggttagaggtatcggatattttagtgtttagggttatagttgtggcgcggcggcggcggggcggcgtatgggggcgtcgggtttcgggttttttttgcgttttagttcgggtttcgggcggtaggttcggtcggggggcgttacgttgggggcgttgcgattgcggttgtcggagttgcgtcggggttgtcgggtggcggcggagtttcgcgcgtcgattttataatttttgcgtcgtcgcggtagtcgcgcggatgttgcgttttttgggtttcgttcgcgttcggttcgggcggaggatttgatttttttttttcggagtagtttttgtttcgttagttgaggagggggtggcggggttcgggcgggcgaattagaacgttaggcgtttaggaacgtgcgggacgggtgagagtttaagaatagagttcggcgaggttagggttgagtttaggagagggcggatttttttcggtttatagtagaagggggtttgt

SEQ ID NO: 38142 - DNA, 721 bp, Artificial Sequence
  chemically treated genomic DNA (Homo sapiens) CpG-island No: 38142
acaaacccccttctactataaaccgaaaaaaatccgccctctcctaaactcaaccctaacctcgccgaactctattcttaaactctcacccgtcccgcacgttcctaaacgcctaacgttctaattcgcccgcccgaaccccgccaccccctcctcaactaacgaaacaaaaactactccgaaaaaaaaaaatcaaatcctccgcccgaaccgaacgcgaacgaaacccaaaaaacgcaacatccgcgcgactaccgcgacgacgcaaaaattataaaatcgacgcgcgaaactccgccgccacccgacaaccccgacgcaactccgacaaccgcaatcgcaacgcccccaacgtaacgccccccgaccgaacctaccgcccgaaacccgaactaaaacgcaaaaaaaacccgaaacccgacgcccccatacgccgccccgccgccgccgcgccacaactataaccctaaacactaaaatatccgatacctctaacctcgccgaaaaaacaaacatcgacgtaataaaaaaaaacgaaaacgaaaaaaacgaaaaaaaaaaaaacgacgacgaaaacgacgataacgaaccccgactaactatccccgcgcaacgacgacgacgacgacgctcgtacgccgaaaaaaacgaactaaaaaatctaaaaaaaaaaaaaaacgacgataacatcctactaaccccgcctactaaaaactccccg

SEQ ID NO: 38143 - DNA, 721 bp, Artificial Sequence
  chemically treated genomic DNA (Homo sapiens) CpG-island No: 38143
ataggtttttttttgttataagtcgaggaaggttcgtttttttttggatttagttttggtttcgtcgagttttgtttttagatttttattcgtttcgtacgtttttgggcgtttggcgttttgattcgttcgttcgggtttcgttattttttttttagttgacggggtaaaagttgtttcgagaggagaaggttaagtttttcgttcgggtcgggcgcgagcggagtttagggagcgtagtattcgcgcggttatcgcggcggcgtaggagttataaagtcggcgcgcgagatttcgtcgttattcggtagtttcggcgtagtttcggtagtcgtagtcgtagcgtttttagcgtggcgtttttcggtcgggtttgtcgttcgggattcgggttggggcgtagagggagttcggagttcggcgtttttatgcgtcgtttcgtcgtcgtcgcgttatagttatgattttgagtattgagatgttcgatgtttttggtttcgtcgaggaaatagatatcgacgtggtgggggagggcgaggacgaagaagacgaggaagaggaggacgacgacgagggcggcggtggcgggtttcggttggttgttttcgcgtagcggcggcggcggcggcgttcgtacgtcggggaggacgagttggaggatttggaggaggaggaggacgacgatgatattttgttggtttcgtttgttgggggtttttcg

SEQ ID NO: 38144 - DNA, 721 bp, Artificial Sequence
  chemically treated genomic DNA (Homo sapiens) CpG-island No: 38144
cgaaaaacccccaacaaacgaaaccaacaaaatatcatcgtcgtcctcctcctcctccaaatcctccaactcgtcctccccgacgtacgaacgccgccgccgccgccgctacgcgaaaacaaccaaccgaaacccgccaccgccgccctcgtcgtcgtcctcctcttcctcgtcttcttcgtcctcgccctcccccaccacgtcgatatctatttcctcgacgaaaccaaaaacatcgaacatctcaatactcaaaatcataactataacgcgacgacgacgaaacgacgcataaaaacgccgaactccgaactccctctacgccccaacccgaatcccgaacgacaaacccgaccgaaaaacgccacgctaaaaacgctacgactacgactaccgaaactacgccgaaactaccgaataacgacgaaatctcgcgcgccgactttataactcctacgccgccgcgataaccgcgcgaatactacgctccctaaactccgctcgcgcccgacccgaacgaaaaacttaaccttctcctctcgaaacaacttttaccccgtcaactaaaaaaaaaataacgaaacccgaacgaacgaatcaaaacgccaaacgcccaaaaacgtacgaaacgaataaaaatctaaaaacaaaactcgacgaaaccaaaactaaatccaaaaaaaaacgaaccttcctcgacttataacaaaaaaaaacctat

SEQ ID NO: 38145 - DNA, 765 bp, Artificial Sequence
  chemically treated genomic DNA (Homo sapiens) CpG-island No: 38145
ttgcggttcgttatcggatggggtttattttggggtcgtagagcgtaggcggcggaggtgcgacggcggcgaagtttacgaggtttcgtagaaggtggttcgtgtcgtttcggggacgtgtgtgggtttcgtaaggtgttgttaatttttttcgaacgttagcgttttcgataattaaaggcgattgtttcgggtttagatcgttgttcgtcgtttcgtttttggagggtagagtataggttgtggggtttttcgcgcgcgtttcggttcggtttcggggagtcgaatttttttcggatcgcgttttaagtagcgttcgggcgtttttttttttgttcggtcggagtcgcgtttttcgcgtttcgcgtagtttatcgttcgttggttggtttcggacggttgttggcgaggaggtgttgcgggcgtcggcggggcggtggtttcgagttttaaatatttttagtttcgttcggttcgtttttttcgaggcggggcggcgtttttgtttagttagtttttttttcggattaggttgggcgagtttcgcgtcggttagatatttcgagtcgtcgtcgtaggggcgattaggaagttttcgacggggagagcgcgggtattgaggggcgcgattttcgttgttatcgttaggtttcgtggcgttttcgggatttgggttgcggtcgcgtttgtttttcgttttttttagaattatttgagtgaagaattcgttgagaggaatttaattaataggttgttttatttgta

SEQ ID NO: 38146 - DNA, 765 bp, Artificial Sequence
  chemically treated genomic DNA (Homo sapiens) CpG-island No: 38146
tacaaataaaacaacctattaattaaattcctctcaacgaattcttcactcaaataattctaaaaaaaacgaaaaacaaacgcgaccgcaacccaaatcccgaaaacgccacgaaacctaacgataacaacgaaaatcgcgcccctcaatacccgcgctctccccgtcgaaaacttcctaatcgcccctacgacgacgactcgaaatatctaaccgacgcgaaactcgcccaacctaatccgaaaaaaaaactaactaaacaaaaacgccgccccgcctcgaaaaaaacgaaccgaacgaaactaaaaatatttaaaactcgaaaccaccgccccgccgacgcccgcaacacctcctcgccaacaaccgtccgaaaccaaccaacgaacgataaactacgcgaaacgcgaaaaacgcgactccgaccgaacaaaaaaaaaaacgcccgaacgctacttaaaacgcgatccgaaaaaaattcgactccccgaaaccgaaccgaaacgcgcgcgaaaaaccccacaacctatactctaccctccaaaaacgaaacgacgaacaacgatctaaacccgaaacaatcgcctttaattatcgaaaacgctaacgttcgaaaaaaattaacaacaccttacgaaacccacacacgtccccgaaacgacacgaaccaccttctacgaaacctcgtaaacttcgccgccgtcgcacctccgccgcctacgctctacgaccccaaaataaaccccatccgataacgaaccgcaa

SEQ ID NO: 38147 - DNA, 765 bp, Artificial Sequence
  chemically treated genomic DNA (Homo sapiens) CpG-island No: 38147
tataaataaagtaatttattaattgaattttttttagcgaattttttatttaggtgattttggagagggcgggggatagacgcggtcgtagtttaggtttcgggagcgttacggaatttaacggtggtagcggaggtcgcgttttttagtgttcgcgtttttttcgtcgggagttttttggtcgtttttgcggcggcggttcggggtgtttggtcggcgcggggttcgtttagtttggttcggggagaggattggttgggtaggggcgtcgtttcgtttcgggagaggcgggtcgggcggggttgggagtatttgaggttcggagttatcgtttcgtcggcgttcgtagtattttttcgttagtagtcgttcggagttagttaacgagcggtgagttgcgcggggcgcgggggacgcggtttcggtcgggtaggggagagggcgttcgggcgttgtttggggcgcggttcggagagggttcggtttttcgggatcgggtcggggcgcgcgcggagagttttatagtttgtgttttgttttttaggagcggggcggcgggtagcgatttgggttcggggtagtcgtttttgattatcgagggcgttggcgttcggggaaggttggtagtattttacgagatttatatacgttttcggggcggtacgggttattttttgcggagtttcgtgggtttcgtcgtcgtcgtattttcgtcgtttgcgttttgcggttttagagtaagttttattcggtgacgagtcgtag

SEQ ID NO: 38148 - DNA, 765 bp, Artificial Sequence
  chemically treated genomic DNA (Homo sapiens) CpG-island No: 38148
ctacgactcgtcaccgaataaaacttactctaaaaccgcaaaacgcaaacgacgaaaatacgacgacgacgaaacccacgaaactccgcaaaaaataacccgtaccgccccgaaaacgtatataaatctcgtaaaatactaccaaccttccccgaacgccaacgccctcgataatcaaaaacgactaccccgaacccaaatcgctacccgccgccccgctcctaaaaaacaaaacacaaactataaaactctccgcgcgcgccccgacccgatcccgaaaaaccgaaccctctccgaaccgcgccccaaacaacgcccgaacgccctctcccctacccgaccgaaaccgcgtcccccgcgccccgcgcaactcaccgctcgttaactaactccgaacgactactaacgaaaaaatactacgaacgccgacgaaacgataactccgaacctcaaatactcccaaccccgcccgacccgcctctcccgaaacgaaacgacgcccctacccaaccaatcctctccccgaaccaaactaaacgaaccccgcgccgaccaaacaccccgaaccgccgccgcaaaaacgaccaaaaaactcccgacgaaaaaaacgcgaacactaaaaaacgcgacctccgctaccaccgttaaattccgtaacgctcccgaaacctaaactacgaccgcgtctatcccccgccctctccaaaatcacctaaataaaaaattcgctaaaaaaaattcaattaataaattactttatttata

SEQ ID NO: 38149 - DNA, 724 bp, Artificial Sequence
  chemically treated genomic DNA (Homo sapiens) CpG-island No: 38149
tagtcgtttagggacgtacgaataaagggagttcgggattaatcggagcgaatcggttttttagcgggtcgcgttcgtcgggaaggggtgggggaggggtcggttcgcgttcgtttcgtttcgtagttagatttgacgttaggcgtttagaaattcgtcgggcgcgacgttagcggttttcgatattttttttttggggggcgatttttaggtagttcgtagcgtggaggaaggcgatcgatagaaacgtttagttttggtgttaggtaggcgattacggttcgagtattggacgtgattcgatgtatttcggttatcgcgttcgtttttcgtttggtcgcgttcgcgggtttcgtaattttagtttttcgatttttttttacgatttttattagtatcgaagtagttttattcggtaatattcgagatcgtagtagggtttagaagcggcgatgggttcgagggattgggttttgaagacgcgggcgtagtttgattgacggtagttagagtagcggcggtaatagtattagtagcgcgcggttttttttggcgtcggaataggaagcgtcgagcgtatcgttttcgttcgttttttttttttttttaggtcgcgtcgcgtgcgtttttcgtaggtttttggcggtattgcggttcgttaggtttagggggatgggttttatttggcgtcggtttcgggtcgtttttttttggtgggcgggtt

SEQ ID NO: 38150 - DNA, 724 bp, Artificial Sequence
  chemically treated genomic DNA (Homo sapiens) CpG-island No: 38150
aacccgcccaccaaaaaaaaacgacccgaaaccgacgccaaataaaacccatccccctaaacctaacgaaccgcaataccgccaaaaacctacgaaaaacgcacgcgacgcgacctaaaaaaaaaaaaaaaacgaacgaaaacgatacgctcgacgcttcctattccgacgccaaaaaaaaccgcgcgctactaatactattaccgccgctactctaactaccgtcaatcaaactacgcccgcgtcttcaaaacccaatccctcgaacccatcgccgcttctaaaccctactacgatctcgaatattaccgaataaaactacttcgatactaataaaaatcgtaaaaaaaaatcgaaaaactaaaattacgaaacccgcgaacgcgaccaaacgaaaaacgaacgcgataaccgaaatacatcgaatcacgtccaatactcgaaccgtaatcgcctacctaacaccaaaactaaacgtttctatcgatcgccttcctccacgctacgaactacctaaaaatcgccccccaaaaaaaaaatatcgaaaaccgctaacgtcgcgcccgacgaatttctaaacgcctaacgtcaaatctaactacgaaacgaaacgaacgcgaaccgacccctcccccaccccttcccgacgaacgcgacccgctaaaaaaccgattcgctccgattaatcccgaactccctttattcgtacgtccctaaacgacta

SEQ ID NO: 38151 - DNA, 724 bp, Artificial Sequence
  chemically treated genomic DNA (Homo sapiens) CpG-island No: 38151
agttcgtttattaggggaaagcggttcggagtcggcgttaggtggagtttatttttttaggtttggcgggtcgtagtatcgttaggggtttgcgggaggcgtacgcggcgcggtttgaggggagggggagaacgggcggaggcggtgcgttcggcgttttttgtttcggcgttaggaggagtcgcgcgttgttggtgttgttgtcgtcgttgttttagttgtcgttagttaggttgcgttcgcgtttttagggtttagtttttcggatttatcgtcgtttttagattttattgcggtttcggatattgtcgggtgaggttgtttcggtattagtgggagtcgtgaaggggaatcggggagttggggttgcggagttcgcgggcgcggttaagcgggaagcgggcgcggtgatcgaggtgtatcgagttacgtttagtgttcgggtcgtggtcgtttgtttggtattaggattaagcgtttttatcggtcgtttttttttacgttgcgggttgtttggggatcgttttttagggagaaggtgtcggaggtcgttgacgtcgcgttcgacgggtttttgggcgtttgacgttaggtttggttgcggggcggggcgggcgcgggtcggttttttttttattttttttcggcgggcgcgattcgttaggaggtcggttcgtttcggttgatttcggattttttttgttcgtgcgtttttaaacggttg

SEQ ID NO: 38152 - DNA, 724 bp, Artificial Sequence
  chemically treated genomic DNA (Homo sapiens) CpG-island No: 38152
caaccgtttaaaaacgcacgaacaaaaaaaatccgaaatcaaccgaaacgaaccgacctcctaacgaatcgcgcccgccgaaaaaaaataaaaaaaaaaccgacccgcgcccgccccgccccgcaaccaaacctaacgtcaaacgcccaaaaacccgtcgaacgcgacgtcaacgacctccgacaccttctccctaaaaaacgatccccaaacaacccgcaacgtaaaaaaaaacgaccgataaaaacgcttaatcctaataccaaacaaacgaccacgacccgaacactaaacgtaactcgatacacctcgatcaccgcgcccgcttcccgcttaaccgcgcccgcgaactccgcaaccccaactccccgattccccttcacgactcccactaataccgaaacaacctcacccgacaatatccgaaaccgcaataaaatctaaaaacgacgataaatccgaaaaactaaaccctaaaaacgcgaacgcaacctaactaacgacaactaaaacaacgacgacaacaacaccaacaacgcgcgactcctcctaacgccgaaacaaaaaacgccgaacgcaccgcctccgcccgttctccccctcccctcaaaccgcgccgcgtacgcctcccgcaaacccctaacgatactacgacccgccaaacctaaaaaaataaactccacctaacgccgactccgaaccgctttcccctaataaacgaact

SEQ ID NO: 38153 - DNA, 618 bp, Artificial Sequence
  chemically treated genomic DNA (Homo sapiens) CpG-island No: 38153
gggtttttcgcgaggggcgtgtttttgtttggtttcgttcgtttcggttcggtagcgaatgaagcgggcgcgtcgggagggcgcgaggttagggggttggggacgcgcgtggggatcgttattcggttcggttattgttgggcggatatttgggcgcgtcgtcgcgggaggagttcggattcgggtcgaggttgtttaggtaatgcgtttattcggcgtaaatatggttgcggttttgcgcgtcgcgggcgttttgtttcgcgattcgcgtaagtgggtttgtcgcggcggtcgttagggttaggatttttgagaaggcgtgggtagagcggtaagtgggtttgtcgcggcggtcgttagggttaggatttttgagaaggcgtgggtagagcgggtagttggcgtttgggttttcgcgttcgggggattcggggagcggttttgggggtgttgcgagtaatcgggcgaggggcgtcgcggagaagggagggttgagggtagtatttagggttcgggaggtcgcggggagggcgttcggatttaggaggcgtaggtttaagttttatcggtcggttgggtggtttggagtagtggttggaattttttagagttttggtt

SEQ ID NO: 38154 - DNA, 618 bp, Artificial Sequence
  chemically treated genomic DNA (Homo sapiens) CpG-island No: 38154
aaccaaaactctaaaaaattccaaccactactccaaaccacccaaccgaccgataaaacttaaacctacgcctcctaaatccgaacgccctccccgcgacctcccgaaccctaaatactaccctcaaccctcccttctccgcgacgcccctcgcccgattactcgcaacacccccaaaaccgctccccgaatcccccgaacgcgaaaacccaaacgccaactacccgctctacccacgccttctcaaaaatcctaaccctaacgaccgccgcgacaaacccacttaccgctctacccacgccttctcaaaaatcctaaccctaacgaccgccgcgacaaacccacttacgcgaatcgcgaaacaaaacgcccgcgacgcgcaaaaccgcaaccatatttacgccgaataaacgcattacctaaacaacctcgacccgaatccgaactcctcccgcgacgacgcgcccaaatatccgcccaacaataaccgaaccgaataacgatccccacgcgcgtccccaaccccctaacctcgcgccctcccgacgcgcccgcttcattcgctaccgaaccgaaacgaacgaaaccaaacaaaaacacgcccctcgcgaaaaaccc

SEQ ID NO: 38155 - DNA, 618 bp, Artificial Sequence
  chemically treated genomic DNA (Homo sapiens) CpG-island No: 38155
aattaaggttttgggaaattttagttattgttttaagttatttagtcgatcgatgggatttgaatttgcgttttttggattcgggcgtttttttcgcggtttttcgagttttgagtgttgtttttagttttttttttttcgcgacgtttttcgttcggttgttcgtagtatttttaaggtcgtttttcgaatttttcgggcgcgagggtttaggcgttagttgttcgttttgtttacgtttttttagggattttggttttggcggtcgtcgcgatagatttatttatcgttttgtttacgtttttttagggattttggttttggcggtcgtcgcgatagatttatttacgcggatcgcggagtaggacgttcgcggcgcgtagggtcgtagttatgtttgcgtcgagtgaacgtattgtttgggtagtttcggttcgagttcgggtttttttcgcggcggcgcgtttaggtgttcgtttagtagtggtcgagtcgggtagcgatttttacgcgcgtttttagttttttgatttcgcgttttttcggcgcgttcgttttattcgttgtcgggtcggggcgggcgaggttaggtagagatacgtttttcgcggagagttt

SEQ ID NO: 38156 - DNA, 618 bp, Artificial Sequence
  chemically treated genomic DNA (Homo sapiens) CpG-island No: 38156
aaactctccgcgaaaaacgtatctctacctaacctcgcccgccccgacccgacaacgaataaaacgaacgcgccgaaaaaacgcgaaatcaaaaaactaaaaacgcgcgtaaaaatcgctacccgactcgaccactactaaacgaacacctaaacgcgccgccgcgaaaaaaacccgaactcgaaccgaaactacccaaacaatacgttcactcgacgcaaacataactacgaccctacgcgccgcgaacgtcctactccgcgatccgcgtaaataaatctatcgcgacgaccgccaaaaccaaaatccctaaaaaaacgtaaacaaaacgataaataaatctatcgcgacgaccgccaaaaccaaaatccctaaaaaaacgtaaacaaaacgaacaactaacgcctaaaccctcgcgcccgaaaaattcgaaaaacgaccttaaaaatactacgaacaaccgaacgaaaaacgtcgcgaaaaaaaaaaaactaaaaacaacactcaaaactcgaaaaaccgcgaaaaaaacgcccgaatccaaaaaacgcaaattcaaatcccatcgatcgactaaataacttaaaacaataactaaaatttcccaaaaccttaatt

SEQ ID NO: 38157 - DNA, 668 bp, Artificial Sequence
  chemically treated genomic DNA (Homo sapiens) CpG-island No: 38157
  misc_feature (446)..(446): n is either a, c, g or t
  misc_feature (579)..(579): n is either a, c, g or t
  misc_feature (625)..(625): n is either a, c, g or t
agttattgcgcgtattgtttttacggttttatgttcgacggtttcgggacgcggttgggtcggggcgggcggtaaggatgcggtcgtcgtcgtcgtcgcggttttttcgcgtttcgtcgacgttaatagtcgtcggtttttttttcgcgcgggatcgagggagtaggagtcgtagttgacgggtcgcgggcgtcgcgttaggttcggtttcggtttcggttcgggtgcgtcgcgattcggtcgtcgttgtagcgagtttcgcgcgtttttcgtgcgtttcggtcggttcggcggcggttgtcgcgtataggttttcgattttagcgttcggttcgttattgagtatgtttagtacgtcggtcggtttcgttgcggttcgtaagtttttagacgcgcgggtgggagcgcgtcggcggtcggggttggggtttgtggtcgagggcggngcgcgggggaggggtcggcggaggggggcggcggttagaaaggggatttcgcgttttcgtttgtagttttgcggggtttacgtagttttcggcgttttggggttttttttcgggcggtttttcggttttgcgnggagtgtggttgaatattgtaatacgatggggttttttaggatttnttaaaatataaatgtttaaaggagcgacggattaattggggta

SEQ ID NO: 38158 - DNA, 668 bp, Artificial Sequence
  chemically treated genomic DNA (Homo sapiens) CpG-island No: 38158
  misc_feature (44)..(44): n is either a, c, g or t
  misc_feature (90)..(90): n is either a, c, g or t
  misc_feature (223)..(223): n is either a, c, g or t
taccccaattaatccgtcgctcctttaaacatttatattttaanaaatcctaaaaaaccccatcgtattacaatattcaaccacactccncgcaaaaccgaaaaaccgcccgaaaaaaaaccccaaaacgccgaaaactacgtaaaccccgcaaaactacaaacgaaaacgcgaaatcccctttctaaccgccgcccccctccgccgacccctcccccgcgcnccgccctcgaccacaaaccccaaccccgaccgccgacgcgctcccacccgcgcgtctaaaaacttacgaaccgcaacgaaaccgaccgacgtactaaacatactcaataacgaaccgaacgctaaaatcgaaaacctatacgcgacaaccgccgccgaaccgaccgaaacgcacgaaaaacgcgcgaaactcgctacaacgacgaccgaatcgcgacgcacccgaaccgaaaccgaaaccgaacctaacgcgacgcccgcgacccgtcaactacgactcctactccctcgatcccgcgcgaaaaaaaaaccgacgactattaacgtcgacgaaacgcgaaaaaaccgcgacgacgacgacgaccgcatccttaccgcccgccccgacccaaccgcgtcccgaaaccgtcgaacataaaaccgtaaaaacaatacgcgcaataact

SEQ ID NO: 38159 - DNA, 668 bp, Artificial Sequence
  chemically treated genomic DNA (Homo sapiens) CpG-island No: 38159
  misc_feature (44)..(44): n is either a, c, g or t
  misc_feature (90)..(90): n is either a, c, g or t
  misc_feature (223)..(223): n is either a, c, g or t
tgttttaattaattcgtcgtttttttgagtatttgtgttttagngggttttgggggattttatcgtattatagtatttagttatattttncgtaaagtcgggaagtcgttcgagagaagattttaggacgtcgggggttgcgtgagtttcgtaaggttgtaggcgggggcgcgggattttttttttggtcgtcgttttttttcgtcggtttttttttcgcgtntcgttttcggttatagattttagtttcggtcgtcggcgcgtttttattcgcgcgtttggggatttgcggatcgtagcgagatcggtcggcgtgttgggtatgtttagtggcgggtcgggcgttggagtcggaagtttgtgcgcggtagtcgtcgtcgagtcggtcggggcgtacggagagcgcgcgggattcgttgtagcggcggtcgggtcgcggcgtattcgggtcgggatcggagtcgagtttagcgcggcgttcgcgattcgttagttgcggtttttgttttttcgatttcgcgcggggaaagggtcggcggttgttggcgtcggcggggcgcggaggaatcgcggcggcggcggcggtcgtatttttgtcgttcgtttcggtttagtcgcgtttcggagtcgtcgggtatggagtcgtggaagtagtgcgcgtagtggtt

SEQ ID NO: 38160 - DNA, 668 bp, Artificial Sequence
  chemically treated genomic DNA (Homo sapiens) CpG-island No: 38160
  misc_feature (446)..(446): n is either a, c, g or t
  misc_feature (579)..(579): n is either a, c, g or t
  misc_feature (625)..(625): n is either a, c, g or t
aaccactacgcgcactacttccacgactccatacccgacgactccgaaacgcgactaaaccgaaacgaacgacaaaaatacgaccgccgccgccgccgcgattcctccgcgccccgccgacgccaacaaccgccgaccctttccccgcgcgaaatcgaaaaaacaaaaaccgcaactaacgaatcgcgaacgccgcgctaaactcgactccgatcccgacccgaatacgccgcgacccgaccgccgctacaacgaatcccgcgcgctctccgtacgccccgaccgactcgacgacgactaccgcgcacaaacttccgactccaacgcccgacccgccactaaacatacccaacacgccgaccgatctcgctacgatccgcaaatccccaaacgcgcgaataaaaacgcgccgacgaccgaaactaaaatctataaccgaaaacganacgcgaaaaaaaaaccgacgaaaaaaaacgacgaccaaaaaaaaaatcccgcgcccccgcctacaaccttacgaaactcacgcaacccccgacgtcctaaaatcttctctcgaacgacttcccgactttacgnaaaatataactaaatactataatacgataaaatcccccaaaacccnctaaaacacaaatactcaaaaaaacgacgaattaattaaaaca

SEQ ID NO: 38161 - DNA, 558 bp, Artificial Sequence
  chemically treated genomic DNA (Homo sapiens) CpG-island No: 38161
tgtgttacgtgatggtcgtcgggatttaacgtgtgagttattttatacgatgtttgatgcgtgcgatgttttttaagttcgtagttgttatcgtcgtgatcgtgaggtttttttagtagagtggaaggttttatttcggacggagcgtggaggttaggagggaggatggttggtcggttcgggacggcgtcgttttgttttttcggtcgatttttagttttattggttagcggttgggtcgtgacggagaggtttgcgttgttgttgagggttaggtcgtgggttgaagtgcggggttcgggttcgagcgtcggaagtttgcgggggtcgtgggttgaagcgcggggtttcggttcgagcgtgggaagtttgcgggggtcgtgggttgaagcgcggggttcgggttcgagcgtgggaagtttgtttgtttgtcgtgtgggatcggtcgcggagatgtcggttgtttatttggaacgaaggtgtttgttttgtgtgtgtcgggtagtttgggggattgtttttttgttcgtggttttcggcgtgtttttagtattttga

SEQ ID NO: 38162 - DNA, 558 bp, Artificial Sequence
  chemically treated genomic DNA (Homo sapiens) CpG-island No: 38162
tcaaaatactaaaaacacgccgaaaaccacgaacaaaaaaacaatcccccaaactacccgacacacacaaaacaaacaccttcgttccaaataaacaaccgacatctccgcgaccgatcccacacgacaaacaaacaaacttcccacgctcgaacccgaaccccgcgcttcaacccacgacccccgcaaacttcccacgctcgaaccgaaaccccgcgcttcaacccacgacccccgcaaacttccgacgctcgaacccgaaccccgcacttcaacccacgacctaaccctcaacaacaacgcaaacctctccgtcacgacccaaccgctaaccaataaaactaaaaatcgaccgaaaaaacaaaacgacgccgtcccgaaccgaccaaccatcctccctcctaacctccacgctccgtccgaaataaaaccttccactctactaaaaaaacctcacgatcacgacgataacaactacgaacttaaaaaacatcgcacgcatcaaacatcgtataaaataactcacacgttaaatcccgacgaccatcacgtaacaca

SEQ ID NO: 38163 - DNA, 558 bp, Artificial Sequence
  chemically treated genomic DNA (Homo sapiens) CpG-island No: 38163
ttaggatgttgggaatacgtcggaagttacgaataggaagataattttttaaattattcggtatatatagggtaggtattttcgttttaagtgaatagtcggtattttcgcggtcggttttatacgataaataggtaagttttttacgttcgagttcgggtttcgcgttttaatttacgattttcgtaggttttttacgttcgagtcggggtttcgcgttttaatttacgattttcgtaggttttcgacgttcgagttcgggtttcgtattttaatttacgatttggtttttaatagtagcgtaggttttttcgttacggtttagtcgttgattaatgggattgagaatcggtcggaggggtagagcgacgtcgtttcggatcggttagttatttttttttttggtttttacgtttcgttcggggtgaggttttttattttgttgaaggagttttacggttacggcgatgatagttacgagtttggggaatatcgtacgtattaggtatcgtgtggagtgatttatacgttgaatttcggcggttattacgtgatata

SEQ ID NO: 38164 - DNA, 558 bp, Artificial Sequence
  chemically treated genomic DNA (Homo sapiens) CpG-island No: 38164
tatatcacgtaataaccgccgaaattcaacgtataaatcactccacacgatacctaatacgtacgatattccccaaactcgtaactatcatcgccgtaaccgtaaaactccttcaacaaaataaaaaacctcaccccgaacgaaacgtaaaaaccaaaaaaaaaaataactaaccgatccgaaacgacgtcgctctacccctccgaccgattctcaatcccattaatcaacgactaaaccgtaacgaaaaaacctacgctactattaaaaaccaaatcgtaaattaaaatacgaaacccgaactcgaacgtcgaaaacctacgaaaatcgtaaattaaaacgcgaaaccccgactcgaacgtaaaaaacctacgaaaatcgtaaattaaaacgcgaaacccgaactcgaacgtaaaaaacttacctatttatcgtataaaaccgaccgcgaaaataccgactattcacttaaaacgaaaatacctaccctatatataccgaataatttaaaaaattatcttcctattcgtaacttccgacgtattcccaacatcctaa

SEQ ID NO: 38165 - DNA, 730 bp, Artificial Sequence
  chemically treated genomic DNA (Homo sapiens) CpG-island No: 38165
  misc_feature (498)..(498): n is either a, c, g or t
gttgggcgcgcgttttttggaattagagaggaggtggtcggggcggggtcgggggaggggggtagggtagagtcggcgggagttcggcgttgattggtcggtttggttggcgggttttcgtcgttggttcgtagtcggcgtagcggtttgggttgggatgtgaggagcggcgggtttcgggtttcgggttttgggtggcggcggttgtgagcggcggtattgcggcgtaggttagcgggcgtcgtcggcggttggttttgtcggtcgcgggatgaggaagcggatcgagttcgtcgttttggagtatgagcgttgcgtcgtcgcgggttcgttttttttcggttcggtcgtcgcggcgttggacgtcgattgtcgtttgaagtagaatttacgtttgacgggttcggcggcggttgagtcgcgttgcgtagtcgacgcgggaatgaagcgggcgttgggtaggtgaggtttcgcgcggagcggggggggggggggggncggttttttattttgcgtaggtgcgtttcgtagggggtcgcggtattttttagttttttttagagtggtcgttcgttcgattcgcggtcgttttcgttcgcgtttgtgtttcgtatttggttcgcggtagttttattttcgtttttttttttaggtatcgcggcgggagcgttttgttttgtcgttgattttttgtgttttgtttcggttttttcgttaggtatttttggtt

SEQ ID NO: 38166 - DNA, 730 bp, Artificial Sequence
  chemically treated genomic DNA (Homo sapiens) CpG-island No: 38166
  misc_feature (233)..(233): n is either a, c, g or t
aaccaaaaatacctaacgaaaaaaccgaaacaaaacacaaaaaatcaacgacaaaacaaaacgctcccgccgcgatacctaaaaaaaaaaacgaaaataaaactaccgcgaaccaaatacgaaacacaaacgcgaacgaaaacgaccgcgaatcgaacgaacgaccactctaaaaaaaactaaaaaataccgcgaccccctacgaaacgcacctacgcaaaataaaaaaccgnccccccccccccccccgctccgcgcgaaacctcacctacccaacgcccgcttcattcccgcgtcgactacgcaacgcgactcaaccgccgccgaacccgtcaaacgtaaattctacttcaaacgacaatcgacgtccaacgccgcgacgaccgaaccgaaaaaaaacgaacccgcgacgacgcaacgctcatactccaaaacgacgaactcgatccgcttcctcatcccgcgaccgacaaaaccaaccgccgacgacgcccgctaacctacgccgcaataccgccgctcacaaccgccgccacccaaaacccgaaacccgaaacccgccgctcctcacatcccaacccaaaccgctacgccgactacgaaccaacgacgaaaacccgccaaccaaaccgaccaatcaacgccgaactcccgccgactctaccctacccccctcccccgaccccgccccgaccacctcctctctaattccaaaaaacgcgcgcccaac

SEQ ID NO: 38167 - DNA, 730 bp, Artificial Sequence
  chemically treated genomic DNA (Homo sapiens) CpG-island No: 38167
  misc_feature (233)..(233): n is either a, c, g or t
ggttaggagtgtttggcgagagggtcggagtaggatatagggggttagcggtagggtagggcgttttcgtcgcggtgtttggggaagggagcgggggtggggttgtcgcgggttaaatgcgggatataggcgcggacgggggcggtcgcggatcgggcggacggttattttgggaggggttgggaggtatcgcggttttttgcgggacgtatttgcgtaaagtgagggatcgntttttttttttttttcgtttcgcgcgaagttttatttgtttagcgttcgttttattttcgcgtcggttgcgtagcgcggtttagtcgtcgtcgggttcgttaggcgtaggttttgttttaggcggtagtcggcgtttagcgtcgcggcggtcgagtcggaggaggacgagttcgcggcggcgtagcgtttatgttttaaggcgacgggttcggttcgtttttttatttcgcggtcgatagggttagtcgtcgacggcgttcgttggtttgcgtcgtagtgtcgtcgtttatagtcgtcgttatttagagttcggagttcggaattcgtcgttttttatattttagtttaggtcgttgcgtcggttacgaattagcggcgggggttcgttagttaggtcggttaattagcgtcgggttttcgtcggttttgttttatttttttttttcggtttcgtttcggttattttttttttagttttaaggagcgcgcgtttagt

SEQ ID NO: 38168 - DNA, 730 bp, Artificial Sequence
  chemically treated genomic DNA (Homo sapiens) CpG-island No: 38168
  misc_feature (498)..(498): n is either a, c, g or t
actaaacgcgcgctccttaaaactaaaaaaaaaataaccgaaacgaaaccgaaaaaaaaaaataaaacaaaaccgacgaaaacccgacgctaattaaccgacctaactaacgaacccccgccgctaattcgtaaccgacgcaacgacctaaactaaaatataaaaaacgacgaattccgaactccgaactctaaataacgacgactataaacgacgacactacgacgcaaaccaacgaacgccgtcgacgactaaccctatcgaccgcgaaataaaaaaacgaaccgaacccgtcgccttaaaacataaacgctacgccgccgcgaactcgtcctcctccgactcgaccgccgcgacgctaaacgccgactaccgcctaaaacaaaacctacgcctaacgaacccgacgacgactaaaccgcgctacgcaaccgacgcgaaaataaaacgaacgctaaacaaataaaacttcgcgcgaaacgaaaaaaaaaaaaaaancgatccctcactttacgcaaatacgtcccgcaaaaaaccgcgatacctcccaacccctcccaaaataaccgtccgcccgatccgcgaccgcccccgtccgcgcctatatcccgcatttaacccgcgacaaccccacccccgctcccttccccaaacaccgcgacgaaaacgccctaccctaccgctaaccccctatatcctactccgaccctctcgccaaacactcctaacc

SEQ ID NO: 38169 - DNA, 525 bp, Artificial Sequence
  chemically treated genomic DNA (Homo sapiens) CpG-island No: 38169
cgaacgttttcggcgagcggagcgtttaacgatgttcgatcggttcgttttattcgaagcgcgcgcgcggttgggtcgtcgatataacgtcgtcgcgtcgttttttcggcgtcgcgatcgacgttcgttttcgtgtttttcgcgtcgtcgcgcgcgcggattcgcgtaacgttcgaggttcgcgcgtcgtatcgtcgtcggcgttttcggtacggtcggtcggatgttttcgttcgtttttttagtattttttttttcgtcgattttcgcggtttcgtgttcgtttagttttttcgattaggtcggtttcggatttcgtcgtcgttttcgcgcgcgtcgttcgtcgtcgtcgtatttatttcgttatttttcggggtcgcgattcgcgttttttttcgttacgattttttcgtttcgcgatttataatgtttgtcgtttcgtaagcgttttgtagcgtataatttttgattcgcggggttaggggttgttgggggttttataattttttgcgaatttaaaagaga

SEQ ID NO: 38170 - DNA, 525 bp, Artificial Sequence
  chemically treated genomic DNA (Homo sapiens) CpG-island No: 38170
tctcttttaaattcgcaaaaaattataaaacccccaacaacccctaaccccgcgaatcaaaaattatacgctacaaaacgcttacgaaacgacaaacattataaatcgcgaaacgaaaaaatcgtaacgaaaaaaaacgcgaatcgcgaccccgaaaaataacgaaataaatacgacgacgacgaacgacgcgcgcgaaaacgacgacgaaatccgaaaccgacctaatcgaaaaaactaaacgaacacgaaaccgcgaaaatcgacgaaaaaaaaaatactaaaaaaacgaacgaaaacatccgaccgaccgtaccgaaaacgccgacgacgatacgacgcgcgaacctcgaacgttacgcgaatccgcgcgcgcgacgacgcgaaaaacacgaaaacgaacgtcgatcgcgacgccgaaaaaacgacgcgacgacgttatatcgacgacccaaccgcgcgcgcgcttcgaataaaacgaaccgatcgaacatcgttaaacgctccgctcgccgaaaacgttcg

SEQ ID NO: 38171 - DNA, 525 bp, Artificial Sequence
  chemically treated genomic DNA (Homo sapiens) CpG-island No: 38171
ttttttttgggttcgtaagaagttataggatttttaataatttttgatttcgcgggttaggggttgtgcgttataaggcgtttgcggggcggtagatattatgggtcgcgagacgggaaggtcgtggcggggaggggcgcgggtcgcgatttcggggagtggcggagtgggtgcggcggcggcgaacgacgcgcgcgggggcggcggcgaggttcgaggtcggtttaatcgaagaagttgggcgggtacgggatcgcgggggtcggcgggggggggggtattgggggggcgggcgggggtattcggtcggtcgtgtcggaggcgtcggcggcggtgcggcgcgcgagtttcgggcgttgcgcgggttcgcgcgcgcggcggcgcggggggtacgagggcgggcgtcggtcgcggcgtcggggagacggcgcggcggcgttgtgtcggcggtttagtcgcgcgcgcgtttcgggtggagcgagtcggtcgggtatcgttgagcgtttcgttcgtcgaggacgttcg

SEQ ID NO: 38172 - DNA, 525 bp, Artificial Sequence
  chemically treated genomic DNA (Homo sapiens) CpG-island No: 38172
cgaacgtcctcgacgaacgaaacgctcaacgatacccgaccgactcgctccacccgaaacgcgcgcgcgactaaaccgccgacacaacgccgccgcgccgtctccccgacgccgcgaccgacgcccgccctcgtaccccccgcgccgccgcgcgcgcgaacccgcgcaacgcccgaaactcgcgcgccgcaccgccgccgacgcctccgacacgaccgaccgaatacccccgcccgcccccccaatacccccccccccgccgacccccgcgatcccgtacccgcccaacttcttcgattaaaccgacctcgaacctcgccgccgcccccgcgcgcgtcgttcgccgccgccgcacccactccgccactccccgaaatcgcgacccgcgcccctccccgccacgaccttcccgtctcgcgacccataatatctaccgccccgcaaacgccttataacgcacaacccctaacccgcgaaatcaaaaattattaaaaatcctataacttcttacgaacccaaaaaaaa

SEQ ID NO: 38173 - DNA, 664 bp, Artificial Sequence
  chemically treated genomic DNA (Homo sapiens) CpG-island No: 38173
  misc_feature (464)..(464): n is either a, c, g or t
  misc_feature (510)..(510): n is either a, c, g or t
  misc_feature (542)..(542): n is either a, c, g or t
attcgttaacgttaatgggggttcgcgattgttgcggggacgagggcgtagagtagttttcgttacgggtcggtttacgtaggggtcgagaaagtggcggagaggcggtggtcgaggtttaggggcgagcgcgggttgagttggtttttgttgcgtttacgagcgatatttattttttcgttgcggacgtttcgcgggcgttaggttgggggttttgcgatcgatttttttcgttttcgaggtatcgtcgggttcgtttggtaggtagcgcgtttcgcgagttggagggtcgagtttcgcgggtcgtggggcgtgtgggtgaaggcgatatttcggatgcgggacgtatgaatggtggtagagtaggggtcgggattcgtttatgggttgggagagagatgtttttgtgagtacggaaaagtaacgttgtcggaggatagttttgaggcgggattaaaagtcgncggcgaaagttcgtcgagggatacggtcgttgttcgggtcgttttncgagcgttttttttttgaagggaagatttttnttcgcgggtttttcggagggtgcggaagcgggttttaaggtagttttttttgttttttttggggaacggttgttaaggttttcggttcgttttttgtatcggtttaggggtaaggaaaggtt

SEQ ID NO: 38174 - DNA, 664 bp, Artificial Sequence
  chemically treated genomic DNA (Homo sapiens) CpG-island No: 38174
  misc_feature (123)..(123): n is either a, c, g or t
  misc_feature (155)..(155): n is either a, c, g or t
  misc_feature (201)..(201): n is either a, c, g or t
aacctttccttacccctaaaccgatacaaaaaacgaaccgaaaaccttaacaaccgttccccaaaaaaaacaaaaaaaactaccttaaaacccgcttccgcaccctccgaaaaacccgcgaanaaaaatcttcccttcaaaaaaaaaacgctcgnaaaacgacccgaacaacgaccgtatccctcgacgaactttcgccgncgacttttaatcccgcctcaaaactatcctccgacaacgttacttttccgtactcacaaaaacatctctctcccaacccataaacgaatcccgacccctactctaccaccattcatacgtcccgcatccgaaatatcgccttcacccacacgccccacgacccgcgaaactcgaccctccaactcgcgaaacgcgctacctaccaaacgaacccgacgatacctcgaaaacgaaaaaaatcgatcgcaaaacccccaacctaacgcccgcgaaacgtccgcaacgaaaaaataaatatcgctcgtaaacgcaacaaaaaccaactcaacccgcgctcgcccctaaacctcgaccaccgcctctccgccactttctcgacccctacgtaaaccgacccgtaacgaaaactactctacgccctcgtccccgcaacaatcgcgaacccccattaacgttaacgaat

SEQ ID NO: 38175 - DNA, 664 bp, Artificial Sequence
  chemically treated genomic DNA (Homo sapiens) CpG-island No: 38175
  misc_feature (123)..(123): n is either a, c, g or t
  misc_feature (155)..(155): n is either a, c, g or t
  misc_feature (201)..(201): n is either a, c, g or t
aatttttttttatttttagatcggtataaaaaacgggtcgggggttttaataatcgttttttaaaaaaaatagggggaattgttttaaaattcgttttcgtatttttcggagaattcgcgggngggaattttttttttaaaaaaagaacgttcgngaagcggttcgggtaacggtcgtgtttttcggcgggttttcgtcgncggtttttgatttcgttttagagttgtttttcggtagcgttattttttcgtgtttataaaagtattttttttttaatttatgaacggatttcgatttttgttttgttattatttatgcgtttcgtattcgaggtgtcgtttttatttatacgttttacggttcgcgaaattcggttttttagttcgcgggacgcgttgtttgttaggcgggttcggcggtatttcgggggcgggaggggtcggtcgtagggtttttagtttggcgttcgcggggcgttcgtagcgaaggggtgggtgtcgttcgtgaacgtagtagggattagtttagttcgcgttcgtttttgggtttcggttatcgttttttcgttattttttcggtttttgcgtggatcggttcgtggcgggggttgttttgcgttttcgttttcgtagtagtcgcggatttttattaacgttgacgagt

SEQ ID NO: 38176 - DNA, 664 bp, Artificial Sequence
  chemically treated genomic DNA (Homo sapiens) CpG-island No: 38176
  misc_feature (464)..(464): n is either a, c, g or t
  misc_feature (510)..(510): n is either a, c, g or t
  misc_feature (542)..(542): n is either a, c, g or t
actcgtcaacgttaataaaaatccgcgactactacgaaaacgaaaacgcaaaacaacccccgccacgaaccgatccacgcaaaaaccgaaaaaataacgaaaaaacgataaccgaaacccaaaaacgaacgcgaactaaactaatccctactacgttcacgaacgacacccaccccttcgctacgaacgccccgcgaacgccaaactaaaaaccctacgaccgacccctcccgcccccgaaataccgccgaacccgcctaacaaacaacgcgtcccgcgaactaaaaaaccgaatttcgcgaaccgtaaaacgtataaataaaaacgacacctcgaatacgaaacgcataaataataacaaaacaaaaatcgaaatccgttcataaattaaaaaaaaaatacttttataaacacgaaaaaataacgctaccgaaaaacaactctaaaacgaaatcaaaaaccgncgacgaaaacccgccgaaaaacacgaccgttacccgaaccgcttcncgaacgttctttttttaaaaaaaaaattcccncccgcgaattctccgaaaaatacgaaaacgaattttaaaacaattccccctattttttttaaaaaacgattattaaaacccccgacccgttttttataccgatctaaaaataaaaaaaaatt

SEQ ID NO: 38177 - DNA, 602 bp, Artificial Sequence
  chemically treated genomic DNA (Homo sapiens) CpG-island No: 38177
  misc_feature (548)..(548): n is either a, c, g or t
  misc_feature (560)..(560): n is either a, c, g or t
gcgcggttgtcgtgtttttttttttttttgcggttcgcgcgttcgtcggtggcgttttcgtgttgtggtttcgcgtttgttcgttttgtgtgtcgcgtcgcgtttcgtttttttttcgttgcgttttggcggttttcggcggttcgtggggttcggttttcgtcggcgtttttcgcgcgggcgttcgcgtttcgggtgtttggggtggggttcgtttttttttttgcgggtcgcgtttcgcgggttcggttttggcgttttttttttcgcgttttcggtgttcgtgcgtcgcggttgttcgttcgtcggcgcggcgcggtcgttgcgttcgtgtcgggcgtcgtgttttttcgttcgtcgttcgttacggttcgttggatcgttcgcgtttttgtcgggtgtattttcgcgcgtggttcgttcgcggttcgtcgttgtggcggtcgtgttcgcgcgttgcggggcgggtgtttcggggcgcggttttttgcgcgcgggtcggcgttcgtcgtcgtcgcgttgtttgggcgtcgtttgcgtgggtcgtntgtttcgttgtntgcgggagtatgcggtagtgtggtcgcgttcgtcgttatttg

SEQ ID NO: 38178 - DNA, 602 bp, Artificial Sequence
  chemically treated genomic DNA (Homo sapiens) CpG-island No: 38178
  misc_feature (43)..(43): n is either a, c, g or t
  misc_feature (55)..(55): n is either a, c, g or t
caaataacgacgaacgcgaccacactaccgcatactcccgcanacaacgaaacanacgacccacgcaaacgacgcccaaacaacgcgacgacgacgaacgccgacccgcgcgcaaaaaaccgcgccccgaaacacccgccccgcaacgcgcgaacacgaccgccacaacgacgaaccgcgaacgaaccacgcgcgaaaatacacccgacaaaaacgcgaacgatccaacgaaccgtaacgaacgacgaacgaaaaaacacgacgcccgacacgaacgcaacgaccgcgccgcgccgacgaacgaacaaccgcgacgcacgaacaccgaaaacgcgaaaaaaaaaacgccaaaaccgaacccgcgaaacgcgacccgcaaaaaaaaaaacgaaccccaccccaaacacccgaaacgcgaacgcccgcgcgaaaaacgccgacgaaaaccgaaccccacgaaccgccgaaaaccgccaaaacgcaacgaaaaaaaaacgaaacgcgacgcgacacacaaaacgaacaaacgcgaaaccacaacacgaaaacgccaccgacgaacgcgcgaaccgcaaaaaaaaaaaaaaacacgacaaccgcgc

SEQ ID NO: 38179 - DNA, 602 bp, Artificial Sequence
  chemically treated genomic DNA (Homo sapiens) CpG-island No: 38179
  misc_feature (43)..(43): n is either a, c, g or t
  misc_feature (55)..(55): n is either a, c, g or t
taagtggcgacggacgcggttatattgtcgtatgttttcgtangtagcgagatangcggtttacgtagacggcgtttagatagcgcggcgacgacgaacgtcgattcgcgcgtagaagatcgcgtttcggggtattcgtttcgtagcgcgcgagtacggtcgttataacgacgaatcgcgggcgggttacgcgcgggagtgtattcggtagggacgcgagcgatttagcgggtcgtggcggacgacgagcggaggggtacggcgttcgatacgggcgtagcgatcgcgtcgcgtcgacgggcggatagtcgcgacgtacggatatcgggggcgcggaaaggagggcgttagaatcggattcgcgaggcgcgattcgtaaaaagaaaaacggattttattttaagtattcggggcgcgggcgttcgcgcggagagcgtcggcgggggtcgggttttacgggtcgtcgggagtcgttagggcgtagcggagagaaggcggagcgcggcgcggtatataagacgggtaggcgcgggattatagtacgggagcgttatcggcgagcgcgcgggtcgtaggggagggggagagtacggtagtcgcgt

SEQ ID NO: 38180 - DNA, 602 bp, Artificial Sequence
  chemically treated genomic DNA (Homo sapiens) CpG-island No: 38180
  misc_feature (548)..(548): n is either a, c, g or t
  misc_feature (560)..(560): n is either a, c, g or t
acgcgactaccgtactctccccctcccctacgacccgcgcgctcgccgataacgctcccgtactataatcccgcgcctacccgtcttatataccgcgccgcgctccgccttctctccgctacgccctaacgactcccgacgacccgtaaaacccgacccccgccgacgctctccgcgcgaacgcccgcgccccgaatacttaaaataaaatccgtttttctttttacgaatcgcgcctcgcgaatccgattctaacgccctcctttccgcgcccccgatatccgtacgtcgcgactatccgcccgtcgacgcgacgcgatcgctacgcccgtatcgaacgccgtacccctccgctcgtcgtccgccacgacccgctaaatcgctcgcgtccctaccgaatacactcccgcgcgtaacccgcccgcgattcgtcgttataacgaccgtactcgcgcgctacgaaacgaataccccgaaacgcgatcttctacgcgcgaatcgacgttcgtcgtcgccgcgctatctaaacgccgtctacgtaaaccgcntatctcgctacntacgaaaacatacgacaatataaccgcgtccgtcgccactta

SEQ ID NO: 38181 - DNA, 746 bp, Artificial Sequence
  chemically treated genomic DNA (Homo sapiens) CpG-island No: 38181
  misc_feature (580)..(580): n is either a, c, g or t
  misc_feature (604)..(604): n is either a, c, g or t
  misc_feature (660)..(660): n is either a, c, g or t
tatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgtttgatgagcgagcggtggtgttggggtcggatcgtgaaacgttgttgtgcggtgtgaaagcgttgtttgtcggttatgaggtttttgggttggtgatcgatttgtggggttgggggtcgatcggttttgtgtttttcgttaggntggtagtggtttgggatggttcgnggttttatcggtttttttcggtgtcgttgttgttttgacgagtttggtttagttgnatgtatatttggttagaaattcgggttcggaggtggtggtcggtttgatttttaatttttgatacgattttgtggcgtaattcgtt

SEQ ID NO: 38182 - DNA, 746 bp, Artificial Sequence
  chemically treated genomic DNA (Homo sapiens) CpG-island No: 38182
  misc_feature (87)..(87): n is either a, c, g or t
  misc_feature (143)..(143): n is either a, c, g or t
  misc_feature (167)..(167): n is either a, c, g or t
aacgaattacgccacaaaatcgtatcaaaaattaaaaatcaaaccgaccaccacctccgaacccgaatttctaaccaaatatacatncaactaaaccaaactcgtcaaaacaacaacgacaccgaaaaaaaccgataaaaccncgaaccatcccaaaccactaccancctaacgaaaaacacaaaaccgatcgacccccaaccccacaaatcgatcaccaacccaaaaacctcataaccgacaaacaacgctttcacaccgcacaacaacgtttcacgatccgaccccaacaccaccgctcgctcatcaaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtata

SEQ ID NO: 38183 - DNA, 746 bp, Artificial Sequence
  chemically treated genomic DNA (Homo sapiens) CpG-island No: 38183
  misc_feature (87)..(87): n is either a, c, g or t
  misc_feature (143)..(143): n is either a, c, g or t
  misc_feature (167)..(167): n is either a, c, g or t
aacggattgcgttataaagtcgtattaaaaattgggaattaaatcggttattattttcgaattcgaatttttggttagatgtgtatntagttgggttaagttcgttaaggtagtaacgatatcgaaaaaagtcggtaaagttncgggttattttaagttattgttantttgacggaaaatatagagtcgatcggtttttagttttatagatcggttattaatttagaagttttatgatcggtagatagcgtttttatatcgtataataacgttttacggttcgattttagtattatcgttcgtttattaagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatg

SEQ ID NO: 38184 - DNA, 746 bp, Artificial Sequence
  chemically treated genomic DNA (Homo sapiens) CpG-island No: 38184
  misc_feature (580)..(580): n is either a, c, g or t
  misc_feature (604)..(604): n is either a, c, g or t
  misc_feature (660)..(660): n is either a, c, g or t
catacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgcttaataaacgaacgataatactaaaatcgaaccgtaaaacgttattatacgatataaaaacgctatctaccgatcataaaacttctaaattaataaccgatctataaaactaaaaaccgatcgactctatattttccgtcaaantaacaataacttaaaataacccgnaactttaccgacttttttcgatatcgttactaccttaacgaacttaacccaactanatacacatctaaccaaaaattcgaattcgaaaataataaccgatttaattcccaatttttaatacgactttataacgcaatccgtt

SEQ ID NO: 38185 - DNA, 524 bp, Artificial Sequence
  chemically treated genomic DNA (Homo sapiens) CpG-island No: 38185
cggtggcggtttgaggagcggtcgagtgaagagatgaacggaggcgtagtgaatggcgaggtcgagtgaacggtgagaacggagaggtgagagaaagaaatcgaagtagaagttgaggtgtttttgcggtcgagtgaatgggaggcgagattgagtgaaaaggaagcgatggtgagacggtgaaggttcgacgatcgagtaggcggtgaatagagaggagtagcggggttaagagtgaagagggaggaaacgttgagacggtgaagtttttggcgaagtgaagggcggagtggtcgagtgaacggcgagtggtgagaagggagagatggtaaaattggttttatcgttgagtgaaagagaggatgaaggcggtggcgtgagtgtcggtggttgtgtcgtaatcgagtgagaagggagacgaagtcggaggggagagatcgagtgtttttgtgtggtcgagtgtttggagaggaagagagatggtgaggtttggtcgagagagagttgtgagggagagatgtcga

SEQ ID NO: 38186 - DNA, 524 bp, Artificial Sequence
  chemically treated genomic DNA (Homo sapiens) CpG-island No: 38186
tcgacatctctccctcacaactctctctcgaccaaacctcaccatctctcttcctctccaaacactcgaccacacaaaaacactcgatctctcccctccgacttcgtctcccttctcactcgattacgacacaaccaccgacactcacgccaccgccttcatcctctctttcactcaacgataaaaccaattttaccatctctcccttctcaccactcgccgttcactcgaccactccgcccttcacttcgccaaaaacttcaccgtctcaacgtttcctccctcttcactcttaaccccgctactcctctctattcaccgcctactcgatcgtcgaaccttcaccgtctcaccatcgcttccttttcactcaatctcgcctcccattcactcgaccgcaaaaacacctcaacttctacttcgatttctttctctcacctctccgttctcaccgttcactcgacctcgccattcactacgcctccgttcatctcttcactcgaccgctcctcaaaccgccaccg

SEQ ID NO: 38187 - DNA, 524 bp, Artificial Sequence
  chemically treated genomic DNA (Homo sapiens) CpG-island No: 38187
tcgatattttttttttataattttttttcgattaaattttattatttttttttttttttaaatattcgattatataaaaatattcgatttttttttttcggtttcgtttttttttttattcgattacgatatagttatcgatatttacgttatcgtttttatttttttttttatttaacgatgggattagttttgttatttttttttttttattattcgtcgtttattcgattatttcgttttttatttcgttagaagttttatcgttttaacgttttttttttttttatttttgatttcgttgtttttttttatttatcgtttattcgatcgtcggatttttatcgttttattatcgttttttttttatttaatttcgttttttatttattcgatcgtaagagtattttagtttttatttcgattttttttttttattttttcgtttttatcgtttattcgatttcgttatttattgcgttttcgtttatttttttattcgatcgttttttaaatcgttatcg

SEQ ID NO: 38188 - DNA, 524 bp, Artificial Sequence
  chemically treated genomic DNA (Homo sapiens) CpG-island No: 38188
cgataacgatttaaaaaacgatcgaataaaaaaataaacgaaaacgcaataaataacgaaatcgaataaacgataaaaacgaaaaaataaaaaaaaaaaatcgaaataaaaactaaaatactcttacgatcgaataaataaaaaacgaaattaaataaaaaaaaaacgataataaaacgataaaaatccgacgatcgaataaacgataaataaaaaaaaacaacgaaatcaaaaataaaaaaaaaaaaaacgttaaaacgataaaacttctaacgaaataaaaaacgaaataatcgaataaacgacgaataataaaaaaaaaaaaataacaaaactaatcccatcgttaaataaaaaaaaaaataaaaacgataacgtaaatatcgataactatatcgtaatcgaataaaaaaaaaaacgaaaccgaaaaaaaaaaatcgaatatttttatataatcgaatatttaaaaaaaaaaaaaaataataaaatttaatcgaaaaaaaattataaaaaaaaaatatcga

SEQ ID NO: 38189 - DNA, 761 bp, Artificial Sequence
  chemically treated genomic DNA (Homo sapiens) CpG-island No: 38189
gtcggttacgttttttataggttcggaagtttattttattttgtatcgtgatttatcggaagcgttttagggaattttggagttttcgcgtttgtttagttttgtttcgaaagatttatcgaggagggagtttgcggtgcgttttgggaaagttgttgggttagtttttttgtttttagtttgagcgttgcgttcggtttttcgagggttttttgaggtatcgcggttgcgggtttttgagttttcggtttttcgtagggaagtttttttttcgtatttcgttttttggttcgtggggggtttttttatcgttggtcgacgtagttagtatgttcggggtgcgcgtagtgcggattagtatcgaatcggtttgcgagaagtaggtttatgaggtgggtttggatggtatcgagacgtatttgttttcgttgtttatgtcgtagaatttggcgcgtttggtttagcggatagattttagttagggttcgggtttcgaggaggaggaggcggcggggatcgagggcgacgcgtaggagtggtcgggcgtcgggtttagcgtagattaggacgacgaggaaggtaaggtttgtattcgttgttcgagtttttcggtttgggttttagtattcgcgcgggttttcgtttttttcgcgatgggggtgattttgtgcgtgcgagaatttttgagtgtttttttagcggaagcgtaaggatatttggtcgttatttttttgttgttgtcggataaggtaggatacgat

SEQ ID NO: 38190 - DNA, 761 bp, Artificial Sequence
  chemically treated genomic DNA (Homo sapiens) CpG-island No: 38190
atcgtatcctaccttatccgacaacaacaaaaaaataacgaccaaatatccttacgcttccgctaaaaaaacactcaaaaattctcgcacgcacaaaatcacccccatcgcgaaaaaaacgaaaacccgcgcgaatactaaaacccaaaccgaaaaactcgaacaacgaatacaaaccttaccttcctcgtcgtcctaatctacgctaaacccgacgcccgaccactcctacgcgtcgccctcgatccccgccgcctcctcctcctcgaaacccgaaccctaactaaaatctatccgctaaaccaaacgcgccaaattctacgacataaacaacgaaaacaaatacgtctcgataccatccaaacccacctcataaacctacttctcgcaaaccgattcgatactaatccgcactacgcgcaccccgaacatactaactacgtcgaccaacgataaaaaaaccccccacgaaccaaaaaacgaaatacgaaaaaaaaacttccctacgaaaaaccgaaaactcaaaaacccgcaaccgcgatacctcaaaaaaccctcgaaaaaccgaacgcaacgctcaaactaaaaacaaaaaaactaacccaacaactttcccaaaacgcaccgcaaactccctcctcgataaatctttcgaaacaaaactaaacaaacgcgaaaactccaaaattccctaaaacgcttccgataaatcacgatacaaaataaaataaacttccgaacctataaaaaacgtaaccgac

SEQ ID NO: 38191 - DNA, 761 bp, Artificial Sequence
  chemically treated genomic DNA (Homo sapiens) CpG-island No: 38191
gtcgtgttttattttgttcggtagtaataaaaagatgacgattaagtatttttacgttttcgttagagggatatttaaaagttttcgtacgtataagattatttttatcgcgggagaggcggaggttcgcgcgggtgttgggatttagatcgggggattcgggtagcggatgtaggttttatttttttcgtcgttttggtttgcgttggattcggcgttcggttatttttgcgcgtcgttttcggttttcgtcgttttttttttttcggagttcgaattttggttgaagtttattcgttgggttagacgcgttagattttgcgatatggatagcgggggtaggtacgtttcggtgttatttaggtttattttatggatttgtttttcgtaggtcgattcgatgttgattcgtattgcgcgtatttcggatatgttggttgcgtcggttagcggtgggaggattttttacgagttaaaaaacgaggtacgaagaggaggtttttttgcggagagtcgggaatttagaagttcgtagtcgcggtgttttagaagattttcgggaaatcgaacgtaacgtttagattggaaataaaggagttggtttagtaatttttttagaacgtatcgtaagtttttttttcggtaagtttttcggagtaaaattgggtaggcgcggaagttttagggttttttagagcgttttcggtgaattacggtgtagggtggggtaaattttcgggtttataagaggcgtggtcggt

SEQ ID NO: 38192 - DNA, 761 bp, Artificial Sequence
  chemically treated genomic DNA (Homo sapiens) CpG-island No: 38192
accgaccacgcctcttataaacccgaaaatttaccccaccctacaccgtaattcaccgaaaacgctctaaaaaaccctaaaacttccgcgcctacccaattttactccgaaaaacttaccgaaaaaaaaacttacgatacgttctaaaaaaattactaaaccaactcctttatttccaatctaaacgttacgttcgatttcccgaaaatcttctaaaacaccgcgactacgaacttctaaattcccgactctccgcaaaaaaacctcctcttcgtacctcgttttttaactcgtaaaaaatcctcccaccgctaaccgacgcaaccaacatatccgaaatacgcgcaatacgaatcaacatcgaatcgacctacgaaaaacaaatccataaaataaacctaaataacaccgaaacgtacctacccccgctatccatatcgcaaaatctaacgcgtctaacccaacgaataaacttcaaccaaaattcgaactccgaaaaaaaaaaaacgacgaaaaccgaaaacgacgcgcaaaaataaccgaacgccgaatccaacgcaaaccaaaacgacgaaaaaaataaaacctacatccgctacccgaatcccccgatctaaatcccaacacccgcgcgaacctccgcctctcccgcgataaaaataatcttatacgtacgaaaacttttaaatatccctctaacgaaaacgtaaaaatacttaatcgtcatctttttattactaccgaacaaaataaaacacgac

SEQ ID NO: 38193 - DNA, 1088 bp, Artificial Sequence
  chemically treated genomic DNA (Homo sapiens) CpG-island No: 38193
cgcgttttcgtgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaacgtttcgcgcgtttttacgttaataggtcggaaaggtagatagaagggaaaacgtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaacgtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttacgttaataggtcggaaaggtagatagaagggaaaaggtttcgcgcgtttttatgttaataggtcggaaaggaagatagaagggaaaacgtttcgcgtgtttttatgttaagaggtcggaaaggtagatagaagggaaaaggtttcgcgcgtttttgtgtttagaggtcggaaaggtagatagaagggaaaaggttttgcgcgtttttgtgttttgttacggggttggggtgtgtagttagggtttt

SEQ ID NO: 38194 - DNA, 1088 bp, Artificial Sequence
  chemically treated genomic DNA (Homo sapiens) CpG-island No: 38194
aaaaccctaactacacaccccaaccccgtaacaaaacacaaaaacgcgcaaaaccttttcccttctatctacctttccgacctctaaacacaaaaacgcgcgaaaccttttcccttctatctacctttccgacctcttaacataaaaacacgcgaaacgttttcccttctatcttcctttccgacctattaacataaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaacgttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaacgttttcccttctatctacctttccgacctattaacgtaaaaacgcgcgaaacgttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacgtaaaaacgcgcgaaaccttttcccttctatctacctttccgacctattaacacgaaaacgcg

SEQ ID NO: 38195 - DNA, 1088 bp, Artificial Sequence
  chemically treated genomic DNA (Homo sapiens) CpG-island No: 38195
aaaattttgattgtatattttagtttcgtaatagaatatagaaacgcgtagggtttttttttttttgtttgttttttcggtttttggatatagaaacgcgcggggtttttttttttttgtttgttttttcggttttttgatatggaaatacgcggagcgtttttttttttgttttttttttcggtttgttgatatggaaacgcgcggagtttttttttttttgtttgttttttcggtttgttgacgtggaaacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggcgtttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggcgtttttttttttgtttgttttttcggtttgttgacgtggagacgcgcggggcgtttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgacgtggagacgcgcggggtttttttttttttgtttgttttttcggtttgttgatacggagacgcg

SEQ ID NO: 38196 - DNA, 1088 bp, Artificial Sequence
  chemically treated genomic DNA (Homo sapiens) CpG-island No: 38196
cgcgtctccgtatcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaacgccccgcgcgtctccacgtcaacaaaccgaaaaaacaaacaaaaaaaaaaacgccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaacgccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtctccacgtcaacaaaccgaaaaaacaaacaaaaaaaaaaaaaccccgcgcgtttccacgtcaacaaaccgaaaaaacaaacaaaaaaaaaaaaactccgcgcgtttccatatcaacaaaccgaaaaaaaaaacaaaaaaaaaaacgctccgcgtatttccatatcaaaaaaccgaaaaaacaaacaaaaaaaaaaaaaccccgcgcgtttctatatccaaaaaccgaaaaaacaaacaaaaaaaaaaaaaccctacgcgtttctatattctattacgaaactaaaatatacaatcaaaatttt

SEQ ID NO: 38197 - DNA, 516 bp, Artificial Sequence
  chemically treated genomic DNA (Homo sapiens) CpG-island No: 38197
aggggtcgttgtaggaaacgtttggtttttttttttcgttattttttgattacgtaaagttattgttcggagttacgatggtagcgttagtggtagttgtagttcggaggttgcggcgggttattcgaaggtcgttcgtatggcggggttttagttatcggtcgtttttatcggagttttttgtagttaaggtttcggtcgtgagggtcgtttttttgaatttttttcgggatcgttatggttatcggttggtgtttttcgttttcgtgcggtttcgcggcgattttagtttgttttttgttaatgcgggtatgaattaggtgagagtcgaattatattgatagggagcggagttcgtgagttttttggtgagaaagacgttgtaggattgggtaaaagaagcgagaggcggagttcgtagtttttggggaaagagggcggtgtttggttgggtaaagtgatgggggtacggcgtttagagtatagggagggtttggggagggtttgagttgggaa

SEQ ID NO: 38198 - DNA, 516 bp, Artificial Sequence
  chemically treated genomic DNA (Homo sapiens) CpG-island No: 38198
ttcccaactcaaaccctccccaaaccctccctatactctaaacgccgtacccccatcactttacccaaccaaacaccgccctctttccccaaaaactacgaactccgcctctcgcttcttttacccaatcctacaacgtctttctcaccaaaaaactcacgaactccgctccctatcaatataattcgactctcacctaattcatacccgcattaacaaaaaacaaactaaaatcgccgcgaaaccgcacgaaaacgaaaaacaccaaccgataaccataacgatcccgaaaaaaattcaaaaaaacgaccctcacgaccgaaaccttaactacaaaaaactccgataaaaacgaccgataactaaaaccccgccatacgaacgaccttcgaataacccgccgcaacctccgaactacaactaccactaacgctaccatcgtaactccgaacaataactttacgtaatcaaaaaataacgaaaaaaaaaaaccaaacgtttcctacaacgacccct

SEQ ID NO: 38199 - DNA, 516 bp, Artificial Sequence
  chemically treated genomic DNA (Homo sapiens) CpG-island No: 38199
tttttagtttaagttttttttaagttttttttatattttgagcgtcgtatttttattattttatttaattaagtatcgttttttttttttaaaagttacgaatttcgtttttcgttttttttgtttaattttgtagcgttttttttattagaaaatttacgaatttcgttttttattagtatggttcggtttttatttggtttatgttcgtattgataaaaagtaaattggggtcgtcgcggggtcgtacggaagcggagggtattagtcggtggttatggcggtttcgaaagaagtttagaaaggcggtttttacggtcgaggttttggttgtagggggtttcgatgagagcggtcgatggttgaggtttcgttatgcgggcgattttcgaatggttcgtcgtagttttcgggttgtagttgttattgacgttgttatcgtagtttcgggtagtgattttacgtggttaaagagtgacgagggaaggaagttaggcgttttttatagcggttttt

SEQ ID NO: 38200 - DNA, 516 bp, Artificial Sequence
  chemically treated genomic DNA (Homo sapiens) CpG-island No: 38200
aaaaaccgctataaaaaacgcctaacttccttccctcgtcactctttaaccacgtaaaatcactacccgaaactacgataacaacgtcaataacaactacaacccgaaaactacgacgaaccattcgaaaatcgcccgcataacgaaacctcaaccatcgaccgctctcatcgaaaccccctacaaccaaaacctcgaccgtaaaaaccgcctttctaaacttctttcgaaaccgccataaccaccgactaataccctccgcttccgtacgaccccgcgacgaccccaatttactttttatcaatacgaacataaaccaaataaaaaccgaaccatactaataaaaaacgaaattcgtaaattttctaataaaaaaaacgctacaaaattaaacaaaaaaaacgaaaaacgaaattcgtaacttttaaaaaaaaaaaacgatacttaattaaataaaataataaaaatacgacgctcaaaatataaaaaaaacttaaaaaaaacttaaactaaaaa

SEQ ID NO: 38201 - DNA, 571 bp, Artificial Sequence
  chemically treated genomic DNA (Homo sapiens) CpG-island No: 38201
ttcgagggttcggaggttggagtcgaggtggattcgggtagggagcgtagagagcgtagagatttaatgttagagtcgtattggttttttttcgtttcgttcggtttttttcgcgttttcgatatgttcgcggttttggtcggtcggggttcggtttgagtaggattcggttttaggtttcgtcgcgtcgttttttcgggttgcgggttcgtttggtagagcgggcgttcggttcgcggcggtttttttttcgggttgtggggtttcgaggggtcggcgcgtagcgaggataaggttcggagcgttggttaggtttatttagcggttattgtgggtagtcgaatcgtttaagcgggttttttttttcgtttcgttttttcggattaatagggtcgttttacgcggatggtttcgtttttttttcgttttcggcgggcgttttcggaaagaggtttcgttttttcggaattttttttttcgggttttgcgtaggtttggagtttgtggttttcgggttttgatttattttttcgttgatttatttatttatttatttatttatttatttatt

SEQ ID NO: 38202 - DNA, 571 bp, Artificial Sequence
  chemically treated genomic DNA (Homo sapiens) CpG-island No: 38202
aataaataaataaataaataaataaataaataaatcaacgaaaaaataaatcaaaacccgaaaaccacaaactccaaacctacgcaaaacccgaaaaaaaaaattccgaaaaaacgaaacctctttccgaaaacgcccgccgaaaacgaaaaaaaaacgaaaccatccgcgtaaaacgaccctattaatccgaaaaaacgaaacgaaaaaaaaaacccgcttaaacgattcgactacccacaataaccgctaaataaacctaaccaacgctccgaaccttatcctcgctacgcgccgacccctcgaaaccccacaacccgaaaaaaaaaccgccgcgaaccgaacgcccgctctaccaaacgaacccgcaacccgaaaaaacgacgcgacgaaacctaaaaccgaatcctactcaaaccgaaccccgaccgaccaaaaccgcgaacatatcgaaaacgcgaaaaaaaccgaacgaaacgaaaaaaaaccaatacgactctaacattaaatctctacgctctctacgctccctacccgaatccacctcgactccaacctccgaaccctcgaa

SEQ ID NO: 38203 - DNA, 571 bp, Artificial Sequence
  chemically treated genomic DNA (Homo sapiens) CpG-island No: 38203
agtgaatgaatgaatgaatgaatgagtgaatgaattaacgaaggagtgagttaaggttcgggaattatagattttaagtttacgtagagttcgggaagggggatttcggaggggcggggttttttttcggaagcgttcgtcgggggcggggagggggcggggttattcgcgtgaggcgattttgttggttcggaggggcggggcgaggaggaggattcgtttgggcggttcggttgtttatagtaatcgttgggtggatttggttagcgtttcgaattttgttttcgttgcgcgtcggtttttcggagttttatagttcgggaaggaggtcgtcgcgggtcgggcgttcgttttgttaagcggattcgtaattcggaaaggcggcgcggcggagtttggagtcggattttgtttagatcgggtttcggtcggttagagtcgcgggtatgtcggaggcgcggaaggggtcggacgaggcggaggagagttagtacgattttggtattgagtttttgcgttttttgcgttttttattcgagtttatttcggttttagttttcgggttttcgga

SEQ ID NO: 38204 - DNA, 571 bp, Artificial Sequence
  chemically treated genomic DNA (Homo sapiens) CpG-island No: 38204
tccgaaaacccgaaaactaaaaccgaaataaactcgaataaaaaacgcaaaaaacgcaaaaactcaataccaaaatcgtactaactctcctccgcctcgtccgaccccttccgcgcctccgacatacccgcgactctaaccgaccgaaacccgatctaaacaaaatccgactccaaactccgccgcgccgcctttccgaattacgaatccgcttaacaaaacgaacgcccgacccgcgacgacctccttcccgaactataaaactccgaaaaaccgacgcgcaacgaaaacaaaattcgaaacgctaaccaaatccacccaacgattactataaacaaccgaaccgcccaaacgaatcctcctcctcgccccgcccctccgaaccaacaaaatcgcctcacgcgaataaccccgccccctccccgcccccgacgaacgcttccgaaaaaaaaccccgcccctccgaaatcccccttcccgaactctacgtaaacttaaaatctataattcccgaaccttaactcactccttcgttaattcattcactcattcattcattcattcattcact

SEQ ID NO: 38205 - DNA, 537 bp, Artificial Sequence
  chemically treated genomic DNA (Homo sapiens) CpG-island No: 38205
aggaatttcgcggtcgattatttggtatagattatttaggatagttaggacggttataattttagcgaggacgtaaacgtttgtttgtagttggtgatgtggaaggttcgatagcgcgtttagatttagttacgttatcggttcgtttttttcgtcgttttggtttgtttttagttttaggttttttttaaaatcgttattagtttcgagagtttattttgtttatttcgtcgtaaagcgaaagaaattggagtagtcggcggtaggagagggtaaaaagttaagagtaattttaattttcgattttcggtatttcggaatttttgtcgcggtttttcgggtttgtttatatatttttgttttttttagatttttgtttttttattaatcgtttttcgtagtttcgagtcgttatttttagtttttcgagtttttgtcgcgcgttttcgcgtttgtttatatttttttgtttattcgagatttttgtttttatattattagttattttacgtgggatttttatggtttttgagtata

SEQ ID NO: 38206 - DNA, 537 bp, Artificial Sequence
  chemically treated genomic DNA (Homo sapiens) CpG-island No: 38206
tatactcaaaaaccataaaaatcccacgtaaaataactaataatataaaaacaaaaatctcgaataaacaaaaaaatataaacaaacgcgaaaacgcgcgacaaaaactcgaaaaactaaaaataacgactcgaaactacgaaaaacgattaataaaaaaacaaaaatctaaaaaaaacaaaaatatataaacaaacccgaaaaaccgcgacaaaaattccgaaataccgaaaatcgaaaattaaaattactcttaactttttaccctctcctaccgccgactactccaatttctttcgctttacgacgaaataaacaaaataaactctcgaaactaataacgattttaaaaaaaacctaaaactaaaaacaaaccaaaacgacgaaaaaaacgaaccgataacgtaactaaatctaaacgcgctatcgaaccttccacatcaccaactacaaacaaacgtttacgtcctcgctaaaattataaccgtcctaactatcctaaataatctataccaaataatcgaccgcgaaattcct

SEQ ID NO: 38207 - DNA, 537 bp, Artificial Sequence
  chemically treated genomic DNA (Homo sapiens) CpG-island No: 38207
tgtatttagaagttatggaagttttacgtggggtggttagtggtgtaaggatagaggtttcggatgggtagagggatgtggataggcgcgagggcgcgcggtagggattcgggggattgggagtggcggttcggggttgcgggaggcgattggtggaaggatagaggtttgggaggggtagaggtatgtggataggttcgaggggtcgcggtagggatttcggggtatcgggagtcgggggttggggttatttttggttttttgtttttttttgtcgtcggttgttttagtttttttcgttttgcggcgaggtgggtagggtgagttttcgggattgatggcggttttggaagaggtttggggttaaggataggttagggcggcgggagaggcggatcggtggcgtggttggatttgggcgcgttgtcggattttttatattattagttgtaggtaggcgtttgcgttttcgttggagttgtggtcgttttggttgttttggatgatttgtgttaggtagtcggtcgcgagattttt

SEQ ID NO: 38208 - DNA, 537 bp, Artificial Sequence
  chemically treated genomic DNA (Homo sapiens) CpG-island No: 38208
aaaaatctcgcgaccgactacctaacacaaatcatccaaaacaaccaaaacgaccacaactccaacgaaaacgcaaacgcctacctacaactaataatataaaaaatccgacaacgcgcccaaatccaaccacgccaccgatccgcctctcccgccgccctaacctatccttaaccccaaacctcttccaaaaccgccatcaatcccgaaaactcaccctacccacctcgccgcaaaacgaaaaaaactaaaacaaccgacgacaaaaaaaaacaaaaaaccaaaaataaccccaacccccgactcccgataccccgaaatccctaccgcgacccctcgaacctatccacatacctctacccctcccaaacctctatccttccaccaatcgcctcccgcaaccccgaaccgccactcccaatcccccgaatccctaccgcgcgccctcgcgcctatccacatccctctacccatccgaaacctctatccttacaccactaaccaccccacgtaaaacttccataacttctaaataca

SEQ ID NO: 38209 - DNA, 515 bp, Artificial Sequence
  chemically treated genomic DNA (Homo sapiens) CpG-island No: 38209
tttacggacgtttttagatgtttttattttacggacgtttttagatatttttaattttacggacgtttttagatacgtttattttacggacgtttttagatatttttaattttacggacgtttttagatatttttattttacggacgtttttagatacgtttattttacggacgtttttagatatttttaattttacggacgtttttagatatttttattttacggacgtttttagatacgtttattttacggacgtttttagatatttttaattttacggacgtttttagatatttttattttacggatgtttttagatgtttttaattttacggacgtttttagatgtttttaattttacggacgtttttagatatttttattttacggacgtttttagatgtttttaattttacggacgtttttagatatttttattttacggatgtttttagatgtttttaattttacggacgtttttagatgtttttaattttacgggcgtttttagatg

SEQ ID NO: 38210 - DNA, 515 bp, Artificial Sequence
  chemically treated genomic DNA (Homo sapiens) CpG-island No: 38210
catctaaaaacgcccgtaaaattaaaaacatctaaaaacgtccgtaaaattaaaaacatctaaaaacatccgtaaaataaaaatatctaaaaacgtccgtaaaattaaaaacatctaaaaacgtccgtaaaataaaaatatctaaaaacgtccgtaaaattaaaaacatctaaaaacgtccgtaaaattaaaaacatctaaaaacatccgtaaaataaaaatatctaaaaacgtccgtaaaattaaaaatatctaaaaacgtccgtaaaataaacgtatctaaaaacgtccgtaaaataaaaatatctaaaaacgtccgtaaaattaaaaatatctaaaaacgtccgtaaaataaacgtatctaaaaacgtccgtaaaataaaaatatctaaaaacgtccgtaaaattaaaaatatctaaaaacgtccgtaaaataaacgtatctaaaaacgtccgtaaaattaaaaatatctaaaaacgtccgtaaaataaaaacatctaaaaacgtccgtaaa

SEQ ID NO: 38211 - DNA, 515 bp, Artificial Sequence
  chemically treated genomic DNA (Homo sapiens) CpG-island No: 38211
tatttgggagcgttcgtggggttgggggtatttgggagcgttcgtggggttgggggtatttgggagtattcgtggggtgggggtatttgggagcgttcgtggggttgggggtatttgggagcgttcgtggggtgggggtatttgggagcgttcgtggggttgggggtatttgggagcgttcgtggggttgggggtatttgggagtattcgtggggtgggggtatttgggagcgttcgtggggttgggggtatttgggagcgttcgtggggtgggcgtatttgggagcgttcgtggggtgggggtatttgggagcgttcgtggggttgggggtatttgggagcgttcgtggggtgggcgtatttgggagcgttcgtggggtgggggtatttgggagcgttcgtggggttgggggtatttgggagcgttcgtggggtgggcgtatttgggagcgttcgtggggttgggggtatttgggagcgttcgtggggtgggggtatttgggagcgttcgtggg

SEQ ID NO: 38212 - DNA, 515 bp, Artificial Sequence
  chemically treated genomic DNA (Homo sapiens) CpG-island No: 38212
cccacgaacgctcccaaatacccccaccccacgaacgctcccaaatacccccaaccccacgaacgctcccaaatacgcccaccccacgaacgctcccaaatacccccaaccccacgaacgctcccaaatacccccaccccacgaacgctcccaaatacgcccaccccacgaacgctcccaaatacccccaaccccacgaacgctcccaaatacccccaccccacgaacgctcccaaatacgcccaccccacgaacgctcccaaatacccccaaccccacgaacgctcccaaatacccccaccccacgaatactcccaaatacccccaaccccacgaacgctcccaaatacccccaaccccacgaacgctcccaaatacccccaccccacgaacgctcccaaatacccccaaccccacgaacgctcccaaatacccccaccccacgaatactcccaaatacccccaaccccacgaacgctcccaaatacccccaaccccacgaacgctcccaaata

SEQ ID NO: 38213 - DNA, 549 bp, Artificial Sequence
  chemically treated genomic DNA (Homo sapiens) CpG-island No: 38213
agggcgggggcgcggaggtttggggtgggggtcgtagggggttggaaggaagtgcgtagtgtggcgagagcgcgaataaagtttttttcggagtttcgttatttttcggtgattttaggttcgtttcgttgagtcgcgggttttcgggtttcgttttcgagtaggtcgtatcgttcggtgggcgtacgttaggttttcgcggtcgttcgggttagtgtttttttcggttttcgtagtcgagttcgcggtcggtttcgaaggcgcgagggatagcgcggtcggcggtggagttttatttaggtacggagtttatagagcgaggttgaggaggattttatgttgttgttcgtcgggaaatcggattattttggggcgcgttggagttattattttgttagtagtcggggaggggtcgcgagggtttttaagtggacggaagtaggcgattaatttcgtcgcgatttttgttttttagagaagggttttggttgaggaggcggcgggaggggattgttgtaaatagttgttttttatatatattttattata

SEQ ID NO: 38214 - DNA, 549 bp, Artificial Sequence
  chemically treated genomic DNA (Homo sapiens) CpG-island No: 38214
tataataaaatatatataaaaaacaactatttacaacaatcccctcccgccgcctcctcaaccaaaacccttctctaaaaaacaaaaatcgcgacgaaattaatcgcctacttccgtccacttaaaaaccctcgcgacccctccccgactactaacaaaataataactccaacgcgccccaaaataatccgatttcccgacgaacaacaacataaaatcctcctcaacctcgctctataaactccgtacctaaataaaactccaccgccgaccgcgctatccctcgcgccttcgaaaccgaccgcgaactcgactacgaaaaccgaaaaaaacactaacccgaacgaccgcgaaaacctaacgtacgcccaccgaacgatacgacctactcgaaaacgaaacccgaaaacccgcgactcaacgaaacgaacctaaaatcaccgaaaaataacgaaactccgaaaaaaactttattcgcgctctcgccacactacgcacttccttccaaccccctacgacccccaccccaaacctccgcgcccccgccct

SEQ ID NO: 38215 - DNA, 549 bp, Artificial Sequence
  chemically treated genomic DNA (Homo sapiens) CpG-island No: 38215
tgtaatgaaatatgtatgaggaatagttgtttgtaatagttttttttcgtcgtttttttagttaaggtttttttttaggaagtaggagtcgcggcgaagttggtcgtttattttcgtttatttgggagttttcgcggttttttttcggttgttggtagaatggtggttttagcgcgttttagagtagttcggtttttcgacggataatagtatggagttttttttagtttcgttttgtgggtttcgtgtttgagtgaggttttatcgtcggtcgcgttgtttttcgcgttttcggggtcggtcgcgggttcggttgcggggatcgaggggagtattggttcgggcggtcgcggaggtttgacgtgcgtttatcgggcggtgcggtttgttcggaggcgaggttcgggagttcgcggtttagcggggcgggtttggggttatcgaggggtgacggggtttcggagagggttttgttcgcgttttcgttatattgcgtatttttttttagttttttgcggtttttattttaaattttcgcgttttcgtttt

SEQ ID NO: 38216 - DNA, 549 bp, Artificial Sequence
  chemically treated genomic DNA (Homo sapiens) CpG-island No: 38216
aaaacgaaaacgcgaaaatttaaaataaaaaccgcaaaaaactaaaaaaaaatacgcaatataacgaaaacgcgaacaaaaccctctccgaaaccccgtcacccctcgataaccccaaacccgccccgctaaaccgcgaactcccgaacctcgcctccgaacaaaccgcaccgcccgataaacgcacgtcaaacctccgcgaccgcccgaaccaatactcccctcgatccccgcaaccgaacccgcgaccgaccccgaaaacgcgaaaaacaacgcgaccgacgataaaacctcactcaaacacgaaacccacaaaacgaaactaaaaaaaactccatactattatccgtcgaaaaaccgaactactctaaaacgcgctaaaaccaccattctaccaacaaccgaaaaaaaaccgcgaaaactcccaaataaacgaaaataaacgaccaacttcgccgcgactcctacttcctaaaaaaaaaccttaactaaaaaaacgacgaaaaaaaactattacaaacaactattcctcatacatatttcattaca

SEQ ID NO: 38217 - DNA, 609 bp, Artificial Sequence
  chemically treated genomic DNA (Homo sapiens) CpG-island No: 38217
ttcggttgcggggtttttgcgttagatcggattgtcgtttgcgggcgattggcggcgttgaacgggcggtttgcggcgggcgcgtttgtgttgggttcggggtggttggtggttttcgcgggtgttgtgcgtcggaggatggtggggttttttggtcgcgtcgtgttcgtcgtttttcgcggttcgttttttcgttcgttcgttgggttcgttgttcgggtttgttttgttgtgtcggtgtgttttcgtcgcgttttgcgtttgttttcgtgtcggggggttttttttgcgcggcgttttgcgcgcggttttcgtgttgtcgcgggcgttttttcgttgcgtcgtcgttttttggttttttttttgttttcggttcgggggcggttttttcgcggcggggttgttttttgggggggtgtttttcggtgggcggcgttcgtgttttcgtgtcgtcgtgttttgtgttttggtgtgcgtcgggtgttttgttgtcgtcgcggcggtttgttcggttcgcgtcgcgcgttgttgggttgtcgtttttttgttttgtgtttcgtcgtcgcgcgttcgtgttcgcgtcgttttgttcggtgttgtgtttgtgtg

SEQ ID NO: 38218 - DNA, 609 bp, Artificial Sequence
  chemically treated genomic DNA (Homo sapiens) CpG-island No: 38218
cacacaaacacaacaccgaacaaaacgacgcgaacacgaacgcgcgacgacgaaacacaaaacaaaaaaacgacaacccaacaacgcgcgacgcgaaccgaacaaaccgccgcgacgacaacaaaacacccgacgcacaccaaaacacaaaacacgacgacacgaaaacacgaacgccgcccaccgaaaaacacccccccaaaaaacaaccccgccgcgaaaaaaccgcccccgaaccgaaaacaaaaaaaaaaccaaaaaacgacgacgcaacgaaaaaacgcccgcgacaacacgaaaaccgcgcgcaaaacgccgcgcaaaaaaaaccccccgacacgaaaacaaacgcaaaacgcgacgaaaacacaccgacacaacaaaacaaacccgaacaacgaacccaacgaacgaacgaaaaaacgaaccgcgaaaaacgacgaacacgacgcgaccaaaaaaccccaccatcctccgacgcacaacacccgcgaaaaccaccaaccaccccgaacccaacacaaacgcgcccgccgcaaaccgcccgttcaacgccgccaatcgcccgcaaacgacaatccgatctaacgcaaaaaccccgcaaccgaa

SEQ ID NO: 38219 - DNA, 609 bp, Artificial Sequence
  chemically treated genomic DNA (Homo sapiens) CpG-island No: 38219
tatatagatataatatcgaatagagcgacgcggatacgagcgcgcggcggcggggtataaaataaaaggacgataatttaatagcgcgcgacgcgaatcgagtaggtcgtcgcgacgatagtagggtattcgacgtatattaaagtataagatacgacggtacgagaatacgaacgtcgtttatcggggaatatttttttaaggaatagtttcgtcgcgagagagtcgttttcggatcggagataaaaaaagaattaggagacggcgacgtagcggggggacgttcgcgataatacgggagtcgcgcgtaaggcgtcgcgtagagagggtttttcggtacggaggtaagcgtagggcgcggcggagatatatcgatatagtaaggtaggttcgaataacggatttagcgagcgaacgggggaacgaatcgcggaaggcggcgagtacgacgcggttaagagattttattatttttcgacgtatagtattcgcgaaggttattagttatttcgggtttagtataagcgcgttcgtcgtagatcgttcgtttagcgtcgttaatcgttcgtaaacggtagttcggtttggcgtaaaggtttcgtagtcggg

SEQ ID NO: 38220 - DNA, 609 bp, Artificial Sequence
  chemically treated genomic DNA (Homo sapiens) CpG-island No: 38220
cccgactacgaaacctttacgccaaaccgaactaccgtttacgaacgattaacgacgctaaacgaacgatctacgacgaacgcgcttatactaaacccgaaataactaataaccttcgcgaatactatacgtcgaaaaataataaaatctcttaaccgcgtcgtactcgccgccttccgcgattcgttcccccgttcgctcgctaaatccgttattcgaacctaccttactatatcgatatatctccgccgcgccctacgcttacctccgtaccgaaaaaccctctctacgcgacgccttacgcgcgactcccgtattatcgcgaacgtccccccgctacgtcgccgtctcctaattctttttttatctccgatccgaaaacgactctctcgcgacgaaactattccttaaaaaaatattccccgataaacgacgttcgtattctcgtaccgtcgtatcttatactttaatatacgtcgaataccctactatcgtcgcgacgacctactcgattcgcgtcgcgcgctattaaattatcgtccttttattttataccccgccgccgcgcgctcgtatccgcgtcgctctattcgatattatatctatata

SEQ ID NO: 38221 - DNA, 659 bp, Artificial Sequence
  chemically treated genomic DNA (Homo sapiens) CpG-island No: 38221
gattcgtacgcgattaaaagtcgagcgtatatttttcgttttcgttttatttgttatcgtttatattaacgtgtatatatgttcgtgtaaacgcgtacgtacggaatcgcgcgtttttttatatttagtcgcgttttcggttcggtttagttaggtgtttttacgcggtagcgttcggtttgttcgtcggttttttgcgaatttttcgttttacgttcgtttgtttgcgcgtacgtacgcgtacgtacgtattttttacgttttcgcgcgggggcgtaggttttgggtggcggggtttggtcgggagtcggtcgggttagggagcggcgagtagagtttagggtgtatttcgcgtttggttttcgtgcgtagttttttcgcgcggaggtatttggttttttttcggttttagaacgcgaatagttggcgttgagtatataattttttttttttttttttcgagatttttgtatttttttcgcgcgttatttttcgttttttataataggttcgaagagtaaatttttaaacgcgtttagaagcggtttttaatttttcgtcgggagtacgttggaggttggatttcggagagattcgggattggggtttattgtcggttttttttggattcggtttgatttttatattttaagaagatt

SEQ ID NO: 38222 - DNA, 659 bp, Artificial Sequence
  chemically treated genomic DNA (Homo sapiens) CpG-island No: 38222
aatcttcttaaaatataaaaatcaaaccgaatccaaaaaaaaccgacaataaaccccaatcccgaatctctccgaaatccaacctccaacgtactcccgacgaaaaattaaaaaccgcttctaaacgcgtttaaaaatttactcttcgaacctattataaaaaacgaaaaataacgcgcgaaaaaaatacaaaaatctcgaaaaaaaaaaaaaaaaaattatatactcaacgccaactattcgcgttctaaaaccgaaaaaaaaccaaatacctccgcgcgaaaaaactacgcacgaaaaccaaacgcgaaatacaccctaaactctactcgccgctccctaacccgaccgactcccgaccaaaccccgccacccaaaacctacgcccccgcgcgaaaacgtaaaaaatacgtacgtacgcgtacgtacgcgcaaacaaacgaacgtaaaacgaaaaattcgcaaaaaaccgacgaacaaaccgaacgctaccgcgtaaaaacacctaactaaaccgaaccgaaaacgcgactaaatataaaaaaacgcgcgattccgtacgtacgcgtttacacgaacatatatacacgttaatataaacgataacaaataaaacgaaaacgaaaaatatacgctcgacttttaatcgcgtacgaatc

SEQ ID NO: 38223 - DNA, 659 bp, Artificial Sequence
  chemically treated genomic DNA (Homo sapiens) CpG-island No: 38223
aatttttttaaaatatgaaaattaagtcggatttaggaggggtcggtaatagattttaatttcgagttttttcgaaatttagtttttaacgtgttttcggcgaagagttgggagtcgtttttggacgcgtttgggggtttatttttcgggtttgttatgaggggcgggagatggcgcgcggggagggtataggggtttcgggggagaaggaggaggagttgtgtgtttaacgttaattgttcgcgttttagagtcgagagggagttaggtgttttcgcgcggggaggttgcgtacggaagttaagcgcgggatgtattttggattttgttcgtcgttttttggttcggtcggttttcggttaaatttcgttatttaaggtttgcgttttcgcgcgggggcgtggggaatgcgtgcgtgcgcgtgcgtgcgcgtaggtaggcgggcgtgaggcgaggggttcgtagggggtcggcgggtagatcgggcgttgtcgcgtgggggtatttggttgagtcgggtcgggagcgcggttgggtgtgagggggcgcgcggtttcgtgcgtgcgcgtttgtacgagtatgtgtgtacgttagtgtgagcgatggtaagtggggcgggggcgggaggtgtgcgttcggtttttggtcgcgtgcggatt

SEQ ID NO: 38224 - DNA, 659 bp, Artificial Sequence
  chemically treated genomic DNA (Homo sapiens) CpG-island No: 38224
aatccgcacgcgaccaaaaaccgaacgcacacctcccgcccccgccccacttaccatcgctcacactaacgtacacacatactcgtacaaacgcgcacgcacgaaaccgcgcgccccctcacacccaaccgcgctcccgacccgactcaaccaaatacccccacgcgacaacgcccgatctacccgccgaccccctacgaacccctcgcctcacgcccgcctacctacgcgcacgcacgcgcacgcacgcattccccacgcccccgcgcgaaaacgcaaaccttaaataacgaaatttaaccgaaaaccgaccgaaccaaaaaacgacgaacaaaatccaaaatacatcccgcgcttaacttccgtacgcaacctccccgcgcgaaaacacctaactccctctcgactctaaaacgcgaacaattaacgttaaacacacaactcctcctccttctcccccgaaacccctataccctccccgcgcgccatctcccgcccctcataacaaacccgaaaaataaacccccaaacgcgtccaaaaacgactcccaactcttcgccgaaaacacgttaaaaactaaatttcgaaaaaactcgaaattaaaatctattaccgacccctcctaaatccgacttaattttcatattttaaaaaaatt

SEQ ID NO: 38225 - DNA, 1014 bp, Artificial Sequence
  chemically treated genomic DNA (Homo sapiens) CpG-island No: 38225
agagtggagaggatcggcgaggcgcgttagtcggagttatttttttttcggtcgttttttttttattttttttatatatatacgttcgttcgttcgtcggcgcgcgtatatttttcgcgtcggattcgtatttcggcgggcgttatatattcggtagttcgagtcgcggtagtcgtagcgggatggaggcggcgcgtacggagcgtttcgtaggtaggtcgggggcgtcgtttgttcggacggggtttttatttttgtcgacgtgggttttggtcggcgtcgagattatttgggacgcgataggcggtttcggacgttcggcggtttcggtttcgcggttatcggcgttgtttttattttcgtcgcgggtagtggttagttagtggtcggaggagttggcgtcggcgcggagagtcgtcgtgttggggcgtcgggtcggattagagttgttgttttagtagggcggcggtagaggcggtgagatgtaggtggaagtcggagggatattatcggtaggcgagcggcggggtcggggtattttagtttttgttaagtttggcggcgcgaggaggagtcgtcgggcgtagtttttaattatttaggaacgcggggacgtttgggttattgtttcggtcgatggttttagaggaagtcgtttttttgttaagggttttcgggaggaggtgaaggcgtcgcgggttggggggtcggcggttgaagattttcggttgtttagtatttttttcgcgttgatcggggattcggtttataattaagttatggtgtattggtcgggatataatagtagcgtgagtatttattcggcggcgggttcgtttgttttttgatatcgaaggggaatgggggggtgggtgggagcgagggatagatagttgttcgggggtcgaggcgggggacgtttcgatttttcgagataataggtttgttcgattttttttacgtttttaataggttaacggagtttgttgttagacgttgtgtgtgtttgtttat

SEQ ID NO: 38226 - DNA, 1014 bp, Artificial Sequence
  chemically treated genomic DNA (Homo sapiens) CpG-island No: 38226
ataaacaaacacacacaacgtctaacaacaaactccgttaacctattaaaaacgtaaaaaaaatcgaacaaacctattatctcgaaaaatcgaaacgtcccccgcctcgacccccgaacaactatctatccctcgctcccacccacccccccattccccttcgatatcaaaaaacaaacgaacccgccgccgaataaatactcacgctactattatatcccgaccaatacaccataacttaattataaaccgaatccccgatcaacgcgaaaaaaatactaaacaaccgaaaatcttcaaccgccgaccccccaacccgcgacgccttcacctcctcccgaaaacccttaacaaaaaaacgacttcctctaaaaccatcgaccgaaacaataacccaaacgtccccgcgttcctaaataattaaaaactacgcccgacgactcctcctcgcgccgccaaacttaacaaaaactaaaataccccgaccccgccgctcgcctaccgataatatccctccgacttccacctacatctcaccgcctctaccgccgccctactaaaacaacaactctaatccgacccgacgccccaacacgacgactctccgcgccgacgccaactcctccgaccactaactaaccactacccgcgacgaaaataaaaacaacgccgataaccgcgaaaccgaaaccgccgaacgtccgaaaccgcctatcgcgtcccaaataatctcgacgccgaccaaaacccacgtcgacaaaaataaaaaccccgtccgaacaaacgacgcccccgacctacctacgaaacgctccgtacgcgccgcctccatcccgctacgactaccgcgactcgaactaccgaatatataacgcccgccgaaatacgaatccgacgcgaaaaatatacgcgcgccgacgaacgaacgaacgtatatatataaaaaaaataaaaaaaaaacgaccgaaaaaaaaataactccgactaacgcgcctcgccgatcctctccactct

SEQ ID NO: 38227 - DNA, 1014 bp, Artificial Sequence
  chemically treated genomic DNA (Homo sapiens) CpG-island No: 38227
gtaaataaatatatatagcgtttaataataaatttcgttaatttgttgggggcgtggggggaatcggataaatttgttatttcgaaaagtcgaggcgtttttcgtttcgattttcgagtaattatttgtttttcgtttttatttatttttttattttttttcggtgttaggaaataggcggattcgtcgtcgggtgggtatttacgttgttgttgtgtttcgattagtgtattatggtttggttgtgggtcgagttttcggttagcgcgaaggaggtgttgggtagtcggaggtttttagtcgtcgattttttagttcgcggcgtttttattttttttcgggaatttttagtaaggggacggttttttttggaattatcggtcggagtagtggtttaggcgttttcgcgtttttgggtgattgggggttgcgttcggcgattttttttcgcgtcgttaagtttggtaggagttgggatgtttcggtttcgtcgttcgtttgtcggtgatgttttttcggtttttatttgtattttatcgtttttgtcgtcgttttgttggggtagtagttttggttcggttcggcgttttagtacggcggtttttcgcgtcgacgttagttttttcggttattggttggttattgttcgcggcgagagtggagataacgtcggtggtcgcgaagtcggggtcgtcgggcgttcgggatcgtttgtcgcgttttaagtgatttcggcgtcggttaggatttacgtcgataagagtaggagtttcgttcggataagcggcgttttcggtttgtttgcggggcgtttcgtgcgcgtcgtttttatttcgttgcggttatcgcggttcgggttgtcgagtgtgtggcgttcgtcgaggtgcgggttcggcgcggggggtgtgcgcgcgtcggcgagcgagcgagcgtgtgtgtgtagggggagtggggagggggcggtcgggaaggaggtggtttcggttggcgcgtttcgtcggttttttttatttt

SEQ ID NO: 38228 - DNA, 1014 bp, Artificial Sequence
  chemically treated genomic DNA (Homo sapiens) CpG-island No: 38228
aaaataaaaaaaaccgacgaaacgcgccaaccgaaaccacctccttcccgaccgccccctccccactccccctacacacacacgctcgctcgctcgccgacgcgcgcacaccccccgcgccgaacccgcacctcgacgaacgccacacactcgacaacccgaaccgcgataaccgcaacgaaataaaaacgacgcgcacgaaacgccccgcaaacaaaccgaaaacgccgcttatccgaacgaaactcctactcttatcgacgtaaatcctaaccgacgccgaaatcacttaaaacgcgacaaacgatcccgaacgcccgacgaccccgacttcgcgaccaccgacgttatctccactctcgccgcgaacaataaccaaccaataaccgaaaaaactaacgtcgacgcgaaaaaccgccgtactaaaacgccgaaccgaaccaaaactactaccccaacaaaacgacgacaaaaacgataaaatacaaataaaaaccgaaaaaacatcaccgacaaacgaacgacgaaaccgaaacatcccaactcctaccaaacttaacgacgcgaaaaaaaatcgccgaacgcaacccccaatcacccaaaaacgcgaaaacgcctaaaccactactccgaccgataattccaaaaaaaaccgtccccttactaaaaattcccgaaaaaaaataaaaacgccgcgaactaaaaaatcgacgactaaaaacctccgactacccaacacctccttcgcgctaaccgaaaactcgacccacaaccaaaccataatacactaatcgaaacacaacaacaacgtaaatacccacccgacgacgaatccgcctatttcctaacaccgaaaaaaaataaaaaaataaataaaaacgaaaaacaaataattactcgaaaatcgaaacgaaaaacgcctcgacttttcgaaataacaaatttatccgattccccccacgcccccaacaaattaacgaaatttattattaaacgctatatatatttatttac

SEQ ID NO: 38229 - DNA, 508 bp, Artificial Sequence
  chemically treated genomic DNA (Homo sapiens) CpG-island No: 38229
ggaaacggggggatgggggcggcgagcgggataaataaagaaaaaaaggggagggcgagggaagagagaggaggcggggcgggagaacggcggtaaagcgcggcgcggcgcggagggaggggggtcgcggaaaaagggatagagaaataaaatcgcggcgcgggggggcgagagaataaggcgcgttaaaattaatttggggggagggcgggggtatagtatatagggcggacggaatggggggacggtggggaaaggtagggtagggatttatgatggaaaataggggggacgtgaagcgatttaaacggcgtgggaggcgtgcgggttaaatatttttttaattgagtttatatagcggcggttcggtatcggtgtaggaataggcggaaaattgttggtcggggttcgtttcgggttgagcgcgggtatttaaaaagttggggtagtgtttgttgaattggcggtgtgaaaatgggttaggtgaggattttgttaataattatta

SEQ ID NO: 38230 - DNA, 508 bp, Artificial Sequence
  chemically treated genomic DNA (Homo sapiens) CpG-island No: 38230
taataattattaacaaaatcctcacctaacccattttcacaccgccaattcaacaaacactaccccaactttttaaatacccgcgctcaacccgaaacgaaccccgaccaacaattttccgcctattcctacaccgataccgaaccgccgctatataaactcaattaaaaaaatatttaacccgcacgcctcccacgccgtttaaatcgcttcacgtcccccctattttccatcataaatccctaccctacctttccccaccgtccccccattccgtccgccctatatactatacccccgccctccccccaaattaattttaacgcgccttattctctcgcccccccgcgccgcgattttatttctctatccctttttccgcgacccccctccctccgcgccgcgccgcgctttaccgccgttctcccgccccgcctcctctctcttccctcgccctcccctttttttctttatttatcccgctcgccgcccccatccccccgtttcc

SEQ ID NO: 38231 - DNA, 508 bp, Artificial Sequence
  chemically treated genomic DNA (Homo sapiens) CpG-island No: 38231
tggtgattgttaataagatttttatttggtttatttttatatcgttaatttaataagtattgttttagttttttgggtattcgcgtttagttcggagcggatttcggttagtagtttttcgtttatttttgtatcgatgtcgagtcgtcgttgtatgggtttagttaggagagtatttagttcgtacgttttttacgtcgtttagatcgttttacgttttttttgttttttattatgaatttttattttatttttttttatcgtttttttatttcgttcgttttgtgtattgtattttcgttttttttttaggttagttttagcgcgttttgttttttcgttttttcgcgtcgcggttttatttttttgttttttttttcgcggttttttttttttcgcgtcgcgtcgcgttttgtcgtcgttttttcgtttcgtttttttttttttttttcgtttttttttttttttttttatttatttcgttcgtcgtttttattttttcgttttt

SEQ ID NO: 38232 - DNA, 508 bp, Artificial Sequence
  chemically treated genomic DNA (Homo sapiens) CpG-island No: 38232
aaaaacgaaaaaataaaaacgacgaacgaaataaataaaaaaaaaaaaaaaaaaacgaaaaaaaaaaaaaaaaacgaaacgaaaaaacgacgacaaaacgcgacgcgacgcgaaaaaaaaaaaaccgcgaaaaaaaaaacaaaaaaataaaaccgcgacgcgaaaaaacgaaaaaacaaaacgcgctaaaactaacctaaaaaaaaaacgaaaatacaatacacaaaacgaacgaaataaaaaaacgataaaaaaaaataaaataaaaattcataataaaaaacaaaaaaaacgtaaaacgatctaaacgacgtaaaaaacgtacgaactaaatactctcctaactaaacccatacaacgacgactcgacatcgatacaaaaataaacgaaaaactactaaccgaaatccgctccgaactaaacgcgaatacccaaaaaactaaaacaatacttattaaattaacgatataaaaataaaccaaataaaaatcttattaacaatcacca

SEQ ID NO: 38233 - DNA, 603 bp, Artificial Sequence
  chemically treated genomic DNA (Homo sapiens) CpG-island No: 38233
tttttcgattttcgtttttcgttcgttttttttaattcgcgtcgttcgttttttcgtttttttttttttgtttatattagtattcgcgtcgttttcgttttttgttttattgttgtcgtatgcgacgtttttttttatattttttttttatttcggtttttttttcgttttttttttttttattatttttcgtttttttcgtttttttcgttttttttttatttattttttattttgttttttttttcgttttttattttttattgaattcgtcgtatcgtttcgtatttttttcgggtttcgtattttttttttttttcgttttcgtcgttatttttttttttcgtttttttcgtattttgtttttttttttttttttttcgcgtttttcgttttttttttttatttgtttttcgttttttttttttttttcgttttcgtttttttggtgtttttcgtttgcgttttttttattttttttttttttttttttatttttttttattatttttcgtttttttttttattcgttgtttattcgtgtgtttatttgtttttcgtttgtttttaacgtatttttttgttcgttaggtttatttttat

SEQ ID NO: 38234 - DNA, 603 bp, Artificial Sequence
  chemically treated genomic DNA (Homo sapiens) CpG-island No: 38234
ataaaaataaacctaacgaacaaaaaaatacgttaaaaacaaacgaaaaacaaataaacacacgaataaacaacgaataaaaaaaaaaacgaaaaataataaaaaaaaataaaaaaaaaaaaaaaaaaaataaaaaaaacgcaaacgaaaaacaccaaaaaaacgaaaacgaaaaaaaaaaaaaaaacgaaaaacaaataaaaaaaaaaaacgaaaaacgcgaaaaaaaaaaaaaaaaaaacaaaatacgaaaaaaacgaaaaaaaaaaataacgacgaaaacgaaaaaaaaaaaaaatacgaaacccgaaaaaaatacgaaacgatacgacgaattcaataaaaaataaaaaacgaaaaaaaaaacaaaataaaaaataaataaaaaaaaaacgaaaaaaacgaaaaaaacgaaaaataataaaaaaaaaaaaaacgaaaaaaaaaccgaaataaaaaaaaaatataaaaaaaaacgtcgcatacgacaacaataaaacaaaaaacgaaaacgacgcgaatactaatataaacaaaaaaaaaaaaacgaaaaaacgaacgacgcgaattaaaaaaaacgaacgaaaaacgaaaatcgaaaaa

SEQ ID NO: 38235 - DNA, 603 bp, Artificial Sequence
  chemically treated genomic DNA (Homo sapiens) CpG-island No: 38235
gtggggatagatttggcggatagaagggtgcgttagggataggcgggggataagtgggtatacgggtgaatagcgggtaaaaggaaaagcggggggtaatgggagggaatgggggggggagagggggggataagagggacgtaaacgggaaatattaggaaaacggggacggggggggggagaggggcggggggtaaatgaagggggggggcggggggcgcgggaggaagggaaggagaggtaggatacgggggaaacgagggggggaaatgacggcggggacggggggaaagggggatacggggttcgggggaagtgcggggcggtgcggcgggtttaatgggagatagagggcgggaggggaggtagggtagggaatgggtagagggagaacggggaaaacggggggggcggggggtaatggggagggggaaagcggaaagaaaatcggaatgggggggggatatgggggggggcgtcgtatacggtaataataaaataaagaacggggacggcgcgggtgttggtgtgggtaggggagggggaacggggggacgggcgacgcgggttgaggggaacgagcggaagacgggaatcgagggg

SEQ ID NO: 38236 - DNA, 603 bp, Artificial Sequence
  chemically treated genomic DNA (Homo sapiens) CpG-island No: 38236
cccctcgattcccgtcttccgctcgttcccctcaacccgcgtcgcccgtccccccgttccccctcccctacccacaccaacacccgcgccgtccccgttctttattttattattaccgtatacgacgcccccccccatatcccccccccattccgattttctttccgctttccccctccccattaccccccgccccccccgttttccccgttctccctctacccattccctaccctacctcccctcccgccctctatctcccattaaacccgccgcaccgccccgcacttcccccgaaccccgtatccccctttccccccgtccccgccgtcatttccccccctcgtttcccccgtatcctacctctccttcccttcctcccgcgccccccgcccccccccttcatttaccccccgcccctctccccccccccgtccccgttttcctaatatttcccgtttacgtccctcttatccccccctctcccccccccattccctcccattaccccccgcttttccttttacccgctattcacccgtatacccacttatcccccgcctatccctaacgcacccttctatccgccaaatctatccccac

SEQ ID NO: 38237 - DNA, 561 bp, Artificial Sequence
  chemically treated genomic DNA (Homo sapiens) CpG-island No: 38237
ttttttcgttgtcggttcggagttttgggtatgttgttgtttcggttcgaatttcgttgttggtgagagttttagcgattcgttttagtcgttcgttaacggtatatgttgtttttgaattcgcgaattgtggaatcgttgcgtattatgtgggaagcggatgttatcgaaagtagggtgagattatatgttcggtatgttcggatgtttttcgaatttttttattgttttttgtatttttcgcggcgtttttcgtcgtttttcgttcgttcgttgtcgttttttagcgttattgtgtatttttagtatttgttttatgtttatttcgttcgtcgcgtgtatttttttcggtatcgtatttttttttatattcgcgttcgtcgtgtcgtttgttttttttttcgttcgtttgtacgtcgtgtcgcgtcggtatttcgtaggattgtattgttcgtcgtcgtttcgttttttttttttcgttttttttttttcgtatgacgttatggtttttgtgttgatcgttacggatcgcgagtttgttatatttttttaggcgatttt

SEQ ID NO: 38238 - DNA, 561 bp, Artificial Sequence
  chemically treated genomic DNA (Homo sapiens) CpG-island No: 38238
aaaatcgcctaaaaaaatataacaaactcgcgatccgtaacgatcaacacaaaaaccataacgtcatacgaaaaaaaaaaaacgaaaaaaaaaaaacgaaacgacgacgaacaatacaatcctacgaaataccgacgcgacacgacgtacaaacgaacgaaaaaaaaaacaaacgacacgacgaacgcgaatataaaaaaaaatacgataccgaaaaaaatacacgcgacgaacgaaataaacataaaacaaatactaaaaatacacaataacgctaaaaaacgacaacgaacgaacgaaaaacgacgaaaaacgccgcgaaaaatacaaaaaacaataaaaaaattcgaaaaacatccgaacataccgaacatataatctcaccctactttcgataacatccgcttcccacataatacgcaacgattccacaattcgcgaattcaaaaacaacatataccgttaacgaacgactaaaacgaatcgctaaaactctcaccaacaacgaaattcgaaccgaaacaacaacatacccaaaactccgaaccgacaacgaaaaaa

SEQ ID NO: 38239 - DNA, 561 bp, Artificial Sequence
  chemically treated genomic DNA (Homo sapiens) CpG-island No: 38239
agggtcgtttgggaaagtgtggtaaattcgcggttcgtggcggttagtataagagttatggcgttatacgggggaaaaggggcgaaaaagaaaaaacggggcgacgacgggtagtgtaattttgcgggatatcggcgcgatacggcgtgtagacgaacgggggaaaaagtaggcggtacggcgaacgcgggtgtggggaggagtgcgatgtcggggaaaatgtacgcggcgagcgaggtgggtatagagtaggtattggaaatgtatagtgacgttaaagggcggtaacgggcgggcggaaaacggcggggggcgtcgcgggggatatagggggtaatgggggaattcgagggatattcgggtatgtcgggtatatgattttattttattttcgatagtattcgttttttatatgatacgtaacggttttatagttcgcgggtttaaggataatatatgtcgttggcggacgattagggcgagtcgttagagtttttattagtagcgagattcgggtcggaatagtagtatgtttagggtttcggatcgataacggaaaag

SEQ ID NO: 38240 - DNA, 561 bp, Artificial Sequence
  chemically treated genomic DNA (Homo sapiens) CpG-island No: 38240
cttttccgttatcgatccgaaaccctaaacatactactattccgacccgaatctcgctactaataaaaactctaacgactcgccctaatcgtccgccaacgacatatattatccttaaacccgcgaactataaaaccgttacgtatcatataaaaaacgaatactatcgaaaataaaataaaatcatatacccgacatacccgaatatccctcgaattcccccattaccccctatatcccccgcgacgccccccgccgttttccgcccgcccgttaccgccctttaacgtcactatacatttccaatacctactctatacccacctcgctcgccgcgtacattttccccgacatcgcactcctccccacacccgcgttcgccgtaccgcctactttttcccccgttcgtctacacgccgtatcgcgccgatatcccgcaaaattacactacccgtcgtcgccccgttttttctttttcgccccttttcccccgtataacgccataactcttatactaaccgccacgaaccgcgaatttaccacactttcccaaacgaccct

SEQ ID NO: 38241 - DNA, 531 bp, Artificial Sequence
  chemically treated genomic DNA (Homo sapiens) CpG-island No: 38241
gttcgcggggacgtcgaggttcggcgtcgtattttgtcgttcgttttgttcgcggggaagtcgaggttcgatgtcgtattttgtcgttcgttttgttcgcggggaagtcgaggttcggcgtcgtattttgtcgttcgttttgttcgcggggaagtcgaggttcggcgtcgtattttgtcgttcgttttattcgcgaggaagtcgaggttcggcgtcgtatcgtgtcgttcgttttgttcgcggggaagtcgaggttcggcgtcgtattttgtggtcgttttattcgcgggaaagtcgaggttcggcgtcgtattttgtcgttcgttttattcgcgaggaagtcgaggttcggcgtcgtatcgtgtcgttcgttttgttcgcggggaagtcgaggttcggcgtcgtattttgtcgttcgttttattcgcggagacgtcgaggttcgatgtcgtattttgtcgttcgttttattcgcgggaaagtcgaggttcggtgttgtattttgtcgtttattttattcgcggggaagtt

SEQ ID NO: 38242 - DNA, 531 bp, Artificial Sequence
  chemically treated genomic DNA (Homo sapiens) CpG-island No: 38242
aacttccccgcgaataaaataaacgacaaaatacaacaccgaacctcgactttcccgcgaataaaacgaacgacaaaatacgacatcgaacctcgacgtctccgcgaataaaacgaacgacaaaatacgacgccgaacctcgacttccccgcgaacaaaacgaacgacacgatacgacgccgaacctcgacttcctcgcgaataaaacgaacgacaaaatacgacgccgaacctcgactttcccgcgaataaaacgaccacaaaatacgacgccgaacctcgacttccccgcgaacaaaacgaacgacacgatacgacgccgaacctcgacttcctcgcgaataaaacgaacgacaaaatacgacgccgaacctcgacttccccgcgaacaaaacgaacgacaaaatacgacgccgaacctcgacttccccgcgaacaaaacgaacgacaaaatacgacatcgaacctcgacttccccgcgaacaaaacgaacgacaaaatacgacgccgaacctcgacgtccccgcgaac

SEQ ID NO: 38243 - DNA, 531 bp, Artificial Sequence
  chemically treated genomic DNA (Homo sapiens) CpG-island No: 38243
agttttttcgcgggtaaaatgggcggtagaatatagtatcgggtttcggttttttcgcgggtaaaacgggcggtaggatacggtatcgggtttcggcgttttcgcgggtaaaacgggcggtaggatacggcgtcgggtttcggttttttcgcgggtaaaacgggcggtacgatacggcgtcgggtttcggttttttcgcgggtaaaacgggcggtaggatacggcgtcgggtttcgattttttcgcgggtaaaacggttataggatacggcgtcgggtttcggttttttcgcgggtaaaacgggcggtacgatacggcgtcgggtttcggttttttcgcgggtaaaacgggcggtaggatacggcgtcgggtttcggttttttcgcgggtaaaacgggcggtaggatgcggcgtcgggtttcggttttttcgcgggtaaaacgggcggtagggtacggtatcgggtttcggttttttcgcgggtaaaacgggcggtaggatgcggcgtcgggtttcggcgttttcgcgggt

SEQ ID NO: 38244 - DNA, 531 bp, Artificial Sequence
  chemically treated genomic DNA (Homo sapiens) CpG-island No: 38244
acccgcgaaaacgccgaaacccgacgccgcatcctaccgcccgttttacccgcgaaaaaaccgaaacccgataccgtaccctaccgcccgttttacccgcgaaaaaaccgaaacccgacgccgcatcctaccgcccgttttacccgcgaaaaaaccgaaacccgacgccgtatcctaccgcccgttttacccgcgaaaaaaccgaaacccgacgccgtatcgtaccgcccgttttacccgcgaaaaaaccgaaacccgacgccgtatcctataaccgttttacccgcgaaaaaatcgaaacccgacgccgtatcctaccgcccgttttacccgcgaaaaaaccgaaacccgacgccgtatcgtaccgcccgttttacccgcgaaaaaaccgaaacccgacgccgtatcctaccgcccgttttacccgcgaaaacgccgaaacccgataccgtatcctaccgcccgttttacccgcgaaaaaaccgaaacccgatactatattctaccgcccattttacccgcgaaaaaact

SEQ ID NO: 38245 - DNA, 517 bp, Artificial Sequence
  chemically treated genomic DNA (Homo sapiens) CpG-island No: 38245
cgttgttggcgtttttttatagtttcgtttttttgacgagtattataaaaatcgacgtttaagttagaggtggcgaaattcgataggattataaagatattaggcgtttttttttggaagttttttcgtgcgttttattgatacgattttgtcgattatcggatatttgttcgttttttttttttcgggaagcgtggcgtttttttatagtttacgttgtaggtattttaggtcggtgtaggtcgttcgttttaagttgggttgtgtgtacgaattttttcgttagttttatcgttgagttttattcggtaattatcgtttcgagtttaatttcgtaagatacgatttattcgtattggtagtagttattggttatagtattagtatatttacgttcgtattcgttgttatatcgtttttttcgttgggggtttattacgcgttattttttattattattattttgttttttgtttttttttgtaaatatgtattttttgtataaaacgtgtttttt

SEQ ID NO: 38246 - DNA, 517 bp, Artificial Sequence
  chemically treated genomic DNA (Homo sapiens) CpG-island No: 38246
aaaaaacacgttttatacaaaaaatacatatttacaaaaaaaaacaaaaaacaaaataataataataaaaaataacgcgtaataaacccccaacgaaaaaaacgatataacaacgaatacgaacgtaaatatactaatactataaccaataactactaccaatacgaataaatcgtatcttacgaaattaaactcgaaacgataattaccgaataaaactcaacgataaaactaacgaaaaaattcgtacacacaacccaacttaaaacgaacgacctacaccgacctaaaatacctacaacgtaaactataaaaaaacgccacgcttcccgaaaaaaaaaaaacgaacaaatatccgataatcgacaaaatcgtatcaataaaacgcacgaaaaaacttccaaaaaaaaacgcctaatatctttataatcctatcgaatttcgccacctctaacttaaacgtcgatttttataatactcgtcaaaaaaacgaaactataaaaaaacgccaacaacg

SEQ ID NO: 38247 - DNA, 517 bp, Artificial Sequence
  chemically treated genomic DNA (Homo sapiens) CpG-island No: 38247
gaaaaatacgttttgtgtagaagatgtatgtttgtaggagagggtaagggataagatggtagtagtggggggtagcgcgtggtgagtttttagcggaaaagacgatgtagtagcgagtacgggcgtggatgtgttgatgttgtgattagtggttgttgttagtgcgagtaagtcgtgttttacggggttgggttcgagacgatagttgtcggataaggtttagcggtgaggttaacgggggggttcgtgtatatagtttagtttgaagcgaacgatttatatcgatttgagatatttatagcgtgagttatgagaaagcgttacgtttttcgaaggaagaaaggcgggtaggtattcggtgatcggtagggtcgtattagtagagcgtacgagggagtttttagggggaaacgtttggtatttttatagttttgtcgggtttcgttatttttgatttgagcgtcgatttttgtgatgttcgttaggggggcggagttatggaaaaacgttagtaacg

SEQ ID NO: 38248 - DNA, 517 bp, Artificial Sequence
  chemically treated genomic DNA (Homo sapiens) CpG-island No: 38248
cgttactaacgtttttccataactccgcccccctaacgaacatcacaaaaatcgacgctcaaatcaaaaataacgaaacccgacaaaactataaaaataccaaacgtttccccctaaaaactccctcgtacgctctactaatacgaccctaccgatcaccgaatacctacccgcctttcttccttcgaaaaacgtaacgctttctcataactcacgctataaatatctcaaatcgatataaatcgttcgcttcaaactaaactatatacacgaacccccccgttaacctcaccgctaaaccttatccgacaactatcgtctcgaacccaaccccgtaaaacacgacttactcgcactaacaacaaccactaatcacaacatcaacacatccacgcccgtactcgctactacatcgtcttttccgctaaaaactcaccacgcgctaccccccactactaccatcttatcccttaccctctcctacaaacatacatcttctacacaaaacgtatttttc

SEQ ID NO: 38249 - DNA, 799 bp, Artificial Sequence
  chemically treated genomic DNA (Homo sapiens) CpG-island No: 38249
ttgttcgttcgtgttcgtaattattaaggtttacgtaaatttttacggttttttttcgttttcgcgttatttttttaagaaatttttagagggtagcgtagacggggcgggttttgagatttcgggtttcgttttttttcgggaatcgtttattatttaggatttcgatagagggtgaaaaaagataattttcggtttcgcgatcgtttttaatttcgcgagaagagaaggcggtcgttatcggtcgaacggaggcggtggcgagggagggggtgtggtcggggagcgcgaagttttcgggagtaagggagagggggcggggtcgcgcgtttcgggtatacgtatgcgtgtacgttgtcggtcgggttgggttgagaggggagggggcggcggcggtcgaggcggcgtcgttattttcgtggttcggatagtgcgtggcggcgcgggtgattacgggagaagtaggtagggatcgtttttgcgtagttattgaaattttttcgttcgtgtgttcgagagtcgtagtttttcgcgcgtgtggtagattttggggattttaggttattttgcggtttcggttttttcgttgcgcgttaggtaggagcggcgggttttttagtgttcgttgtcggtcgaggttttatttttgttcggtgttgtcgaggcgacgattcggcgtcggacgtgttcgttttttcgcgcggcgatagttttgtttttgtttatgcgtttagtgggatcggggttgggttgggttgattcgggtagggcggaagggaagcgtgtgttcgttttaggt

SEQ ID NO: 38250 - DNA, 799 bp, Artificial Sequence
  chemically treated genomic DNA (Homo sapiens) CpG-island No: 38250
acctaaaacgaacacacgcttcccttccgccctacccgaatcaacccaacccaaccccgatcccactaaacgcataaacaaaaacaaaactatcgccgcgcgaaaaaacgaacacgtccgacgccgaatcgtcgcctcgacaacaccgaacaaaaataaaacctcgaccgacaacgaacactaaaaaacccgccgctcctacctaacgcgcaacgaaaaaaccgaaaccgcaaaataacctaaaatccccaaaatctaccacacgcgcgaaaaactacgactctcgaacacacgaacgaaaaaatttcaataactacgcaaaaacgatccctacctacttctcccgtaatcacccgcgccgccacgcactatccgaaccacgaaaataacgacgccgcctcgaccgccgccgccccctcccctctcaacccaacccgaccgacaacgtacacgcatacgtatacccgaaacgcgcgaccccgccccctctcccttactcccgaaaacttcgcgctccccgaccacaccccctccctcgccaccgcctccgttcgaccgataacgaccgccttctcttctcgcgaaattaaaaacgatcgcgaaaccgaaaattatcttttttcaccctctatcgaaatcctaaataataaacgattcccgaaaaaaaacgaaacccgaaatctcaaaacccgccccgtctacgctaccctctaaaaatttcttaaaaaaataacgcgaaaacgaaaaaaaaccgtaaaaatttacgtaaaccttaataattacgaacacgaacgaacaa

SEQ ID NO: 38251 - DNA, 799 bp, Artificial Sequence
  chemically treated genomic DNA (Homo sapiens) CpG-island No: 38251
atttgaggcgggtatacgtttttttttcgttttgttcgggttagtttagtttagtttcggttttattgggcgtataagtaaggatagagttgtcgtcgcgcgggagggcgggtacgttcggcgtcgggtcgtcgtttcggtaatatcgggtaagagtggggtttcggtcgatagcgggtattggggagttcgtcgtttttatttgacgcgtagcgggagggtcggggtcgtagggtgatttggggtttttaggatttgttatacgcgcggggggttgcggttttcggatatacgagcgagagggttttaatggttacgtaggggcggtttttatttatttttttcgtggttattcgcgtcgttacgtattgttcggattacggaaataacgacgtcgtttcggtcgtcgtcgttttttttttttttagtttagttcgatcggtagcgtgtacgtatgcgtatgttcgggacgcgcgatttcgtttttttttttttattttcggggatttcgcgtttttcggttatattttttttttcgttatcgttttcgttcggtcgatggcggtcgtttttttttttcgcgagattagagacgatcgcgagatcggaagttatttttttttattttttgtcggagttttgggtagtgggcggttttcggaaagaggcggagttcggagttttagagttcgtttcgtttgcgttgttttttgggaattttttagaaaggtgacgcgaaggcggaaggaaatcgtggaggtttgcgtagattttagtggttgcgagtacgaacgagtag

SEQ ID NO: 38252 - DNA, 799 bp, Artificial Sequence
  chemically treated genomic DNA (Homo sapiens) CpG-island No: 38252
ctactcgttcgtactcgcaaccactaaaatctacgcaaacctccacgatttccttccgccttcgcgtcacctttctaaaaaattcccaaaaaacaacgcaaacgaaacgaactctaaaactccgaactccgcctctttccgaaaaccgcccactacccaaaactccgacaaaaaataaaaaaaaataacttccgatctcgcgatcgtctctaatctcgcgaaaaaaaaaaacgaccgccatcgaccgaacgaaaacgataacgaaaaaaaaaatataaccgaaaaacgcgaaatccccgaaaataaaaaaaaaaaaacgaaatcgcgcgtcccgaacatacgcatacgtacacgctaccgatcgaactaaactaaaaaaaaaaaaaacgacgacgaccgaaacgacgtcgttatttccgtaatccgaacaatacgtaacgacgcgaataaccacgaaaaaaataaataaaaaccgcccctacgtaaccattaaaaccctctcgctcgtatatccgaaaaccgcaaccccccgcgcgtataacaaatcctaaaaaccccaaatcaccctacgaccccgaccctcccgctacgcgtcaaataaaaacgacgaactccccaatacccgctatcgaccgaaaccccactcttacccgatattaccgaaacgacgacccgacgccgaacgtacccgccctcccgcgcgacgacaactctatccttacttatacgcccaataaaaccgaaactaaactaaactaacccgaacaaaacgaaaaaaaaacgtatacccgcctcaaat

SEQ ID NO: 38253 - DNA, 993 bp, Artificial Sequence
  chemically treated genomic DNA (Homo sapiens) CpG-island No: 38253
ttatgatttgggattttatcgaattcgtttgtcgcggttgcgttaattacgagggcgtcgatcgcgtcgagttcgttatcgagacggcgcggtagtttaagcgggcgtacggttgtttttcggagggtcgttttttattcggcgtcgcggtttcggtcgtcgttaagtcgtcgtcgtttttcgttaaggatatttttttgtagtagtagtagtagtttggttacggcggtttcgaggcggtttcgcgcgcgtcgtaggttttggagcgttattcgttggcggtcgcggtcgagaggttttcgcgtttcggttttgatttcggtagtagtcgttcggtagcgagtttggtttagtcgtcgacgtcgtagtcgtcgttcgtgaacggtattttggtgtttaacggtttttttaagttagaggagtcgttcgagttgaatcgttagagttcgaattcgcggcgcggttacgcggtgtcgtttattttggtgtcgtttatgaacggttcggttacgtcgttgtttatcgcgttcggtttcggcggtcgcgttgtcgtttttttagtcgcggtgttcggaatcgcggtcgttagtttgggtttcgcgtagttttatcggatttgggcgtttataagcggtcggtattcgtgtcgagtagcgttgtcgtggagtacgagtagcgtgaggcggtagttaaaaagaaataatcgtcgtcgtttgcgtatcggggttcggtcgatagtttgtttatcgcggtcggggtcgtcgagttgagcgcggaaggtgcgggtaagagtcgcgggtttggagagtaggattgggttaataggtttaagatcgtgcgcgatacgttgttggcgttgtattagtacggttattcggggtttttcgagagtaagtttaagaaggagtcggttttgattgtaggtaggttgttgggtttcgaggttaacggggttaacgggtttaaagtaggtaggggcggttgtgaagtgag

SEQ ID NO: 38254 - DNA, 993 bp, Artificial Sequence
  chemically treated genomic DNA (Homo sapiens) CpG-island No: 38254
ctcacttcacaaccgcccctacctactttaaacccgttaaccccgttaacctcgaaacccaacaacctacctacaatcaaaaccgactccttcttaaacttactctcgaaaaaccccgaataaccgtactaatacaacgccaacaacgtatcgcgcacgatcttaaacctattaacccaatcctactctccaaacccgcgactcttacccgcaccttccgcgctcaactcgacgaccccgaccgcgataaacaaactatcgaccgaaccccgatacgcaaacgacgacgattatttctttttaactaccgcctcacgctactcgtactccacgacaacgctactcgacacgaataccgaccgcttataaacgcccaaatccgataaaactacgcgaaacccaaactaacgaccgcgattccgaacaccgcgactaaaaaaacgacaacgcgaccgccgaaaccgaacgcgataaacaacgacgtaaccgaaccgttcataaacgacaccaaaataaacgacaccgcgtaaccgcgccgcgaattcgaactctaacgattcaactcgaacgactcctctaacttaaaaaaaccgttaaacaccaaaataccgttcacgaacgacgactacgacgtcgacgactaaaccaaactcgctaccgaacgactactaccgaaatcaaaaccgaaacgcgaaaacctctcgaccgcgaccgccaacgaataacgctccaaaacctacgacgcgcgcgaaaccgcctcgaaaccgccgtaaccaaactactactactactacaaaaaaatatccttaacgaaaaacgacgacgacttaacgacgaccgaaaccgcgacgccgaataaaaaacgaccctccgaaaaacaaccgtacgcccgcttaaactaccgcgccgtctcgataacgaactcgacgcgatcgacgccctcgtaattaacgcaaccgcgacaaacgaattcgataaaatcccaaatcataa

SEQ ID NO: 38255 - DNA, 993 bp, Artificial Sequence
  chemically treated genomic DNA (Homo sapiens) CpG-island No: 38255
tttattttatagtcgtttttatttgttttagattcgttggtttcgttggtttcgaaatttaataatttgtttgtagttagggtcggtttttttttaaatttgttttcgaagggtttcgagtggtcgtgttggtgtagcgttagtagcgtgtcgcgtacggttttgggtttgttgatttagttttgttttttagattcgcggtttttgttcgtatttttcgcgtttagttcggcggtttcggtcgcggtggataggttgtcggtcgggtttcggtgcgtaggcggcggcggttgtttttttttggttgtcgttttacgttgttcgtgttttacggtagcgttgttcgatacggatgtcggtcgtttgtgggcgtttagattcggtggggttgcgcggagtttaggttggcggtcgcggtttcggatatcgcggttaaggaggcggtagcgcggtcgtcgaggtcgagcgcggtgggtagcggcgtggtcgagtcgtttatgagcggtattagggtgggcggtatcgcgtggtcgcgtcgcgggttcgggttttggcgatttagttcgggcggtttttttagtttggagaagtcgttgggtattaggatgtcgtttacgggcggcggttgcggcgtcggcggttgggttaggttcgttgtcgggcggttgttgtcgaagttagagtcgaggcgcgggggtttttcggtcgcggtcgttaacgggtagcgttttaaggtttgcggcgcgcgcggggtcgtttcggggtcgtcgtggttaagttgttgttgttgttgtaaaaggatgtttttggcggagagcggcggcggtttggcggcggtcgaggtcgcggcgtcgggtggggagcgatttttcgggaagtagtcgtgcgttcgtttgagttgtcgcgtcgtttcgatgacgaattcgacgcggtcggcgttttcgtagttgacgtagtcgcggtagacgggttcggtgaagttttagattatgg

SEQ ID NO: 38256 - DNA, 993 bp, Artificial Sequence
  chemically treated genomic DNA (Homo sapiens) CpG-island No: 38256
ccataatctaaaacttcaccgaacccgtctaccgcgactacgtcaactacgaaaacgccgaccgcgtcgaattcgtcatcgaaacgacgcgacaactcaaacgaacgcacgactacttcccgaaaaatcgctccccacccgacgccgcgacctcgaccgccgccaaaccgccgccgctctccgccaaaaacatccttttacaacaacaacaacaacttaaccacgacgaccccgaaacgaccccgcgcgcgccgcaaaccttaaaacgctacccgttaacgaccgcgaccgaaaaacccccgcgcctcgactctaacttcgacaacaaccgcccgacaacgaacctaacccaaccgccgacgccgcaaccgccgcccgtaaacgacatcctaatacccaacgacttctccaaactaaaaaaaccgcccgaactaaatcgccaaaacccgaacccgcgacgcgaccacgcgataccgcccaccctaataccgctcataaacgactcgaccacgccgctacccaccgcgctcgacctcgacgaccgcgctaccgcctccttaaccgcgatatccgaaaccgcgaccgccaacctaaactccgcgcaaccccaccgaatctaaacgcccacaaacgaccgacatccgtatcgaacaacgctaccgtaaaacacgaacaacgtaaaacgacaaccaaaaaaaaacaaccgccgccgcctacgcaccgaaacccgaccgacaacctatccaccgcgaccgaaaccgccgaactaaacgcgaaaaatacgaacaaaaaccgcgaatctaaaaaacaaaactaaatcaacaaacccaaaaccgtacgcgacacgctactaacgctacaccaacacgaccactcgaaacccttcgaaaacaaatttaaaaaaaaaccgaccctaactacaaacaaattattaaatttcgaaaccaacgaaaccaacgaatctaaaacaaataaaaacgactataaaataaa

SEQ ID NO: 38257 - DNA, 708 bp, Artificial Sequence
  chemically treated genomic DNA (Homo sapiens) CpG-island No: 38257
gttcggggatttcgcgttgtttttttttcggtttttatagagtagggggttttcggcggggtatttttttttgtgggcggggtttatcgttttcgttttcgttttttcggttgcgcgcggttgcgggttgcgattacgtgagtatagtagggagggggaggggttttgattttcgggcggcggaaggagacgcggtcgcgtgaggacgaggttatttgaaaatacgtttcgggagttagagtttgaggtcggcggcgtacgttgttgtttcgtgggtttttgttttttcgtttgttttttcgggtttttcgtttcggtcgcggtcgggtttttaggtaagcggtcgtcgttcgtcgggtcgggttttttcggggcgcgggattgagcgtggtggggtcgtcgtttttcgattcgcggtttaagcgggtagggtcggtcgtgtacgatttgcgtttttcgggtttgggtcgcggcgttttttcgagttgggtttgggtgtgcggtcggtattgcgggggcgggattttttagggcgtttgcggagttttaggtgattgggcgggttcgtttggtttcgggttcgagagagttttagttcggagtgtgtgaatcgggttttattttttcgattttggttttggtcggcgttttttggagtaggaggaacgatggttttttaaaatttatggtgtgttcgtttttgggatg

SEQ ID NO: 38258 - DNA, 708 bp, Artificial Sequence
  chemically treated genomic DNA (Homo sapiens) CpG-island No: 38258
catcccaaaaacgaacacaccataaattttaaaaaaccatcgttcctcctactccaaaaaacgccgaccaaaaccaaaatcgaaaaaataaaacccgattcacacactccgaactaaaactctctcgaacccgaaaccaaacgaacccgcccaatcacctaaaactccgcaaacgccctaaaaaatcccgcccccgcaataccgaccgcacacccaaacccaactcgaaaaaacgccgcgacccaaacccgaaaaacgcaaatcgtacacgaccgaccctacccgcttaaaccgcgaatcgaaaaacgacgaccccaccacgctcaatcccgcgccccgaaaaaacccgacccgacgaacgacgaccgcttacctaaaaacccgaccgcgaccgaaacgaaaaacccgaaaaaacaaacgaaaaaacaaaaacccacgaaacaacaacgtacgccgccgacctcaaactctaactcccgaaacgtattttcaaataacctcgtcctcacgcgaccgcgtctccttccgccgcccgaaaatcaaaacccctccccctccctactatactcacgtaatcgcaacccgcaaccgcgcgcaaccgaaaaaacgaaaacgaaaacgataaaccccgcccacaaaaaaaaataccccgccgaaaaccccctactctataaaaaccgaaaaaaaaacaacgcgaaatccccgaac

SEQ ID NO: 38259 - DNA, 708 bp, Artificial Sequence
  chemically treated genomic DNA (Homo sapiens) CpG-island No: 38259
tattttagaggcgaatatattatgggttttaggaaattatcgttttttttattttaagggacgtcggttaggattagagtcggggaagtggggttcgatttatatatttcgggttaaaattttttcggattcgaaattaggcgaattcgtttagttatttgaagtttcgtaaacgttttagggggtttcgttttcgtagtgtcggtcgtatatttaggtttagttcggagggacgtcgcggtttagattcgggggacgtaaatcgtgtacggtcgattttgttcgtttgggtcgcggatcggggggcgacggttttattacgtttagtttcgcgtttcgggaggattcggttcgacgggcgacggtcgtttatttgaggattcggtcgcggtcggggcgagaagttcgagaagataagcgagggagtagaagtttacggggtaatagcgtgcgtcgtcgattttaggttttagttttcggagcgtgtttttaaatagtttcgtttttacgcggtcgcgttttttttcgtcgttcggaaattagggtttttttttttttttgttgtgtttacgtgatcgtagttcgtagtcgcgcgtaatcggggaggcgggagcgggagcggtaggtttcgtttatagaggagggtatttcgtcggaagttttttgttttgtgggaatcggagggaggatagcgcgaggttttcggat

SEQ ID NO: 38260 - DNA, 708 bp, Artificial Sequence
  chemically treated genomic DNA (Homo sapiens) CpG-island No: 38260
atccgaaaacctcgcgctatcctccctccgattcccacaaaacaaaaaacttccgacgaaataccctcctctataaacgaaacctaccgctcccgctcccgcctccccgattacgcgcgactacgaactacgatcacgtaaacacaacaaaaaaaaaaaaaaaccctaatttccgaacgacgaaaaaaaacgcgaccgcgtaaaaacgaaactatttaaaaacacgctccgaaaactaaaacctaaaatcgacgacgcacgctattaccccgtaaacttctactccctcgcttatcttctcgaacttctcgccccgaccgcgaccgaatcctcaaataaacgaccgtcgcccgtcgaaccgaatcctcccgaaacgcgaaactaaacgtaataaaaccgtcgccccccgatccgcgacccaaacgaacaaaatcgaccgtacacgatttacgtcccccgaatctaaaccgcgacgtccctccgaactaaacctaaatatacgaccgacactacgaaaacgaaaccccctaaaacgtttacgaaacttcaaataactaaacgaattcgcctaatttcgaatccgaaaaaattttaacccgaaatatataaatcgaaccccacttccccgactctaatcctaaccgacgtcccttaaaataaaaaaaacgataatttcctaaaacccataatatattcgcctctaaaata

SEQ ID NO: 38261 - DNA, 826 bp, Artificial Sequence
  chemically treated genomic DNA (Homo sapiens) CpG-island No: 38261
gcggcgcggtcgcggcgaggttttttagaggcggtattagcgtatgcgtagggcggagtttcggttcgggatataagatggcggtacggcgttggggagggcgaggcggaggcggtaaaacgggcggtcgagtagaacgtgtagtcgcgttttttttagttcgtttcgggtaggtaagagttttaggaagttatggtttcgtagcgagtcgcgttagggtttggggattcgaagttggggggcggcggtttttcggcgttttttgttcgggattgtcgtttgttttgtttttgttgtcgtcgttattttagattcgcgggtgggcggtcgcgtcggtggtcgaagtgagggaggtggttcgagagtttttagcggagcgggttttagggttttttcgttgttgtcgtcgttatcgtttttgtgtcgggtttcgattttgagtcgttttagttcgggggcgggagcgcgcggcggggcggggggcggagttcgagagatgggtcggcgcgcgcgcgcgcgttaaatagtttattttcgttggggtagggggaggggaaggtgcgcgcgcgcgcgcgcgttggagttcgtttttcgttttcgtgcgtcgtcgcgtttgcgtattttgttcgttttttgatttttttttattgggtcggagaattttgattggtatattgcggagatggtttcgttttacgtgtttttaatttcggattcggattttggtttttggtgggtttttttggttgcgtagatagagttgtttatttttgagtagcggtaatttttaaattgcggtatgcgtgggggtcgggaagttatagga

SEQ ID NO: 38262 - DNA, 826 bp, Artificial Sequence
  chemically treated genomic DNA (Homo sapiens) CpG-island No: 38262
tcctataacttcccgacccccacgcataccgcaatttaaaaattaccgctactcaaaaataaacaactctatctacgcaaccaaaaaaacccaccaaaaaccaaaatccgaatccgaaattaaaaacacgtaaaacgaaaccatctccgcaatataccaatcaaaattctccgacccaataaaaaaaaatcaaaaaacgaacaaaatacgcaaacgcgacgacgcacgaaaacgaaaaacgaactccaacgcgcgcgcgcgcgcgcaccttcccctccccctaccccaacgaaaataaactatttaacgcgcgcgcgcgcgccgacccatctctcgaactccgccccccgccccgccgcgcgctcccgcccccgaactaaaacgactcaaaatcgaaacccgacacaaaaacgataacgacgacaacaacgaaaaaaccctaaaacccgctccgctaaaaactctcgaaccacctccctcacttcgaccaccgacgcgaccgcccacccgcgaatctaaaataacgacgacaacaaaaacaaaacaaacgacaatcccgaacaaaaaacgccgaaaaaccgccgccccccaacttcgaatccccaaaccctaacgcgactcgctacgaaaccataacttcctaaaactcttacctacccgaaacgaactaaaaaaaacgcgactacacgttctactcgaccgcccgttttaccgcctccgcctcgccctccccaacgccgtaccgccatcttatatcccgaaccgaaactccgccctacgcatacgctaataccgcctctaaaaaacctcgccgcgaccgcgccgc

SEQ ID NO: 38263 - DNA, 826 bp, Artificial Sequence
  chemically treated genomic DNA (Homo sapiens) CpG-island No: 38263
ttttgtggtttttcgatttttacgtatatcgtagtttgagaattatcgttgtttaaggataaataattttatttgcgtaattagaaaaatttattagaagttagagttcgagttcgggattggaggtacgtggggcgggattattttcgtaatgtattaattagaatttttcggtttagtagggaggagttaaagggcgaataaagtacgtaggcgcgacggcgtacgaaggcgagaggcgagttttagcgcgcgcgcgcgcgcgtatttttttttttttttattttagcgagggtgggttgtttggcgcgcgcgcgcgcgtcggtttatttttcgggtttcgtttttcgtttcgtcgcgcgttttcgttttcgggttgaggcgatttagagtcggagttcgatataaaggcggtggcggcggtagtagcggaggggttttagagttcgtttcgttgggggttttcgggttattttttttatttcggttatcggcgcggtcgtttattcgcgggtttaagatggcggcggtaatagagatagggtaagcggtagtttcgagtagaaagcgtcggagggtcgtcgttttttagtttcggatttttagattttggcgcggttcgttgcgggattatggttttttgggatttttatttgttcggagcggattggaggggacgcggttatacgttttgttcgatcgttcgttttgtcgttttcgtttcgttttttttagcgtcgtgtcgttattttgtgtttcgggtcgggatttcgttttgcgtatgcgttggtatcgtttttgagggatttcgtcgcggtcgcgtcgt

SEQ ID NO: 38264 - DNA, 826 bp, Artificial Sequence
  chemically treated genomic DNA (Homo sapiens) CpG-island No: 38264
acgacgcgaccgcgacgaaatccctcaaaaacgataccaacgcatacgcaaaacgaaatcccgacccgaaacacaaaataacgacacgacgctaaaaaaaacgaaacgaaaacgacaaaacgaacgatcgaacaaaacgtataaccgcgtcccctccaatccgctccgaacaaataaaaatcccaaaaaaccataatcccgcaacgaaccgcgccaaaatctaaaaatccgaaactaaaaaacgacgaccctccgacgctttctactcgaaactaccgcttaccctatctctattaccgccgccatcttaaacccgcgaataaacgaccgcgccgataaccgaaataaaaaaaataacccgaaaacccccaacgaaacgaactctaaaacccctccgctactaccgccgccaccgcctttatatcgaactccgactctaaatcgcctcaacccgaaaacgaaaacgcgcgacgaaacgaaaaacgaaacccgaaaaataaaccgacgcgcgcgcgcgcgccaaacaacccaccctcgctaaaataaaaaaaaaaaaaaatacgcgcgcgcgcgcgcgctaaaactcgcctctcgccttcgtacgccgtcgcgcctacgtactttattcgccctttaactcctccctactaaaccgaaaaattctaattaatacattacgaaaataatcccgccccacgtacctccaatcccgaactcgaactctaacttctaataaatttttctaattacgcaaataaaattatttatccttaaacaacgataattctcaaactacgatatacgtaaaaatcgaaaaaccacaaaa

SEQ ID NO: 38265 - DNA, 784 bp, Artificial Sequence
  chemically treated genomic DNA (Homo sapiens) CpG-island No: 38265
tagtgttaaatatttatagagagacgcgtagatataaacggatttatacgggtaattttcgagataaaatttatattcgatggatttacgcggtcgtggaaatatttgtcgttttagaaatatttaggtattcgcgatatatatagtatagttacgtttaagggtattaggatttcgggtttgcgcgtatgcgcggtttttttggatgttcgtgcgtatagatataatattttatacgttttagatttacgaaattttttacggtttagttttagtttattcgggtcgtttttttttcgaggcggtttttcgtttttttttttttcgtttttttttttttttcgtttaaagatgtataaaatatttttcggaagtaatttcggcgtttagttttttttttttcgtttttcggtcgtcgtttttttatttattttcggtcgtcgtcggttaagtttttttttcggcgtagttcggttttcgtcgtttttcgttcggagatcgcggcgtatttggatttttttttttattcgttagtcgtttcgttttcggattttacggttgtaaattgatttggcgcgcggggaggaggagagcgtaggcgagcgaattcgcgagagagggagagagcgagcgagtaatagcgagagcgagagcgagagagtcgggaggtagagggagtagtgatcgtttttcggagtcgggatttatgtttgttttcgggattagcgaaggggattttacggttgagtatgagttaggttgttaggagttaggtatttttacg

SEQ ID NO: 38266 - DNA, 784 bp, Artificial Sequence
  chemically treated genomic DNA (Homo sapiens) CpG-island No: 38266
cgtaaaaatacctaactcctaacaacctaactcatactcaaccgtaaaatccccttcgctaatcccgaaaacaaacataaatcccgactccgaaaaacgatcactactccctctacctcccgactctctcgctctcgctctcgctattactcgctcgctctctccctctctcgcgaattcgctcgcctacgctctcctcctccccgcgcgccaaatcaatttacaaccgtaaaatccgaaaacgaaacgactaacgaataaaaaaaaaaatccaaatacgccgcgatctccgaacgaaaaacgacgaaaaccgaactacgccgaaaaaaaaacttaaccgacgacgaccgaaaataaataaaaaaacgacgaccgaaaaacgaaaaaaaaaaaactaaacgccgaaattacttccgaaaaatattttatacatctttaaacgaaaaaaaaaaaaaaacgaaaaaaaaaaaaacgaaaaaccgcctcgaaaaaaaaacgacccgaataaactaaaactaaaccgtaaaaaatttcgtaaatctaaaacgtataaaatattatatctatacgcacgaacatccaaaaaaaccgcgcatacgcgcaaacccgaaatcctaatacccttaaacgtaactatactatatatatcgcgaatacctaaatatttctaaaacgacaaatatttccacgaccgcgtaaatccatcgaatataaattttatctcgaaaattacccgtataaatccgtttatatctacgcgtctctctataaatatttaacacta

SEQ ID NO: 38267 - DNA, 784 bp, Artificial Sequence
  chemically treated genomic DNA (Homo sapiens) CpG-island No: 38267
cgtgggggtatttggtttttagtagtttggtttatatttagtcgtaaagtttttttcgttggtttcgaggataggtatgaatttcggtttcggaaggcggttattattttttttgtttttcggttttttcgttttcgttttcgttgttgttcgttcgttttttttttttttcgcgggttcgttcgtttgcgtttttttttttttcgcgcgttagattagtttgtagtcgtggggttcgggagcgaggcggttggcgaatggagagggaagtttaagtgcgtcgcggttttcgggcggggagcggcggaggtcgggttacgtcgggggagggatttagtcggcgacggtcgaaaatgaatgggggagcggcggtcggggggcggggagggaggagttgaacgtcggggttgttttcgaggagtgttttgtatatttttaggcggaggaggaggagaagcgagaggaggagagacgggaggtcgtttcgagggaagggcggttcgggtgggttggggttgagtcgtagggagtttcgtgggtttggggcgtgtagggtgttgtgtttatgcgtacgagtatttaaagggatcgcgtatacgcgtaaattcggaattttggtgtttttaagcgtgattgtattgtgtgtgtcgcgagtatttgagtgtttttggggcggtaggtgtttttacggtcgcgtggatttatcgagtgtgggttttgtttcgggagttgttcgtgtgggttcgtttgtgtttgcgcgtttttttgtgagtgtttgatattg

SEQ ID NO: 38268 - DNA, 784 bp, Artificial Sequence
  chemically treated genomic DNA (Homo sapiens) CpG-island No: 38268
caatatcaaacactcacaaaaaaacgcgcaaacacaaacgaacccacacgaacaactcccgaaacaaaacccacactcgataaatccacgcgaccgtaaaaacacctaccgccccaaaaacactcaaatactcgcgacacacacaatacaatcacgcttaaaaacaccaaaattccgaatttacgcgtatacgcgatccctttaaatactcgtacgcataaacacaacaccctacacgccccaaacccacgaaactccctacgactcaaccccaacccacccgaaccgcccttccctcgaaacgacctcccgtctctcctcctctcgcttctcctcctcctccgcctaaaaatatacaaaacactcctcgaaaacaaccccgacgttcaactcctccctccccgccccccgaccgccgctcccccattcattttcgaccgtcgccgactaaatccctcccccgacgtaacccgacctccgccgctccccgcccgaaaaccgcgacgcacttaaacttccctctccattcgccaaccgcctcgctcccgaaccccacgactacaaactaatctaacgcgcgaaaaaaaaaaaaacgcaaacgaacgaacccgcgaaaaaaaaaaaaaacgaacgaacaacaacgaaaacgaaaacgaaaaaaccgaaaaacaaaaaaaataataaccgccttccgaaaccgaaattcatacctatcctcgaaaccaacgaaaaaaactttacgactaaatataaaccaaactactaaaaaccaaatacccccacg

SEQ ID NO: 38269 - DNA, 514 bp, Artificial Sequence
  chemically treated genomic DNA (Homo sapiens) CpG-island No: 38269
tcgaagagcggtgttgggtattcgagagattcggcggtggggaagttattttttttcgaagacgttgttttttagtaatcgtttttcgtttttgttattagtttttttttttcgttcggtttaggatcggttttgcgggcgtcgttaggtttagattaaggtgagtagtttttattcgatgtttggtttttgatttttagggtcgcggagaattggtcgcgggcgttcggggtcgggaatagaaagcgggatttgggggttatgggggattcggatagagatcgcgtttggacgtgtacgggtttggcgttcgttggtgtttagtatacggcgcggtgaggagcggcgagtattcggacgttatttggtttggtagggaacggaattcggggcgtataacgttatgggcggttttgttaggtttttgtttcgagtacgggaaatcgcgattttaatgcggtttatcgcgaaagtttcgtcgttttgtttggttttttttaatatttttgtgaga

SEQ ID NO: 38270 - DNA, 514 bp, Artificial Sequence
  chemically treated genomic DNA (Homo sapiens) CpG-island No: 38270
tctcacaaaaatattaaaaaaaaccaaacaaaacgacgaaactttcgcgataaaccgcattaaaatcgcgatttcccgtactcgaaacaaaaacctaacaaaaccgcccataacgttatacgccccgaattccgttccctaccaaaccaaataacgtccgaatactcgccgctcctcaccgcgccgtatactaaacaccaacgaacgccaaacccgtacacgtccaaacgcgatctctatccgaatcccccataacccccaaatcccgctttctattcccgaccccgaacgcccgcgaccaattctccgcgaccctaaaaatcaaaaaccaaacatcgaataaaaactactcaccttaatctaaacctaacgacgcccgcaaaaccgatcctaaaccgaacgaaaaaaaaaaactaataacaaaaacgaaaaacgattactaaaaaacaacgtcttcgaaaaaaaataacttccccaccgccgaatctctcgaatacccaacaccgctcttcga

SEQ ID NO: 38271 - DNA, 514 bp, Artificial Sequence
  chemically treated genomic DNA (Homo sapiens) CpG-island No: 38271
ttttataaaagtgttaaagagagttagataaaacgacgaagttttcgcgatgagtcgtattaaaatcgcggtttttcgtattcggagtagaggtttggtagggtcgtttatagcgttgtgcgtttcgggtttcgttttttattaggttaggtgacgttcgggtgttcgtcgttttttatcgcgtcgtatgttgagtattagcgaacgttaggttcgtgtacgtttaagcgcggtttttgttcggattttttatggtttttaggtttcgttttttgttttcggtttcggacgttcgcggttagtttttcgcgattttgagaattaagagttaagtatcgggtaggagttgtttattttggtttgggtttggcggcgttcgtagagtcggttttggatcgagcgaggaggaggggttaataatagaggcggagggcggttgttaggaaatagcgttttcgggaggaagtgatttttttatcgtcgggtttttcgggtatttaatatcgtttttcgg

SEQ ID NO: 38272 - DNA, 514 bp, Artificial Sequence
  chemically treated genomic DNA (Homo sapiens) CpG-island No: 38272
ccgaaaaacgatattaaatacccgaaaaacccgacgataaaaaaatcacttcctcccgaaaacgctatttcctaacaaccgccctccgcctctattattaacccctcctcctcgctcgatccaaaaccgactctacgaacgccgccaaacccaaaccaaaataaacaactcctacccgatacttaactcttaattctcaaaatcgcgaaaaactaaccgcgaacgtccgaaaccgaaaacaaaaaacgaaacctaaaaaccataaaaaatccgaacaaaaaccgcgcttaaacgtacacgaacctaacgttcgctaatactcaacatacgacgcgataaaaaacgacgaacacccgaacgtcacctaacctaataaaaaacgaaacccgaaacgcacaacgctataaacgaccctaccaaacctctactccgaatacgaaaaaccgcgattttaatacgactcatcgcgaaaacttcgtcgttttatctaactctctttaacacttttataaaa

SEQ ID NO: 38273 - DNA, 655 bp, Artificial Sequence
  chemically treated genomic DNA (Homo sapiens) CpG-island No: 38273
ttggtcgataggtttcgatttttcgtcgttttatttcgtagagattttagttttatttacgacgcgcgtaagtttgttcgtgggtcgttatggcgaggtcgcgggaagaggggaatttgcgggagggataagaagtgcggtaagttggggttaaagggttaaagggagatttcgggtagagaggggcgaggggtcgcggggtagcgcggttattttaggaagttagggtcgatttcgagttcggcgcgggttttcggtttggtcgtcgcggtttaggtttttgggtcggcgtgaggcgggcgcggcggtatttggtggtgttttgaggggggtcgtcgttatcgtttcgttagttgttgaagtcgtttggtacgttcgcggtcgggttgtagttgtagtagttggagggcgaagtgaaggagatatcgtttcgttcgtcgtaattttgtttttttttagataggatttcgtcgttgttttcggggttgttcgtcgcgtttgtttttgtagcgtagttcgttgttaattttaatttgttttagagcggttacgtggatcgatagcgtttcggttttgtaggtgggttgttttcgttcgtcggtggggattcggaaggtagaagttgttgggttttggattaggtagttattcgggt

SEQ ID NO: 38274 - DNA, 655 bp, Artificial Sequence
  chemically treated genomic DNA (Homo sapiens) CpG-island No: 38274
acccgaataactacctaatccaaaacccaacaacttctaccttccgaatccccaccgacgaacgaaaacaacccacctacaaaaccgaaacgctatcgatccacgtaaccgctctaaaacaaattaaaattaacaacgaactacgctacaaaaacaaacgcgacgaacaaccccgaaaacaacgacgaaatcctatctaaaaaaaaacaaaattacgacgaacgaaacgatatctccttcacttcgccctccaactactacaactacaacccgaccgcgaacgtaccaaacgacttcaacaactaacgaaacgataacgacgacccccctcaaaacaccaccaaataccgccgcgcccgcctcacgccgacccaaaaacctaaaccgcgacgaccaaaccgaaaacccgcgccgaactcgaaatcgaccctaacttcctaaaataaccgcgctaccccgcgacccctcgcccctctctacccgaaatctccctttaaccctttaaccccaacttaccgcacttcttatccctcccgcaaattcccctcttcccgcgacctcgccataacgacccacgaacaaacttacgcgcgtcgtaaataaaactaaaatctctacgaaataaaacgacgaaaaatcgaaacctatcgaccaa

SEQ ID NO: 38275 - DNA, 655 bp, Artificial Sequence
  chemically treated genomic DNA (Homo sapiens) CpG-island No: 38275
gttcggatagttgtttgatttaaggtttagtagtttttgtttttcggatttttatcgacggacggaggtagtttatttgtaggatcggggcgttgtcggtttacgtggtcgttttggagtaggttggagttggtagcgggttgcgttgtagggataggcgcggcggatagtttcgggggtagcggcggggttttgtttgggagaggatagggttgcggcgggcggaacggtgttttttttatttcgttttttagttgttgtagttgtagttcgatcgcgagcgtgttaagcggttttagtagttagcggagcggtggcggcggttttttttaggatattattaggtatcgtcgcgttcgttttacgtcgatttaggggtttaggtcgcggcggttaagtcggaggttcgcgtcggattcggagtcggttttggttttttaagatggtcgcgttgtttcgcggtttttcgtttttttttgttcgggatttttttttggttttttgattttagtttatcgtattttttgtttttttcgtagattttttttttttcgcggtttcgttatggcgatttacggatagatttgcgcgcgtcgtaagtaaagttgggatttttgcgggatggggcggcggagagtcgaagtttgtcgattag

SEQ ID NO: 38276 - DNA, 655 bp, Artificial Sequence
  chemically treated genomic DNA (Homo sapiens) CpG-island No: 38276
ctaatcgacaaacttcgactctccgccgccccatcccgcaaaaatcccaactttacttacgacgcgcgcaaatctatccgtaaatcgccataacgaaaccgcgaaaaaaaaaaaatctacgaaaaaaacaaaaaatacgataaactaaaatcaaaaaaccaaaaaaaaatcccgaacaaaaaaaaacgaaaaaccgcgaaacaacgcgaccatcttaaaaaaccaaaaccgactccgaatccgacgcgaacctccgacttaaccgccgcgacctaaacccctaaatcgacgtaaaacgaacgcgacgatacctaataatatcctaaaaaaaaccgccgccaccgctccgctaactactaaaaccgcttaacacgctcgcgatcgaactacaactacaacaactaaaaaacgaaataaaaaaaacaccgttccgcccgccgcaaccctatcctctcccaaacaaaaccccgccgctacccccgaaactatccgccgcgcctatccctacaacgcaacccgctaccaactccaacctactccaaaacgaccacgtaaaccgacaacgccccgatcctacaaataaactacctccgtccgtcgataaaaatccgaaaaacaaaaactactaaaccttaaatcaaacaactatccgaac

SEQ ID NO: 38277 - DNA, 609 bp, Artificial Sequence
  chemically treated genomic DNA (Homo sapiens) CpG-island No: 38277
tggaggcggacgaagaaggcggtagggtcgggggcgttagcgggaatttcggtcgtcgcgggtagtcgcggtttttttttttattttagggttcgggcggttatcgcgggcggatgagttaggcgagggggcgggtggtaaggggtgtaagcggacggagggtgggggcgtttttatgttcgcgtcgggggggtatcggaggtttcggggtaggggatgcgtcgttgtcggtgtttatagagggtcgtcgttattcgggcgtagagtttaggcgcgtttgttttcggagggtatcgggcgtagtaagtcgggtaggggagagggagtcgtcgtttaggcggcgtcgttatcgcgtttaagaaagataaaagggatcgggaacgggaggggaaaagttttttgttcggttttagatggattttagttttaaattttacgttataaagtttcgaagaggcgggttgggggcgggggtcggggcggatttttaggggcgtggttgcgcgtttgcgatttcggatcgtgttaatttcgtcgtcgttttaaaatttgtgggaaattttagttttgttatttattttttttggaggacgtagataggatttgttt

SEQ ID NO: 38278 - DNA, 609 bp, Artificial Sequence
  chemically treated genomic DNA (Homo sapiens) CpG-island No: 38278
aaacaaatcctatctacgtcctccaaaaaaaataaataacaaaactaaaatttcccacaaattttaaaacgacgacgaaattaacacgatccgaaatcgcaaacgcgcaaccacgcccctaaaaatccgccccgacccccgcccccaacccgcctcttcgaaactttataacgtaaaatttaaaactaaaatccatctaaaaccgaacaaaaaacttttcccctcccgttcccgatcccttttatctttcttaaacgcgataacgacgccgcctaaacgacgactccctctcccctacccgacttactacgcccgataccctccgaaaacaaacgcgcctaaactctacgcccgaataacgacgaccctctataaacaccgacaacgacgcatcccctaccccgaaacctccgatacccccccgacgcgaacataaaaacgcccccaccctccgtccgcttacaccccttaccacccgccccctcgcctaactcatccgcccgcgataaccgcccgaaccctaaaataaaaaaaaaaaccgcgactacccgcgacgaccgaaattcccgctaacgcccccgaccctaccgccttcttcgtccgcctcca

SEQ ID NO: 38279 - DNA, 609 bp, Artificial Sequence
  chemically treated genomic DNA (Homo sapiens) CpG-island No: 38279
gagtagattttgtttgcgttttttaggaggagtgggtggtaggattggggttttttataggttttggggcggcggcgagattggtacggttcggggtcgtaggcgcgtagttacgtttttggaagttcgtttcggttttcgtttttaattcgttttttcggggttttatggcgtgaggtttggggttgggatttatttggagtcgagtagaaaattttttttttttcgttttcggttttttttgttttttttggacgcggtggcggcgtcgtttgagcggcgatttttttttttttgttcggtttgttgcgttcggtgtttttcgagggtaggcgcgtttggattttgcgttcggatggcggcggttttttgtgagtatcggtagcggcgtattttttgtttcgaggttttcggtgttttttcggcgcgggtataggggcgtttttatttttcgttcgtttgtattttttgttattcgttttttcgtttgatttattcgttcgcggtggtcgttcgagttttgggatggggagggagatcgcggttgttcgcggcggtcgagattttcgttgacgttttcgattttgtcgtttttttcgttcgttttta

SEQ ID NO: 38280 - DNA, 609 bp, Artificial Sequence
  chemically treated genomic DNA (Homo sapiens) CpG-island No: 38280
taaaaacgaacgaaaaaaacgacaaaatcgaaaacgtcaacgaaaatctcgaccgccgcgaacaaccgcgatctccctccccatcccaaaactcgaacgaccaccgcgaacgaataaatcaaacgaaaaaacgaataacaaaaaatacaaacgaacgaaaaataaaaacgcccctatacccgcgccgaaaaaacaccgaaaacctcgaaacaaaaaatacgccgctaccgatactcacaaaaaaccgccgccatccgaacgcaaaatccaaacgcgcctaccctcgaaaaacaccgaacgcaacaaaccgaacaaaaaaaaaaaaatcgccgctcaaacgacgccgccaccgcgtccaaaaaaaacaaaaaaaaccgaaaacgaaaaaaaaaaaattttctactcgactccaaataaatcccaaccccaaacctcacgccataaaaccccgaaaaaacgaattaaaaacgaaaaccgaaacgaacttccaaaaacgtaactacgcgcctacgaccccgaaccgtaccaatctcgccgccgccccaaaacctataaaaaaccccaatcctaccacccactcctcctaaaaaacgcaaacaaaatctactc

SEQ ID NO: 38281 - DNA, 576 bp, Artificial Sequence
  chemically treated genomic DNA (Homo sapiens) CpG-island No: 38281
atttcgagagtttaaattattcgtagataaaatttatttttgggaataaagtattcgtttgtaggcgtttttttcgggttggaaggttggcgtgcggaaacggatatatttattcgtggggttcgtttttagttatcgcgggattatcggttatcgagttagggattcggtttttttagtttttcggagcggttggggagttttagtcgattcgtagtattttcggagtaggtatcgtaggattttggttttacgtttttcggacgttttttttttagatgtcgttcggcgggtcggggtttttttggcgggttgcgcgggcgttgcgcgagttaaattaaatttggtcggaaaagacgcggttaaggttcgtttcgtttacgtttttcgtcggttcggtaaggggtttcggagaacggtttgggggggcgagaattatgggcgggggaaatggaagatagagggaattgaagtacgggggttttcgatgagtagtgcggatgttcgattttaaatattaaagttaacgagaggtttaggttatttttttttgattttaaatatttagtgagtgga

SEQ ID NO: 38282 - DNA, 576 bp, Artificial Sequence
  chemically treated genomic DNA (Homo sapiens) CpG-island No: 38282
tccactcactaaatatttaaaatcaaaaaaaaataacctaaacctctcgttaactttaatatttaaaatcgaacatccgcactactcatcgaaaacccccgtacttcaattccctctatcttccatttcccccgcccataattctcgcccccccaaaccgttctccgaaaccccttaccgaaccgacgaaaaacgtaaacgaaacgaaccttaaccgcgtcttttccgaccaaatttaatttaactcgcgcaacgcccgcgcaacccgccaaaaaaaccccgacccgccgaacgacatctaaaaaaaaaacgtccgaaaaacgtaaaaccaaaatcctacgatacctactccgaaaatactacgaatcgactaaaactccccaaccgctccgaaaaactaaaaaaaccgaatccctaactcgataaccgataatcccgcgataactaaaaacgaaccccacgaataaatatatccgtttccgcacgccaaccttccaacccgaaaaaaacgcctacaaacgaatactttattcccaaaaataaattttatctacgaataatttaaactctcgaaat

SEQ ID NO: 38283 - DNA, 576 bp, Artificial Sequence
  chemically treated genomic DNA (Homo sapiens) CpG-island No: 38283
tttatttattggatgtttggggttaaggaggagtaatttgaatttttcgttggttttgatgtttggagtcgaatattcgtattgtttatcgaagattttcgtgttttagttttttttgttttttatttttttcgtttatggttttcgtttttttaagtcgtttttcggaattttttgtcgggtcggcgggaagcgtggacggagcgggttttggtcgcgtttttttcggttaggtttggtttagttcgcgtagcgttcgcgtagttcgttagggggatttcggttcgtcgggcggtatttgaggagaaagcgttcgaggggcgtggagttagggttttgcggtgtttgtttcgggaatattgcgagtcggttggagttttttagtcgtttcggagaattgggggagtcgggtttttggttcggtaatcggtggtttcgcggtagttagaggcgggttttacgggtgggtgtgttcgttttcgtacgttagttttttagttcgggaagagcgtttgtaagcgggtattttgtttttaaagatgggttttgtttgcgggtgatttgggttttcgaagt

SEQ ID NO: 38284 - DNA, 576 bp, Artificial Sequence
  chemically treated genomic DNA (Homo sapiens) CpG-island No: 38284
acttcgaaaacccaaatcacccgcaaacaaaacccatctttaaaaacaaaatacccgcttacaaacgctcttcccgaactaaaaaactaacgtacgaaaacgaacacacccacccgtaaaacccgcctctaactaccgcgaaaccaccgattaccgaaccaaaaacccgactcccccaattctccgaaacgactaaaaaactccaaccgactcgcaatattcccgaaacaaacaccgcaaaaccctaactccacgcccctcgaacgctttctcctcaaataccgcccgacgaaccgaaatccccctaacgaactacgcgaacgctacgcgaactaaaccaaacctaaccgaaaaaaacgcgaccaaaacccgctccgtccacgcttcccgccgacccgacaaaaaattccgaaaaacgacttaaaaaaacgaaaaccataaacgaaaaaaataaaaaacaaaaaaaactaaaacacgaaaatcttcgataaacaatacgaatattcgactccaaacatcaaaaccaacgaaaaattcaaattactcctccttaaccccaaacatccaataaataaa

SEQ ID NO: 38285 - DNA, 1600 bp, Artificial Sequence
  chemically treated genomic DNA (Homo sapiens) CpG-island No: 38285
atagaggagagcgcgatagtcgcgagttatattttgtaatgaaattttttagattttttgtcgggagagcggtttagacgcgttaggtttgtagtaggaggtcgcgtcgagggcgggtttttagaagtttataggtgagtatcggttttttttttttcggttttcggttcggaggaggcgggagtagtttttttgttttgattttatcgcgggcggcgtagggtcggtttggtttttcgtgggacggggaggggggcgggatgtgttatttaaatattagtggggacggtcggtggtggaattagtcgggtaggtcgggtagagtataagagtcggagggagcggtcgggcggtagacgtttgtagattattttagacgtcggagttcgagtttcgtcgagttttcgcgttttattcgttcgcgttcggttcgcgttttttcgttttataatggttcggggtttcggtttcgcgtcgttatcgttgcggttgtcgttgttgttgttggtgttggcggcggtgatcggttatacggtcgcgtaggataattgtacgtgttttattaataagatgatcgtgtgtagtttcgacggtttcggcggtcgttgttagtgtcgcgcgttgggttcgggtatggcggtcgattgttttacgttgatttttaagtgtttgttgtttaaggcgcgtatgagcgtttttaagaacgttcgtacgttggtgcggtcgagtgagtacgcgttcgtggataacgatggtttttacgatttcgattgcgatttcgagggtcgttttaaggcgcgttagtgtaattagacgtcggtgtgttggtgcgtgaattcggtgggcgtgcgtcgtacggataagggcgatttgagtttacgttgcgatgagttggtgcgtatttattatatttttattgatttgcgttatcgttttatcgtcggcgtttttaattatttagatttggacgtcgagttgaggcggttttttcgcgagcgttatcggttgtattttaagttcgtggcggtcgtgtattacgagtagtttattatttagatcgagttgcggtagaatacgttttagaaggtcgtcggtgaagtggatatcggcgatgtcgtttattatttcgagagggatattaagggcgagtttttattttagggtcgcggcggtttggatttgcgcgtgcgcggagaatttttgtaggtggagcgtacgtttatttattatttggacgagattttttcgaagttttttatgaagcgttttatcgtcggttttatcgtcgttatcgtggtggtcgtggtggttttcgtcgtcggtatggtcgttttggtgattattaatcggagaaagtcggggaagtataagaaggtggagattaaggaattgggggagttgagaaaggaatcgagtttgtaggtattcggcggggtaggggatggggtggggtatcggatttcggtatcgttttagatttaagtgagttacgttttttgatttttcggcgtaaaggagacgtttatttttttaaatttttgtttttttttttttttttgcgtatatattaggtttaatagattttggttttagggttttt

SEQ ID NO: 38286 - DNA, 1600 bp, Artificial Sequence
  chemically treated genomic DNA (Homo sapiens) CpG-island No: 38286
aaaaaccctaaaaccaaaatctattaaacctaatatatacgcaaaaaaaaaaaaaaaaacaaaaatttaaaaaaataaacgtctcctttacgccgaaaaatcaaaaaacgtaactcacttaaatctaaaacgataccgaaatccgataccccaccccatcccctaccccgccgaatacctacaaactcgattcctttctcaactcccccaattccttaatctccaccttcttatacttccccgactttctccgattaataatcaccaaaacgaccataccgacgacgaaaaccaccacgaccaccacgataacgacgataaaaccgacgataaaacgcttcataaaaaacttcgaaaaaatctcgtccaaataataaataaacgtacgctccacctacaaaaattctccgcgcacgcgcaaatccaaaccgccgcgaccctaaaataaaaactcgcccttaatatccctctcgaaataataaacgacatcgccgatatccacttcaccgacgaccttctaaaacgtattctaccgcaactcgatctaaataataaactactcgtaatacacgaccgccacgaacttaaaatacaaccgataacgctcgcgaaaaaaccgcctcaactcgacgtccaaatctaaataattaaaaacgccgacgataaaacgataacgcaaatcaataaaaatataataaatacgcaccaactcatcgcaacgtaaactcaaatcgcccttatccgtacgacgcacgcccaccgaattcacgcaccaacacaccgacgtctaattacactaacgcgccttaaaacgaccctcgaaatcgcaatcgaaatcgtaaaaaccatcgttatccacgaacgcgtactcactcgaccgcaccaacgtacgaacgttcttaaaaacgctcatacgcgccttaaacaacaaacacttaaaaatcaacgtaaaacaatcgaccgccatacccgaacccaacgcgcgacactaacaacgaccgccgaaaccgtcgaaactacacacgatcatcttattaataaaacacgtacaattatcctacgcgaccgtataaccgatcaccgccgccaacaccaacaacaacaacgacaaccgcaacgataacgacgcgaaaccgaaaccccgaaccattataaaacgaaaaaacgcgaaccgaacgcgaacgaataaaacgcgaaaactcgacgaaactcgaactccgacgtctaaaataatctacaaacgtctaccgcccgaccgctccctccgactcttatactctacccgacctacccgactaattccaccaccgaccgtccccactaatatttaaataacacatcccgcccccctccccgtcccacgaaaaaccaaaccgaccctacgccgcccgcgataaaatcaaaacaaaaaaactactcccgcctcctccgaaccgaaaaccgaaaaaaaaaaaaccgatactcacctataaacttctaaaaacccgccctcgacgcgacctcctactacaaacctaacgcgtctaaaccgctctcccgacaaaaaatctaaaaaatttcattacaaaatataactcgcgactatcgcgctctcctctat

SEQ ID NO: 38287 - DNA, 1600 bp, Artificial Sequence
  chemically treated genomic DNA (Homo sapiens) CpG-island No: 38287
ggagattttgaggttaggatttattaaatttggtgtgtgcgtaaaagggagggggaaggtaggaatttgaaaggataaacgttttttttgcgtcgaggaattaggaagcgtgatttatttgggtttgggacgatatcgaaattcggtattttattttattttttgtttcgtcgggtatttataagttcggttttttttttaatttttttagttttttgatttttatttttttgtattttttcgatttttttcggttggtgattattaggacggttatgtcggcgacgagggttattacgattattacgatgacggcgatgaggtcggcggtgaggcgttttatggagaatttcgggggaatttcgtttaggtaatagatgagcgtgcgttttatttgtaggggtttttcgcgtacgcgtaagtttaggtcgtcgcggttttggaatagagattcgtttttgatgtttttttcgaagtagtaggcggtatcgtcgatatttattttatcggcggttttttgagacgtgttttgtcgtagttcgatttggatggtgggttgttcgtagtgtacggtcgttacgaatttggggtgtagtcgatagcgttcgcggaagagtcgttttagttcggcgtttaggtttgagtggttgaaggcgtcggcggtggggcggtggcgtaggttaatgaggatgtggtgggtgcgtattagtttatcgtagcgtaggtttaggtcgtttttgttcgtgcggcgtacgtttatcgagtttacgtattagtatatcgacgtttggttgtattggcgcgttttgaagcggttttcggggtcgtagtcggggtcgtagaggttatcgttgtttacgagcgcgtgtttattcggtcgtattagcgtgcgggcgtttttgggggcgtttatgcgcgttttgagtagtagatatttggaggttagcgtggagtagtcgatcgttatgttcgagtttagcgcgcggtattggtagcggtcgtcggggtcgtcggggttgtatacggttattttgttggtgggatacgtgtagttgttttgcgcggtcgtgtggtcggttatcgtcgttagtattagtagtagtagcggtagtcgtagcggtggcggcgcgaggtcggggtttcgagttattgtggggcggaggaacgcggatcggacgcgggcggatgaggcgcggggattcggcggggttcgggtttcggcgtttgggatggtttgtaggcgtttgtcgttcggtcgtttttttcggtttttatattttattcgatttgttcggttggttttattatcgatcgtttttattggtatttgggtgatatatttcgttttttttttcgttttacggaaggttaagtcggttttgcgtcgttcgcgataggattagaatagggaagttgttttcgtttttttcggatcgaaagtcgggaaggggagaatcgatatttatttgtaggtttttggggattcgttttcggcgcggttttttgttatagatttggcgcgtttgggtcgttttttcggtagaaagtttaaagagttttattgtaaagtgtggttcgcgattgtcgcgtttttttttat

SEQ ID NO: 38288 - DNA, 1600 bp, Artificial Sequence
  chemically treated genomic DNA (Homo sapiens) CpG-island No: 38288
ataaaaaaaaacgcgacaatcgcgaaccacactttacaataaaactctttaaactttctaccgaaaaaacgacccaaacgcgccaaatctataacaaaaaaccgcgccgaaaacgaatccccaaaaacctacaaataaatatcgattctccccttcccgactttcgatccgaaaaaaacgaaaacaacttccctattctaatcctatcgcgaacgacgcaaaaccgacttaaccttccgtaaaacgaaaaaaaaaacgaaatatatcacccaaataccaataaaaacgatcgataataaaaccaaccgaacaaatcgaataaaatataaaaaccgaaaaaaacgaccgaacgacaaacgcctacaaaccatcccaaacgccgaaacccgaaccccgccgaatccccgcgcctcatccgcccgcgtccgatccgcgttcctccgccccacaataactcgaaaccccgacctcgcgccgccaccgctacgactaccgctactactactaatactaacgacgataaccgaccacacgaccgcgcaaaacaactacacgtatcccaccaacaaaataaccgtatacaaccccgacgaccccgacgaccgctaccaataccgcgcgctaaactcgaacataacgatcgactactccacgctaacctccaaatatctactactcaaaacgcgcataaacgcccccaaaaacgcccgcacgctaatacgaccgaataaacacgcgctcgtaaacaacgataacctctacgaccccgactacgaccccgaaaaccgcttcaaaacgcgccaatacaaccaaacgtcgatatactaatacgtaaactcgataaacgtacgccgcacgaacaaaaacgacctaaacctacgctacgataaactaatacgcacccaccacatcctcattaacctacgccaccgccccaccgccgacgccttcaaccactcaaacctaaacgccgaactaaaacgactcttccgcgaacgctatcgactacaccccaaattcgtaacgaccgtacactacgaacaacccaccatccaaatcgaactacgacaaaacacgtctcaaaaaaccgccgataaaataaatatcgacgataccgcctactacttcgaaaaaaacatcaaaaacgaatctctattccaaaaccgcgacgacctaaacttacgcgtacgcgaaaaacccctacaaataaaacgcacgctcatctattacctaaacgaaattcccccgaaattctccataaaacgcctcaccgccgacctcatcgccgtcatcgtaataatcgtaataaccctcgtcgccgacataaccgtcctaataatcaccaaccgaaaaaaatcgaaaaaatacaaaaaaataaaaatcaaaaaactaaaaaaattaaaaaaaaaaccgaacttataaatacccgacgaaacaaaaaataaaataaaataccgaatttcgatatcgtcccaaacccaaataaatcacgcttcctaattcctcgacgcaaaaaaaacgtttatcctttcaaattcctaccttccccctcccttttacgcacacaccaaatttaataaatcctaacctcaaaatctcc

SEQ ID NO: 38289 - DNA, 828 bp, Artificial Sequence
  chemically treated genomic DNA (Homo sapiens) CpG-island No: 38289
tttcgcgattttttgtattgtatttttttaagaatttagcgttagttttgggtttcggcggtcgagatttgggtagggcgtataggaaagtttaaaggtttaatgtatcgcgtagatttttttgcgggagaggggattgtaggggaaaagcggggtaaataaagtaaagtcgtcgtttattttttagttttttattttaatatttcgtatcggagttttcggattttttcgaattcgggatgtcgttcggatttcggtaaattatcgagtttttttttatttgagtcgcggtttttagtttttatttttacgcgcgggtcgggtcgttgggcgttgttattttaaaggtttcggagtttgagcggtttagggttagggttgcgaagcggcggagtcgcggtgtcgtcgggcggttgtaggaaagtttttttcgcgttagttgggtcgagtggagcggggcgggcggagtaggcggttggttaggtaggagcgcgttacggtcggtttcgcgtttttttcggcgtcgtcgttttacggttttcgggttttcgcggttattcggtttgtttagttttgttaatcgtaggtttagtcgtttatagtttcgttcgttaggttcgggatttagcgcgggcggggagtagaggggcgggggcgtatttgtttggttaatcgatttttttattatcgtttcgtttaggtcggattgggtagagtcgaggtttttcgtttcgagtatacgttttttagtttggtgtcggttcgagatgtcggcgggattatacgtttttttttttttcggagtttttaggtttttaggagtttaga

SEQ ID NO: 38290 - DNA, 828 bp, Artificial Sequence
  chemically treated genomic DNA (Homo sapiens) CpG-island No: 38290
tctaaactcctaaaaacctaaaaactccgaaaaaaaaaaaaacgtataatcccgccgacatctcgaaccgacaccaaactaaaaaacgtatactcgaaacgaaaaacctcgactctacccaatccgacctaaacgaaacgataataaaaaaatcgattaaccaaacaaatacgcccccgcccctctactccccgcccgcgctaaatcccgaacctaacgaacgaaactataaacgactaaacctacgattaacaaaactaaacaaaccgaataaccgcgaaaacccgaaaaccgtaaaacgacgacgccgaaaaaaacgcgaaaccgaccgtaacgcgctcctacctaaccaaccgcctactccgcccgccccgctccactcgacccaactaacgcgaaaaaaactttcctacaaccgcccgacgacaccgcgactccgccgcttcgcaaccctaaccctaaaccgctcaaactccgaaacctttaaaataacaacgcccaacgacccgacccgcgcgtaaaaataaaaactaaaaaccgcgactcaaataaaaaaaaactcgataatttaccgaaatccgaacgacatcccgaattcgaaaaaatccgaaaactccgatacgaaatattaaaataaaaaactaaaaaataaacgacgactttactttatttaccccgcttttcccctacaatcccctctcccgcaaaaaaatctacgcgatacattaaacctttaaactttcctatacgccctacccaaatctcgaccgccgaaacccaaaactaacgctaaattcttaaaaaaatacaatacaaaaaatcgcgaaa

SEQ ID NO: 38291 - DNA, 828 bp, Artificial Sequence
  chemically treated genomic DNA (Homo sapiens) CpG-island No: 38291
tttggatttttggaggtttggggatttcgggaggggagggggcgtgtggtttcgtcggtatttcgggtcggtattaggttggggagcgtgtgttcggagcggagggtttcggttttgtttagttcggtttgggcggggcggtggtggggaggtcgattgattaaataggtgcgttttcgtttttttgtttttcgttcgcgttgggtttcgggtttggcgggcggagttgtgggcggttgggtttgcgattggtagggttgggtaggtcgggtggtcgcgggagttcgggagtcgtagagcggcggcgtcgggggaggcgcggagtcggtcgtagcgcgtttttgtttggttagtcgtttatttcgttcgtttcgttttattcggtttagttggcgcgaaggaaatttttttgtagtcgttcggcgatatcgcgatttcgtcgtttcgtaattttggttttgggtcgtttaggtttcggagtttttgggatggtagcgtttagcggttcggttcgcgcgtagaggtaaaagttgggggtcgcggtttaggtggaggggggttcggtggtttgtcgggattcgagcggtatttcgggttcgagaggattcgggggtttcgatgcgaggtgttggggtaggggattgaggaatgggcggcgattttgttttatttatttcgttttttttttatagttttttttttcgtaaggaaatttgcgcgatgtattgagtttttaaatttttttgtgcgttttgtttagatttcgatcgtcgggatttagggttggcgttgggtttttgggagagtataatataggggatcgcgagg

SEQ ID NO: 38292 - DNA, 828 bp, Artificial Sequence
  chemically treated genomic DNA (Homo sapiens) CpG-island No: 38292
cctcgcgatcccctatattatactctcccaaaaacccaacgccaaccctaaatcccgacgatcgaaatctaaacaaaacgcacaaaaaaatttaaaaactcaatacatcgcgcaaatttccttacgaaaaaaaaaactataaaaaaaaaacgaaataaataaaacaaaatcgccgcccattcctcaatcccctaccccaacacctcgcatcgaaacccccgaatcctctcgaacccgaaataccgctcgaatcccgacaaaccaccgaacccccctccacctaaaccgcgacccccaacttttacctctacgcgcgaaccgaaccgctaaacgctaccatcccaaaaactccgaaacctaaacgacccaaaaccaaaattacgaaacgacgaaatcgcgatatcgccgaacgactacaaaaaaatttccttcgcgccaactaaaccgaataaaacgaaacgaacgaaataaacgactaaccaaacaaaaacgcgctacgaccgactccgcgcctcccccgacgccgccgctctacgactcccgaactcccgcgaccacccgacctacccaaccctaccaatcgcaaacccaaccgcccacaactccgcccgccaaacccgaaacccaacgcgaacgaaaaacaaaaaaacgaaaacgcacctatttaatcaatcgacctccccaccaccgccccgcccaaaccgaactaaacaaaaccgaaaccctccgctccgaacacacgctccccaacctaataccgacccgaaataccgacgaaaccacacgccccctcccctcccgaaatccccaaacctccaaaaatccaaa

SEQ ID NO: 38293 - DNA, 623 bp, Artificial Sequence
  chemically treated genomic DNA (Homo sapiens) CpG-island No: 38293
gtcggggtcgttttagtagtcggtagtagtaggaggatttttcggtgttttttttggcgttgtcgttcgcggatatgttgtcgttcgtcgggtatcgggtcgggtttgggcgcgtttatacgggttttatcggtcgtttcggatagttcggcgggcgtttacgcgttttttcgcgttcgttcgagcggtcgtcgaggttttggttgttttataaagtcgtttaaatttttttttcgttttttgttttttttcgtttttcgagtagtcggtttcgcggcgggggttggggattcggaggtcgggttggtatcggttcggaaagttagtgcgggagaaatttcggtttggaatcggcggggcgaggcggttcggagttttttcgggattttagacgggtcgtttcgagggttttggtttttattttcgttttcgagggttcgatcgtcgatttgagggcgtattaggtatttaatttcgttagcgcgggtagacggtgtatatttgtttgtgcgtttttcggagttcggggtaggacgtatgtttggggacggttatttttaattagggttcgtttttgttttaggttcgttgggttgagaaacgatttttattgtttcgtaggt

SEQ ID NO: 38294 - DNA, 623 bp, Artificial Sequence
  chemically treated genomic DNA (Homo sapiens) CpG-island No: 38294
acctacgaaacaataaaaatcgtttctcaacccaacgaacctaaaacaaaaacgaaccctaattaaaaataaccgtccccaaacatacgtcctaccccgaactccgaaaaacgcacaaacaaatatacaccgtctacccgcgctaacgaaattaaatacctaatacgccctcaaatcgacgatcgaaccctcgaaaacgaaaataaaaaccaaaaccctcgaaacgacccgtctaaaatcccgaaaaaactccgaaccgcctcgccccgccgattccaaaccgaaatttctcccgcactaactttccgaaccgataccaacccgacctccgaatccccaacccccgccgcgaaaccgactactcgaaaaacgaaaaaaaacaaaaaacgaaaaaaaaatttaaacgactttataaaacaaccaaaacctcgacgaccgctcgaacgaacgcgaaaaaacgcgtaaacgcccgccgaactatccgaaacgaccgataaaacccgtataaacgcgcccaaacccgacccgatacccgacgaacgacaacatatccgcgaacgacaacgccaaaaaaaacaccgaaaaatcctcctactactaccgactactaaaacgaccccgac

SEQ ID NO: 38295 - DNA, 623 bp, Artificial Sequence
  chemically treated genomic DNA (Homo sapiens) CpG-island No: 38295
gtttgcggagtagtgagggtcgttttttagtttagcgagtttggggtaggaacggattttaattgaaggtgatcgtttttaagtatgcgttttatttcgggtttcggagagcgtataagtaggtgtgtatcgtttattcgcgttggcgggattgggtgtttggtgcgtttttaggtcgacggtcgaattttcgggggcgggggtgggagttagaattttcgggacgattcgtttggggtttcggggaaatttcgggtcgtttcgtttcgtcgattttaggtcgggatttttttcgtattgatttttcgggtcggtgttagttcggttttcgggtttttagttttcgtcgcggggtcggttgttcggggagcgggagggggtaggaggcggaggaggagtttgagcgattttgtggggtagttagggtttcggcggtcgttcgggcgagcgcgggagaacgcgtgggcgttcgtcgggttgttcggagcggtcgatggggttcgtgtgagcgcgtttaggttcggttcggtgttcggcgggcggtagtatgttcgcgggcggtagcgttaggaagagtatcgggaggtttttttattattatcggttgttgaggcggtttcggt

SEQ ID NO: 38296 - DNA, 623 bp, Artificial Sequence
  chemically treated genomic DNA (Homo sapiens) CpG-island No: 38296
accgaaaccgcctcaacaaccgataataataaaaaaacctcccgatactcttcctaacgctaccgcccgcgaacatactaccgcccgccgaacaccgaaccgaacctaaacgcgctcacacgaaccccatcgaccgctccgaacaacccgacgaacgcccacgcgttctcccgcgctcgcccgaacgaccgccgaaaccctaactaccccacaaaatcgctcaaactcctcctccgcctcctaccccctcccgctccccgaacaaccgaccccgcgacgaaaactaaaaacccgaaaaccgaactaacaccgacccgaaaaatcaatacgaaaaaaatcccgacctaaaatcgacgaaacgaaacgacccgaaatttccccgaaaccccaaacgaatcgtcccgaaaattctaactcccacccccgcccccgaaaattcgaccgtcgacctaaaaacgcaccaaacacccaatcccgccaacgcgaataaacgatacacacctacttatacgctctccgaaacccgaaataaaacgcatacttaaaaacgatcaccttcaattaaaatccgttcctaccccaaactcgctaaactaaaaaacgaccctcactactccgcaaac

SEQ ID NO: 38297 - DNA, 722 bp, Artificial Sequence
  chemically treated genomic DNA (Homo sapiens) CpG-island No: 38297
atggttttttttacggtgaatttattttttagtaatgttcgattaattattacgtcgcgtatattagtgttacgtagggtcgttatattattaatgtcgttaatatcgtcggaggattgaaatgttatttgcggatatttggcgtatatttttttatataagagacgttagagtttgttagcgtgtcgtcgcgcgagatatcggtatatagtatatgttttaggtcgacgggtagatggtttttattagttgttttagtgaaacgttcgagtttttttgttagtcgttgattgttatttgtttgttgttttgttcgttaatacggatatttagcgttagtattaaggtatcggtatcgaagcgtttaaattagttttttattatattttgtgattttatcgcggtggagtcgattattacgcgcgtaacgttcgtttttagtaacgtcgttatatttttttcgttacgtacgtcgtcgttaatttgtatcggaacgttaacgttcgcgattagggtttaattagcgggatttgacgtttagtcggattttttgtttcggttagatttattaggtgtagtatttcggtattttgcgcggcgtaattttgtaatcgcggtagcgggtcgttatcgtaatcgcgttgtttgtcgtaatcgttttgatggagacgtattatagtgtcgtcgattaaatttaatgtcggaataattattatattttt

SEQ ID NO: 38298 - DNA, 722 bp, Artificial Sequence
  chemically treated genomic DNA (Homo sapiens) CpG-island No: 38298
aaaaatataataattattccgacattaaatttaatcgacgacactataatacgtctccatcaaaacgattacgacaaacaacgcgattacgataacgacccgctaccgcgattacaaaattacgccgcgcaaaataccgaaatactacacctaataaatctaaccgaaacaaaaaatccgactaaacgtcaaatcccgctaattaaaccctaatcgcgaacgttaacgttccgatacaaattaacgacgacgtacgtaacgaaaaaaatataacgacgttactaaaaacgaacgttacgcgcgtaataatcgactccaccgcgataaaatcacaaaatataataaaaaactaatttaaacgcttcgataccgataccttaatactaacgctaaatatccgtattaacgaacaaaacaacaaacaaataacaatcaacgactaacaaaaaaactcgaacgtttcactaaaacaactaataaaaaccatctacccgtcgacctaaaacatatactatataccgatatctcgcgcgacgacacgctaacaaactctaacgtctcttatataaaaaaatatacgccaaatatccgcaaataacatttcaatcctccgacgatattaacgacattaataatataacgaccctacgtaacactaatatacgcgacgtaataattaatcgaacattactaaaaaataaattcaccgtaaaaaaaaccat

SEQ ID NO: 38299 - DNA, 722 bp, Artificial Sequence
  chemically treated genomic DNA (Homo sapiens) CpG-island No: 38299
ggagatgtgatgattatttcggtattagatttaatcgacggtattgtggtgcgtttttattagggcgattacggtaaatagcgcgattacggtaacgattcgttgtcgcgattgtaggattacgtcgcgtagggtgtcgaagtgttgtatttggtggatttgatcggggtaaaagattcggttaaacgttaaatttcgttgattaaattttggtcgcgggcgttaacgtttcggtgtaggttggcggcggcgtgcgtagcgaagaagatgtggcggcgttattggaagcgggcgttgcgcgcgtagtggtcggttttatcgcggtgaaattataagatatggtgaaaggttggtttgaacgtttcggtgtcgatgttttagtgttggcgttggatgttcgtattgacgagtaaggtaataagtaggtggtagttagcggttggtaagagaattcgggcgttttattggaataattggtggaaattatttgttcgtcggtttgaaatatgtgttgtgtatcgatatttcgcgcgacggtacgttggtaggttttaacgttttttatatgaagaagtgtgcgttagatattcgtaggtggtattttagtttttcggcggtattggcgatattgatgatgtggcggttttgcgtggtattggtgtgcgcggcgtaatagttggtcgggtattattggaaggtaaatttatcgtgaaggaggttat

SEQ ID NO: 38300 - DNA, 722 bp, Artificial Sequence
  chemically treated genomic DNA (Homo sapiens) CpG-island No: 38300
ataacctccttcacgataaatttaccttccaataatacccgaccaactattacgccgcgcacaccaataccacgcaaaaccgccacatcatcaatatcgccaataccgccgaaaaactaaaataccacctacgaatatctaacgcacacttcttcatataaaaaacgttaaaacctaccaacgtaccgtcgcgcgaaatatcgatacacaacacatatttcaaaccgacgaacaaataatttccaccaattattccaataaaacgcccgaattctcttaccaaccgctaactaccacctacttattaccttactcgtcaatacgaacatccaacgccaacactaaaacatcgacaccgaaacgttcaaaccaacctttcaccatatcttataatttcaccgcgataaaaccgaccactacgcgcgcaacgcccgcttccaataacgccgccacatcttcttcgctacgcacgccgccgccaacctacaccgaaacgttaacgcccgcgaccaaaatttaatcaacgaaatttaacgtttaaccgaatcttttaccccgatcaaatccaccaaatacaacacttcgacaccctacgcgacgtaatcctacaatcgcgacaacgaatcgttaccgtaatcgcgctatttaccgtaatcgccctaataaaaacgcaccacaataccgtcgattaaatctaataccgaaataatcatcacatctcc

SEQ ID NO: 38301 - DNA, 521 bp, Artificial Sequence
  chemically treated genomic DNA (Homo sapiens) CpG-island No: 38301
gacggcgtcgagaatttttttattcgacgtagtaaggtgcgtattttggcgtatatttcgcggggtgaaaacggtttagttacgtagtcgttagtattaatttttagtttaagtaggcgatcgatttttttatttcgggtcgttaggaatagtataggtacgtcggatggagcgttagtaattggcggtataatttaaagtcgttaatattcggtagattaatatcgagaattatgacgtcgggtatttgtttgcgagttttatttagtatcggtaagtttcgtttaaagatttcgacggtaaaatttttttgttgtaatatgtagattagcgtgtcggttattttttgtttattttttattaattagatcgtttttcgttgtataaatcgtttttgttattgtcgttacggtatgataggaatcgcgttaatcgcgtttttcggcgaattttttataattttgtcggagtaagttagatagcgagcgcgttgcgtttggtattataaaagcgtacgaatt

SEQ ID NO: 38302 - DNA, 521 bp, Artificial Sequence
  chemically treated genomic DNA (Homo sapiens) CpG-island No: 38302
aattcgtacgcttttataataccaaacgcaacgcgctcgctatctaacttactccgacaaaattataaaaaattcgccgaaaaacgcgattaacgcgattcctatcataccgtaacgacaataacaaaaacgatttatacaacgaaaaacgatctaattaataaaaaataaacaaaaaataaccgacacgctaatctacatattacaacaaaaaaattttaccgtcgaaatctttaaacgaaacttaccgatactaaataaaactcgcaaacaaatacccgacgtcataattctcgatattaatctaccgaatattaacgactttaaattataccgccaattactaacgctccatccgacgtacctatactattcctaacgacccgaaataaaaaaatcgatcgcctacttaaactaaaaattaatactaacgactacgtaactaaaccgttttcaccccgcgaaatatacgccaaaatacgcaccttactacgtcgaataaaaaaattctcgacgccgtc

SEQ ID NO: 38303 - DNA, 521 bp, Artificial Sequence
  chemically treated genomic DNA (Homo sapiens) CpG-island No: 38303
agttcgtgcgtttttatgatgttaaacgtaacgcgttcgttatttggtttatttcgataaagttgtagaaggttcgtcgaaaaacgcgattagcgcggtttttgttatgtcgtggcggtaataatagaggcgatttatgtaacgggaaacggtttggttagtggaagatgagtaagggatagtcgatacgttggtttatatgttgtagtaggaaggttttgtcgtcgaggtttttgagcgaggtttgtcggtgttggataaagttcgtaagtaggtattcgacgttatgattttcgatgttggtttgtcggatattagcggttttgaattgtgtcgttagttattggcgttttattcggcgtatttgtattgtttttgacggttcgaagtgaagaggtcgatcgtttgtttgggttggaaattggtgttgacgattacgtggttaaatcgtttttatttcgcgaagtgtgcgttagggtgcgtattttattgcgtcgggtgaagaagttttcgacgtcgtt

SEQ ID NO: 38304 - DNA, 521 bp, Artificial Sequence
  chemically treated genomic DNA (Homo sapiens) CpG-island No: 38304
aacgacgtcgaaaacttcttcacccgacgcaataaaatacgcaccctaacgcacacttcgcgaaataaaaacgatttaaccacgtaatcgtcaacaccaatttccaacccaaacaaacgatcgacctcttcacttcgaaccgtcaaaaacaatacaaatacgccgaataaaacgccaataactaacgacacaattcaaaaccgctaatatccgacaaaccaacatcgaaaatcataacgtcgaatacctacttacgaactttatccaacaccgacaaacctcgctcaaaaacctcgacgacaaaaccttcctactacaacatataaaccaacgtatcgactatcccttactcatcttccactaaccaaaccgtttcccgttacataaatcgcctctattattaccgccacgacataacaaaaaccgcgctaatcgcgtttttcgacgaaccttctacaactttatcgaaataaaccaaataacgaacgcgttacgtttaacatcataaaaacgcacgaact

SEQ ID NO: 38305 - DNA, 558 bp, Artificial Sequence
  chemically treated genomic DNA (Homo sapiens) CpG-island No: 38305
ggtgttagcggcgtgttgtgtttgattggcggcgtgttgttgttgaaacgtcgtttgtttagtttacgcgtgcgtgtaattattatcggagcggatattttgattttgtcgttgttcgttatttagtgcgcgttgggtttgttgattatttcgtttttcgtttagtatatggacggtagcgagatgatgaaattgtttgttgggcgtagtcgtgtgattttttacgtggcgttttttaatattcgatgtgtggcgttaatttttcgtttgtatttgttgttggggatgacgtaatttttgttgttttcgttttcgcgtttgatatatatttggagcgtatcggtggagtatttgatacgtaagtattagttggtgcgcgttcgttattaagcgaattttagtttatatagattttgtttcgtcggggtttttttatgggtacggtgcggggtgagttgtcggatgcgtttcgtttattcgatttataggggaggatattgtaggttcggtaaacgtggtgttatcgggtaaaattagttcggagtaataggttttgat

SEQ ID NO: 38306 - DNA, 558 bp, Artificial Sequence
  chemically treated genomic DNA (Homo sapiens) CpG-island No: 38306
atcaaaacctattactccgaactaattttacccgataacaccacgtttaccgaacctacaatatcctcccctataaatcgaataaacgaaacgcatccgacaactcaccccgcaccgtacccataaaaaaaccccgacgaaacaaaatctatataaactaaaattcgcttaataacgaacgcgcaccaactaatacttacgtatcaaatactccaccgatacgctccaaatatatatcaaacgcgaaaacgaaaacaacaaaaattacgtcatccccaacaacaaatacaaacgaaaaattaacgccacacatcgaatattaaaaaacgccacgtaaaaaatcacacgactacgcccaacaaacaatttcatcatctcgctaccgtccatatactaaacgaaaaacgaaataatcaacaaacccaacgcgcactaaataacgaacaacgacaaaatcaaaatatccgctccgataataattacacgcacgcgtaaactaaacaaacgacgtttcaacaacaacacgccgccaatcaaacacaacacgccgctaacacc

SEQ ID NO: 38307 - DNA, 558 bp, Artificial Sequence
  chemically treated genomic DNA (Homo sapiens) CpG-island No: 38307
attaaaatttgttatttcgagttaattttgttcgatggtattacgtttatcgggtttataatatttttttttgtaggtcggataagcgaagcgtattcgataatttatttcgtatcgtgtttataaaaaaatttcgacgaagtagggtttatgtgaattaaaattcgtttagtgacgagcgcgtattagttggtatttacgtgttagatattttatcggtacgttttagatgtgtattagacgcgagaacgggaatagtaggaattacgttatttttagtaataggtgtagacggaagattaacgttatatatcgagtgttgagaagcgttacgtggaaggttatacgattgcgtttagtaaatagttttattatttcgttatcgtttatatgttgagcggagaacggaatggttaataggtttagcgcgtattggataacgagtagcgataggattaggatattcgtttcggtagtggttgtacgtacgcgtgggttgaatagacgacgttttagtaatagtacgtcgttaattagatatagtacgtcgttggtatt

SEQ ID NO: 38308 - DNA, 558 bp, Artificial Sequence
  chemically treated genomic DNA (Homo sapiens) CpG-island No: 38308
aataccaacgacgtactatatctaattaacgacgtactattactaaaacgtcgtctattcaacccacgcgtacgtacaaccactaccgaaacgaatatcctaatcctatcgctactcgttatccaatacgcgctaaacctattaaccattccgttctccgctcaacatataaacgataacgaaataataaaactatttactaaacgcaatcgtataaccttccacgtaacgcttctcaacactcgatatataacgttaatcttccgtctacacctattactaaaaataacgtaattcctactattcccgttctcgcgtctaatacacatctaaaacgtaccgataaaatatctaacacgtaaataccaactaatacgcgctcgtcactaaacgaattttaattcacataaaccctacttcgtcgaaatttttttataaacacgatacgaaataaattatcgaatacgcttcgcttatccgacctacaaaaaaaaatattataaacccgataaacgtaataccatcgaacaaaattaactcgaaataacaaattttaat

SEQ ID NO: 38309 - DNA, 532 bp, Artificial Sequence
  chemically treated genomic DNA (Homo sapiens) CpG-island No: 38309
ggcggcgattgatttgtaaattgtttaggatcgtttttttattattcgcgtttcgttggaagaagtcgagtaaacgttgattatttcggtggcgttggtgattttggtggtgtttttatttttgcgttcgggtcgcgttattattattttcgtcgtttcggtgtcggtttcgttgattggtacgtttgcggcgatgtatttgtgcggatttagttttaataatttttcgttaatggcgtttattatcgttattggtttcgtggtggatggacgttatcgtggtgttggaaaatattgtacgttatttggaagcgggaatgaaatcgttgtaagtcgtattgtaaggtagttcgcgaagtcggttttacggtgttgtcgatgagtttgttattggtggcggtgtttttgtcgttgttgttgatgggcggattgtcgggtcgattgttacgcgaatttgtcgtgacgttttttgtcgttattggtatatcgttgttggtttttttgatattaacgttaatgatgtgtggttgga

SEQ ID NO: 38310 - DNA, 532 bp, Artificial Sequence
  chemically treated genomic DNA (Homo sapiens) CpG-island No: 38310
tccaaccacacatcattaacgttaatatcaaaaaaaccaacaacgatataccaataacgacaaaaaacgtcacgacaaattcgcgtaacaatcgacccgacaatccgcccatcaacaacaacgacaaaaacaccgccaccaataacaaactcatcgacaacaccgtaaaaccgacttcgcgaactaccttacaatacgacttacaacgatttcattcccgcttccaaataacgtacaatattttccaacaccacgataacgtccatccaccacgaaaccaataacgataataaacgccattaacgaaaaattattaaaactaaatccgcacaaatacatcgccgcaaacgtaccaatcaacgaaaccgacaccgaaacgacgaaaataataataacgcgacccgaacgcaaaaataaaaacaccaccaaaatcaccaacgccaccgaaataatcaacgtttactcgacttcttccaacgaaacgcgaataataaaaaaacgatcctaaacaatttacaaatcaatcgccgcc

SEQ ID NO: 38311 - DNA, 532 bp, Artificial Sequence
  chemically treated genomic DNA (Homo sapiens) CpG-island No: 38311
tttagttatatattattggcgttaatgttagagaaattagtaacgatatattaatggcgatagaaagcgttacggtaaattcgcgtaatagtcggttcggtaattcgtttattaatagtagcggtaggaatatcgttattagtgatagatttatcgatagtatcgtaaaatcgatttcgcgagttattttgtagtgcggtttgtaacggttttattttcgtttttagatgacgtgtaatgttttttagtattacgatggcgtttatttattacgaaattagtagcgatggtgagcgttattaacgaaaggttattgagattgaattcgtataggtatatcgtcgtaaacgtattaattagcgaaatcggtatcgaaacggcgggaataatagtggcgcgattcgagcgtaggaataaaaatattattagaattattagcgttatcgagataattagcgtttgttcgattttttttagcgaggcgcgaatggtgggggagcgattttgggtaatttgtagattaatcgtcgtt

SEQ ID NO: 38312 - DNA, 532 bp, Artificial Sequence
  chemically treated genomic DNA (Homo sapiens) CpG-island No: 38312
aacgacgattaatctacaaattacccaaaatcgctcccccaccattcgcgcctcgctaaaaaaaatcgaacaaacgctaattatctcgataacgctaataattctaataatatttttattcctacgctcgaatcgcgccactattattcccgccgtttcgataccgatttcgctaattaatacgtttacgacgatatacctatacgaattcaatctcaataacctttcgttaataacgctcaccatcgctactaatttcgtaataaataaacgccatcgtaatactaaaaaacattacacgtcatctaaaaacgaaaataaaaccgttacaaaccgcactacaaaataactcgcgaaatcgattttacgatactatcgataaatctatcactaataacgatattcctaccgctactattaataaacgaattaccgaaccgactattacgcgaatttaccgtaacgctttctatcgccattaatatatcgttactaatttctctaacattaacgccaataatatataactaaa

SEQ ID NO: 38313 - DNA, 559 bp, Artificial Sequence
  chemically treated genomic DNA (Homo sapiens) CpG-island No: 38313
tacggtaggatcggtagggcgatgtttttttcggtttcgttatttatatttagtagtggtattaggtttttaaacgttagcgcgatatttagatcgttatcgttaatacggtaattattgtgatttagtaggttggttttacgatcgagacgcgaacgttattgcggttttattagtagtaatgaatagttagtcgtattatcgtcgatatttattattagtattcgtttttttttttgtaaggtggtttcgtaatttagtttagtcgcgatcggttcgtattggaatattacgtttttgaattcggtacgtttcgtcgcgcgttttagaattttttgcgtttgggtgtttgttttattatcgtttagtttttggaagttgatcggacgattaattatcgtttgagtaatcgtttttggtagttgtgtttgcgtttgttggcgaatgtgtaatattattgcgtagattagatttttaaatagcgttatttgttgcggttttaagtcgttggtatcgaggaacgattttggtgattttataaattatattttttttggat

SEQ ID NO: 38314 - DNA, 559 bp, Artificial Sequence
  chemically treated genomic DNA (Homo sapiens) CpG-island No: 38314
atccaaaaaaaatataatttataaaatcaccaaaatcgttcctcgataccaacgacttaaaaccgcaacaaataacgctatttaaaaatctaatctacgcaataatattacacattcgccaacaaacgcaaacacaactaccaaaaacgattactcaaacgataattaatcgtccgatcaacttccaaaaactaaacgataataaaacaaacacccaaacgcaaaaaattctaaaacgcgcgacgaaacgtaccgaattcaaaaacgtaatattccaatacgaaccgatcgcgactaaactaaattacgaaaccaccttacaaaaaaaaaaacgaatactaataataaatatcgacgataatacgactaactattcattactactaataaaaccgcaataacgttcgcgtctcgatcgtaaaaccaacctactaaatcacaataattaccgtattaacgataacgatctaaatatcgcgctaacgtttaaaaacctaataccactactaaatataaataacgaaaccgaaaaaaacatcgccctaccgatcctaccgta

SEQ ID NO: 38315 - DNA, 559 bp, Artificial Sequence
  chemically treated genomic DNA (Homo sapiens) CpG-island No: 38315
atttagaagaagtgtggtttgtgaaattattaaaatcgtttttcggtgttagcggtttaaaatcgtagtaggtagcgttgtttgaggatttggtttgcgtaatgatgttgtatattcgttagtaggcgtaggtatagttgttagaagcgattatttaggcggtgattggtcgttcgattaatttttaggggttgggcggtgatgaagtaaatatttaggcgtaagggattttggaacgcgcggcgaagcgtgtcggatttagggacgtggtattttagtacgagtcggtcgcggttgggttggattacgaagttattttgtaggaagaaaaacgggtgttggtggtggatatcggcggtggtacgattgattgtttattgttgttgatggggtcgtagtggcgttcgcgtttcgatcgtgaagttagtttgttgggttatagtggttgtcgtattggcggtaacgatttggatatcgcgttggcgtttaaaaatttgatgttattgttgggtatgggtggcgaaatcgaaaaaggtatcgttttgtcgattttgtcgtg

SEQ ID NO: 38316 - DNA, 559 bp, Artificial Sequence
  chemically treated genomic DNA (Homo sapiens) CpG-island No: 38316
cacgacaaaatcgacaaaacgatacctttttcgatttcgccacccatacccaacaataacatcaaatttttaaacgccaacgcgatatccaaatcgttaccgccaatacgacaaccactataacccaacaaactaacttcacgatcgaaacgcgaacgccactacgaccccatcaacaacaataaacaatcaatcgtaccaccgccgatatccaccaccaacacccgtttttcttcctacaaaataacttcgtaatccaacccaaccgcgaccgactcgtactaaaataccacgtccctaaatccgacacgcttcgccgcgcgttccaaaatcccttacgcctaaatatttacttcatcaccgcccaacccctaaaaattaatcgaacgaccaatcaccgcctaaataatcgcttctaacaactatacctacgcctactaacgaatatacaacatcattacgcaaaccaaatcctcaaacaacgctacctactacgattttaaaccgctaacaccgaaaaacgattttaataatttcacaaaccacacttcttctaaat

SEQ ID NO: 38317 - DNA, 546 bp, Artificial Sequence
  chemically treated genomic DNA (Homo sapiens) CpG-island No: 38317
tatcgcgtagtttagaagttattgtatgtgtcgtgttttcgtttgtatcggagttgcgttcgtagcgtttgttgattttaggttttagttgttcggggttaggttcgtttttcgtttcgtttttcgtttttcgtttcgtttcgtttttcgtttttcgttcggtacggttaaaggtgtcgtttcggttttttcgtttcgtttcgagtacgttttttatttcgtatcggttaatggtatcgtttcgttcgtttcgttttgggaacgtcggtaggtttcgggtgtagggcggtggtttaggggcggcggggaagatttggggtttgcgatttgttaggtgtttttaggttattgtttagttcgtcgcgcgttttcgagttttcgagggcgtttcgggacgcgaggagaaagtagttcgatttagtttcgagaggttcggtgtgcgggtagcggttagggattttgcggggtagcgcggatttttggatttttaataagggtcgttgcgtaggcgttgtaattattgtaggtatttgtttgtatgtttgg

SEQ ID NO: 38318 - DNA, 546 bp, Artificial Sequence
  chemically treated genomic DNA (Homo sapiens) CpG-island No: 38318
ccaaacatacaaacaaatacctacaataattacaacgcctacgcaacgacccttattaaaaatccaaaaatccgcgctaccccgcaaaatccctaaccgctacccgcacaccgaacctctcgaaactaaatcgaactactttctcctcgcgtcccgaaacgccctcgaaaactcgaaaacgcgcgacgaactaaacaataacctaaaaacacctaacaaatcgcaaaccccaaatcttccccgccgcccctaaaccaccgccctacacccgaaacctaccgacgttcccaaaacgaaacgaacgaaacgataccattaaccgatacgaaataaaaaacgtactcgaaacgaaacgaaaaaaccgaaacgacacctttaaccgtaccgaacgaaaaacgaaaaacgaaacgaaacgaaaaacgaaaaacgaaacgaaaaacgaacctaaccccgaacaactaaaacctaaaatcaacaaacgctacgaacgcaactccgatacaaacgaaaacacgacacatacaataacttctaaactacgcgata

SEQ ID NO: 38319 - DNA, 546 bp, Artificial Sequence
  chemically treated genomic DNA (Homo sapiens) CpG-island No: 38319
ttaggtatgtagataagtgtttgtagtgattgtagcgtttgcgtagcggtttttgttggaagtttaggagttcgcgttatttcgtaaagtttttggtcgttgttcgtatatcgaatttttcggggttgagtcgggttgtttttttttcgcgtttcggggcgttttcgggaattcgggagcgcgcggcgagttgaataatggtttggggatatttggtaggtcgtaggttttaaatttttttcgtcgtttttaggttatcgttttgtattcggaatttatcggcgtttttagagcggggcggacggggcggtgttattggtcggtgcggagtgaggggcgtgttcggggcgggacggagagatcggggcggtatttttggtcgtgtcgggcgagaggcggggagcggggcggggcgaggggcgaggggcggggcgaggggcgggtttggtttcgagtagttgaagtttggggttagtaggcgttgcgggcgtagtttcggtgtaagcgaggatacgatatatgtagtggtttttggattgcgcgatg

SEQ ID NO: 38320 - DNA, 546 bp, Artificial Sequence
  chemically treated genomic DNA (Homo sapiens) CpG-island No: 38320
catcgcgcaatccaaaaaccactacatatatcgtatcctcgcttacaccgaaactacgcccgcaacgcctactaaccccaaacttcaactactcgaaaccaaacccgcccctcgccccgcccctcgcccctcgccccgccccgctccccgcctctcgcccgacacgaccaaaaataccgccccgatctctccgtcccgccccgaacacgcccctcactccgcaccgaccaataacaccgccccgtccgccccgctctaaaaacgccgataaattccgaatacaaaacgataacctaaaaacgacgaaaaaaatttaaaacctacgacctaccaaatatccccaaaccattattcaactcgccgcgcgctcccgaattcccgaaaacgccccgaaacgcgaaaaaaaaacaacccgactcaaccccgaaaaattcgatatacgaacaacgaccaaaaactttacgaaataacgcgaactcctaaacttccaacaaaaaccgctacgcaaacgctacaatcactacaaacacttatctacatacctaa

SEQ ID NO: 38321 - DNA, 805 bp, Artificial Sequence
  chemically treated genomic DNA (Homo sapiens) CpG-island No: 38321
gacgttcgtttatacgtgaataaggttaatttatcgtggagtttgcgtttgaatttttgttttttaggttatttcggggttttagttgttcgggatgaaaaaacgatgttcgggtattaggggtcggggattagtaacgtcggcgtttagcgtaatcgttattttttttagttacggcgtacgcgttttttttttgttaaggaaggggcggggagtaggcggggcgggtatttttgaggttaatcgaaagcgagtattttcgtttttcgggtcgatggatttagtttgatttcggcggtgggcggaggaggcggggtaagtcgcgcggttaggaaggggcggggttcggggtttggaggcggggtttggggttgttagtttcgcgttcgtcgtcgcgttacggtttttcgtatgtcgtggttcgggtggttgttagcgttgtcgttcgtcgttcgttatttcggtattttaagtcgtttttcgtcgtttcggttcggcgcgtaggtaaggttggtcgcggttgtcgagttatcgcgttttttttttcgggttcggtttgacgcgcgggcgtttttttcgggtcgtgttagcgtcgtagttttcgattgcgttcgggggcggtttcggggggcgggacgagagttttttttatttttttaacgttttcgggcgtcggtttttttagttggggtttttcgtttggttttcgtagtttcggcgtagggagttgtttcgagttttttttttcgggtcgattatataattttcggttttggggcgggggtttttttttagttcgggtttt

SEQ ID NO: 38322 - DNA, 805 bp, Artificial Sequence
  chemically treated genomic DNA (Homo sapiens) CpG-island No: 38322
aaaacccgaactaaaaaaaaacccccgccccaaaaccgaaaattatataatcgacccgaaaaaaaaaactcgaaacaactccctacgccgaaactacgaaaaccaaacgaaaaaccccaactaaaaaaaccgacgcccgaaaacgttaaaaaaataaaaaaaactctcgtcccgccccccgaaaccgcccccgaacgcaatcgaaaactacgacgctaacacgacccgaaaaaaacgcccgcgcgtcaaaccgaacccgaaaaaaaaaacgcgataactcgacaaccgcgaccaaccttacctacgcgccgaaccgaaacgacgaaaaacgacttaaaataccgaaataacgaacgacgaacgacaacgctaacaaccacccgaaccacgacatacgaaaaaccgtaacgcgacgacgaacgcgaaactaacaaccccaaaccccgcctccaaaccccgaaccccgccccttcctaaccgcgcgacttaccccgcctcctccgcccaccgccgaaatcaaactaaatccatcgacccgaaaaacgaaaatactcgctttcgattaacctcaaaaatacccgccccgcctactccccgccccttccttaacaaaaaaaaaacgcgtacgccgtaactaaaaaaaataacgattacgctaaacgccgacgttactaatccccgacccctaatacccgaacatcgttttttcatcccgaacaactaaaaccccgaaataacctaaaaaacaaaaattcaaacgcaaactccacgataaattaaccttattcacgtataaacgaacgtc

SEQ ID NO: 38323 - DNA, 805 bp, Artificial Sequence
  chemically treated genomic DNA (Homo sapiens) CpG-island No: 38323
ggggttcgggttgaggaggggttttcgttttaggatcggaggttgtgtaatcggttcgggaaggggggttcgggatagttttttgcgtcggagttgcggaggttagacgggggattttagttgagggggtcggcgttcggaggcgttggggggatggggagggttttcgtttcgtttttcgggatcgttttcgggcgtagtcgggagttgcggcgttgatacggttcggagagggcgttcgcgcgttagatcgagttcgaggaggggggcgcgatggttcggtagtcgcggttagttttatttgcgcgtcgggtcggggcggcgggaggcggtttgggatgtcggggtggcgggcggcgggcggtagcgttggtagttattcgggttacggtatgcgaggagtcgtggcgcggcggcgggcgcgggattgatagttttaggtttcgtttttagatttcgggtttcgtttttttttggtcgcgcggtttgtttcgtttttttcgtttatcgtcggggttaaattgggtttatcggttcggagggcggggatgttcgttttcgattggttttaaaggtgttcgtttcgtttatttttcgttttttttttggtagggaagaggcgcgtgcgtcgtggttggggagggtagcggttacgttgagcgtcggcgttgttggttttcgatttttggtattcgggtatcgtttttttatttcgggtagttgggatttcgggatgatttaaggaataaggatttagacgtagattttacggtgaattggttttatttacgtgtgaacgaacgtt

SEQ ID NO: 38324 - DNA, 805 bp, Artificial Sequence
  chemically treated genomic DNA (Homo sapiens) CpG-island No: 38324
aacgttcgttcacacgtaaataaaaccaattcaccgtaaaatctacgtctaaatccttattccttaaatcatcccgaaatcccaactacccgaaataaaaaaacgatacccgaataccaaaaatcgaaaaccaacaacgccgacgctcaacgtaaccgctaccctccccaaccacgacgcacgcgcctcttccctaccaaaaaaaaaacgaaaaataaacgaaacgaacacctttaaaaccaatcgaaaacgaacatccccgccctccgaaccgataaacccaatttaaccccgacgataaacgaaaaaaacgaaacaaaccgcgcgaccaaaaaaaaacgaaacccgaaatctaaaaacgaaacctaaaactatcaatcccgcgcccgccgccgcgccacgactcctcgcataccgtaacccgaataactaccaacgctaccgcccgccgcccgccaccccgacatcccaaaccgcctcccgccgccccgacccgacgcgcaaataaaactaaccgcgactaccgaaccatcgcgcccccctcctcgaactcgatctaacgcgcgaacgccctctccgaaccgtatcaacgccgcaactcccgactacgcccgaaaacgatcccgaaaaacgaaacgaaaaccctccccatccccccaacgcctccgaacgccgaccccctcaactaaaatcccccgtctaacctccgcaactccgacgcaaaaaactatcccgaaccccccttcccgaaccgattacacaacctccgatcctaaaacgaaaacccctcctcaacccgaacccc

SEQ ID NO: 38325 - DNA, 569 bp, Artificial Sequence
  chemically treated genomic DNA (Homo sapiens) CpG-island No: 38325
tgcggtatcgtagtgcggggcgcgggatttatatttcggcgggcgtttttcgttcgggcgtagcgtttggtttttcggcgtagtcgatcgggtcgggaggcgagaggcgagaggcggttcggttttgtacgttcgttcggttagattcgttatgtagcggagtattttttcgcgggtagggagggtacggcggttatcgcgttgcgggttcgggggttgtagatatcggttgtttagaataggttttattcgtttttcggggcgtttattcgttcgtgcgtttattttcgggagtcgggttgtgttgggtcgtaattcgttagtttcggtggaggcggggtcgggagaataggggcggcgtcgtggtcggggcgagcgcggcgattaataggcggttttcggtcgggcgcggcgtcggggcgcgcggttgtagcggagtaggttgggaagcgtagttttcggttgagtttcgtcgcggtttcgtagttttttagtttcgttttttttcgataggtgttttttttcggaatcggggtttgaatttcgttatagttttgtaggggaggaag

SEQ ID NO: 38326 - DNA, 569 bp, Artificial Sequence
  chemically treated genomic DNA (Homo sapiens) CpG-island No: 38326
cttcctcccctacaaaactataacgaaattcaaaccccgattccgaaaaaaaacacctatcgaaaaaaaacgaaactaaaaaactacgaaaccgcgacgaaactcaaccgaaaactacgcttcccaacctactccgctacaaccgcgcgccccgacgccgcgcccgaccgaaaaccgcctattaatcgccgcgctcgccccgaccacgacgccgcccctattctcccgaccccgcctccaccgaaactaacgaattacgacccaacacaacccgactcccgaaaataaacgcacgaacgaataaacgccccgaaaaacgaataaaacctattctaaacaaccgatatctacaacccccgaacccgcaacgcgataaccgccgtaccctccctacccgcgaaaaaatactccgctacataacgaatctaaccgaacgaacgtacaaaaccgaaccgcctctcgcctctcgcctcccgacccgatcgactacgccgaaaaaccaaacgctacgcccgaacgaaaaacgcccgccgaaatataaatcccgcgccccgcactacgataccgca

SEQ ID NO: 38327 - DNA, 569 bp, Artificial Sequence
  chemically treated genomic DNA (Homo sapiens) CpG-island No: 38327
tttttttttttgtagagttgtggcggggtttagatttcgatttcgggagaggatatttgtcggggaagggcggggttgggggattgcggggtcgcgacgaggtttagtcgggaattacgttttttagtttgtttcgttgtagtcgcgcgtttcggcgtcgcgttcggtcgggagtcgtttgttgatcgtcgcgttcgtttcggttacggcgtcgtttttgttttttcggtttcgtttttatcggggttgacggattacggtttagtatagttcggttttcgggaatgagcgtacggacgggtgagcgtttcggggggcgggtggggtttgttttggatagtcggtgtttgtagttttcgggttcgtagcgcggtggtcgtcgtgttttttttgttcgcgggaggatgtttcgttatatggcgggtttgatcgggcgggcgtgtagagtcgggtcgtttttcgtttttcgtttttcggttcggtcggttgcgtcgggagattaggcgttgcgttcgggcgggaggcgttcgtcggggtgtgagtttcgcgtttcgtattgcggtgtcgta

SEQ ID NO: 38328 - DNA, 569 bp, Artificial Sequence
  chemically treated genomic DNA (Homo sapiens) CpG-island No: 38328
tacgacaccgcaatacgaaacgcgaaactcacaccccgacgaacgcctcccgcccgaacgcaacgcctaatctcccgacgcaaccgaccgaaccgaaaaacgaaaaacgaaaaacgacccgactctacacgcccgcccgatcaaacccgccatataacgaaacatcctcccgcgaacaaaaaaaacacgacgaccaccgcgctacgaacccgaaaactacaaacaccgactatccaaaacaaaccccacccgccccccgaaacgctcacccgtccgtacgctcattcccgaaaaccgaactatactaaaccgtaatccgtcaaccccgataaaaacgaaaccgaaaaaacaaaaacgacgccgtaaccgaaacgaacgcgacgatcaacaaacgactcccgaccgaacgcgacgccgaaacgcgcgactacaacgaaacaaactaaaaaacgtaattcccgactaaacctcgtcgcgaccccgcaatcccccaaccccgcccttccccgacaaatatcctctcccgaaatcgaaatctaaaccccgccacaactctacaaaaaaaaaaa

SEQ ID NO: 38329 - DNA, 533 bp, Artificial Sequence
  chemically treated genomic DNA (Homo sapiens) CpG-island No: 38329
gcgcgtttcgttgaatttcggttttttttcgtttttttttcgtgttttagattttttagtttttgttttttcggttttttttcggtttcgggtttcgttttttcgtttttttttttttcgaggttttttttttagtcgggcggggtagatcgtttcgtaaataggcggatggttcggggcgttgcgagcgtagatattcgtttttagagtcggtaattgattttttttagttgataatttatggtttgtatatgcgttttaatgcgggcgtttcgggaggcgcggtaggcggggcgggagcggggcgcgggtttgcgcggtcgttcgtttattcgttcgttcgtgttcgcgggagacgtgggcgtttttattcgggttgtttgtttagcgttttcgaggtcgcgcgcggcggaaggggtttgagttgggtcggacgtaaaggtcgggcggtttttgggcggcgtagggtttattggttggtttttcgaattgaatgcgggcgggggtatgtgggtattttttttttatgtagt

SEQ ID NO: 38330 - DNA, 533 bp, Artificial Sequence
  chemically treated genomic DNA (Homo sapiens) CpG-island No: 38330
actacataaaaaaaaaatacccacatacccccgcccgcattcaattcgaaaaaccaaccaataaaccctacgccgcccaaaaaccgcccgacctttacgtccgacccaactcaaaccccttccgccgcgcgcgacctcgaaaacgctaaacaaacaacccgaataaaaacgcccacgtctcccgcgaacacgaacgaacgaataaacgaacgaccgcgcaaacccgcgccccgctcccgccccgcctaccgcgcctcccgaaacgcccgcattaaaacgcatatacaaaccataaattatcaactaaaaaaaatcaattaccgactctaaaaacgaatatctacgctcgcaacgccccgaaccatccgcctatttacgaaacgatctaccccgcccgactaaaaaaaaaacctcgaaaaaaaaaaaaacgaaaaaacgaaacccgaaaccgaaaaaaaaccgaaaaaacaaaaactaaaaaatctaaaacacgaaaaaaaaacgaaaaaaaaccgaaattcaacgaaacgcgc

SEQ ID NO: 38331 - DNA, 533 bp, Artificial Sequence
  chemically treated genomic DNA (Homo sapiens) CpG-island No: 38331
gttgtatagggaaggggtgtttatatgttttcgttcgtatttagttcgaaggattagttagtaggttttgcgtcgtttagggatcgttcggtttttgcgttcggtttagtttaagtttttttcgtcgcgcgcggtttcgggagcgttgggtaggtagttcgggtgggagcgtttacgtttttcgcggatacggacggacggatggacgggcggtcgcgtaggttcgcgtttcgttttcgtttcgtttgtcgcgtttttcggggcgttcgtattaaagcgtatatgtaagttatgaattattaattgaaaggagttaattatcggttttaaaaacgagtgtttgcgttcgtagcgtttcgggttattcgtttatttacggagcgatttatttcgttcggttggggagggggtttcgggagggagagagacggagaaacggagttcgagatcgggagagagtcggagaggtagggattggagagtttgggatacgaaggagaggcggggagagatcgagatttagcgagacgcgt

SEQ ID NO: 38332 - DNA, 533 bp, Artificial Sequence
  chemically treated genomic DNA (Homo sapiens) CpG-island No: 38332
acgcgtctcgctaaatctcgatctctccccgcctctccttcgtatcccaaactctccaatccctacctctccgactctctcccgatctcgaactccgtttctccgtctctctccctcccgaaaccccctccccaaccgaacgaaataaatcgctccgtaaataaacgaataacccgaaacgctacgaacgcaaacactcgtttttaaaaccgataattaactcctttcaattaataattcataacttacatatacgctttaatacgaacgccccgaaaaacgcgacaaacgaaacgaaaacgaaacgcgaacctacgcgaccgcccgtccatccgtccgtccgtatccgcgaaaaacgtaaacgctcccacccgaactacctacccaacgctcccgaaaccgcgcgcgacgaaaaaaacttaaactaaaccgaacgcaaaaaccgaacgatccctaaacgacgcaaaacctactaactaatccttcgaactaaatacgaacgaaaacatataaacaccccttccctatacaac

SEQ ID NO: 38333 - DNA, 569 bp, Artificial Sequence
  chemically treated genomic DNA (Homo sapiens) CpG-island No: 38333
cgtttgttcggtttggcggggagcgggatgtcgttgggggcgatgttaggcgggtcgtttttgatagtttttaggttttggcgcgttttttcgtttttttcgcgtaggcgggcgtgggatttcggttgatttagttcgggttttgcggcggagcgggcgggttgcgcgtgcggcggttttaattgtcgcggtaggtagtagtaggttgaagggattatggtgtagtacgagttgtgggtcgcgttgtttggcgttttcggggtcgttttggtttgttgtttcgtggcggcggtcgtggttttgcgttggttcgggcgtcggacggcgcggggcgcggtggttcgggcgcgatagaggtagcgagcgggtttggagaatatggatagggcggcgtagcgttttcggttttaggtgattgtcggagcgtagtgggatgggcgcggtttgagggtattcgtagcggtatttttagtcgtcggattcgtcgagggataggggatggggcgggtagagtagatgtgtaattttttagaatttttttttgttttaagatatttcgtattttttga

SEQ ID NO: 38334 - DNA, 569 bp, Artificial Sequence
  chemically treated genomic DNA (Homo sapiens) CpG-island No: 38334
tcaaaaaatacgaaatatcttaaaacaaaaaaaaattctaaaaaattacacatctactctacccgccccatcccctatccctcgacgaatccgacgactaaaaataccgctacgaataccctcaaaccgcgcccatcccactacgctccgacaatcacctaaaaccgaaaacgctacgccgccctatccatattctccaaacccgctcgctacctctatcgcgcccgaaccaccgcgccccgcgccgtccgacgcccgaaccaacgcaaaaccacgaccgccgccacgaaacaacaaaccaaaacgaccccgaaaacgccaaacaacgcgacccacaactcgtactacaccataatcccttcaacctactactacctaccgcgacaattaaaaccgccgcacgcgcaacccgcccgctccgccgcaaaacccgaactaaatcaaccgaaatcccacgcccgcctacgcgaaaaaaacgaaaaaacgcgccaaaacctaaaaactatcaaaaacgacccgcctaacatcgcccccaacgacatcccgctccccgccaaaccgaacaaacg

SEQ ID NO: 38335 - DNA, 569 bp, Artificial Sequence
  chemically treated genomic DNA (Homo sapiens) CpG-island No: 38335
ttagaaagtgcggaatattttagggtaaggagagattttggagagttatatatttgttttgttcgttttattttttgtttttcggcgggttcggcggttgaaagtgtcgttgcgagtatttttaggtcgcgtttattttattacgtttcggtagttatttggagtcggaagcgttgcgtcgttttgtttatgttttttaggttcgttcgttgtttttgtcgcgttcggattatcgcgtttcgcgtcgttcggcgttcggattagcgtagggttacggtcgtcgttacgaagtagtaggttagggcgatttcggaggcgttaggtagcgcggtttatagttcgtattgtattatgatttttttagtttgttgttgtttatcgcgatagttgaagtcgtcgtacgcgtagttcgttcgtttcgtcgtaaaattcggattggattagtcgggattttacgttcgtttgcgcgggaggggcggggaagcgcgttagagtttagaggttattagaggcggttcgtttggtatcgtttttagcgatatttcgtttttcgttaagtcgagtaggcg

SEQ ID NO: 38336 - DNA, 569 bp, Artificial Sequence
  chemically treated genomic DNA (Homo sapiens) CpG-island No: 38336
cgcctactcgacttaacgaaaaacgaaatatcgctaaaaacgataccaaacgaaccgcctctaataacctctaaactctaacgcgcttccccgcccctcccgcgcaaacgaacgtaaaatcccgactaatccaatccgaattttacgacgaaacgaacgaactacgcgtacgacgacttcaactatcgcgataaacaacaacaaactaaaaaaatcataatacaatacgaactataaaccgcgctacctaacgcctccgaaatcgccctaacctactacttcgtaacgacgaccgtaaccctacgctaatccgaacgccgaacgacgcgaaacgcgataatccgaacgcgacaaaaacaacgaacgaacctaaaaaacataaacaaaacgacgcaacgcttccgactccaaataactaccgaaacgtaataaaataaacgcgacctaaaaatactcgcaacgacactttcaaccgccgaacccgccgaaaaacaaaaaataaaacgaacaaaacaaatatataactctccaaaatctctccttaccctaaaatattccgcactttctaa

SEQ ID NO: 38337 - DNA, 801 bp, Artificial Sequence
  chemically treated genomic DNA (Homo sapiens) CpG-island No: 38337
cgtttagttttaaggaaattacgtagtatttatattaaaaatagtttatacgagatcgtagtgtagataacggaaggatagggggtcgtagcggtcgggtttagcgcgtaggaaggtaataggcggtcgttagtcgtcgaggggtgttttcgttttcgtatcgagggaagcggtcgagttcgcgtcgattttttttttattcgtttatcgggatttaggcgtcgcgatggtttttcgaagcggttttgtaagtataagtcgcgtttgcgtttacgttcgttcgatttacggtttttagttcgtcgttatttttatcgttttttggttggcgtcggtttttagtttatttttatatcgggtttcgttttaggttattagcggaagtgcgggttcgtagtcgtagttattaattagttgttgtcgcgaggtaggtttcgttttcgcgttgagtcggtcggtcgtaggtttcgtttcggtcgttgttttttggttttggtgttttttagggggcggggtatgggaagagcggtcgcggtgtatcgtttacgtcgggcgttggcgttacgttcgggtagttggggttcgattaatttcgagttttcgttagggtggacggggagagtttgtcgcggaattttgatttcggtttcgttcggggttttttgcgggtggggcggtttcgggatgagttttgttgcgggtggggttagtttttattcgttggttattttcgtttttttttttttttttttttttttacgttttaggtgttttagcggatgtattacggtgacgaagtaa

SEQ ID NO: 38338 - DNA, 801 bp, Artificial Sequence
  chemically treated genomic DNA (Homo sapiens) CpG-island No: 38338
ttacttcgtcaccgtaatacatccgctaaaacacctaaaacgtaaaaaaaaaaaaaaaaaaaaaaaaacgaaaataaccaacgaataaaaactaaccccacccgcaacaaaactcatcccgaaaccgccccacccgcaaaaaaccccgaacgaaaccgaaatcaaaattccgcgacaaactctccccgtccaccctaacgaaaactcgaaattaatcgaaccccaactacccgaacgtaacgccaacgcccgacgtaaacgatacaccgcgaccgctcttcccataccccgccccctaaaaaacaccaaaaccaaaaaacaacgaccgaaacgaaacctacgaccgaccgactcaacgcgaaaacgaaacctacctcgcgacaacaactaattaataactacgactacgaacccgcacttccgctaataacctaaaacgaaacccgatataaaaataaactaaaaaccgacgccaaccaaaaaacgataaaaataacgacgaactaaaaaccgtaaatcgaacgaacgtaaacgcaaacgcgacttatacttacaaaaccgcttcgaaaaaccatcgcgacgcctaaatcccgataaacgaataaaaaaaaaatcgacgcgaactcgaccgcttccctcgatacgaaaacgaaaacacccctcgacgactaacgaccgcctattaccttcctacgcgctaaacccgaccgctacgaccccctatccttccgttatctacactacgatctcgtataaactatttttaatataaatactacgtaatttccttaaaactaaacg

SEQ ID NO: 38339 - DNA, 801 bp, Artificial Sequence
  chemically treated genomic DNA (Homo sapiens) CpG-island No: 38339
ttatttcgttatcgtagtatattcgttgagatatttgaggcgtggaaaaaagaagaaaaaagagggaacggaaatggttagcgggtaagggttgattttattcgtagtagagtttatttcggagtcgttttattcgtaggaagtttcgggcggggtcgaggttaaggtttcgcggtaaatttttttcgtttattttgacggggattcgggattggtcgggttttagttgttcggacgtgacgttagcgttcggcgtgggcggtgtatcgcggtcgttttttttatgtttcgttttttggggggtattaaaattagaaagtagcggtcggggcggggtttgcggtcggtcgatttagcgcgggggcggggtttatttcgcggtaatagttggttggtagttgcggttgcgggttcgtattttcgttggtggtttagagcggggttcggtatggaggtgggttagaggtcgacgttagttagagagcggtgagggtagcggcgggttggaggtcgtaggtcgggcgggcgtgagcgtaggcgcggtttgtgtttgtagggtcgtttcggggaattatcgcggcgtttaggtttcggtgggcggatgggggaagagtcggcgcgggttcggtcgtttttttcggtgcgggggcgggagtatttttcgacggttggcggtcgtttgttgtttttttgcgcgttggattcggtcgttgcgattttttgttttttcgttgtttatattgcggtttcgtgtgagttgtttttggtgtggatattgcgtagtttttttggggttgagcg

SEQ ID NO: 38340 - DNA, 801 bp, Artificial Sequence
  chemically treated genomic DNA (Homo sapiens) CpG-island No: 38340
cgctcaaccccaaaaaaactacgcaatatccacaccaaaaacaactcacacgaaaccgcaatataaacaacgaaaaaacaaaaaatcgcaacgaccgaatccaacgcgcaaaaaaacaacaaacgaccgccaaccgtcgaaaaatactcccgcccccgcaccgaaaaaaacgaccgaacccgcgccgactcttcccccatccgcccaccgaaacctaaacgccgcgataattccccgaaacgaccctacaaacacaaaccgcgcctacgctcacgcccgcccgacctacgacctccaacccgccgctaccctcaccgctctctaactaacgtcgacctctaacccacctccataccgaaccccgctctaaaccaccaacgaaaatacgaacccgcaaccgcaactaccaaccaactattaccgcgaaataaaccccgcccccgcgctaaatcgaccgaccgcaaaccccgccccgaccgctactttctaattttaataccccccaaaaaacgaaacataaaaaaaacgaccgcgatacaccgcccacgccgaacgctaacgtcacgtccgaacaactaaaacccgaccaatcccgaatccccgtcaaaataaacgaaaaaaatttaccgcgaaaccttaacctcgaccccgcccgaaacttcctacgaataaaacgactccgaaataaactctactacgaataaaatcaacccttacccgctaaccatttccgttccctcttttttcttcttttttccacgcctcaaatatctcaacgaatatactacgataacgaaataa

SEQ ID NO: 38341 - DNA, 1170 bp, Artificial Sequence
  chemically treated genomic DNA (Homo sapiens) CpG-island No: 38341
tttttgcgcgtaggggaggggcggggaggggttaatttttttttagaagatcgttcgcgatcgtcgtattttgttcgaggcgttgatggaagcggttaagatttatagtttcggttagattagttacgcgttgtacgacgtgggtggcgagtatcggcggaatatgtaaacgcgcgtgtttcgtcggagagaaaagttcgtttaatggcgggtttttcgtagggtcggtatagaagcgcgaggcggtgcggtttttggtcgaggtatacgtacgttttttgcgtcggttttgcgagatcgtcgatttgtcgcgatcggtttggtacgttttagtcgggtaagtcgaattagaacgtttttatcgagcgttttaatcgtatttatcgcgaggaggtgttcgattcgtatttgtttgttcgattggacgacgttttcgaggttacgtggcgttttttgatcgattataacgagtatcgtttttacgacgtttttagcggtatgatatcggttgagtatcgaaattattacgcggttagaaattttattttcgaattgttcgtttgacgggggaggttacgttgtaagatgttggacgatatcgtgtttttcgacgcgttgtatcgggtcggggattataattggcgtaagtttcgtcggatggacgataagcgttattttattattatcgtcgggagggtgagatggatcggaagttgggaggattgattgtagttatcggtttgttgtttgcgggttgcgcgacgaagttagttaattcgttagaggcgatttttgttttatcggatcgattgttcgtattttagatttcgattgtaggggacgttggtacgattatcgtcgtgcgcgacgtcgggtttttcggcggcgggtgttatatggtcgtttatatcgatggagtgtttgttgtacgtattggcgatcgggaataggcggttttttatgttttagtcggggagtatattgtcggtatcggttttataggtcgaggtatttgtcgtatcggcgaggagcgtttgcgtcgcgagacgcgggttgtagtcggtgtaggcgagagtaagaagtttcgtatttcgattaatttaaattcggggttagcgattgagtcgatcgtattttgagacgcgtatggtatttattaattgtattagt

SEQ ID NO: 38342 - DNA, 1170 bp, Artificial Sequence
  chemically treated genomic DNA (Homo sapiens) CpG-island No: 38342
actaatacaattaataaataccatacgcgtctcaaaatacgatcgactcaatcgctaaccccgaatttaaattaatcgaaatacgaaacttcttactctcgcctacaccgactacaacccgcgtctcgcgacgcaaacgctcctcgccgatacgacaaatacctcgacctataaaaccgataccgacaatatactccccgactaaaacataaaaaaccgcctattcccgatcgccaatacgtacaacaaacactccatcgatataaacgaccatataacacccgccgccgaaaaacccgacgtcgcgcacgacgataatcgtaccaacgtcccctacaatcgaaatctaaaatacgaacaatcgatccgataaaacaaaaatcgcctctaacgaattaactaacttcgtcgcgcaacccgcaaacaacaaaccgataactacaatcaatcctcccaacttccgatccatctcaccctcccgacgataataataaaataacgcttatcgtccatccgacgaaacttacgccaattataatccccgacccgatacaacgcgtcgaaaaacacgatatcgtccaacatcttacaacgtaacctcccccgtcaaacgaacaattcgaaaataaaatttctaaccgcgtaataatttcgatactcaaccgatatcataccgctaaaaacgtcgtaaaaacgatactcgttataatcgatcaaaaaacgccacgtaacctcgaaaacgtcgtccaatcgaacaaacaaatacgaatcgaacacctcctcgcgataaatacgattaaaacgctcgataaaaacgttctaattcgacttacccgactaaaacgtaccaaaccgatcgcgacaaatcgacgatctcgcaaaaccgacgcaaaaaacgtacgtatacctcgaccaaaaaccgcaccgcctcgcgcttctataccgaccctacgaaaaacccgccattaaacgaacttttctctccgacgaaacacgcgcgtttacatattccgccgatactcgccacccacgtcgtacaacgcgtaactaatctaaccgaaactataaatcttaaccgcttccatcaacgcctcgaacaaaatacgacgatcgcgaacgatcttctaaaaaaaaattaacccctccccgcccctcccctacgcgcaaaaa

SEQ ID NO: 38343 - DNA, 1170 bp, Artificial Sequence
  chemically treated genomic DNA (Homo sapiens) CpG-island No: 38343
gttgatgtaattgatgagtgttatgcgcgttttagaatgcggtcggtttaatcgttggtttcgagtttgggttgatcgagatgcggaattttttgttttcgtttgtatcgattatagttcgcgtttcgcggcgtaagcgtttttcgtcgatgcggtaggtgtttcggtttgtggggtcggtgtcgataatgtgtttttcggttggaatatggaaagtcgtttgttttcgatcgttaatgcgtgtagtaagtattttatcgatatagacggttatgtggtattcgtcgtcgaggaattcggcgtcgcgtacggcgatgatcgtgttagcgttttttgtaatcggagtttggaatgcgagtagtcggttcggtgggataggaatcgtttttgacgagttgattggtttcgtcgcgtagttcgtaagtaataggtcgatggttgtaattaatttttttagttttcgatttattttattttttcgacgatagtgatggggtggcgtttgtcgtttattcggcggggtttgcgttagttgtggttttcggttcggtatagcgcgtcgaagaatacgatgtcgtttaatattttgtaacgtaatttttttcgttaagcggatagttcgaaagtagagtttttggtcgcgtggtgatttcggtatttagtcggtgttatgtcgttgagggcgtcgtgggggcggtgttcgttgtagtcgattaggaagcgttacgtggtttcgaggacgtcgtttagtcgggtaaataggtacgggtcgagtattttttcgcgataggtgcggttgaagcgttcgatgaaggcgttttggttcggtttgttcggttggggcgtattaggtcgatcgcgataggtcgacgatttcgtaggatcggcgtagggggcgtgcgtgtatttcgattaggaatcgtatcgtttcgcgtttttgtgtcggttttacgaaaagttcgttattaggcgggttttttttttcgacgaggtacgcgcgtttatatatttcgtcggtattcgttatttacgtcgtatagcgcgtggttgatttggtcgaggttgtgggttttgatcgtttttattagcgtttcgaataaaatgcggcggtcgcgggcggttttttggaggaaggttaattttttttcgttttttttttgcgcgtagggg

SEQ ID NO: 38344 - DNA, 1170 bp, Artificial Sequence
  chemically treated genomic DNA (Homo sapiens) CpG-island No: 38344
cccctacgcgcaaaaaaaaaacgaaaaaaaattaaccttcctccaaaaaaccgcccgcgaccgccgcattttattcgaaacgctaataaaaacgatcaaaacccacaacctcgaccaaatcaaccacgcgctatacgacgtaaataacgaataccgacgaaatatataaacgcgcgtacctcgtcgaaaaaaaaaacccgcctaataacgaacttttcgtaaaaccgacacaaaaacgcgaaacgatacgattcctaatcgaaatacacgcacgccccctacgccgatcctacgaaatcgtcgacctatcgcgatcgacctaatacgccccaaccgaacaaaccgaaccaaaacgccttcatcgaacgcttcaaccgcacctatcgcgaaaaaatactcgacccgtacctatttacccgactaaacgacgtcctcgaaaccacgtaacgcttcctaatcgactacaacgaacaccgcccccacgacgccctcaacgacataacaccgactaaataccgaaatcaccacgcgaccaaaaactctactttcgaactatccgcttaacgaaaaaaattacgttacaaaatattaaacgacatcgtattcttcgacgcgctataccgaaccgaaaaccacaactaacgcaaaccccgccgaataaacgacaaacgccaccccatcactatcgtcgaaaaaataaaataaatcgaaaactaaaaaaattaattacaaccatcgacctattacttacgaactacgcgacgaaaccaatcaactcgtcaaaaacgattcctatcccaccgaaccgactactcgcattccaaactccgattacaaaaaacgctaacacgatcatcgccgtacgcgacgccgaattcctcgacgacgaataccacataaccgtctatatcgataaaatacttactacacgcattaacgatcgaaaacaaacgactttccatattccaaccgaaaaacacattatcgacaccgaccccacaaaccgaaacacctaccgcatcgacgaaaaacgcttacgccgcgaaacgcgaactataatcgatacaaacgaaaacaaaaaattccgcatctcgatcaacccaaactcgaaaccaacgattaaaccgaccgcattctaaaacgcgcataacactcatcaattacatcaac

SEQ ID NO: 38345 - DNA, 816 bp, Artificial Sequence
  chemically treated genomic DNA (Homo sapiens) CpG-island No: 38345
gtacgtggcgcggcggtggcggcgcggaggatttaggcgaaggcgaaggcgaaggcgaaggcgtaggcgaaggcgaaggcgtaggcggcgggaagttacgttaaagtcgtcgtcgtcgtcgttgtcggggtttgtttatagtttggtatcgggcggtagcggtggcggcggcggacgcggtaggtgtagcgatcgcgaagttcgggcggtcgcgcgttttcggaattttttcgcggttttcgaggtggtagtcgcgcgttattcggtagtttcgtagtcgagtttttgaatttttttggaaagttgcggggtagatacggtcgtagcggttgcggtaattcgaggaggaggaggaagaggaggacgacgagaaggagtaggtatagaaggaggaagcggcggagacgcgatgtcgggcgatttcggtcgttgtcgggcgcgttcgtttgtaattcggttgttggcgggcggcgtcgattttttttcgtgacgttacggttattatcgtcgtttttcgcgtcgcgtcgcgtcgggttcgcgttttcgttatcgaggtcgcgcgttcggtttcgcgtttttattggtcgcgttcgcgcgagcgagggacgtcgacgtgttagggagttaataggcgtagcgttcgtgagttcgttagcggattcggttcggatttcgttgtttttttgagaattcgtatatttttgagttcgtagttttgagtcgaatttcgagtttagtggtttcggtgtttataattacgagtgcgaggtaaagggagagggaggaagagattagagggagattagagaaagggaa

SEQ ID NO: 38346 - DNA, 816 bp, Artificial Sequence
  chemically treated genomic DNA (Homo sapiens) CpG-island No: 38346
ttccctttctctaatctccctctaatctcttcctccctctccctttacctcgcactcgtaattataaacaccgaaaccactaaactcgaaattcgactcaaaactacgaactcaaaaatatacgaattctcaaaaaaacaacgaaatccgaaccgaatccgctaacgaactcacgaacgctacgcctattaactccctaacacgtcgacgtccctcgctcgcgcgaacgcgaccaataaaaacgcgaaaccgaacgcgcgacctcgataacgaaaacgcgaacccgacgcgacgcgacgcgaaaaacgacgataataaccgtaacgtcacgaaaaaaaatcgacgccgcccgccaacaaccgaattacaaacgaacgcgcccgacaacgaccgaaatcgcccgacatcgcgtctccgccgcttcctccttctatacctactccttctcgtcgtcctcctcttcctcctcctcctcgaattaccgcaaccgctacgaccgtatctaccccgcaactttccaaaaaaattcaaaaactcgactacgaaactaccgaataacgcgcgactaccacctcgaaaaccgcgaaaaaattccgaaaacgcgcgaccgcccgaacttcgcgatcgctacacctaccgcgtccgccgccgccaccgctaccgcccgataccaaactataaacaaaccccgacaacgacgacgacgacgactttaacgtaacttcccgccgcctacgccttcgccttcgcctacgccttcgccttcgccttcgccttcgcctaaatcctccgcgccgccaccgccgcgccacgtac

SEQ ID NO: 38347 - DNA, 816 bp, Artificial Sequence
  chemically treated genomic DNA (Homo sapiens) CpG-island No: 38347
ttttttttttttggtttttttttgatttttttttttttttttttttgtttcgtattcgtgattgtggatatcgggattattggattcggagttcggtttagggttgcgggtttagggatgtgcgggtttttaaaagagtagcggagttcgagtcgagttcgttgacgggtttacgagcgttgcgtttattggttttttggtacgtcggcgtttttcgttcgcgcgggcgcggttaataggggcgcggggtcggacgcgcggtttcggtggcgggggcgcgggttcggcgcggcgcggcgcggggagcggcggtagtggtcgtgacgttacgggagggggtcggcgtcgttcgttagtagtcggattataagcgaacgcgttcggtagcggtcggagtcgttcggtatcgcgttttcgtcgttttttttttttgtgtttgttttttttcgtcgttttttttttttttttttttttcgggttgtcgtaatcgttgcggtcgtgtttgtttcgtaattttttaagaaagtttagaaattcggttacggggttgtcgagtggcgcgcggttgttatttcgggagtcgcgggggagtttcgagggcgcgcggtcgttcgggtttcgcggtcgttgtatttgtcgcgttcgtcgtcgttatcgttgtcgttcggtgttaggttgtgggtagatttcggtagcggcggcggcggcggttttggcgtagtttttcgtcgtttgcgttttcgttttcgtttgcgttttcgttttcgttttcgttttcgtttgggtttttcgcgtcgttatcgtcgcgttacgtgt

SEQ ID NO: 38348 - DNA, 816 bp, Artificial Sequence
  chemically treated genomic DNA (Homo sapiens) CpG-island No: 38348
acacgtaacgcgacgataacgacgcgaaaaacccaaacgaaaacgaaaacgaaaacgaaaacgcaaacgaaaacgaaaacgcaaacgacgaaaaactacgccaaaaccgccgccgccgccgctaccgaaatctacccacaacctaacaccgaacgacaacgataacgacgacgaacgcgacaaatacaacgaccgcgaaacccgaacgaccgcgcgccctcgaaactcccccgcgactcccgaaataacaaccgcgcgccactcgacaaccccgtaaccgaatttctaaactttcttaaaaaattacgaaacaaacacgaccgcaacgattacgacaacccgaaaaaaaaaaaaaaaaaaaaaacgacgaaaaaaaacaaacacaaaaaaaaaaaacgacgaaaacgcgataccgaacgactccgaccgctaccgaacgcgttcgcttataatccgactactaacgaacgacgccgaccccctcccgtaacgtcacgaccactaccgccgctccccgcgccgcgccgcgccgaacccgcgcccccgccaccgaaaccgcgcgtccgaccccgcgcccctattaaccgcgcccgcgcgaacgaaaaacgccgacgtaccaaaaaaccaataaacgcaacgctcgtaaacccgtcaacgaactcgactcgaactccgctactcttttaaaaacccgcacatccctaaacccgcaaccctaaaccgaactccgaatccaataatcccgatatccacaatcacgaatacgaaacaaaaaaaaaaaaaaaaaaaaatcaaaaaaaaaccaaaaaaaaaaaa

SEQ ID NO: 38349 - DNA, 613 bp, Artificial Sequence
  chemically treated genomic DNA (Homo sapiens) CpG-island No: 38349
  misc_feature (73)..(80): n is either a, c, g or t
  misc_feature (107)..(108): n is either a, c, g or t
  misc_feature (110)..(110): n is either a, c, g or t
  misc_feature (140)..(143): n is either a, c, g or t
  misc_feature (579)..(579): n is either a, c, g or t
gtgtggttagcgtgttttcggtagttttttagagcgcggattttgggtttataacgtggagtgtggttagcgnnnnnnnngtagttttttagagcgcggattttggnntnataacgtggagtgtggttagcgcggttttnnnnagttttttagagcgcggattttgggtttataacgtggagtgtggttagcgaggtttcggtagttttttagagcgcggattttgggtttataacgtggagtgtggttagcgaggtttcggtagttttttagagcgcggattttgggtttataacgtggagtgtggttagtgtgttttcggtagttttttagagcgcggattttgggtttataacgtggagtgtggttagcgaggtttcggtagttttttagagcgcggattttgggtttataacgtggagtgtggttagcgaggtttcggtagttttttagagcgcggattttgggtttataacgtggagtgtggttagtgtgttttcggtagttttttagagcgcggattttgggtttataacgtggagtgtggttagcgaggtttcggtagttttttagagcgtngattttgggtttataacgtggagtgtggttagtg

SEQ ID NO: 38350 - DNA, 613 bp, Artificial Sequence
  chemically treated genomic DNA (Homo sapiens) CpG-island No: 38350
  misc_feature (35)..(35): n is either a, c, g or t
  misc_feature (471)..(474): n is either a, c, g or t
  misc_feature (504)..(504): n is either a, c, g or t
  misc_feature (506)..(507): n is either a, c, g or t
  misc_feature (534)..(541): n is either a, c, g or t
cactaaccacactccacgttataaacccaaaatcnacgctctaaaaaactaccgaaacctcgctaaccacactccacgttataaacccaaaatccgcgctctaaaaaactaccgaaaacacactaaccacactccacgttataaacccaaaatccgcgctctaaaaaactaccgaaacctcgctaaccacactccacgttataaacccaaaatccgcgctctaaaaaactaccgaaacctcgctaaccacactccacgttataaacccaaaatccgcgctctaaaaaactaccgaaaacacactaaccacactccacgttataaacccaaaatccgcgctctaaaaaactaccgaaacctcgctaaccacactccacgttataaacccaaaatccgcgctctaaaaaactaccgaaacctcgctaaccacactccacgttataaacccaaaatccgcgctctaaaaaactnnnnaaaaccgcgctaaccacactccacgttatnannccaaaatccgcgctctaaaaaactacnnnnnnnncgctaaccacactccacgttataaacccaaaatccgcgctctaaaaaactaccgaaaacacgctaaccacac

SEQ ID NO: 38351 - DNA, 613 bp, Artificial Sequence
  chemically treated genomic DNA (Homo sapiens) CpG-island No: 38351
  misc_feature (35)..(35): n is either a, c, g or t
  misc_feature (471)..(474): n is either a, c, g or t
  misc_feature (504)..(504): n is either a, c, g or t
  misc_feature (506)..(507): n is either a, c, g or t
  misc_feature (534)..(541): n is either a, c, g or t
tattgattatattttacgttatgggtttagagttngcgttttgaggagttgtcggggtttcgttgattatattttacgttatgggtttagagttcgcgttttgagaagttgtcggggatatattgattatattttacgttatgggtttagagttcgcgttttgaggagttgtcggggtttcgttgattatattttacgttatgggtttagagttcgcgttttgaggagttgtcggggtttcgttgattatattttacgttatgggtttagagttcgcgttttgagaagttgtcggggatatattgattatattttacgttatgggtttagagttcgcgttttgaggagttgtcggggtttcgttgattatattttacgttatgggtttagagttcgcgttttgaggagttgtcggggtttcgttgattatattttacgttatgggtttagagttcgcgttttgaggagttnnnnggggtcgcgttgattatattttacgttatngnnttagagttcgcgttttgaggagttgtnnnnnnnncgttgattatattttacgttatgggtttagagttcgcgttttgaggagttgtcggggatacgttgattatat

SEQ ID NO: 38352 - DNA, 613 bp, Artificial Sequence
  chemically treated genomic DNA (Homo sapiens) CpG-island No: 38352
  misc_feature (73)..(80): n is either a, c, g or t
  misc_feature (107)..(108): n is either a, c, g or t
  misc_feature (110)..(110): n is either a, c, g or t
  misc_feature (140)..(143): n is either a, c, g or t
  misc_feature (579)..(579): n is either a, c, g or t
atataatcaacgtatccccgacaactcctcaaaacgcgaactctaaacccataacgtaaaatataatcaacgnnnnnnnnacaactcctcaaaacgcgaactctaanncnataacgtaaaatataatcaacgcgaccccnnnnaactcctcaaaacgcgaactctaaacccataacgtaaaatataatcaacgaaaccccgacaactcctcaaaacgcgaactctaaacccataacgtaaaatataatcaacgaaaccccgacaactcctcaaaacgcgaactctaaacccataacgtaaaatataatcaatatatccccgacaacttctcaaaacgcgaactctaaacccataacgtaaaatataatcaacgaaaccccgacaactcctcaaaacgcgaactctaaacccataacgtaaaatataatcaacgaaaccccgacaactcctcaaaacgcgaactctaaacccataacgtaaaatataatcaatatatccccgacaacttctcaaaacgcgaactctaaacccataacgtaaaatataatcaacgaaaccccgacaactcctcaaaacgcnaactctaaacccataacgtaaaatataatcaata

SEQ ID NO: 38353 - DNA, 1324 bp, Artificial Sequence
  chemically treated genomic DNA (Homo sapiens) CpG-island No: 38353
tttcgcgtttattggttggggtttttcgtttttgggcggagtggtgagggtcggttttcgtttttttgtttatggagcgcgtagttgttgcgtttttcgagcgttggggttgtttttaaagttttttatttagttttttaggttaattggggtttcgttttattttcgttttttttttcgtacgtttttcgtgtggtacggtttatattattagagtggcggcgcgtgtgggcgttcgtcgcgttttttcgttcgttttcgtcgggtcgtattttttatttcgagggtgtatttggtacggttcgcgtcgtttttttttttcgttcgggtggttatttttttttttttagtcggcggcgtttggtgtcgttcgggagaattaggttatcggtcggttttcgtgaaaataaaaataatcggtcgcgtcgtcgtaggtattcgaacgtcgcgagcggggtttggggacgcggagtcgagtgtagcgagcgaacgggagtagcggcgattcgtcggggggttagggcgttatggggtaggcgggtttcggttgcgcggggttttttcggcgtcgcggttagtgcgttcgtcgtttcggtcgttttagtttttcgcgtcgttcgtttggggaacgaggagtaggacgcggtttcggtggggttcgggtcgaacggttgcggatatttgggcgtcgaggagtcgagcgtcgtcgttttcggtatggattagtgcgtgacggtggagcgcgagttggagaaggtgttgtataagtttttaggttacgggtagttgtgtaagcgcggtttggaggagtttatcgattatatcggcggttttaagtacgagattttgtagagttacggtagggcgattcgcgtggtatcggggtaatgtgtaattgttcgagtttcggtttcggttcgcggcgggaattttttatttaatttttcgcgttttggttcggtttttgttttttttgaggcgcggaggtttttagatttttgagattttttttttttttcgttcgatttatttcgaatttgtcgcgatttcgttgttaatttagaaggagcgcgaattattcggaaatttagtcgggagcggcgggttttagttcggataaacgtgggtgagggggtcgtttatcgtatttgtaaattgtcgattttcgagtgggcgtttttcgtttttcgtttttagtcggtttcgggagttttacgtggtgttcgcggcgttgttttgtgggcggtgattgaatcgtttgggattttaggttttgagtgatgagggtagtgtaggaagtttcgttttttttttgtgtcgtttt

SEQ ID NO: 38354 - DNA, 1324 bp, Artificial Sequence
  chemically treated genomic DNA (Homo sapiens) CpG-island No: 38354
aaaacgacacaaaaaaaaaacgaaacttcctacactaccctcatcactcaaaacctaaaatcccaaacgattcaatcaccgcccacaaaacaacgccgcgaacaccacgtaaaactcccgaaaccgactaaaaacgaaaaacgaaaaacgcccactcgaaaatcgacaatttacaaatacgataaacgaccccctcacccacgtttatccgaactaaaacccgccgctcccgactaaatttccgaataattcgcgctccttctaaattaacaacgaaatcgcgacaaattcgaaataaatcgaacgaaaaaaaaaaaaaatctcaaaaatctaaaaacctccgcgcctcaaaaaaaacaaaaaccgaaccaaaacgcgaaaaattaaataaaaaattcccgccgcgaaccgaaaccgaaactcgaacaattacacattaccccgataccacgcgaatcgccctaccgtaactctacaaaatctcgtacttaaaaccgccgatataatcgataaactcctccaaaccgcgcttacacaactacccgtaacctaaaaacttatacaacaccttctccaactcgcgctccaccgtcacgcactaatccataccgaaaacgacgacgctcgactcctcgacgcccaaatatccgcaaccgttcgacccgaaccccaccgaaaccgcgtcctactcctcgttccccaaacgaacgacgcgaaaaactaaaacgaccgaaacgacgaacgcactaaccgcgacgccgaaaaaaccccgcgcaaccgaaacccgcctaccccataacgccctaaccccccgacgaatcgccgctactcccgttcgctcgctacactcgactccgcgtccccaaaccccgctcgcgacgttcgaatacctacgacgacgcgaccgattatttttattttcacgaaaaccgaccgataacctaattctcccgaacgacaccaaacgccgccgactaaaaaaaaaaaaataaccacccgaacgaaaaaaaaaaacgacgcgaaccgtaccaaatacaccctcgaaataaaaaatacgacccgacgaaaacgaacgaaaaaacgcgacgaacgcccacacgcgccgccactctaataatataaaccgtaccacacgaaaaacgtacgaaaaaaaaaacgaaaataaaacgaaaccccaattaacctaaaaaactaaataaaaaactttaaaaacaaccccaacgctcgaaaaacgcaacaactacgcgctccataaacaaaaaaacgaaaaccgaccctcaccactccgcccaaaaacgaaaaaccccaaccaataaacgcgaaa

SEQ ID NO: 38355 - DNA, 1324 bp, Artificial Sequence
  chemically treated genomic DNA (Homo sapiens) CpG-island No: 38355
ggggcggtatagaggggaaacggagttttttgtattgtttttattatttagaatttggggttttaggcgatttagttatcgtttatagaatagcgtcgcgggtattacgtgagattttcggggtcggttgggagcgggggacgaggggcgtttattcgggggtcggtagtttgtaggtgcgatgggcggtttttttatttacgtttattcggattggagttcgtcgttttcggttgggttttcgggtggttcgcgttttttttgaattggtagcgaggtcgcggtaggttcgaggtaaatcggacgaagaggggaaaaagttttaggggtttgggggttttcgcgttttaggggaggtaagggtcgggttagagcgcgaagggttgggtgagggattttcgtcgcgggtcgggatcggggttcgggtagttgtatattgtttcggtgttacgcgggtcgttttatcgtggttttgtaggatttcgtgtttgaggtcgtcggtgtagtcgatgagtttttttaggtcgcgtttgtatagttgttcgtagtttgagaatttgtgtagtattttttttagttcgcgttttatcgttacgtattgatttatgtcggaggcggcggcgttcggtttttcggcgtttaggtgttcgtagtcgttcggttcgggttttatcgaggtcgcgttttgtttttcgttttttaagcgggcggcgcgggaggttgaggcggtcgaggcggcgggcgtattagtcgcggcgtcgggggagtttcgcgtagtcggagttcgtttgttttatggcgttttagtttttcggcgagtcgtcgttgttttcgttcgttcgttgtattcggtttcgcgtttttaggtttcgttcgcgacgttcgggtgtttgcgacggcgcggtcgattgtttttgtttttacgggaatcgatcgatgatttggttttttcgggcggtattaagcgtcgtcgattggggggagggggatggttattcgggcgaggaaaggaggcggcgcgggtcgtattaagtatattttcggggtggggggtgcgattcggcgagaacgggcggaggaacgcgacgggcgtttatacgcgtcgttattttaatggtgtgggtcgtattatacggaaggcgtgcgagggagagggcgagggtggagcgaggttttaattggtttgaggagttaaatagggaattttggagatagttttagcgttcggagagcgtaataattacgcgttttataaataaggaggcggaaatcggtttttattatttcgtttagaagcggggaattttaattaatgggcgcgggg

SEQ ID NO: 38356 - DNA, 1324 bp, Artificial Sequence
  chemically treated genomic DNA (Homo sapiens) CpG-island No: 38356
ccccgcgcccattaattaaaattccccgcttctaaacgaaataataaaaaccgatttccgcctccttatttataaaacgcgtaattattacgctctccgaacgctaaaactatctccaaaattccctatttaactcctcaaaccaattaaaacctcgctccaccctcgccctctccctcgcacgccttccgtataatacgacccacaccattaaaataacgacgcgtataaacgcccgtcgcgttcctccgcccgttctcgccgaatcgcaccccccaccccgaaaatatacttaatacgacccgcgccgcctcctttcctcgcccgaataaccatccccctccccccaatcgacgacgcttaataccgcccgaaaaaaccaaatcatcgatcgattcccgtaaaaacaaaaacaatcgaccgcgccgtcgcaaacacccgaacgtcgcgaacgaaacctaaaaacgcgaaaccgaatacaacgaacgaacgaaaacaacgacgactcgccgaaaaactaaaacgccataaaacaaacgaactccgactacgcgaaactcccccgacgccgcgactaatacgcccgccgcctcgaccgcctcaacctcccgcgccgcccgcttaaaaaacgaaaaacaaaacgcgacctcgataaaacccgaaccgaacgactacgaacacctaaacgccgaaaaaccgaacgccgccgcctccgacataaatcaatacgtaacgataaaacgcgaactaaaaaaaatactacacaaattctcaaactacgaacaactatacaaacgcgacctaaaaaaactcatcgactacaccgacgacctcaaacacgaaatcctacaaaaccacgataaaacgacccgcgtaacaccgaaacaatatacaactacccgaaccccgatcccgacccgcgacgaaaatccctcacccaacccttcgcgctctaacccgacccttacctcccctaaaacgcgaaaacccccaaacccctaaaactttttcccctcttcgtccgatttacctcgaacctaccgcgacctcgctaccaattcaaaaaaaacgcgaaccacccgaaaacccaaccgaaaacgacgaactccaatccgaataaacgtaaataaaaaaaccgcccatcgcacctacaaactaccgacccccgaataaacgcccctcgtcccccgctcccaaccgaccccgaaaatctcacgtaatacccgcgacgctattctataaacgataactaaatcgcctaaaaccccaaattctaaataataaaaacaatacaaaaaactccgtttcccctctataccgcccc

SEQ ID NO: 38357 - DNA, 503 bp, Artificial Sequence
  chemically treated genomic DNA (Homo sapiens) CpG-island No: 38357
  misc_feature (346)..(346): n is either a, c, g or t
  misc_feature (427)..(427): n is either a, c, g or t
  misc_feature (450)..(450): n is either a, c, g or t
aggcgataatcgcgaaaaggagggtgatttttttcggcgggggtttcgggtgatattatattttttaaatgcgaaattaggtttcgggtcggtcgaaggcgtaatttttttttttcggcgttttatcggttttcgcgcgttttttttcgcgttcgagtttcgagttaagtagcgttttggggagcgcgttatggttttattagtgatcgttttgtttttgtcgttggttttgttgtttcgtgagtttgagacgttcgggaaggtaggggatggggcgggcggggggcggggggcgcggattgcgggtttagttcgttgtttgtcgtttgtagacgtcgttagcgangtttagtttcgggtgtcgtcgttggatcggatttggaatttggggcgagatagtggagttgaagtgttaggtgttgttgtntaattcgacgttcggttgttcgntgtttttttagcgcgcgcgtcgcgaagttttttatttttttttatattttttt

SEQ ID NO: 38358 - DNA, 503 bp, Artificial Sequence
  chemically treated genomic DNA (Homo sapiens) CpG-island No: 38358
  misc_feature (54)..(54): n is either a, c, g or t
  misc_feature (77)..(77): n is either a, c, g or t
  misc_feature (158)..(158): n is either a, c, g or t
aaaaaaatataaaaaaaaataaaaaacttcgcgacgcgcgcgctaaaaaaacancgaacaaccgaacgtcgaattanacaacaacacctaacacttcaactccactatctcgccccaaattccaaatccgatccaacgacgacacccgaaactaaacntcgctaacgacgtctacaaacgacaaacaacgaactaaacccgcaatccgcgccccccgccccccgcccgccccatcccctaccttcccgaacgtctcaaactcacgaaacaacaaaaccaacgacaaaaacaaaacgatcactaataaaaccataacgcgctccccaaaacgctacttaactcgaaactcgaacgcgaaaaaaaacgcgcgaaaaccgataaaacgccgaaaaaaaaaaattacgccttcgaccgacccgaaacctaatttcgcatttaaaaaatataatatcacccgaaacccccgccgaaaaaaatcaccctccttttcgcgattatcgcct

SEQ ID NO: 38359 - DNA, 503 bp, Artificial Sequence
  chemically treated genomic DNA (Homo sapiens) CpG-island No: 38359
  misc_feature (54)..(54): n is either a, c, g or t
  misc_feature (77)..(77): n is either a, c, g or t
  misc_feature (158)..(158): n is either a, c, g or t
gaagaggtatagaagaaagtgggaaatttcgcggcgcgcgcgttggaagagtancgagtagtcggacgtcgggttgnatagtagtatttggtattttagttttattgtttcgttttaggttttaggttcgatttagcggcgatattcggaattgggtntcgttggcggcgtttgtaggcggtaagtagcgagttgagttcgtagttcgcgtttttcgtttttcgttcgttttattttttgttttttcgggcgttttaaatttacggagtagtaaggttagcggtaggagtaaggcggttattggtaaggttatgacgcgttttttaggacgttgtttggttcgaagttcgggcgcgaggggaggcgcgcgggagtcggtggggcgtcgaggggggaaagttgcgttttcggtcggttcggagtttgatttcgtatttggaggatgtgatgttattcgaagttttcgtcgaggagagttattttttttttcgcggttgtcgttt

SEQ ID NO: 38360 - DNA, 503 bp, Artificial Sequence
  chemically treated genomic DNA (Homo sapiens) CpG-island No: 38360
  misc_feature (346)..(346): n is either a, c, g or t
  misc_feature (427)..(427): n is either a, c, g or t
  misc_feature (450)..(450): n is either a, c, g or t
aaacgacaaccgcgaaaaaaaaaataactctcctcgacgaaaacttcgaataacatcacatcctccaaatacgaaatcaaactccgaaccgaccgaaaacgcaactttcccccctcgacgccccaccgactcccgcgcgcctcccctcgcgcccgaacttcgaaccaaacaacgtcctaaaaaacgcgtcataaccttaccaataaccgccttactcctaccgctaaccttactactccgtaaatttaaaacgcccgaaaaaacaaaaaataaaacgaacgaaaaacgaaaaacgcgaactacgaactcaactcgctacttaccgcctacaaacgccgccaacganacccaattccgaatatcgccgctaaatcgaacctaaaacctaaaacgaaacaataaaactaaaataccaaatactactatncaacccgacgtccgactactcgntactcttccaacgcgcgcgccgcgaaatttcccactttcttctatacctcttc

SEQ ID NO: 38361 - DNA, 771 bp, Artificial Sequence
  chemically treated genomic DNA (Homo sapiens) CpG-island No: 38361
ggatcgttcgagcgtttttttgttttaaggaggcgatttcgatttcggatttcgggaaaacggcgagcgcgggtatcgaatttcggtaagggtcggagcgggttgttatcggttttcgtattttttttttgcggtcgcggtcggtcgttttttttttagtttgatagtcgttgtagttacggacggagcgtttttgttttagcgtcgtcgttcgttcggacgttcgtattttcgtgttttacgcggaggggggtagtgtcgggaagattttttcggatttttttttcgttttggtttttagatttcggaaaagcggttatttggcgcgcgggttggggcgagagtacgattcggtggaggaggaagagaagatagtggttttcggtttagggagatttgggaaatttgggagatttgtttcgtattaggtgatagttgttcgttgcgtacgcgtataggatttcggtcgttcgattattgcgtcgcgttttattttttcgtcgagggggtgggtgggaggtagcggcgaaggcgcgcgtatcgtcggttttttttgcgcgagggcgcgcgcgtcgttacgtgatcgttggggttcgtatttggtgagttacgtgggtttataaatagtttaaaggtgttcggtacgtttttgttttgggtttaattttcgcgttgtggttaatttaggtttgttggcgcgtatttttttgttttttggatataggtatattttatttttttcggaggggaaagatattcgcgtagaaggag

SEQ ID NO: 38362 - DNA, 771 bp, Artificial Sequence
  chemically treated genomic DNA (Homo sapiens) CpG-island No: 38362
ctccttctacgcgaatatctttcccctccgaaaaaaataaaatatacctatatccaaaaaacaaaaaaatacgcgccaacaaacctaaattaaccacaacgcgaaaattaaacccaaaacaaaaacgtaccgaacacctttaaactatttataaacccacgtaactcaccaaatacgaaccccaacgatcacgtaacgacgcgcgcgccctcgcgcaaaaaaaaccgacgatacgcgcgccttcgccgctacctcccacccaccccctcgacgaaaaaataaaacgcgacgcaataatcgaacgaccgaaatcctatacgcgtacgcaacgaacaactatcacctaatacgaaacaaatctcccaaatttcccaaatctccctaaaccgaaaaccactatcttctcttcctcctccaccgaatcgtactctcgccccaacccgcgcgccaaataaccgcttttccgaaatctaaaaaccaaaacgaaaaaaaaatccgaaaaaatcttcccgacactacccccctccgcgtaaaacacgaaaatacgaacgtccgaacgaacgacgacgctaaaacaaaaacgctccgtccgtaactacaacgactatcaaactaaaaaaaaaacgaccgaccgcgaccgcaaaaaaaaaatacgaaaaccgataacaacccgctccgacccttaccgaaattcgatacccgcgctcgccgttttcccgaaatccgaaatcgaaatcgcctccttaaaacaaaaaaacgctcgaacgatcc

SEQ ID NO: 38363 - DNA, 771 bp, Artificial Sequence
  chemically treated genomic DNA (Homo sapiens) CpG-island No: 38363
ttttttttacgcgagtatttttttttttcggaaagaatgggatatgtttgtgtttaaaggataagaagatgcgcgttagtaagtttaagttaattatagcgcggaagttgagtttaaagtaagagcgtgtcgggtatttttaagttgtttgtaagtttacgtgatttattaagtgcgggttttagcggttacgtgacggcgcgcgcgttttcgcgtagggagagtcggcggtgcgcgcgttttcgtcgttgttttttatttattttttcgacgggagggtgaggcgcggcgtagtgatcgggcggtcggggttttgtgcgcgtgcgtagcgaatagttgttatttagtgcggaataagttttttaaattttttaaatttttttgggtcggaggttattgtttttttttttttttttatcgagtcgtgttttcgttttaattcgcgcgttaggtaatcgttttttcggagtttgggggttagggcggggggagggttcggagaggttttttcggtattgttttttttcgcgtggggtacgggggtgcgggcgttcgggcgagcggcgacgttggggtagagacgtttcgttcgtgattgtagcgattgttaagttggggagggagcggtcggtcgcggtcgtaggggagggatgcgggggtcggtgatagttcgtttcggtttttatcgaggttcggtattcgcgttcgtcgttttttcgggattcggagtcggggtcgtttttttggggtagaggagcgttcgggcggttt

SEQ ID NO: 38364 - DNA, 771 bp, Artificial Sequence
  chemically treated genomic DNA (Homo sapiens) CpG-island No: 38364
aaaccgcccgaacgctcctctaccccaaaaaaacgaccccgactccgaatcccgaaaaaacgacgaacgcgaataccgaacctcgataaaaaccgaaacgaactatcaccgacccccgcatccctcccctacgaccgcgaccgaccgctccctccccaacttaacaatcgctacaatcacgaacgaaacgtctctaccccaacgtcgccgctcgcccgaacgcccgcacccccgtaccccacgcgaaaaaaaacaataccgaaaaaacctctccgaaccctccccccgccctaacccccaaactccgaaaaaacgattacctaacgcgcgaattaaaacgaaaacacgactcgataaaaaaaaaaaaaaaaacaataacctccgacccaaaaaaatttaaaaaatttaaaaaacttattccgcactaaataacaactattcgctacgcacgcgcacaaaaccccgaccgcccgatcactacgccgcgcctcaccctcccgtcgaaaaaataaataaaaaacaacgacgaaaacgcgcgcaccgccgactctccctacgcgaaaacgcgcgcgccgtcacgtaaccgctaaaacccgcacttaataaatcacgtaaacttacaaacaacttaaaaatacccgacacgctcttactttaaactcaacttccgcgctataattaacttaaacttactaacgcgcatcttcttatcctttaaacacaaacatatcccattctttccgaaaaaaaaaaatactcgcgtaaaaaaaa

SEQ ID NO: 38365 - DNA, 612 bp, Artificial Sequence
  chemically treated genomic DNA (Homo sapiens) CpG-island No: 38365
ggttttttggaagcgacgttttttgtgcgttacgtaatacgttgtaggaaaggtatattggggggtattacgtgatcgttaatcgttggggcgagtaggcgtttagaatttagcgatcgtttatggttagggagtttttagttacgtttttttttttaatattatttttcgcgttttatttaagtaagcgttattttttcgtagttttttgttttttaaagtttcggaagttttggtttttttaaggtggggaaacggaggaacggacgtgaagggagttgtgggacgcgcgatcgtggagttggattgtatcgagttttagcgcgtattcgggtttcgggagttttatcgagtcgtgacgttagaggcggggtcgagtattgggcgatttttgagttcggggtttcgcgggttcggcggttttttgtttcgtttttttgtttttgggttattttttttaagtgggaagatttaggttttgttaatcggttattcgagattttggagtaacggtcgcgtttgtttgtaaaattttttttattgtgtggtattcgttttgcgtaggtggagtttttaaatgggaatatttggacgaggttttgatgggaaacg

SEQ ID NO: 38366 - DNA, 612 bp, Artificial Sequence
  chemically treated genomic DNA (Homo sapiens) CpG-island No: 38366
cgtttcccatcaaaacctcgtccaaatattcccatttaaaaactccacctacgcaaaacgaataccacacaataaaaaaaattttacaaacaaacgcgaccgttactccaaaatctcgaataaccgattaacaaaacctaaatcttcccacttaaaaaaaataacccaaaaacaaaaaaacgaaacaaaaaaccgccgaacccgcgaaaccccgaactcaaaaatcgcccaatactcgaccccgcctctaacgtcacgactcgataaaactcccgaaacccgaatacgcgctaaaactcgatacaatccaactccacgatcgcgcgtcccacaactcccttcacgtccgttcctccgtttccccaccttaaaaaaaccaaaacttccgaaactttaaaaaacaaaaaactacgaaaaaataacgcttacttaaataaaacgcgaaaaataatattaaaaaaaaaaacgtaactaaaaactccctaaccataaacgatcgctaaattctaaacgcctactcgccccaacgattaacgatcacgtaataccccccaatatacctttcctacaacgtattacgtaacgcacaaaaaacgtcgcttccaaaaaacc

SEQ ID NO: 38367 - DNA, 612 bp, Artificial Sequence
  chemically treated genomic DNA (Homo sapiens) CpG-island No: 38367
cgttttttattagagtttcgtttaggtgtttttatttaaaggttttatttgcgtagggcgggtgttatataatgaggagagttttgtaaataaacgcggtcgttgttttaaggtttcgggtaatcgattggtaaaatttaggtttttttatttagggaagatggtttaagagtaagaaggcgaaataagaggtcgtcggattcgcgaagtttcgagtttagaggtcgtttagtgttcggtttcgtttttgacgttacggttcggtgggattttcggagttcggatgcgcgttgggattcggtgtagtttagttttacggtcgcgcgttttatagttttttttacgttcgttttttcgtttttttattttgggagggttaggattttcgaggttttagggggtaggaagttgcgagaaggtggcgtttgtttaggtgaggcgcggaggatggtattagagagaggaacgtgattggaagttttttggttatggacgatcgttgggttttaggcgtttgttcgttttagcggttgacggttacgtgatattttttagtgtattttttttgtagcgtgttacgtggcgtatagagaacgtcgtttttagaggatt

SEQ ID NO: 38368 - DNA, 612 bp, Artificial Sequence
  chemically treated genomic DNA (Homo sapiens) CpG-island No: 38368
aatcctctaaaaacgacgttctctatacgccacgtaacacgctacaaaaaaaatacactaaaaaatatcacgtaaccgtcaaccgctaaaacgaacaaacgcctaaaacccaacgatcgtccataaccaaaaaacttccaatcacgttcctctctctaataccatcctccgcgcctcacctaaacaaacgccaccttctcgcaacttcctaccccctaaaacctcgaaaatcctaaccctcccaaaataaaaaaacgaaaaaacgaacgtaaaaaaaactataaaacgcgcgaccgtaaaactaaactacaccgaatcccaacgcgcatccgaactccgaaaatcccaccgaaccgtaacgtcaaaaacgaaaccgaacactaaacgacctctaaactcgaaacttcgcgaatccgacgacctcttatttcgccttcttactcttaaaccatcttccctaaataaaaaaacctaaattttaccaatcgattacccgaaaccttaaaacaacgaccgcgtttatttacaaaactctcctcattatataacacccgccctacgcaaataaaacctttaaataaaaacacctaaacgaaactctaataaaaaacg

SEQ ID NO: 38369 - DNA, 898 bp, Artificial Sequence
  chemically treated genomic DNA (Homo sapiens) CpG-island No: 38369
acgcgaatttcgcgggtcggcgtggttttggtcgggtagggggcggggcgagcgtcggtgacgcggtcgttgttatgggaattcgtcgttcgttcgttttttggagttggagtcggagttgtcgttagtcgttcgttttaggttttttttgttagtcgtgcggttaggttcgcggggtggtcggggggagtcgggcggtagagaaggagggagcgggtacggttttttagtcgagatcggtaagtcgaagtttttgagtcgttcgttgtcgttgtcgtcgtcgtcgtcgcgatcgcgagggataaggataagcgtcgagtagcgtttgtttaattttcggaacgcgtattcgttttaacgtttagatacggatcgtgcgggtcgttttcgttttagcgtcgttttattttagttcggttcgcgttttggacgttttcgtatttttggtcggtttcggtttagtttcggtagttttttttcgttttcgtcgtagttttcgtcgtagtcgtagttttcgttatagtcgtcgtttttattttcggttttatttcgttcgcgatttttgtcggggtttcgatttcggttttattttcggtttcgttcgcggttttattaattttcgtttcggtttcgtattcggaggtttagtcgtgggtacgatgttgtttagttttatttagatttcgggggagtcgttgttcggcgtcgaggtgcgggatatttgtcgcggttttcgcgataacgtcgtgcgtttgtttttattgcgcggttgtcgtttttgcgatcgcgattttggtcgtatttgtcgggttttggtcggggttacgtttttggcgtagtttaattttaatttgggcgtcgtgtttagttttagtcgtattaagtagttggttgaggt

SEQ ID NO: 38370 - DNA, 898 bp, Artificial Sequence
  chemically treated genomic DNA (Homo sapiens) CpG-island No: 38370
acctcaaccaactacttaatacgactaaaactaaacacgacgcccaaattaaaattaaactacgccaaaaacgtaaccccgaccaaaacccgacaaatacgaccaaaatcgcgatcgcaaaaacgacaaccgcgcaataaaaacaaacgcacgacgttatcgcgaaaaccgcgacaaatatcccgcacctcgacgccgaacaacgactcccccgaaatctaaataaaactaaacaacatcgtacccacgactaaacctccgaatacgaaaccgaaacgaaaattaataaaaccgcgaacgaaaccgaaaataaaaccgaaatcgaaaccccgacaaaaatcgcgaacgaaataaaaccgaaaataaaaacgacgactataacgaaaactacgactacgacgaaaactacgacgaaaacgaaaaaaaactaccgaaactaaaccgaaaccgaccaaaaatacgaaaacgtccaaaacgcgaaccgaactaaaataaaacgacgctaaaacgaaaacgacccgcacgatccgtatctaaacgttaaaacgaatacgcgttccgaaaattaaacaaacgctactcgacgcttatccttatccctcgcgatcgcgacgacgacgacgacaacgacaacgaacgactcaaaaacttcgacttaccgatctcgactaaaaaaccgtacccgctccctccttctctaccgcccgactccccccgaccaccccgcgaacctaaccgcacgactaacaaaaaaaacctaaaacgaacgactaacgacaactccgactccaactccaaaaaacgaacgaacgacgaattcccataacaacgaccgcgtcaccgacgctcgccccgccccctacccgaccaaaaccacgccgacccgcgaaattcgcgt

SEQ ID NO: 38371 - DNA, 898 bp, Artificial Sequence
  chemically treated genomic DNA (Homo sapiens) CpG-island No: 38371
gttttagttagttgtttgatgcggttggggttggatacgacgtttaggttaaggttgagttgcgttagggacgtggtttcggttagggttcggtagatgcggttaaagtcgcggtcgtagaggcggtagtcgcgtagtgagagtaggcgtacggcgttgtcgcgaaggtcgcggtagatgtttcgtatttcggcgtcggatagcggttttttcgaaatttggatggagttgggtagtatcgtgtttacggttgggttttcgggtacggggtcggaacggaggttggtggggtcgcgggcggggtcggggatagggtcggggtcggggtttcggtaggggtcgcgggcggagtggggtcgggggtggaggcggcggttgtggcggaggttgcggttgcggcggaggttgcggcgggggcggagaagagttatcgggattgagtcggagtcggttagaggtgcggaggcgtttagggcgcgggtcgggttgaagtggggcggcgttggggcgggggcggttcgtacggttcgtgtttgggcgttggggcgggtgcgcgtttcgggggttgggtaggcgttgttcggcgtttgtttttgtttttcgcggtcgcggcggcggcggcggtagcggtagcgagcggtttaagggtttcggtttatcggtttcggttaggaggtcgtattcgttttttttttttttgtcgttcggtttttttcgattatttcgcgggtttggtcgtacggttggtagagagagtttgaggcgggcggttggcggtagtttcggttttagttttagagagcgagcgggcggcgagtttttatggtaacggtcgcgttatcggcgttcgtttcgttttttgttcggttaaggttacgtcggttcgcgaggttcgcgt

SEQ ID NO: 38372 - DNA, 898 bp, Artificial Sequence
  chemically treated genomic DNA (Homo sapiens) CpG-island No: 38372
acgcgaacctcgcgaaccgacgtaaccttaaccgaacaaaaaacgaaacgaacgccgataacgcgaccgttaccataaaaactcgccgcccgctcgctctctaaaactaaaaccgaaactaccgccaaccgcccgcctcaaactctctctaccaaccgtacgaccaaacccgcgaaataatcgaaaaaaaccgaacgacaaaaaaaaaaaaaacgaatacgacctcctaaccgaaaccgataaaccgaaacccttaaaccgctcgctaccgctaccgccgccgccgccgcgaccgcgaaaaacaaaaacaaacgccgaacaacgcctacccaacccccgaaacgcgcacccgccccaacgcccaaacacgaaccgtacgaaccgcccccgccccaacgccgccccacttcaacccgacccgcgccctaaacgcctccgcacctctaaccgactccgactcaatcccgataactcttctccgcccccgccgcaacctccgccgcaaccgcaacctccgccacaaccgccgcctccacccccgaccccactccgcccgcgacccctaccgaaaccccgaccccgaccctatccccgaccccgcccgcgaccccaccaacctccgttccgaccccgtacccgaaaacccaaccgtaaacacgatactacccaactccatccaaatttcgaaaaaaccgctatccgacgccgaaatacgaaacatctaccgcgaccttcgcgacaacgccgtacgcctactctcactacgcgactaccgcctctacgaccgcgactttaaccgcatctaccgaaccctaaccgaaaccacgtccctaacgcaactcaaccttaacctaaacgtcgtatccaaccccaaccgcatcaaacaactaactaaaac

SEQ ID NO: 38373 - DNA, 602 bp, Artificial Sequence
  chemically treated genomic DNA (Homo sapiens) CpG-island No: 38373
gagcggcggagaagcgagtgaggagggcgagcgcgaagtcgggaagaggggcgcgcgtggagggggtgtcgggcgtcgcgagggtttgtttcgggtatttgcgaacgcgcggcgtttttaaggagcgtttggttttcgttcgttagttttcggtcgcgacgcgtttagggcgcggagagggggtggggacggattgggattttgttatcgtttttatcggttgggttttggagtcgtttttaggataattttacgttggggagggcgttcgtcgagttttttcggtttgtgtagacggcgcgcgcggcgggagggcgcggattagcgtttttagttcggtttcgggcggaaggcgagcggagcgcggtcgcgcgggtagtagacggtagacggtgttcggcgtttacggggtgagtgtgtagtttcggggttgatttgggtagcgtcgtcgtcgtcggggaatcgtggatatcgaggtcgttggcgtggtcgaggcgtacgcggcgggagcggtcggagtagtcgttttagggtttttggtttttgtttcggtatcgtagtttcgtttgattcgggtgggggttagaggagggtcggtcgtt

SEQ ID NO: 38374 - DNA, 602 bp, Artificial Sequence
  chemically treated genomic DNA (Homo sapiens) CpG-island No: 38374
aacgaccgaccctcctctaacccccacccgaatcaaacgaaactacgataccgaaacaaaaaccaaaaaccctaaaacgactactccgaccgctcccgccgcgtacgcctcgaccacgccaacgacctcgatatccacgattccccgacgacgacgacgctacccaaatcaaccccgaaactacacactcaccccgtaaacgccgaacaccgtctaccgtctactacccgcgcgaccgcgctccgctcgccttccgcccgaaaccgaactaaaaacgctaatccgcgccctcccgccgcgcgcgccgtctacacaaaccgaaaaaactcgacgaacgccctccccaacgtaaaattatcctaaaaacgactccaaaacccaaccgataaaaacgataacaaaatcccaatccgtccccaccccctctccgcgccctaaacgcgtcgcgaccgaaaactaacgaacgaaaaccaaacgctccttaaaaacgccgcgcgttcgcaaatacccgaaacaaaccctcgcgacgcccgacaccccctccacgcgcgcccctcttcccgacttcgcgctcgccctcctcactcgcttctccgccgctc

SEQ ID NO: 38375 - DNA, 602 bp, Artificial Sequence
  chemically treated genomic DNA (Homo sapiens) CpG-island No: 38375
agcggtcggtttttttttggtttttattcgggttaggcggagttgcggtgtcggggtaggagttaggagttttgaggcggttgtttcggtcgttttcgtcgcgtacgtttcggttacgttagcgatttcggtgtttacgatttttcggcggcggcggcgttgtttaggttagtttcgaagttgtatatttatttcgtgggcgtcgggtatcgtttgtcgtttgttgttcgcgcggtcgcgtttcgttcgtttttcgttcggggtcgggttggggacgttggttcgcgttttttcgtcgcgcgcgtcgtttgtataggtcggggaggttcggcgggcgttttttttaacgtggagttattttgggagcggttttagggtttagtcggtgagggcgatggtagaattttaattcgtttttatttttttttcgcgttttgggcgcgtcgcggtcggaggttggcgggcgagagttaggcgttttttgagagcgtcgcgcgttcgtaggtgttcggagtaggttttcgcggcgttcggtattttttttacgcgcgttttttttttcggtttcgcgttcgttttttttattcgttttttcgtcgttt

SEQ ID NO: 38376 - DNA, 602 bp, Artificial Sequence
  chemically treated genomic DNA (Homo sapiens) CpG-island No: 38376
aaacgacgaaaaaacgaataaaaaaaacgaacgcgaaaccgaaaaaaaaaacgcgcgtaaaaaaaataccgaacgccgcgaaaacctactccgaacacctacgaacgcgcgacgctctcaaaaaacgcctaactctcgcccgccaacctccgaccgcgacgcgcccaaaacgcgaaaaaaaaataaaaacgaattaaaattctaccatcgccctcaccgactaaaccctaaaaccgctcccaaaataactccacgttaaaaaaaacgcccgccgaacctccccgacctatacaaacgacgcgcgcgacgaaaaaacgcgaaccaacgtccccaacccgaccccgaacgaaaaacgaacgaaacgcgaccgcgcgaacaacaaacgacaaacgatacccgacgcccacgaaataaatatacaacttcgaaactaacctaaacaacgccgccgccgccgaaaaatcgtaaacaccgaaatcgctaacgtaaccgaaacgtacgcgacgaaaacgaccgaaacaaccgcctcaaaactcctaactcctaccccgacaccgcaactccgcctaacccgaataaaaaccaaaaaaaaaccgaccgct

SEQ ID NO: 38377 - DNA, 624 bp, Artificial Sequence
  chemically treated genomic DNA (Homo sapiens) CpG-island No: 38377
tacgcgcgcgcgcgcgcgtatatatatatatacgtatattaaaaaattcggattagtcgcgtcgtagttgttttaatttttggaaaaggtaatcgagcgtttttcggatcgttgcgtatagtttcggtttcgatttggcgtttaaaatagagttagttttagtttttcgcgcggttagtttggtcgggtgtttttaaaaataaagcgaggagggaaggtatagatagattttgaaaatattcgggttatatacgtcgcgatttatagtttttttttagcgttggagtggagacggcgttcgtagcgttttgcgcgggtgaggttcgcgtagttgttggggaagagtttttttgttaggttgcgttgggttagcgtagtaagtggggttggtcgttatttcgttgtattcggtcgcgtttcgggtttcgtgcgttttcgttttagttggtttggagtttaattttcggtttcgtcgtcggttttttgcgttttcggagtgtttcgtagcgacgtcgggagtcgacgcgtcgcgcgggtatttagttatggttggggcgagtaggttgttttttttgtggttgggttgtttttgcgtgagtttggcgtagggagagagatcgaagt

SEQ ID NO: 38378 - DNA, 624 bp, Artificial Sequence
  chemically treated genomic DNA (Homo sapiens) CpG-island No: 38378
acttcgatctctctccctacgccaaactcacgcaaaaacaacccaaccacaaaaaaaacaacctactcgccccaaccataactaaatacccgcgcgacgcgtcgactcccgacgtcgctacgaaacactccgaaaacgcaaaaaaccgacgacgaaaccgaaaattaaactccaaaccaactaaaacgaaaacgcacgaaacccgaaacgcgaccgaatacaacgaaataacgaccaaccccacttactacgctaacccaacgcaacctaacaaaaaaactcttccccaacaactacgcgaacctcacccgcgcaaaacgctacgaacgccgtctccactccaacgctaaaaaaaaactataaatcgcgacgtatataacccgaatattttcaaaatctatctataccttccctcctcgctttatttttaaaaacacccgaccaaactaaccgcgcgaaaaactaaaactaactctattttaaacgccaaatcgaaaccgaaactatacgcaacgatccgaaaaacgctcgattaccttttccaaaaattaaaacaactacgacgcgactaatccgaattttttaatatacgtatatatatatatacgcgcgcgcgcgcgcgta

SEQ ID NO: 38379 - DNA, 624 bp, Artificial Sequence
  chemically treated genomic DNA (Homo sapiens) CpG-island No: 38379
gtttcggtttttttttttgcgttaggtttacgtagaagtagtttagttatagaaagagtagtttgttcgttttagttatggttaggtattcgcgcggcgcgtcggttttcggcgtcgttgcgggatatttcgaaggcgtaaggagtcggcggcggagtcgagggttgaattttaaattagttggggcgagggcgtacggagttcgggacgcggtcgggtgtagcgagatagcggttagttttatttgttgcgttgatttagcgtagtttgataggggggtttttttttagtagttgcgcggattttattcgcgtagggcgttgcgggcgtcgtttttattttaacgttgagaaagagttgtaggtcgcggcgtgtgtggttcgggtgtttttaagatttgtttgtatttttttttttcgttttatttttgggaatattcggttaaattggtcgcgcgagggattaggattagttttgttttgggcgttaggtcggagtcggggttgtgcgtagcggttcggagggcgttcgattgttttttttagggattggagtagttgcggcgcggttggttcgagttttttagtgtacgtgtgtgtgtgtgtgcgcgcgcgcgcgcgcgtg

SEQ ID NO: 38380 - DNA, 624 bp, Artificial Sequence
  chemically treated genomic DNA (Homo sapiens) CpG-island No: 38380
cacgcgcgcgcgcgcgcgcacacacacacacacgtacactaaaaaactcgaaccaaccgcgccgcaactactccaatccctaaaaaaaacaatcgaacgccctccgaaccgctacgcacaaccccgactccgacctaacgcccaaaacaaaactaatcctaatccctcgcgcgaccaatttaaccgaatattcccaaaaataaaacgaaaaaaaaaaatacaaacaaatcttaaaaacacccgaaccacacacgccgcgacctacaactctttctcaacgttaaaataaaaacgacgcccgcaacgccctacgcgaataaaatccgcgcaactactaaaaaaaaacccccctatcaaactacgctaaatcaacgcaacaaataaaactaaccgctatctcgctacacccgaccgcgtcccgaactccgtacgccctcgccccaactaatttaaaattcaaccctcgactccgccgccgactccttacgccttcgaaatatcccgcaacgacgccgaaaaccgacgcgccgcgcgaatacctaaccataactaaaacgaacaaactactctttctataactaaactacttctacgtaaacctaacgcaaaaaaaaaaaccgaaac

SEQ ID NO: 38381 - DNA, 609 bp, Artificial Sequence
  chemically treated genomic DNA (Homo sapiens) CpG-island No: 38381
cgggtgtcgcgagtaatgtaattggcgaagattatcgattttatgttggtttttttcgattcgtttttttttattagtagtatttttttttttatggttgtatttggtattattcgtcggggtatcgcggattgggtttgagggcgcggtttatacgtagcgtcgagggaggggtcgggggttgtcggggattcgtaggtcgcgtttcgtttcgtttcgtcgcgtagttgggtaggtaggagagtcgagagcgcgaattcggggttggagaggtcgcggacgggttggtttttatttagatgggagcgttcgcggttgttagtggtaacggttcgggagatacgttcgtttttcgggagggagtcgttgcgttttcgttattatttattttcggcggcgatttcgcgagagttttttcgtttcgtttttcgtgttcgacgagttttgaaaagtcgttgttttaatgaaatttaatcggggcggcgtgagttttaagatggaagggaagttcgaggatttcggttttttgttttgttgtagttgggtttgttgttgttaggggtacgtgtgtggttggtcgggggaaatgttgttttttcgtggttaaaa

SEQ ID NO: 38382 - DNA, 609 bp, Artificial Sequence
  chemically treated genomic DNA (Homo sapiens) CpG-island No: 38382
ttttaaccacgaaaaaacaacatttcccccgaccaaccacacacgtacccctaacaacaacaaacccaactacaacaaaacaaaaaaccgaaatcctcgaacttcccttccatcttaaaactcacgccgccccgattaaatttcattaaaacaacgacttttcaaaactcgtcgaacacgaaaaacgaaacgaaaaaactctcgcgaaatcgccgccgaaaataaataataacgaaaacgcaacgactccctcccgaaaaacgaacgtatctcccgaaccgttaccactaacaaccgcgaacgctcccatctaaataaaaaccaacccgtccgcgacctctccaaccccgaattcgcgctctcgactctcctacctacccaactacgcgacgaaacgaaacgaaacgcgacctacgaatccccgacaacccccgacccctccctcgacgctacgtataaaccgcgccctcaaacccaatccgcgataccccgacgaataataccaaatacaaccataaaaaaaaaaatactactaataaaaaaaaacgaatcgaaaaaaaccaacataaaatcgataatcttcgccaattacattactcgcgacacccg

SEQ ID NO: 38383 - DNA, 609 bp, Artificial Sequence
  chemically treated genomic DNA (Homo sapiens) CpG-island No: 38383
ttttggttacgagagggtagtatttttttcggttaattatatacgtatttttagtaatagtaaatttagttgtaatagaataaaagatcgaagttttcgagttttttttttattttagggtttacgtcgtttcggttaggttttattagagtagcggttttttaaggttcgtcgggtacggagggcggagcgagggagttttcgcgagatcgtcgtcggaagtgggtggtggcggggacgtagcggttttttttcggaaagcgagcgtatttttcgagtcgttgttattgatagtcgcgggcgtttttatttgagtaagagttagttcgttcgcggtttttttagtttcgggttcgcgttttcgatttttttgtttgtttagttgcgcggcggagcggagcgaggcgcggtttgcgagttttcggtagttttcgatttttttttcggcgttgcgtgtaggtcgcgtttttaggtttagttcgcggtgtttcggcgggtgatgttaaatatagttatgaagaaaaaggtgttgttgatggggaagagcgggtcggggaagattagtatgaggtcgataattttcgttaattatattgttcgcgatattcg

SEQ ID NO: 38384 - DNA, 609 bp, Artificial Sequence
  chemically treated genomic DNA (Homo sapiens) CpG-island No: 38384
cgaatatcgcgaacaatataattaacgaaaattatcgacctcatactaatcttccccgacccgctcttccccatcaacaacacctttttcttcataactatatttaacatcacccgccgaaacaccgcgaactaaacctaaaaacgcgacctacacgcaacgccgaaaaaaaaatcgaaaactaccgaaaactcgcaaaccgcgcctcgctccgctccgccgcgcaactaaacaaacaaaaaaatcgaaaacgcgaacccgaaactaaaaaaaccgcgaacgaactaactcttactcaaataaaaacgcccgcgactatcaataacaacgactcgaaaaatacgctcgctttccgaaaaaaaaccgctacgtccccgccaccacccacttccgacgacgatctcgcgaaaactccctcgctccgccctccgtacccgacgaaccttaaaaaaccgctactctaataaaacctaaccgaaacgacgtaaaccctaaaataaaaaaaaaactcgaaaacttcgatcttttattctattacaactaaatttactattactaaaaatacgtatataattaaccgaaaaaaatactaccctctcgtaaccaaaa

SEQ ID NO: 38385 - DNA, 956 bp, Artificial Sequence
  chemically treated genomic DNA (Homo sapiens) CpG-island No: 38385
gttacgtgattttttttttaaggaattttagttgtcggttttttagtaatcggtgcgtttcgtttagcgacgttcgcgtatttcggttggttttcgggggcggttgtggtaaggaggtgtttacggtcgcgttgtttattggttcgggttgtcgtcgtttagattcgttgttcgggcgttcgtaggcggtgttgtcggatgtttcgttttttggtcgttaggttcgtggttggttggtcgttgttgttatttttcggtcgtttttttgcggttagcgttttatttggggcgggaggaagaggggcgggattggggtttgattagtcgtcgtcgttttcgcggttgttatgattagcgggcgaggcgtttttcgtagtttcgcgtaacgttagtcgcggtcgtgcgttcgtcgtagtcgtttgcgttttagcgcggtcgcggtttttttcggttttgttagcgtcgtttgcgaggcggaggtaggatgaagatgattgtggatttcgaggagtgtttgaagattcgtttcgttttaggtaatcggtacgtcgttcggcgttatcgcggagttgttttttcggcgttgggggcgtgaaagtcgggttcgcgtattcggaggaggtttcgtcgttcgtttttttcgacggggcgagcggttgttgtcgtcgttttttattttgcgagggtattgtagtttttatcgagttttttcgaggggcgacgaagtggcggggacggggacgtcgttttttatttttttttttgttttttgtcggggcggacgtttcgaaggtcggcgtattttttttcgttgggggaaatggggtgtagtcgcgttttcgaagtttcgtttttttcgcgggcgttcgttttcgtttttttttttttttggttgtttttttttttttttttttttcgtttttttttggtttttattttttttttatttttttttt

SEQ ID NO: 38386 - DNA, 956 bp, Artificial Sequence
  chemically treated genomic DNA (Homo sapiens) CpG-island No: 38386
aaaaaaaaaataaaaaaaaaataaaaaccaaaaaaaaacgaaaaaaaaaaaaaaaaaaaaacaaccaaaaaaaaaaaaaaacgaaaacgaacgcccgcgaaaaaaacgaaacttcgaaaacgcgactacaccccatttcccccaacgaaaaaaaatacgccgaccttcgaaacgtccgccccgacaaaaaacaaaaaaaaaaataaaaaacgacgtccccgtccccgccacttcgtcgcccctcgaaaaaactcgataaaaactacaataccctcgcaaaataaaaaacgacgacaacaaccgctcgccccgtcgaaaaaaacgaacgacgaaacctcctccgaatacgcgaacccgactttcacgcccccaacgccgaaaaaacaactccgcgataacgccgaacgacgtaccgattacctaaaacgaaacgaatcttcaaacactcctcgaaatccacaatcatcttcatcctacctccgcctcgcaaacgacgctaacaaaaccgaaaaaaaccgcgaccgcgctaaaacgcaaacgactacgacgaacgcacgaccgcgactaacgttacgcgaaactacgaaaaacgcctcgcccgctaatcataacaaccgcgaaaacgacgacgactaatcaaaccccaatcccgcccctcttcctcccgccccaaataaaacgctaaccgcaaaaaaacgaccgaaaaataacaacaacgaccaaccaaccacgaacctaacgaccaaaaaacgaaacatccgacaacaccgcctacgaacgcccgaacaacgaatctaaacgacgacaacccgaaccaataaacaacgcgaccgtaaacacctccttaccacaaccgcccccgaaaaccaaccgaaatacgcgaacgtcgctaaacgaaacgcaccgattactaaaaaaccgacaactaaaattccttaaaaaaaaaatcacgtaac

SEQ ID NO: 38387 - DNA, 956 bp, Artificial Sequence
  chemically treated genomic DNA (Homo sapiens) CpG-island No: 38387
aaagagggggtggggagggggtggaaattaagaaggggcggaaggaagggggaaggaagagtagttagaggaggaagggggcgagagcgagcgttcgcgaaggggacgggatttcgggagcgcggttgtattttattttttttagcgggagagggtgcgtcggttttcggggcgttcgtttcggtagagggtaaggaaagaaatgagaggcgacgttttcgttttcgttatttcgtcgtttttcgggagggttcggtggggattgtagtgttttcgtagggtgggaaacggcggtaatagtcgttcgtttcgtcggaaggagcggacggcggggtttttttcgggtgcgcgggttcggtttttacgtttttagcgtcgggaaggtagtttcgcggtgacgtcgggcggcgtgtcggttatttgaagcggggcgagtttttagatatttttcgaaatttatagttatttttattttgttttcgtttcgtaggcggcgttggtaaagtcgaagggggtcgcggtcgcgttgggacgtagacggttacggcgggcgtacggtcgcgattagcgttgcgcggagttgcgaagggcgtttcgttcgttggttatagtagtcgcgaagacggcgacgattagttaggttttagtttcgtttttttttttttcgttttaagtagagcgttggtcgtagggaaacggtcggggagtgatagtagcggttagttagttacgaatttggcggttaaggggcggggtattcggtagtatcgtttgcgggcgttcgggtaacgggtttgagcgacggtaattcgagttaatgagtagcgcgatcgtgggtatttttttgttataatcgttttcgagggttaatcgggatgcgcgggcgtcgttaggcgggacgtatcggttgttgggaggtcggtagttgaggttttttgggaaggaagttacgtggt

SEQ ID NO: 38388 - DNA, 956 bp, Artificial Sequence
  chemically treated genomic DNA (Homo sapiens) CpG-island No: 38388
accacgtaacttccttcccaaaaaacctcaactaccgacctcccaacaaccgatacgtcccgcctaacgacgcccgcgcatcccgattaaccctcgaaaacgattataacaaaaaaatacccacgatcgcgctactcattaactcgaattaccgtcgctcaaacccgttacccgaacgcccgcaaacgatactaccgaataccccgccccttaaccgccaaattcgtaactaactaaccgctactatcactccccgaccgtttccctacgaccaacgctctacttaaaacgaaaaaaaaaaaaacgaaactaaaacctaactaatcgtcgccgtcttcgcgactactataaccaacgaacgaaacgcccttcgcaactccgcgcaacgctaatcgcgaccgtacgcccgccgtaaccgtctacgtcccaacgcgaccgcgacccccttcgactttaccaacgccgcctacgaaacgaaaacaaaataaaaataactataaatttcgaaaaatatctaaaaactcgccccgcttcaaataaccgacacgccgcccgacgtcaccgcgaaactaccttcccgacgctaaaaacgtaaaaaccgaacccgcgcacccgaaaaaaaccccgccgtccgctccttccgacgaaacgaacgactattaccgccgtttcccaccctacgaaaacactacaatccccaccgaaccctcccgaaaaacgacgaaataacgaaaacgaaaacgtcgcctctcatttctttccttaccctctaccgaaacgaacgccccgaaaaccgacgcaccctctcccgctaaaaaaaataaaatacaaccgcgctcccgaaatcccgtccccttcgcgaacgctcgctctcgcccccttcctcctctaactactcttccttcccccttccttccgccccttcttaatttccaccccctccccaccccctcttt

SEQ ID NO: 38389 - DNA, 833 bp, Artificial Sequence
  chemically treated genomic DNA (Homo sapiens) CpG-island No: 38389
ttcgagcggtattcgagtcgtatttacgtcgttcgttcgtttttggggtttgggtaggtaacgggttcggcgggaaggaggggtttttaggtcgttttttttagcgtttattttagtttttcgtcgatattttcgcggggttgttcggtcgacgttattatagaggaagtcgtagaggttttgttttttaagatttttttgatgggtcggtgcgaggtcgtcgaggtcgttattgtcgggcgtttcggttgtcggtttagggtcgttgtttggcgtggggttcgcgaagagaagggtcggtatagtagagattcgtaggtagtcgtagatttcgtttagggttaaagcggtcgtaattgttgtttcggaaacggttatcgtagcggttgttacgatataacgatttcgacgttagagttaacgtcgaacgggtggcggttattcgcgtatttttagttattgttatttgattcgcggttcgcggagagacgtcggtttagagttttagcgtaggagcgacgcgacgtcgaagttaagcggattcgttttttcgcgatatttagggaggaggcggggagagggcggggcgagaataaagtcgattttttcgtttcgtttttttcgtttcgttcgcgtgttattttcgttcggcgcggcgttgggaggcgggagttgtttttgagaattgcgggagagcgttcgggtttgttgtttttcggattcgcgcgtttttcgagtattttcgttttattattttgtgaggtcgtagtgttatttttattttttagattagtagattgagattcgaggtgacgttatttcgtagagaggtt

SEQ ID NO: 38390 - DNA, 833 bp, Artificial Sequence
  chemically treated genomic DNA (Homo sapiens) CpG-island No: 38390
aacctctctacgaaataacgtcacctcgaatctcaatctactaatctaaaaaataaaaataacactacgacctcacaaaataataaaacgaaaatactcgaaaaacgcgcgaatccgaaaaacaacaaacccgaacgctctcccgcaattctcaaaaacaactcccgcctcccaacgccgcgccgaacgaaaataacacgcgaacgaaacgaaaaaaacgaaacgaaaaaatcgactttattctcgccccgccctctccccgcctcctccctaaatatcgcgaaaaaacgaatccgcttaacttcgacgtcgcgtcgctcctacgctaaaactctaaaccgacgtctctccgcgaaccgcgaatcaaataacaataactaaaaatacgcgaataaccgccacccgttcgacgttaactctaacgtcgaaatcgttatatcgtaacaaccgctacgataaccgtttccgaaacaacaattacgaccgctttaaccctaaacgaaatctacgactacctacgaatctctactataccgacccttctcttcgcgaaccccacgccaaacaacgaccctaaaccgacaaccgaaacgcccgacaataacgacctcgacgacctcgcaccgacccatcaaaaaaatcttaaaaaacaaaacctctacgacttcctctataataacgtcgaccgaacaaccccgcgaaaatatcgacgaaaaactaaaataaacgctaaaaaaaacgacctaaaaacccctccttcccgccgaacccgttacctacccaaaccccaaaaacgaacgaacgacgtaaatacgactcgaataccgctcgaa

SEQ ID NO: 38391 - DNA, 833 bp, Artificial Sequence
  chemically treated genomic DNA (Homo sapiens) CpG-island No: 38391
aatttttttgcggagtgacgttatttcgagttttagtttgttgatttaaaaaataaaaataatattacggttttataaggtggtgggacgagggtgttcgagagacgcgcgggttcgggaagtagtaagttcgggcgttttttcgtagtttttagagatagttttcgttttttagcgtcgcgtcgggcgggggtagtacgcgggcgggacggagggggcggggcgaggaggtcggttttgttttcgtttcgtttttttttcgttttttttttagatatcgcgagagggcgggttcgtttggtttcggcgtcgcgtcgtttttgcgttggagttttaggtcggcgttttttcgcgagtcgcgggttaagtggtagtggttaagggtgcgcgagtagtcgttattcgttcggcgttggttttggcgtcggggtcgttgtgtcgtgataatcgttgcggtagtcgttttcgaggtagtagttgcggtcgttttagttttgagcgggatttgcggttgtttgcgagtttttgttgtgtcgattttttttttcgcggattttacgttaagtagcgattttgagtcgatagtcggagcgttcggtaatggcggtttcgacggtttcgtatcggtttattaaggggattttgaagaataagatttttacgattttttttatggtggcgtcggtcgaatagtttcgcgggaatgtcgacgaggagttgaggtgagcgttgggagggacggtttgggagtttttttttttcgtcgggttcgttatttatttagattttaggggcgggcgggcggcgtggatgcggttcgggtgtcgttcgag

SEQ ID NO: 38392 - DNA, 833 bp, Artificial Sequence
  chemically treated genomic DNA (Homo sapiens) CpG-island No: 38392
ctcgaacgacacccgaaccgcatccacgccgcccgcccgcccctaaaatctaaataaataacgaacccgacgaaaaaaaaaaactcccaaaccgtccctcccaacgctcacctcaactcctcgtcgacattcccgcgaaactattcgaccgacgccaccataaaaaaaatcgtaaaaatcttattcttcaaaatccccttaataaaccgatacgaaaccgtcgaaaccgccattaccgaacgctccgactatcgactcaaaatcgctacttaacgtaaaatccgcgaaaaaaaaaatcgacacaacaaaaactcgcaaacaaccgcaaatcccgctcaaaactaaaacgaccgcaactactacctcgaaaacgactaccgcaacgattatcacgacacaacgaccccgacgccaaaaccaacgccgaacgaataacgactactcgcgcacccttaaccactaccacttaacccgcgactcgcgaaaaaacgccgacctaaaactccaacgcaaaaacgacgcgacgccgaaaccaaacgaacccgccctctcgcgatatctaaaaaaaaaacgaaaaaaaaacgaaacgaaaacaaaaccgacctcctcgccccgccccctccgtcccgcccgcgtactacccccgcccgacgcgacgctaaaaaacgaaaactatctctaaaaactacgaaaaaacgcccgaacttactacttcccgaacccgcgcgtctctcgaacaccctcgtcccaccaccttataaaaccgtaatattatttttattttttaaatcaacaaactaaaactcgaaataacgtcactccgcaaaaaaatt

SEQ ID NO: 38393 - DNA, 1178 bp, Artificial Sequence
  chemically treated genomic DNA (Homo sapiens) CpG-island No: 38393
ttggcggagaaacggttatacgtttacggagttattgagaaggcgagcggaggcgtagttcgttcgttcgtcgcgggaattttaggttggggcgttgggcgcgcgaagatttagtcgtttcgtttattaagggcgcgtcggttttcggtcgtagtttttgggttggtagtcgtcgtcgcgtcgcgtttttattggtgttcggcggtgacgcggtcgagcgggtcggggttgtttggttcgggggcgggcgtggggcgcggggcgcggagcgcgaggggcgggggtcgggcgtattgttgatgaaatttggcgtcggaattcgttagttttcggcgtttatttagttcgcgtaggtaggtgtgagtagcgggttaattatttggtaggcgcgtacgcggtcgcgggttttcgttaatcgtagtttttattttttttttcgcgcgtcgcgttttcgtttcgtttcgtttcgttcggtttcgtcggtcgagcgttcgttggtttttgagcgcgttcgatagtttgtttgttcgcgattttgtcggagttttttcgtcgtcggtttggtgagtgttcggtttcgttaacgtagggggtagttttttgggttcgggttattacggagggggttttggcgtcgcgtggggtcgcggtagggcggcgcgggagtggcgagggttttcgcgtcgggaacgttgttattttttgggaagggttaggattagggtcgggcgggtttcggagtgggcgagcggggttggtgtttatgcgattgtcgtttttacggagtttattttggttttttgaaatcgcggcgtggtgtatgatgtaatatcgagtgagtaagcgtgggcgatttggcgatgttcgtttcgcgcgtttgttcggggattcgcgcgtcgttacgtacggggtggtcggggtgcgtaggcgggcggcgggtacgggggttagattgggaggtatacggagttcgtcggcggcgaggagatttttttttatatggcgcggtgtagagtatttcgtttcgttacgaggttcggggatgtgttattagtcgtgggtggggattttgttcggtcgttcggagggtggtttcgcggtaggtggtcggtttagggattttgttgttattttcgttcggtggtcgttttgatttagggcgtttggtttttcgtttg

SEQ ID NO: 38394 - DNA, 1178 bp, Artificial Sequence
  chemically treated genomic DNA (Homo sapiens) CpG-island No: 38394
caaacgaaaaaccaaacgccctaaatcaaaacgaccaccgaacgaaaataacaacaaaatccctaaaccgaccacctaccgcgaaaccaccctccgaacgaccgaacaaaatccccacccacgactaataacacatccccgaacctcgtaacgaaacgaaatactctacaccgcgccatataaaaaaaaatctcctcgccgccgacgaactccgtatacctcccaatctaacccccgtacccgccgcccgcctacgcaccccgaccaccccgtacgtaacgacgcgcgaatccccgaacaaacgcgcgaaacgaacatcgccaaatcgcccacgcttactcactcgatattacatcatacaccacgccgcgatttcaaaaaaccaaaataaactccgtaaaaacgacaatcgcataaacaccaaccccgctcgcccactccgaaacccgcccgaccctaatcctaacccttcccaaaaaataacaacgttcccgacgcgaaaaccctcgccactcccgcgccgccctaccgcgaccccacgcgacgccaaaaccccctccgtaataacccgaacccaaaaaactaccccctacgttaacgaaaccgaacactcaccaaaccgacgacgaaaaaactccgacaaaatcgcgaacaaacaaactatcgaacgcgctcaaaaaccaacgaacgctcgaccgacgaaaccgaacgaaacgaaacgaaacgaaaacgcgacgcgcgaaaaaaaaaataaaaactacgattaacgaaaacccgcgaccgcgtacgcgcctaccaaataattaacccgctactcacacctacctacgcgaactaaataaacgccgaaaactaacgaattccgacgccaaatttcatcaacaatacgcccgacccccgcccctcgcgctccgcgccccgcgccccacgcccgcccccgaaccaaacaaccccgacccgctcgaccgcgtcaccgccgaacaccaataaaaacgcgacgcgacgacgactaccaacccaaaaactacgaccgaaaaccgacgcgcccttaataaacgaaacgactaaatcttcgcgcgcccaacgccccaacctaaaattcccgcgacgaacgaacgaactacgcctccgctcgccttctcaataactccgtaaacgtataaccgtttctccgccaa

SEQ ID NO: 38395 - DNA, 1178 bp, Artificial Sequence
  chemically treated genomic DNA (Homo sapiens) CpG-island No: 38395
taagcggagagttaggcgttttaggttagggcggttatcgggcggggatggtagtagagtttttgggtcggttatttgtcgcgggattatttttcgggcggtcgggtagagtttttatttacggttgatgatatattttcggatttcgtggcggggcggggtgttttgtatcgcgttatgtaagggaaggttttttcgtcgtcggcgggtttcgtgtgttttttagtttggttttcgtgttcgtcgttcgtttacgtatttcgattatttcgtgcgtagcggcgcgcgggttttcggataggcgcgcggagcgggtatcgttagatcgtttacgtttatttattcggtgttgtattatgtattacgtcgcggttttagggagttaaaatggatttcgtggaggcgatagtcgtatgggtattagtttcgttcgtttatttcggggttcgttcggttttggttttggttttttttagaggatggtagcgttttcggcgcgggggttttcgttattttcgcgtcgttttgtcgcggttttacgcggcgttagggtttttttcgtgatgattcgggtttaaggagttgttttttgcgttggcggggtcgggtatttattaagtcggcggcgggggggtttcggtaggatcgcgaatagatagattgtcggacgcgtttaaggattaacggacgttcggtcggcgagatcgggcggggcggggcggggcgggggcgcggcgcgcggggagaggagtggaggttgcggttagcgggagttcgcggtcgcgtgcgcgtttgttaggtagttgattcgttgtttatatttgtttgcgcggattgaatgggcgtcgagggttggcgggtttcggcgttaggttttattagtagtgcgttcggttttcgtttttcgcgtttcgcgtttcgcgttttacgttcgttttcggattaggtagtttcggttcgttcggtcgcgttatcgtcgggtattaatgggagcgcggcgcggcggcggttgttagtttagaggttgcggtcggggatcgacgcgtttttggtgggcggggcggttgagttttcgcgcgtttagcgttttaatttggggttttcgcggcgggcgggcgggttgcgttttcgttcgtttttttagtagtttcgtaggcgtgtggtcgttttttcgttaa

SEQ ID NO: 38396 - DNA, 1178 bp, Artificial Sequence
  chemically treated genomic DNA (Homo sapiens) CpG-island No: 38396
ttaacgaaaaaacgaccacacgcctacgaaactactaaaaaaacgaacgaaaacgcaacccgcccgcccgccgcgaaaaccccaaattaaaacgctaaacgcgcgaaaactcaaccgccccgcccaccaaaaacgcgtcgatccccgaccgcaacctctaaactaacaaccgccgccgcgccgcgctcccattaatacccgacgataacgcgaccgaacgaaccgaaactacctaatccgaaaacgaacgtaaaacgcgaaacgcgaaacgcgaaaaacgaaaaccgaacgcactactaataaaacctaacgccgaaacccgccaaccctcgacgcccattcaatccgcgcaaacaaatataaacaacgaatcaactacctaacaaacgcgcacgcgaccgcgaactcccgctaaccgcaacctccactcctctccccgcgcgccgcgcccccgccccgccccgccccgcccgatctcgccgaccgaacgtccgttaatccttaaacgcgtccgacaatctatctattcgcgatcctaccgaaacccccccgccgccgacttaataaatacccgaccccgccaacgcaaaaaacaactccttaaacccgaatcatcacgaaaaaaaccctaacgccgcgtaaaaccgcgacaaaacgacgcgaaaataacgaaaacccccgcgccgaaaacgctaccatcctctaaaaaaaaccaaaaccaaaaccgaacgaaccccgaaataaacgaacgaaactaatacccatacgactatcgcctccacgaaatccattttaactccctaaaaccgcgacgtaatacataatacaacaccgaataaataaacgtaaacgatctaacgatacccgctccgcgcgcctatccgaaaacccgcgcgccgctacgcacgaaataatcgaaatacgtaaacgaacgacgaacacgaaaaccaaactaaaaaacacacgaaacccgccgacgacgaaaaaaccttcccttacataacgcgatacaaaacaccccgccccgccacgaaatccgaaaatatatcatcaaccgtaaataaaaactctacccgaccgcccgaaaaataatcccgcgacaaataaccgacccaaaaactctactaccatccccgcccgataaccgccctaacctaaaacgcctaactctccgctta

SEQ ID NO: 38397 - DNA, 510 bp, Artificial Sequence
  chemically treated genomic DNA (Homo sapiens) CpG-island No: 38397
gttgcgggtgcgcgttgggggtgtgtgggtcgtcgcgggtgggtttggggttcgtcgtcggtggtgtgtgcgggcgggcgggtcggggcgcggggggttgtggttcgttttcggggcgcggcggggcgtcgcgcgggcgcggcgtttcggcgcggggttcgcggttcgttgcggggggggcgcgggggcggttcggcgcggtcgcgcgtggttcgcgggttcgcgtcgcggttcgttgcgggttgggggggggtggttgtcgcggttttttgcggtttcggtgggcgcgtcgttttgcgttcggcgcgttcgtcgtgttcgtcgcggtgttgtggtcgcgtcgtcgggttcggttcgttcgggttgtgtcggtttcgtcggggcggtcgcggcggtcgtcgtttggttcggggtttggtcgcgcgtcgcggggcgcgggtcgttggtcgtgtcgtcgttgtcgtcgcgttgtcgtgcggtcgggtggcgggtttttcgcgttcggtagtt

SEQ ID NO: 38398 - DNA, 510 bp, Artificial Sequence
  chemically treated genomic DNA (Homo sapiens) CpG-island No: 38398
aactaccgaacgcgaaaaacccgccacccgaccgcacgacaacgcgacgacaacgacgacacgaccaacgacccgcgccccgcgacgcgcgaccaaaccccgaaccaaacgacgaccgccgcgaccgccccgacgaaaccgacacaacccgaacgaaccgaacccgacgacgcgaccacaacaccgcgacgaacacgacgaacgcgccgaacgcaaaacgacgcgcccaccgaaaccgcaaaaaaccgcgacaaccacccccccccaacccgcaacgaaccgcgacgcgaacccgcgaaccacgcgcgaccgcgccgaaccgcccccgcgccccccccgcaacgaaccgcgaaccccgcgccgaaacgccgcgcccgcgcgacgccccgccgcgccccgaaaacgaaccacaaccccccgcgccccgacccgcccgcccgcacacaccaccgacgacgaaccccaaacccacccgcgacgacccacacacccccaacgcgcacccgcaac

SEQ ID NO: 38399 - DNA, 510 bp, Artificial Sequence
  chemically treated genomic DNA (Homo sapiens) CpG-island No: 38399
agttgtcgggcgcgaggggttcgttattcgatcgtacgatagcgcggcggtagcggcggtacggttagcgattcgcgtttcgcgacgcgcgattaaatttcgggttaagcggcggtcgtcgcggtcgtttcggcgagatcggtataattcgagcgagtcgggttcgacggcgcggttataatatcgcggcgagtacggcgggcgcgtcgggcgtaggacggcgcgtttatcgagatcgtagagggtcgcggtaattatttttttttagttcgtagcggatcgcggcgcgggttcgcgggttacgcgcggtcgcgtcgggtcgttttcgcgtttttttcgtagcgagtcgcgagtttcgcgtcggagcgtcgcgttcgcgcgacgtttcgtcgcgtttcgggagcgggttatagtttttcgcgtttcggttcgttcgttcgtatatattatcggcggcgagttttaggtttattcgcggcggtttatatatttttagcgcgtattcgtagt

SEQ ID NO: 38400 - DNA, 510 bp, Artificial Sequence
  chemically treated genomic DNA (Homo sapiens) CpG-island No: 38400
actacgaatacgcgctaaaaatatataaaccgccgcgaataaacctaaaactcgccgccgataatatatacgaacgaacgaaccgaaacgcgaaaaactataacccgctcccgaaacgcgacgaaacgtcgcgcgaacgcgacgctccgacgcgaaactcgcgactcgctacgaaaaaaacgcgaaaacgacccgacgcgaccgcgcgtaacccgcgaacccgcgccgcgatccgctacgaactaaaaaaaaataattaccgcgaccctctacgatctcgataaacgcgccgtcctacgcccgacgcgcccgccgtactcgccgcgatattataaccgcgccgtcgaacccgactcgctcgaattataccgatctcgccgaaacgaccgcgacgaccgccgcttaacccgaaatttaatcgcgcgtcgcgaaacgcgaatcgctaaccgtaccgccgctaccgccgcgctatcgtacgatcgaataacgaacccctcgcgcccgacaact

SEQ ID NO: 38401 - DNA, 847 bp, Artificial Sequence
  chemically treated genomic DNA (Homo sapiens) CpG-island No: 38401
ggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgttggggtcggatcgtgaaacgttgttgtgcggtgtgaaagcgttgtttgtcggttatgaggtttttgggttggtgatcggatttgtgggggttgggggtcgtatcgggtttgtgtttttcggttagggtcgttagtggttggggatgggtcgagggttttatcgggttttttcggtgttcgttgttagttttgacgaagttgtgttcgagttggtgtatatttgggttaggaaatcggggttcgggaggtggtgatcggtttcgatgtttattttttgatcgaacgttgggatttatcggatcgattatttgtaggcgttcgttgaagatttgattcgggggggttcgcgtagggggttgggtttttg

SEQ ID NO: 38402 - DNA, 847 bp, Artificial Sequence
  chemically treated genomic DNA (Homo sapiens) CpG-island No: 38402
caaaaacccaaccccctacgcgaacccccccgaatcaaatcttcaacgaacgcctacaaataatcgatccgataaatcccaacgttcgatcaaaaaataaacatcgaaaccgatcaccacctcccgaaccccgatttcctaacccaaatatacaccaactcgaacacaacttcgtcaaaactaacaacgaacaccgaaaaaacccgataaaaccctcgacccatccccaaccactaacgaccctaaccgaaaaacacaaacccgatacgacccccaacccccacaaatccgatcaccaacccaaaaacctcataaccgacaaacaacgctttcacaccgcacaacaacgtttcacgatccgaccccaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgacc

SEQ ID NO: 38403 - DNA, 847 bp, Artificial Sequence
  chemically treated genomic DNA (Homo sapiens) CpG-island No: 38403
tagaggtttaattttttgcgcgaattttttcggattagatttttagcgagcgtttgtaagtgatcgattcgatgggttttaacgttcgattaagaaatgggtatcggaatcggttattatttttcggatttcgattttttggtttagatgtgtattagttcgggtatagtttcgttaaagttagtagcgaatatcgaaaaagttcggtaaagttttcggtttatttttagttattgacgattttgatcggaaaatataaattcgatgcggtttttagtttttatagattcggttattaatttagaagttttatgatcggtagatagcgtttttatatcgtataataacgttttacggttcgattttagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgatt

SEQ ID NO: 38404 - DNA, 847 bp, Artificial Sequence
  chemically treated genomic DNA (Homo sapiens) CpG-island No: 38404
aatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatactaaaatcgaaccgtaaaacgttattatacgatataaaaacgctatctaccgatcataaaacttctaaattaataaccgaatctataaaaactaaaaaccgcatcgaatttatattttccgatcaaaatcgtcaataactaaaaataaaccgaaaactttaccgaactttttcgatattcgctactaactttaacgaaactatacccgaactaatacacatctaaaccaaaaaatcgaaatccgaaaaataataaccgattccgatacccatttcttaatcgaacgttaaaacccatcgaatcgatcacttacaaacgctcgctaaaaatctaatccgaaaaaattcgcgcaaaaaattaaacctcta

SEQ ID NO: 38405 - DNA, 856 bp, Artificial Sequence
  chemically treated genomic DNA (Homo sapiens) CpG-island No: 38405
tattaatttcgcgtttttcgtgttcggttttttcggttatagtagtttgttttttttttttttgtatttgtagtatgtgtagggtttgtcgtcgttggcggcgggatggcggatggcgtcgtatttcgtcgcggtcggattggtgtttacggtgttcggtcgtttgaatgttcgtttcggtttgtcgcggttgatggtcgcgggttatggtttgatcggcgtggttatgttgggtatgatgcggttcgaggcgtatacgttttggttcgagatcggatttttgatggtgatgttgggtttgggtatggggttggcggtgtcgtcgattagtatggcggttatggttacggtgtcgcgcgaacgttcgggtatggcgttcgttattatgaatgcgatgcgttagacgggtatgacgatcggtatcgcgttgttgggcgtattgatgagcgggcgcgcggtcgacgcgttgacgcgtacgatcgtttacgtcggcgttagcgatgcgtacggcgtggcgcgcgtcgtcgttacgcggtatgtgatgttcgagtagtcggtaagcgtcgtcgcgtggttcgtcgatgcgttggtcggcggtttttacgtcgcgatgttgatcgcgggcggtgtatcggtggtggtagttttgttgatgtgggtcgtggcgcgcggcgtaaaattcgcgttgtacgtcgtttgaacgtgcgatttcggcgttcggaattttatttttcggaattaaacggagcggattttaagtattcgtaataaagttgtcggtcgcgcggcgtttgggtaagatttttatttaataataggttaataattacgaggagaagattatgtagtttcgtaa

SEQ ID NO: 38406 - DNA, 856 bp, Artificial Sequence
  chemically treated genomic DNA (Homo sapiens) CpG-island No: 38406
ttacgaaactacataatcttctcctcgtaattattaacctattattaaataaaaatcttacccaaacgccgcgcgaccgacaactttattacgaatacttaaaatccgctccgtttaattccgaaaaataaaattccgaacgccgaaatcgcacgttcaaacgacgtacaacgcgaattttacgccgcgcgccacgacccacatcaacaaaactaccaccaccgatacaccgcccgcgatcaacatcgcgacgtaaaaaccgccgaccaacgcatcgacgaaccacgcgacgacgcttaccgactactcgaacatcacataccgcgtaacgacgacgcgcgccacgccgtacgcatcgctaacgccgacgtaaacgatcgtacgcgtcaacgcgtcgaccgcgcgcccgctcatcaatacgcccaacaacgcgataccgatcgtcatacccgtctaacgcatcgcattcataataacgaacgccatacccgaacgttcgcgcgacaccgtaaccataaccgccatactaatcgacgacaccgccaaccccatacccaaacccaacatcaccatcaaaaatccgatctcgaaccaaaacgtatacgcctcgaaccgcatcatacccaacataaccacgccgatcaaaccataacccgcgaccatcaaccgcgacaaaccgaaacgaacattcaaacgaccgaacaccgtaaacaccaatccgaccgcgacgaaatacgacgccatccgccatcccgccgccaacgacgacaaaccctacacatactacaaatacaaaaaaaaaaaaaacaaactactataaccgaaaaaaccgaacacgaaaaacgcgaaattaata

SEQ ID NO: 38407 - DNA, 856 bp, Artificial Sequence
  chemically treated genomic DNA (Homo sapiens) CpG-island No: 38407
ttgcgggattgtatggtttttttttcgtggttgttaatttgttattgggtgaggattttatttaagcgtcgcgcggtcggtagttttgttacggatgtttaaaattcgtttcgtttgatttcgaaaggtggaatttcgaacgtcgaaatcgtacgtttaggcggcgtgtagcgcgggttttgcgtcgcgcgttacgatttatattagtaaggttgttattatcgatgtatcgttcgcgattagtatcgcggcgtgaaagtcgtcggttagcgtatcggcgaattacgcggcgacgtttgtcggttgttcgggtattatatgtcgcgtgacggcggcgcgcgttacgtcgtgcgtatcgttgacgtcggcgtgggcgatcgtgcgcgttaacgcgtcgatcgcgcgttcgtttattagtgcgtttagtagcgcgatgtcgatcgttatgttcgtttggcgtatcgtatttatggtggcggacgttatgttcgagcgttcgcgcggtatcgtggttatgatcgttatgttggtcgacggtatcgttagttttatgtttaggtttagtattattattagggattcggtttcgagttagggcgtgtgcgtttcgaatcgtattatgtttagtatggttacgtcgattaggttatagttcgcgattattagtcgcggtaggtcgaagcgaatatttaggcggtcgaatatcgtggatattagttcggtcgcgacgaaatgcggcgttattcgttatttcgtcgttagcggcgataggttttgtatatgttgtagatatagggaaaagaagaataggttgttgtagtcggaaaagtcgagtacgaaagacgcgaagttggtg

SEQ ID NO: 38408 - DNA, 856 bp, Artificial Sequence
  chemically treated genomic DNA (Homo sapiens) CpG-island No: 38408
caccaacttcgcgtctttcgtactcgacttttccgactacaacaacctattcttcttttccctatatctacaacatatacaaaacctatcgccgctaacgacgaaataacgaataacgccgcatttcgtcgcgaccgaactaatatccacgatattcgaccgcctaaatattcgcttcgacctaccgcgactaataatcgcgaactataacctaatcgacgtaaccatactaaacataatacgattcgaaacgcacacgccctaactcgaaaccgaatccctaataataatactaaacctaaacataaaactaacgataccgtcgaccaacataacgatcataaccacgataccgcgcgaacgctcgaacataacgtccgccaccataaatacgatacgccaaacgaacataacgatcgacatcgcgctactaaacgcactaataaacgaacgcgcgatcgacgcgttaacgcgcacgatcgcccacgccgacgtcaacgatacgcacgacgtaacgcgcgccgccgtcacgcgacatataatacccgaacaaccgacaaacgtcgccgcgtaattcgccgatacgctaaccgacgactttcacgccgcgatactaatcgcgaacgatacatcgataataacaaccttactaatataaatcgtaacgcgcgacgcaaaacccgcgctacacgccgcctaaacgtacgatttcgacgttcgaaattccacctttcgaaatcaaacgaaacgaattttaaacatccgtaacaaaactaccgaccgcgcgacgcttaaataaaatcctcacccaataacaaattaacaaccacgaaaaaaaaaccatacaatcccgcaa

SEQ ID NO: 38409 - DNA, 822 bp, Artificial Sequence
  chemically treated genomic DNA (Homo sapiens) CpG-island No: 38409
tttttcgtttatttttttagtagcgttttttcgtcgttttttttttttttttttttttttttatcgttttttttcggtttattatcgttaatcgtttttttttttatttcgtatttttttttttttatgtttgttttagttttttttttattttttttttttttttttatcgttttttttttattttttttttttttttttatcgttttttttttatttttttttttttttttaatcgtttttttttttagttttttttttatttttttgtcgtttttatatttttatttttttttcgtagtagcgtttttttgtcgcgtttttttttttttttattatttttttttttttttttttatcgttttttttttacgtttttttttttttattgtttttttttcgcgttttttttataatcgttttttttttcgtttttttttttttatatcgttttttttttatgtttttttatcgtttcgtagtagcgtttgttagtcgtaattttttttttattttttttttttttttttttatcgttttttttttttagttttttatttttcgttattttttttttttttttattttttcgtagtagcgattttttgtcgcgttttttttttttcgtatttttttttttttttttttattttttatcgttttcgttttcgatcgtttttttgtttatttttttttcgcgttttttaattgttttttatttagaagcgttttacgcgtgcgttcgtttgtgtttttgcgtttggtgtgtttgtgcgtttagttagttttatgagttgggtttttgagtttcgttttaatagt

SEQ ID NO: 38410 - DNA, 822 bp, Artificial Sequence
  chemically treated genomic DNA (Homo sapiens) CpG-island No: 38410
actattaaaacgaaactcaaaaacccaactcataaaactaactaaacgcacaaacacaccaaacgcaaaaacacaaacgaacgcacgcgtaaaacgcttctaaataaaaaacaattaaaaaacgcgaaaaaaaaataaacaaaaaaacgatcgaaaacgaaaacgataaaaaataaaaaaaaaaaaaaaaaaatacgaaaaaaaaaaaacgcgacaaaaaatcgctactacgaaaaaataaaaaaaaaaaaaaaataacgaaaaataaaaaactaaaaaaaaaaaacgataaaaaaaaaaaaaaaaaaaataaaaaaaaaattacgactaacaaacgctactacgaaacgataaaaaaacataaaaaaaaaacgatataaaaaaaaaaaaacgaaaaaaaaaacgattataaaaaaaacgcgaaaaaaaaacaataaaaaaaaaaaaacgtaaaaaaaaaacgataaaaaaaaaaaaaaaaaaataataaaaaaaaaaaaaaacgcgacaaaaaaacgctactacgaaaaaaaaataaaaatataaaaacgacaaaaaaataaaaaaaaaactaaaaaaaaaaacgattaaaaaaaaaaaaaaaaataaaaaaaaaacgataaaaaaaaaaaaaaaaaataaaaaaaaaacgataaaaaaaaaaaaaaaaaataaaaaaaaaactaaaacaaacataaaaaaaaaaaaatacgaaataaaaaaaaaaacgattaacgataataaaccgaaaaaaaacgataaaaaaaaaaaaaaaaaaaaaaaaaacgacgaaaaaacgctactaaaaaaataaacgaaaaa

SEQ ID NO: 38411 - DNA, 822 bp, Artificial Sequence
  chemically treated genomic DNA (Homo sapiens) CpG-island No: 38411
gttgttggggcggagtttaggggtttagtttatggggttggttgggcgtatagatatattaggcgtagggatataggcgggcgtacgcgtggagcgtttttaggtgaaaggtagttggagagcgcgagaagggggtgggtaagaagacgatcgggggcgaagacggtggggagtggaagaggggagaagagggtgcggggagagaaaaacgcggtaggaagtcgttgttgcgagaaggtggggaggggaagaagatggcggagaataagaggttggggaaaaaagacgatgggagggggagagaagaaagtgggaagaagattgcgattgatagacgttgttgcgagacggtgggaggatatgggaagaaaacggtgtgaggggaagaaaacgggggagaaaacggttgtggggaaggcgcggggagaagatagtgaggagaagagggcgtggggagaggacggtggggaagaggaagagaagatggtgaggggagagaaaagcgcggtaggaagacgttgttgcgagaagaaggtggggatatggaggcggtaagaaaatggagaagaggttgggaaagaagacgattgggagaggagaagagggtgggaagaaggcgatggggagaggagaagagggtgggaagaaggcgatggggagaggagaagagggtgggaagaagattaaggtagatatgggaagaaaagggtgcgggatgaggaagaaaacggttggcggtaataggtcgggagaagacggtgaggagggggaggggagaagagggagcggcgggaagacgttgttgggggaataggcgggaag

SEQ ID NO: 38412 - DNA, 822 bp, Artificial Sequence
  chemically treated genomic DNA (Homo sapiens) CpG-island No: 38412
cttcccgcctattcccccaacaacgtcttcccgccgctccctcttctcccctccccctcctcaccgtcttctcccgacctattaccgccaaccgttttcttcctcatcccgcacccttttcttcccatatctaccttaatcttcttcccaccctcttctcctctccccatcgccttcttcccaccctcttctcctctccccatcgccttcttcccaccctcttctcctctcccaatcgtcttctttcccaacctcttctccattttcttaccgcctccatatccccaccttcttctcgcaacaacgtcttcctaccgcgcttttctctcccctcaccatcttctcttcctcttccccaccgtcctctccccacgccctcttctcctcactatcttctccccgcgccttccccacaaccgttttctcccccgttttcttcccctcacaccgttttcttcccatatcctcccaccgtctcgcaacaacgtctatcaatcgcaatcttcttcccactttcttctctccccctcccatcgtcttttttccccaacctcttattctccgccatcttcttcccctccccaccttctcgcaacaacgacttcctaccgcgtttttctctccccgcaccctcttctcccctcttccactccccaccgtcttcgcccccgatcgtcttcttacccacccccttctcgcgctctccaactacctttcacctaaaaacgctccacgcgtacgcccgcctatatccctacgcctaatatatctatacgcccaaccaaccccataaactaaacccctaaactccgccccaacaac

SEQ ID NO: 38413 - DNA, 592 bp, Artificial Sequence
  chemically treated genomic DNA (Homo sapiens) CpG-island No: 38413
gttattttattatatcgaatgtgtttggaattggggcgttgcggttggtcgtcgttcgatttttagtttaggcgcgatttaagcgtttttttttcgttattgcggttgtagagggtggggtacggcgggggatagcgaggacgtcgaagtatttttcgggttttgggacgtcgcggttttcggattcgaagtcgtttatttatcggaatacggttcgcgtacgtatttagcgacgttttcgttttacgtcgtcgtcggtgttattagttttagattcgttgatttaacgtttcgcgtatcgtcgcgggttagttacgtgattagtcgttttaattttaaatttcgaatttggcgttggatcgttcgagtttaggaaggtgtattttgcgcgttaggtttgggtttggtttcgttttcggaggcgtttaattagagagcgtagttaagtatgggtcgttattaaacgtattcgcgttattggttgcggcgtagcggcgggtagggtttgttttttcggggcgggtcggaggtcgcgtagtgtagttgcgtatttggggtagggatttgtagaattgattcgttttggttgtag

SEQ ID NO: 38414 - DNA, 592 bp, Artificial Sequence
  chemically treated genomic DNA (Homo sapiens) CpG-island No: 38414
ctacaaccaaaacgaatcaattctacaaatccctaccccaaatacgcaactacactacgcgacctccgacccgccccgaaaaaacaaaccctacccgccgctacgccgcaaccaataacgcgaatacgtttaataacgacccatacttaactacgctctctaattaaacgcctccgaaaacgaaaccaaacccaaacctaacgcgcaaaatacaccttcctaaactcgaacgatccaacgccaaattcgaaatttaaaattaaaacgactaatcacgtaactaacccgcgacgatacgcgaaacgttaaatcaacgaatctaaaactaataacaccgacgacgacgtaaaacgaaaacgtcgctaaatacgtacgcgaaccgtattccgataaataaacgacttcgaatccgaaaaccgcgacgtcccaaaacccgaaaaatacttcgacgtcctcgctatcccccgccgtaccccaccctctacaaccgcaataacgaaaaaaaaacgcttaaatcgcgcctaaactaaaaatcgaacgacgaccaaccgcaacgccccaattccaaacacattcgatataataaaataac

SEQ ID NO: 38415 - DNA, 592 bp, Artificial Sequence
  chemically treated genomic DNA (Homo sapiens) CpG-island No: 38415
ttgtagttaaagcgggttagttttgtaggtttttgttttaggtgcgtagttgtattacgcggttttcggttcgtttcggagaaataggttttgttcgtcgttgcgtcgtagttaatagcgcgggtgcgtttggtggcggtttatgtttggttgcgttttttgattgggcgttttcgggggcggggttaagtttaagtttggcgcgtagagtgtatttttttgagttcgagcggtttagcgttaagttcggggtttggggttggagcggttggttacgtggttggttcgcggcggtgcgcggggcgttgggttagcgggtttgggattggtggtatcggcggcggcgtaggacggaggcgtcgttaggtacgtgcgcgggtcgtgtttcggtaggtgggcggtttcgggttcgagggtcgcggcgttttagagttcggggggtgtttcggcgttttcgttgtttttcgtcgtattttattttttgtagtcgtaatgacgggaggggagcgtttgggtcgcgtttgggttggggatcgggcggcggttagtcgtagcgttttagttttaggtatattcggtatgatggggtggt

SEQ ID NO: 38416 - DNA, 592 bp, Artificial Sequence
  chemically treated genomic DNA (Homo sapiens) CpG-island No: 38416
accaccccatcataccgaatatacctaaaactaaaacgctacgactaaccgccgcccgatccccaacccaaacgcgacccaaacgctcccctcccgtcattacgactacaaaaaataaaatacgacgaaaaacaacgaaaacgccgaaacaccccccgaactctaaaacgccgcgaccctcgaacccgaaaccgcccacctaccgaaacacgacccgcgcacgtacctaacgacgcctccgtcctacgccgccgccgataccaccaatcccaaacccgctaacccaacgccccgcgcaccgccgcgaaccaaccacgtaaccaaccgctccaaccccaaaccccgaacttaacgctaaaccgctcgaactcaaaaaaatacactctacgcgccaaacttaaacttaaccccgcccccgaaaacgcccaatcaaaaaacgcaaccaaacataaaccgccaccaaacgcacccgcgctattaactacgacgcaacgacgaacaaaacctatttctccgaaacgaaccgaaaaccgcgtaatacaactacgcacctaaaacaaaaacctacaaaactaacccgctttaactacaa

SEQ ID NO: 38417 - DNA, 536 bp, Artificial Sequence
  chemically treated genomic DNA (Homo sapiens) CpG-island No: 38417
  misc_feature (503)..(506): n is either a, c, g or t
gcgcggttaatggacgtttttagcgcggatagataggttttttgttggagttgggtagggcgaaaggattttagggcggggttttagtcgaggtcggtttcgtttatcgttgtagtcgcgtatgcgttatgtataggttgttttgggttttttcgcgtgtcgtttttattcggtttgtttcgcgtcgtcgttttcggaagtgggtttcgtttttttttaagcggagtatttgtgtttgaagttgtcgggtttgttacggtatcgcggggttgtagaaattcgggggttaagggcgggttgtttgtcgttatggttggtagttaggatatattcgatgttatcgtgatggcggatgagaggtgggtggtgaggtcgggttcgtatttcgttttgtttggtcgttttttagcggtttcgtcgtcggttgcggtttagggcggttgttggagtttggcgttttttgggcgtgcgtattggggagcgtttggtggtcgtggacgtannnntaagtgtgggtttgatgttttggttttttt

SEQ ID NO: 38418 - DNA, 536 bp, Artificial Sequence
  chemically treated genomic DNA (Homo sapiens) CpG-island No: 38418
  misc_feature (31)..(34): n is either a, c, g or t
aaaaaaaccaaaacatcaaacccacacttannnntacgtccacgaccaccaaacgctccccaatacgcacgcccaaaaaacgccaaactccaacaaccgccctaaaccgcaaccgacgacgaaaccgctaaaaaacgaccaaacaaaacgaaatacgaacccgacctcaccacccacctctcatccgccatcacgataacatcgaatatatcctaactaccaaccataacgacaaacaacccgcccttaacccccgaatttctacaaccccgcgataccgtaacaaacccgacaacttcaaacacaaatactccgcttaaaaaaaaacgaaacccacttccgaaaacgacgacgcgaaacaaaccgaataaaaacgacacgcgaaaaaacccaaaacaacctatacataacgcatacgcgactacaacgataaacgaaaccgacctcgactaaaaccccgccctaaaatcctttcgccctacccaactccaacaaaaaacctatctatccgcgctaaaaacgtccattaaccgcgc

SEQ ID NO: 38419 - DNA, 536 bp, Artificial Sequence
  chemically treated genomic DNA (Homo sapiens) CpG-island No: 38419
  misc_feature (31)..(34): n is either a, c, g or t
aagaggattagagtattaggtttatatttgnnnntgcgtttacggttattaggcgttttttaatgcgtacgtttaagggacgttaggttttagtagtcgttttgggtcgtagtcggcggcgaagtcgttgggagacgattagatagggcggggtgcgggttcggttttattatttattttttattcgttattacgatggtatcgaatatgttttgattgttagttatagcggtaagtagttcgtttttggttttcgggtttttgtagtttcgcggtgtcgtagtagattcggtagttttaggtataaatgtttcgtttgggaggagacgagatttattttcggaagcggcggcgcggggtaggtcgggtaagaacggtacgcgggagggtttaaagtagtttgtatatggcgtatgcgcggttgtagcggtgggcggggtcggtttcgattgaagtttcgttttggggttttttcgttttgtttagttttagtaaagggtttgtttgttcgcgttgggagcgtttattggtcgcgt

SEQ ID NO: 38420 - DNA, 536 bp, Artificial Sequence
  chemically treated genomic DNA (Homo sapiens) CpG-island No: 38420
  misc_feature (503)..(506): n is either a, c, g or t
acgcgaccaataaacgctcccaacgcgaacaaacaaaccctttactaaaactaaacaaaacgaaaaaaccccaaaacgaaacttcaatcgaaaccgaccccgcccaccgctacaaccgcgcatacgccatatacaaactactttaaaccctcccgcgtaccgttcttacccgacctaccccgcgccgccgcttccgaaaataaatctcgtctcctcccaaacgaaacatttatacctaaaactaccgaatctactacgacaccgcgaaactacaaaaacccgaaaaccaaaaacgaactacttaccgctataactaacaatcaaaacatattcgataccatcgtaataacgaataaaaaataaataataaaaccgaacccgcaccccgccctatctaatcgtctcccaacgacttcgccgccgactacgacccaaaacgactactaaaacctaacgtcccttaaacgtacgcattaaaaaacgcctaataaccgtaaacgcannnncaaatataaacctaatactctaatcctctt

SEQ ID NO: 38421 - DNA, 507 bp, Artificial Sequence
  chemically treated genomic DNA (Homo sapiens) CpG-island No: 38421
tttcggttcgtcgttaatggtcgcggtcggtaggggcgggtcggggcgggtatttcgcggtttcgtttcgttttttcgtttttagtttttttttcgcggcggcgttattattagttcgcgttttttttcggttagggttatcgtcgttcgagcgttcgcgagggttggcgttttattttcggcgtaacgagtgttgcgtaacggtttacgcggtcgatacgatcggagcgagtttgcggaggagttcgggagtttttcgttttatcgtttcgttcgtttttggttttttttattttttcggtcgtcgcggtggttttgcgtttttcgcgatttttatttgttcgtagaggcgttttttgtttttttgagagtcgtagtttgttgggttatttgttgtcgattgagtattgcgggttgcggttattcgggcgtggttcggatttcggttttttttttttcgtatattttcgagaggagttttttattttggggtgggtaggagggaag

SEQ ID NO: 38422 - DNA, 507 bp, Artificial Sequence
  chemically treated genomic DNA (Homo sapiens) CpG-island No: 38422
cttccctcctacccaccccaaaataaaaaactcctctcgaaaatatacgaaaaaaaaaaaaccgaaatccgaaccacgcccgaataaccgcaacccgcaatactcaatcgacaacaaataacccaacaaactacgactctcaaaaaaacaaaaaacgcctctacgaacaaataaaaatcgcgaaaaacgcaaaaccaccgcgacgaccgaaaaaataaaaaaaaccaaaaacgaacgaaacgataaaacgaaaaactcccgaactcctccgcaaactcgctccgatcgtatcgaccgcgtaaaccgttacgcaacactcgttacgccgaaaataaaacgccaaccctcgcgaacgctcgaacgacgataaccctaaccgaaaaaaaacgcgaactaataataacgccgccgcgaaaaaaaaactaaaaacgaaaaaacgaaacgaaaccgcgaaatacccgccccgacccgcccctaccgaccgcgaccattaacgacgaaccgaaa

SEQ ID NO: 38423 - DNA, 507 bp, Artificial Sequence
  chemically treated genomic DNA (Homo sapiens) CpG-island No: 38423
ttttttttttgtttattttaaggtagagggtttttttcgggagtgtgcggggaaggggaggtcgaggttcgggttacgttcgggtagtcgtaattcgtagtgtttagtcggtaataggtagtttagtaggttgcggtttttaggaagataaaaagcgtttttgcgagtaagtgagggtcgcggggagcgtagagttatcgcggcgatcgggagggtgaagggagttaagagcggacggggcggtgggacggggggttttcgggttttttcgtaggttcgtttcggtcgtgtcggtcgcgtgggtcgttgcgtaatattcgttgcgtcgggaatggggcgttagttttcgcgggcgttcggacggcggtggttttggtcggggagggacgcgagttggtagtggcgtcgtcgcggagggggagttgagggcggggaggcggggcggggtcgcggagtgttcgtttcggttcgtttttgtcggtcgcggttattggcggcgggtcgggg

SEQ ID NO: 38424 - DNA, 507 bp, Artificial Sequence
  chemically treated genomic DNA (Homo sapiens) CpG-island No: 38424
ccccgacccgccgccaataaccgcgaccgacaaaaacgaaccgaaacgaacactccgcgaccccgccccgcctccccgccctcaactccccctccgcgacgacgccactaccaactcgcgtccctccccgaccaaaaccaccgccgtccgaacgcccgcgaaaactaacgccccattcccgacgcaacgaatattacgcaacgacccacgcgaccgacacgaccgaaacgaacctacgaaaaaacccgaaaaccccccgtcccaccgccccgtccgctcttaactcccttcaccctcccgatcgccgcgataactctacgctccccgcgaccctcacttactcgcaaaaacgctttttatcttcctaaaaaccgcaacctactaaactacctattaccgactaaacactacgaattacgactacccgaacgtaacccgaacctcgacctccccttccccgcacactcccgaaaaaaaccctctaccttaaaataaacaaaaaaaaaa

SEQ ID NO: 38425 - DNA, 520 bp, Artificial Sequence
  chemically treated genomic DNA (Homo sapiens) CpG-island No: 38425
atttcgatcgttaaggtagatttttcgcggggcggggcgcgcgacggagatttcgtttttttttttcgtcggcgcgggggatttttcggtgagtagtttaagggttttgggagaagtggggttaggatatggttagatttgagagtcggtcgtgaacgcgtgggggcgcgattacgggttcgtgcgaggggcgtcgtttttgggcggcggggcgtcgcgacgtttcgacgcgtcgatgttacgtttcgtgaagcggattcgtttttcgggcgtagcgcgcgtagggtgtcgcggcgggcgcgagaatcgaggcgtcgaagcgggttcgttgttcgatcgtttattttgtatcgtatacgcgttttattcgagttcgacgttcggtcgcgtttattggttacggcggttttttgtttttaaattcgcggagtggtttcgtacgatagtattcgcgatcgggcgagagcgagtggcgaagatacgcgttcgttggtcggcggatggcgttgtgttgattttt

SEQ ID NO: 38426 - DNA, 520 bp, Artificial Sequence
  chemically treated genomic DNA (Homo sapiens) CpG-island No: 38426
aaaaatcaacacaacgccatccgccgaccaacgaacgcgtatcttcgccactcgctctcgcccgatcgcgaatactatcgtacgaaaccactccgcgaatttaaaaacaaaaaaccgccgtaaccaataaacgcgaccgaacgtcgaactcgaataaaacgcgtatacgatacaaaataaacgatcgaacaacgaacccgcttcgacgcctcgattctcgcgcccgccgcgacaccctacgcgcgctacgcccgaaaaacgaatccgcttcacgaaacgtaacatcgacgcgtcgaaacgtcgcgacgccccgccgcccaaaaacgacgcccctcgcacgaacccgtaatcgcgcccccacgcgttcacgaccgactctcaaatctaaccatatcctaaccccacttctcccaaaacccttaaactactcaccgaaaaatcccccgcgccgacgaaaaaaaaaaacgaaatctccgtcgcgcgccccgccccgcgaaaaatctaccttaacgatcgaaat

SEQ ID NO: 38427 - DNA, 520 bp, Artificial Sequence
  chemically treated genomic DNA (Homo sapiens) CpG-island No: 38427
ggaggttagtatagcgttattcgtcggttaacgagcgcgtgttttcgttattcgttttcgttcggtcgcgggtgttgtcgtgcggggttatttcgcgggtttggaaatagggggtcgtcgtgattaatgggcgcgatcgggcgtcgagttcgagtggggcgcgtgtgcggtgtagaatggacgatcgggtaacgggttcgtttcggcgtttcggttttcgcgttcgtcgcggtattttgcgcgcgttgcgttcggagggcgagttcgttttacggaacgtggtatcggcgcgtcggaacgtcgcggcgtttcgtcgtttaggggcgacgtttttcgtacggattcgtggtcgcgtttttacgcgtttacggtcgatttttagatttgattatgttttgattttattttttttagaatttttgaattgtttatcgaggggtttttcgcgtcggcggggggaggagacggggttttcgtcgcgcgtttcgtttcgcggggggtttgttttagcggtcggagt

SEQ ID NO: 38428 - DNA, 520 bp, Artificial Sequence
  chemically treated genomic DNA (Homo sapiens) CpG-island No: 38428
actccgaccgctaaaacaaaccccccgcgaaacgaaacgcgcgacgaaaaccccgtctcctccccccgccgacgcgaaaaacccctcgataaacaattcaaaaattctaaaaaaaataaaatcaaaacataatcaaatctaaaaatcgaccgtaaacgcgtaaaaacgcgaccacgaatccgtacgaaaaacgtcgcccctaaacgacgaaacgccgcgacgttccgacgcgccgataccacgttccgtaaaacgaactcgccctccgaacgcaacgcgcgcaaaataccgcgacgaacgcgaaaaccgaaacgccgaaacgaacccgttacccgatcgtccattctacaccgcacacgcgccccactcgaactcgacgcccgatcgcgcccattaatcacgacgaccccctatttccaaacccgcgaaataaccccgcacgacaacacccgcgaccgaacgaaaacgaataacgaaaacacgcgctcgttaaccgacgaataacgctatactaacctcc

SEQ ID NO: 38429 - DNA, 519 bp, Artificial Sequence
  chemically treated genomic DNA (Homo sapiens) CpG-island No: 38429
ggatcggcgttcggcgcgtttttggtgtttttcgcgtgtaagtgagtatggtcggcgcgtagtattttgaagcgtttgcgacgtcgtaggaagttgtcgttttcgaatatgttttcgtagtcggggtgtagcgtttagaagttatttttgttaggttggtcgggttttcgcggaattttgatgaagtagtcgttgaaggagaggttgtggcgtaggttgttttgttagcgttgtgtgtgttcgcggtagtaggggaagcgttttatgatgaatttgtagatgtcgtttagcggtagtattttttcggtcgagtgttggattgttatggcggttagcgagatgtaagagtagggcggtttttggtcgttgtacgagttttttttcggtcgcggtatcgttttcggtttttttatcgtttttcggttcgtattggattatagaattttttcgtatttcgtttttggggtttggttgtttttattaatttttattcggtttttttagtttcgttattttgtt

SEQ ID NO: 38430 - DNA, 519 bp, Artificial Sequence
  chemically treated genomic DNA (Homo sapiens) CpG-island No: 38430
aacaaaataacgaaactaaaaaaaccgaataaaaattaataaaaacaaccaaaccccaaaaacgaaatacgaaaaaattctataatccaatacgaaccgaaaaacgataaaaaaaccgaaaacgataccgcgaccgaaaaaaaactcgtacaacgaccaaaaaccgccctactcttacatctcgctaaccgccataacaatccaacactcgaccgaaaaaatactaccgctaaacgacatctacaaattcatcataaaacgcttcccctactaccgcgaacacacacaacgctaacaaaacaacctacgccacaacctctccttcaacgactacttcatcaaaattccgcgaaaacccgaccaacctaacaaaaataacttctaaacgctacaccccgactacgaaaacatattcgaaaacgacaacttcctacgacgtcgcaaacgcttcaaaatactacgcgccgaccatactcacttacacgcgaaaaacaccaaaaacgcgccgaacgccgatcc

SEQ ID NO: 38431 - DNA, 519 bp, Artificial Sequence
  chemically treated genomic DNA (Homo sapiens) CpG-island No: 38431
ggtaaagtggcgggattggaggggtcgagtgggaattagtgggggtagttaggttttaggaacggagtgcggagagattttgtggtttagtgcgggtcggagggcggtggaggagtcgggggcgatgtcgcggtcggggaagagttcgtatagcgattaaaaatcgttttatttttatatttcgttgatcgttatggtaatttagtattcggtcgagaagatgttgtcgttgagcgatatttataagtttattatggagcgttttttttattatcgcgagtatatatagcgttggtagaatagtttgcgttataattttttttttaacgattgttttattaagatttcgcggaggttcgattagtttggtaagggtagtttttgggcgttgtatttcgattgcggggatatgttcgagaacggtagttttttgcggcgtcgtaagcgttttaaggtgttgcgcgtcgattatatttatttgtacgcgggaagtattaagagcgcgtcgggcgtcggttt

SEQ ID NO: 38432 - DNA, 519 bp, Artificial Sequence
  chemically treated genomic DNA (Homo sapiens) CpG-island No: 38432
aaaccgacgcccgacgcgctcttaatacttcccgcgtacaaataaatataatcgacgcgcaacaccttaaaacgcttacgacgccgcaaaaaactaccgttctcgaacatatccccgcaatcgaaatacaacgcccaaaaactacccttaccaaactaatcgaacctccgcgaaatcttaataaaacaatcgttaaaaaaaaaattataacgcaaactattctaccaacgctatatatactcgcgataataaaaaaaacgctccataataaacttataaatatcgctcaacgacaacatcttctcgaccgaatactaaattaccataacgatcaacgaaatataaaaataaaacgatttttaatcgctatacgaactcttccccgaccgcgacatcgcccccgactcctccaccgccctccgacccgcactaaaccacaaaatctctccgcactccgttcctaaaacctaactacccccactaattcccactcgacccctccaatcccgccactttacc

SEQ ID NO: 38433 - DNA, 654 bp, Artificial Sequence
  chemically treated genomic DNA (Homo sapiens) CpG-island No: 38433
cgagttttttttttagcgtttaagagatgagggttgcgggcggtagcggtaagcgaggaatcgaacgtatggaatttaagtttcggcggggtcggaatatacgtttttttaattttttatttcgtttcgtttttcgtcgttcgtaataaagtttgcgatagtcgtagttcgatttagttgtgtattcgcgggtttcggatttatcgttcgttcggtttggcgcggcgtttttatttcggaaacgttgggtggatttcgttgtaaatcgtaattttttatttagacggtagtcgcgtcgtcgcgtttcggttcgtttttggcgttataggtcgttcgtttcgcgtttttaaaagtatcgcgtttatttagaagtttacgttgtttcgcgacgtttatttattttttttaatatcgtcgttgttttaatcgtcgtttagtttatagtttgcggttagttggatttttagggtttcgttcggcgcgttaggagagtttaaggcgtaggcgtagcggggttttaaaggtatatggtcgtttttgcggtatagcgggttcgcgcgggttaggaaaaggagtaatcgagcggatagatagagtgtagtagagatcgggaaatttttttttttttttcgttttttttttaaagtattagtt

SEQ ID NO: 38434 - DNA, 654 bp, Artificial Sequence
  chemically treated genomic DNA (Homo sapiens) CpG-island No: 38434
aactaatactttaaaaaaaaaacgaaaaaaaaaaaaaaatttcccgatctctactacactctatctatccgctcgattactccttttcctaacccgcgcgaacccgctataccgcaaaaacgaccatatacctttaaaaccccgctacgcctacgccttaaactctcctaacgcgccgaacgaaaccctaaaaatccaactaaccgcaaactataaactaaacgacgattaaaacaacgacgatattaaaaaaaataaataaacgtcgcgaaacaacgtaaacttctaaataaacgcgatacttttaaaaacgcgaaacgaacgacctataacgccaaaaacgaaccgaaacgcgacgacgcgactaccgtctaaataaaaaattacgatttacaacgaaatccacccaacgtttccgaaataaaaacgccgcgccaaaccgaacgaacgataaatccgaaacccgcgaatacacaactaaatcgaactacgactatcgcaaactttattacgaacgacgaaaaacgaaacgaaataaaaaattaaaaaaacgtatattccgaccccgccgaaacttaaattccatacgttcgattcctcgcttaccgctaccgcccgcaaccctcatctcttaaacgctaaaaaaaaaactcg

SEQ ID NO: 38435 - DNA, 654 bp, Artificial Sequence
  chemically treated genomic DNA (Homo sapiens) CpG-island No: 38435
ggttggtgttttaaaagagaggcggaggggagagagggatttttcggtttttgttgtattttgtttattcgttcggttatttttttttttggttcgcgcgaattcgttgtgtcgtagaggcggttatgtatttttaaggtttcgttgcgtttgcgttttgggtttttttgacgcgtcgagcgggattttgaggatttagttggtcgtaggttatgggttgggcggcggttgagatagcggcgatattgggaggggtaggtgagcgtcgcgaggtagcgtgagtttttgagtgaacgcggtgtttttgggaacgcgggacgggcgatttgtggcgttaggagcgggtcgaggcgcggcggcgcggttgtcgtttggatgggaagttacggtttatagcgaagtttatttagcgttttcgaggtgaaggcgtcgcgttaggtcgggcgggcggtgagttcgggattcgcgggtatatagttgggtcgagttgcggttgtcgtaagttttgttgcgagcgacggagggcgaggcggggtggggggttgggagggcgtgtgtttcggtttcgtcggggtttaagttttatgcgttcgatttttcgtttgtcgttgtcgttcgtagtttttattttttgggcgttggggaagaaattcg

SEQ ID NO: 38436 - DNA, 654 bp, Artificial Sequence
  chemically treated genomic DNA (Homo sapiens) CpG-island No: 38436
cgaatttcttccccaacgcccaaaaaataaaaactacgaacgacaacgacaaacgaaaaatcgaacgcataaaacttaaaccccgacgaaaccgaaacacacgccctcccaaccccccaccccgcctcgccctccgtcgctcgcaacaaaacttacgacaaccgcaactcgacccaactatatacccgcgaatcccgaactcaccgcccgcccgacctaacgcgacgccttcacctcgaaaacgctaaataaacttcgctataaaccgtaacttcccatccaaacgacaaccgcgccgccgcgcctcgacccgctcctaacgccacaaatcgcccgtcccgcgttcccaaaaacaccgcgttcactcaaaaactcacgctacctcgcgacgctcacctacccctcccaatatcgccgctatctcaaccgccgcccaacccataacctacgaccaactaaatcctcaaaatcccgctcgacgcgtcaaaaaaacccaaaacgcaaacgcaacgaaaccttaaaaatacataaccgcctctacgacacaacgaattcgcgcgaaccaaaaaaaaaaataaccgaacgaataaacaaaatacaacaaaaaccgaaaaatccctctctcccctccgcctctcttttaaaacaccaacc

SEQ ID NO: 38437 - DNA, 821 bp, Artificial Sequence
  chemically treated genomic DNA (Homo sapiens) CpG-island No: 38437
tatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgtttgggtcggatcgtgaaacgttggtgggcggggcgaaagtttttttgtcggttatgacgtttttgggttgcgttttgttttggtgattgtttcggtttttttggttttgttattgtcgtcgtcgtcgttcgtttcgttttttgtttcggcgttcgtttcgttttcgtcgtttttttcgttttttttttcgttttttcgtgtttgttcgtgttgttttcggttttcggttgtgagttttcgtgggtattgcgttcggttgttgttcgttgggtttgtcgttttggtttttttgtttattgttgttcgtttgcgcgtcgtgtcgtcgttgtttcgttttcgttttttttttttttttggttttcgt

SEQ ID NO: 38438 - DNA, 821 bp, Artificial Sequence
  chemically treated genomic DNA (Homo sapiens) CpG-island No: 38438
acgaaaaccaaaaaaaaaaaaaaaacgaaaacgaaacaacgacgacacgacgcgcaaacgaacaacaataaacaaaaaaaccaaaacgacaaacccaacgaacaacaaccgaacgcaatacccacgaaaactcacaaccgaaaaccgaaaacaacacgaacaaacacgaaaaaacgaaaaaaaaaacgaaaaaaacgacgaaaacgaaacgaacgccgaaacaaaaaacgaaacgaacgacgacgacgacaataacaaaaccaaaaaaaccgaaacaatcaccaaaacaaaacgcaacccaaaaacgtcataaccgacaaaaaaactttcgccccgcccaccaacgtttcacgatccgacccaaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtata

SEQ ID NO: 38439 - DNA, 821 bp, Artificial Sequence
  chemically treated genomic DNA (Homo sapiens) CpG-island No: 38439
gcggaggttaaagaaagagggggaacgaagacgaaataacggcgatacgacgcgtaaacggataataataaataggagggttagaacgataagtttagcgaataataatcggacgtaatatttacgggaatttatagtcggggatcgaggataatacgaatagatacgagagggcgaaagggagaacgaaaaaagcggcgagaacggggcgaacgtcggaataaaaagcggagcgggcggcggcggcgatagtaatagggttagaaaggtcgaggtaattattaaagtagggcgtaatttaagagcgttatgatcggtagaaaggttttcgtttcgtttattaacgttttacggttcgatttaagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatg

SEQ ID NO: 38440 - DNA, 821 bp, Artificial Sequence
  chemically treated genomic DNA (Homo sapiens) CpG-island No: 38440
catacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatacttaaatcgaaccgtaaaacgttaataaacgaaacgaaaacctttctaccgatcataacgctcttaaattacgccctactttaataattacctcgacctttctaaccctattactatcgccgccgccgcccgctccgctttttattccgacgttcgccccgttctcgccgcttttttcgttctccctttcgccctctcgtatctattcgtattatcctcgatccccgactataaattcccgtaaatattacgtccgattattattcgctaaacttatcgttctaaccctcctatttattattatccgtttacgcgtcgtatcgccgttatttcgtcttcgttccccctctttctttaacctccgc

SEQ ID NO: 38441 - DNA, 638 bp, Artificial Sequence
  chemically treated genomic DNA (Homo sapiens) CpG-island No: 38441
ttttcggagttttttttttcgtgcgagttttcgcgcgcgcgtatagttatttcgttggtttgacgattgtggagaggcggtggagaggttttatttattttattcggtcgtcgtcggggattggggttttagcgagattttttcgggagaagtagtgtttaggaggttttttgaagtcggggaagttgtgtagtcgaagtcgtcgtcgcgtcggagttcgggatatcggttatttttcgcgttatttattttcgtcggtttcggttttttttggtttaggcgtcgcgcggattcggtagttgtttgcgtacgtcgagttttacggtcggtgtaagttttttttatcggggattgggattggggcgggtgcggggatggcggagacgttgtttgggtttttcggtcgggagaagacgagagttgggaacgttttggttcgatcgttttgtagtttgggcgattcgtcgtagtaggggttggtatttatttgttttagggcgcgcggggaggcgggcgtttttcgtgaggggtgcgttgcggatacgtgtagagttcggggaattttatttttttacgttagggtttaggattcggagttttaggaagaggaagtttaatagttttttttgggtgatttt

SEQ ID NO: 38442 - DNA, 638 bp, Artificial Sequence
  chemically treated genomic DNA (Homo sapiens) CpG-island No: 38442
aaaatcacccaaaaaaaactattaaacttcctcttcctaaaactccgaatcctaaaccctaacgtaaaaaaataaaattccccgaactctacacgtatccgcaacgcacccctcacgaaaaacgcccgcctccccgcgcgccctaaaacaaataaataccaacccctactacgacgaatcgcccaaactacaaaacgatcgaaccaaaacgttcccaactctcgtcttctcccgaccgaaaaacccaaacaacgtctccgccatccccgcacccgccccaatcccaatccccgataaaaaaaacttacaccgaccgtaaaactcgacgtacgcaaacaactaccgaatccgcgcgacgcctaaaccaaaaaaaaccgaaaccgacgaaaataaataacgcgaaaaataaccgatatcccgaactccgacgcgacgacgacttcgactacacaacttccccgacttcaaaaaacctcctaaacactacttctcccgaaaaaatctcgctaaaaccccaatccccgacgacgaccgaataaaataaataaaacctctccaccgcctctccacaatcgtcaaaccaacgaaataactatacgcgcgcgcgaaaactcgcacgaaaaaaaaaactccgaaaa

SEQ ID NO: 38443 - DNA, 638 bp, Artificial Sequence
  chemically treated genomic DNA (Homo sapiens) CpG-island No: 38443
ggggttatttagggaaaattattgggttttttttttttaaaatttcgaattttaaattttaacgtggagaggtgaagtttttcgaattttatacgtgttcgtagcgtattttttacggaaggcgttcgttttttcgcgcgttttggggtaagtgggtgttagtttttgttgcgacgggtcgtttaagttgtagggcggtcgggttagaacgtttttagttttcgttttttttcgatcgaggggtttaggtagcgttttcgttattttcgtattcgttttagttttagttttcgataagaaagatttgtatcgatcgtggagttcggcgtgcgtagatagttgtcgggttcgcgcggcgtttgggttagaggaagtcggagtcggcgagggtgggtggcgcggagggtggtcggtgtttcgggtttcggcgcggcggcggtttcggttgtatagttttttcggttttagaaaattttttgggtattgtttttttcggggaggtttcgttgggattttaattttcggcgacgatcgggtgggatggatgaagtttttttatcgtttttttataatcgttagattagcgggatgattgtacgcgcgcgcgagggttcgtacgaaaaagaaaatttcggagg

SEQ ID NO: 38444 - DNA, 638 bp, Artificial Sequence
  chemically treated genomic DNA (Homo sapiens) CpG-island No: 38444
cctccgaaattttctttttcgtacgaaccctcgcgcgcgcgtacaatcatcccgctaatctaacgattataaaaaaacgataaaaaaacttcatccatcccacccgatcgtcgccgaaaattaaaatcccaacgaaacctccccgaaaaaaacaatacccaaaaaattttctaaaaccgaaaaaactatacaaccgaaaccgccgccgcgccgaaacccgaaacaccgaccaccctccgcgccacccaccctcgccgactccgacttcctctaacccaaacgccgcgcgaacccgacaactatctacgcacgccgaactccacgatcgatacaaatctttcttatcgaaaactaaaactaaaacgaatacgaaaataacgaaaacgctacctaaacccctcgatcgaaaaaaaacgaaaactaaaaacgttctaacccgaccgccctacaacttaaacgacccgtcgcaacaaaaactaacacccacttaccccaaaacgcgcgaaaaaacgaacgccttccgtaaaaaatacgctacgaacacgtataaaattcgaaaaacttcacctctccacgttaaaatttaaaattcgaaattttaaaaaaaaaaaacccaataattttccctaaataacccc

SEQ ID NO: 38445 - DNA, 813 bp, Artificial Sequence
  chemically treated genomic DNA (Homo sapiens) CpG-island No: 38445
ttttttttgggttatatcgtttttttttttttcgcggaattcggatttttttttttattatttttttttcgtttcgttacgatagttttttattggacggaggtacggttaatttttttcgagttagggagtcgattggacgcgaggtttttgggtcgtttttagtttcgtcggattggttttttgcgcgttggcgtaacggaagaggcggtcggtcgagggcgcgtttttgttttggttggattgtcgcggaggaggcgagaaggaattcgacgttggggggtttgttcgggcggtagcgattgttgttgcggatgggagggggtcggttcggcgcgtttatggagcgttacggtagggttttcgttattttcgtttcgtcggttggggagtaggcggtcggggatttcgaagggcggcggtaggagttattgcggcgtcgggcgagtagcgcgtcggtgttcgcggtcggggtttcggttgagggtacgaggcgggatcgattgggtttttatagcggttttatttcggtttttcgttagcgcgtcgaaagtttgaggaaaaagcggtcgcgtaagtgtttcgtggggcgttttttcggttcgttttgttttttttttcggtttattttgttttttttcggtttcgtcgtcgtttttttcgcgcgcggatattgttttcgtacggtggtttttcgttggtgcgtggtttgatattcggttggaggtttcgggtgtttcgaaagcggtattttcgggggttttttcgtatttattggtatgtatttttcgtttgttggagtggagggttttt

SEQ ID NO: 38446 - DNA, 813 bp, Artificial Sequence
  chemically treated genomic DNA (Homo sapiens) CpG-island No: 38446
aaaaaccctccactccaacaaacgaaaaatacataccaataaatacgaaaaaacccccgaaaataccgctttcgaaacacccgaaacctccaaccgaatatcaaaccacgcaccaacgaaaaaccaccgtacgaaaacaatatccgcgcgcgaaaaaaacgacgacgaaaccgaaaaaaaacaaaataaaccgaaaaaaaaaacaaaacgaaccgaaaaaacgccccacgaaacacttacgcgaccgctttttcctcaaactttcgacgcgctaacgaaaaaccgaaataaaaccgctataaaaacccaatcgatcccgcctcgtaccctcaaccgaaaccccgaccgcgaacaccgacgcgctactcgcccgacgccgcaataactcctaccgccgcccttcgaaatccccgaccgcctactccccaaccgacgaaacgaaaataacgaaaaccctaccgtaacgctccataaacgcgccgaaccgaccccctcccatccgcaacaacaatcgctaccgcccgaacaaaccccccaacgtcgaattccttctcgcctcctccgcgacaatccaaccaaaacaaaaacgcgccctcgaccgaccgcctcttccgttacgccaacgcgcaaaaaaccaatccgacgaaactaaaaacgacccaaaaacctcgcgtccaatcgactccctaactcgaaaaaaattaaccgtacctccgtccaataaaaaactatcgtaacgaaacgaaaaaaaaataataaaaaaaaaaatccgaattccgcgaaaaaaaaaaaaacgatataacccaaaaaaaa

SEQ ID NO: 38447 - DNA, 813 bp, Artificial Sequence
  chemically treated genomic DNA (Homo sapiens) CpG-island No: 38447
aaaagttttttattttaataagcgggaagtgtatattaatgggtgcgggggggttttcgaaggtatcgttttcggagtattcgaggtttttagtcggatgttaggttacgtattaacgagggattatcgtgcggggatagtgttcgcgcgcgggaaaaacggcggcggggtcggaaggggatagggtgggtcggaagggggggtagggcgggtcgggagggcgttttacggaatatttacgcggtcgttttttttttaggttttcgacgcgttggcgggagatcgaggtggggtcgttgtaagagtttagtcgatttcgtttcgtgtttttagtcgaggtttcgatcgcgggtatcgacgcgttgttcgttcggcgtcgtagtggtttttgtcgtcgtttttcggggttttcggtcgtttgttttttagtcgacgagacggaggtggcggaagttttgtcgtggcgttttatgggcgcgtcgagtcggtttttttttattcgtagtagtagtcgttgtcgttcgagtaagttttttagcgtcggattttttttcgtttttttcgcggtagtttagttagagtagaggcgcgttttcggtcggtcgtttttttcgttgcgttaacgcgtaggaagttaattcgacgaggttggggacggtttaaaggtttcgcgtttagtcggttttttaattcgaggaggattgatcgtgttttcgtttaatgagaggttatcgtgacggggcggggagagggtggtggaggaggggattcgggtttcgcggaggaagagaaggcggtgtagtttagaagaga

SEQ ID NO: 38448 - DNA, 813 bp, Artificial Sequence
  chemically treated genomic DNA (Homo sapiens) CpG-island No: 38448
tctcttctaaactacaccgccttctcttcctccgcgaaacccgaatcccctcctccaccaccctctccccgccccgtcacgataacctctcattaaacgaaaacacgatcaatcctcctcgaattaaaaaaccgactaaacgcgaaacctttaaaccgtccccaacctcgtcgaattaacttcctacgcgttaacgcaacgaaaaaaacgaccgaccgaaaacgcgcctctactctaactaaactaccgcgaaaaaaacgaaaaaaaatccgacgctaaaaaacttactcgaacgacaacgactactactacgaataaaaaaaaaccgactcgacgcgcccataaaacgccacgacaaaacttccgccacctccgtctcgtcgactaaaaaacaaacgaccgaaaaccccgaaaaacgacgacaaaaaccactacgacgccgaacgaacaacgcgtcgatacccgcgatcgaaacctcgactaaaaacacgaaacgaaatcgactaaactcttacaacgaccccacctcgatctcccgccaacgcgtcgaaaacctaaaaaaaaaacgaccgcgtaaatattccgtaaaacgccctcccgacccgccctacccccccttccgacccaccctatccccttccgaccccgccgccgtttttcccgcgcgcgaacactatccccgcacgataatccctcgttaatacgtaacctaacatccgactaaaaacctcgaatactccgaaaacgataccttcgaaaacccccccgcacccattaatatacacttcccgcttattaaaataaaaaactttt

SEQ ID NO: 38449 - DNA, 580 bp, Artificial Sequence
  chemically treated genomic DNA (Homo sapiens) CpG-island No: 38449
ttgttttttgggttttttttcgtcgtttgcgttttttagttttacgtcggttatatcgcgtttcgagttttttttttattgtcgttgtttattgcggagtaggcggagtcgagtattttgagtgggtttagcgaatattcgagataggatttggttattattattggtggtgtttcgcgtattcggcggtggtgtcgttcgtcgtggtacgggtttttcgtagttgttcgtttcgtcgtagttaggaggagcgtggcgtttggcgtgtgtcgcgttcgggacgtaggcgtaagattcgcgcgtagagcgcgacgtgtgttattagttttgcgttatcgcgtttagcggtcgtacgcgcgttgttattagtatttgtcgttagtcgtgtggtatggggtacgttcggtacggagtcgtgtgcgcgcgatcggttagtgggtagtgcgtatttgtgacgtgcgtttttgtacggcgtcgtagcgtcggttcgattgcggttattttattttttttttcggttttcgttttggttacgtatcgtcgtcgtgtttttagttttttttttgagtttttttttttt

SEQ ID NO: 38450 - DNA, 580 bp, Artificial Sequence
  chemically treated genomic DNA (Homo sapiens) CpG-island No: 38450
aaaaaaaaaaaactcaaaaaaaaaactaaaaacacgacgacgatacgtaaccaaaacgaaaaccgaaaaaaaaaataaaataaccgcaatcgaaccgacgctacgacgccgtacaaaaacgcacgtcacaaatacgcactacccactaaccgatcgcgcgcacacgactccgtaccgaacgtaccccataccacacgactaacgacaaatactaataacaacgcgcgtacgaccgctaaacgcgataacgcaaaactaataacacacgtcgcgctctacgcgcgaatcttacgcctacgtcccgaacgcgacacacgccaaacgccacgctcctcctaactacgacgaaacgaacaactacgaaaaacccgtaccacgacgaacgacaccaccgccgaatacgcgaaacaccaccaataataataaccaaatcctatctcgaatattcgctaaacccactcaaaatactcgactccgcctactccgcaataaacaacgacaataaaaaaaaaactcgaaacgcgatataaccgacgtaaaactaaaaaacgcaaacgacgaaaaaaaacccaaaaaacaa

SEQ ID NO: 38451 - DNA, 580 bp, Artificial Sequence
  chemically treated genomic DNA (Homo sapiens) CpG-island No: 38451
gaggagaagggatttagaagaagaattgaaggtacgacggcgatgcgtaattaaggcggaggtcgagaagaaggatgaggtggtcgtagtcgggtcggcgttgcggcgtcgtgtaggggcgtacgttatagatgcgtattgtttattggtcggtcgcgcgtatacgatttcgtgtcgagcgtattttatgttatacgattagcgataagtgttggtagtagcgcgcgtgcggtcgttaagcgcgatgacgtagaattagtaatatacgtcgcgttttgcgcgcgaattttgcgtttgcgtttcgggcgcgatatacgttaagcgttacgttttttttggttgcgacgaaacgaatagttacgagagattcgtattacggcgggcggtattatcgtcgggtacgcgggatattattaatgataataattaagttttgtttcgagtgttcgttgggtttatttaggatgttcgatttcgtttgtttcgtagtgaatagcggtagtggagggggagttcgggacgcggtgtgatcgacgtggggttgagaagcgtaggcgacggggggaagtttagagggtag

SEQ ID NO: 38452 - DNA, 580 bp, Artificial Sequence
  chemically treated genomic DNA (Homo sapiens) CpG-island No: 38452
ctaccctctaaacttccccccgtcgcctacgcttctcaaccccacgtcgatcacaccgcgtcccgaactccccctccactaccgctattcactacgaaacaaacgaaatcgaacatcctaaataaacccaacgaacactcgaaacaaaacttaattattatcattaataatatcccgcgtacccgacgataataccgcccgccgtaatacgaatctctcgtaactattcgtttcgtcgcaaccaaaaaaaacgtaacgcttaacgtatatcgcgcccgaaacgcaaacgcaaaattcgcgcgcaaaacgcgacgtatattactaattctacgtcatcgcgcttaacgaccgcacgcgcgctactaccaacacttatcgctaatcgtataacataaaatacgctcgacacgaaatcgtatacgcgcgaccgaccaataaacaatacgcatctataacgtacgcccctacacgacgccgcaacgccgacccgactacgaccacctcatccttcttctcgacctccgccttaattacgcatcgccgtcgtaccttcaattcttcttctaaatcccttctcctc

SEQ ID NO: 38453 - DNA, 585 bp, Artificial Sequence
  chemically treated genomic DNA (Homo sapiens) CpG-island No: 38453
tgtttatgcggtgagagttagcgcgggaggcggcgagggcgcggggagatcggggagggggtgggtttcgcggcgttcgtcgttcgtttttacgcgcgttgtcggtatttgttcgttttgttgtaatttgttgtagtgtttgaaagagtagtaggagcgtatggaggtggggtcggggaaagattaggcggagtggttgtggggtgagcgcggagtgggtggggaggcggcggcggtggggaggggggattggttttagggggtgggatgggggagaacggggtagttcggcgtttatatatgttatatgtgttttttaagacggtcgggagcgtttgcgagttggatttggtggaggatgttgcggtaggtgtttcgtagagggttttagtcgttttgttataggttgggtttgtgcgtgagtcggtattcggtttttttttttatcgtgttcgtagttttgataattattttcggttttagcgcgtttaatcgtttttagttcgagggcgatttggagcgtttggtcgtttttagttatagtttggttaagatcgagcgtagtttggttagtagttttttttt

SEQ ID NO: 38454 - DNA, 585 bp, Artificial Sequence
  chemically treated genomic DNA (Homo sapiens) CpG-island No: 38454
aaaaaaaaactactaaccaaactacgctcgatcttaaccaaactataactaaaaacgaccaaacgctccaaatcgccctcgaactaaaaacgattaaacgcgctaaaaccgaaaataattatcaaaactacgaacacgataaaaaaaaaaaccgaataccgactcacgcacaaacccaacctataacaaaacgactaaaaccctctacgaaacacctaccgcaacatcctccaccaaatccaactcgcaaacgctcccgaccgtcttaaaaaacacatataacatatataaacgccgaactaccccgttctcccccatcccaccccctaaaaccaatcccccctccccaccgccgccgcctccccacccactccgcgctcaccccacaaccactccgcctaatctttccccgaccccacctccatacgctcctactactctttcaaacactacaacaaattacaacaaaacgaacaaataccgacaacgcgcgtaaaaacgaacgacgaacgccgcgaaacccaccccctccccgatctccccgcgccctcgccgcctcccgcgctaactctcaccgcataaaca

SEQ ID NO: 38455 - DNA, 585 bp, Artificial Sequence
  chemically treated genomic DNA (Homo sapiens) CpG-island No: 38455
gggaaaaggttgttggttaggttgcgttcgattttggttaggttgtggttgggagcgattaggcgttttaggtcgttttcgggttggaagcggttgagcgcgttgaggtcgaaggtgattgttaggattgcgggtacggtgaggaaaaagatcgggtgtcggtttacgtataaatttagtttgtggtagaacgattggagttttttgcgaagtatttgtcgtagtattttttattagatttagttcgtaggcgttttcggtcgttttaaaaagtatatgtgatatgtgtaagcgtcgggttatttcgtttttttttattttattttttggggttagttttttttttttatcgtcgtcgtttttttatttatttcgcgtttattttataattatttcgtttggttttttttcggttttatttttatgcgtttttattatttttttaaatattgtagtaagttgtagtaaggcgggtaaatatcgatagcgcgcgtgggggcgggcggcgggcgtcgcggggtttatttttttttcggttttttcgcgttttcgtcgtttttcgcgttggtttttatcgtatgagta

SEQ ID NO: 38456 - DNA, 585 bp, Artificial Sequence
  chemically treated genomic DNA (Homo sapiens) CpG-island No: 38456
tactcatacgataaaaaccaacgcgaaaaacgacgaaaacgcgaaaaaaccgaaaaaaaaataaaccccgcgacgcccgccgcccgcccccacgcgcgctatcgatatttacccgccttactacaacttactacaatatttaaaaaaataataaaaacgcataaaaataaaaccgaaaaaaaaccaaacgaaataattataaaataaacgcgaaataaataaaaaaacgacgacgataaaaaaaaaaaactaaccccaaaaaataaaataaaaaaaaacgaaataacccgacgcttacacatatcacatatactttttaaaacgaccgaaaacgcctacgaactaaatctaataaaaaatactacgacaaatacttcgcaaaaaactccaatcgttctaccacaaactaaatttatacgtaaaccgacacccgatctttttcctcaccgtacccgcaatcctaacaatcaccttcgacctcaacgcgctcaaccgcttccaacccgaaaacgacctaaaacgcctaatcgctcccaaccacaacctaaccaaaatcgaacgcaacctaaccaacaaccttttccc

SEQ ID NO: 38457 - DNA, 610 bp, Artificial Sequence
  chemically treated genomic DNA (Homo sapiens) CpG-island No: 38457
ttatattacgtattagcggacgcggagagcgagcgacgcgttagttgacggtcgatagacggtaagagtatcgggggaggtaaatagaggtcggcgtagaaggtcgtcgatcgagaaaaacgggtacgaggtacggtagtacgttataggagggtacggacgggcggatacggggcggaggagagcgcggagaggaggtgcgagacgtagggcggtatagggtagaagaacgagggcgcgttacggcgcgaagacgtagataagtcggcgtcggcggcggtatacgagaggtacggagcgagagagggtatagaatacggggaggcgaacgttaggaaagacgcgttagcgatacggcgtagggacggacgggacgaaatcgatacgtagtttacgcgattcgaggattataggtcgatagcgaggttaagcgggtagtagagagaggtaggtcggcgtagaggattacgtagaagcgcgtagaatttaaatttagcgagagtagaacgacggtagtaaagcggaaggtagtataacgtagaaagaatgagtcgtagggaaagattattattatggttagtttaagtcgagtttataacggggttttgtt

SEQ ID NO: 38458 - DNA, 610 bp, Artificial Sequence
  chemically treated genomic DNA (Homo sapiens) CpG-island No: 38458
aacaaaaccccgttataaactcgacttaaactaaccataataataatctttccctacgactcattctttctacgttatactaccttccgctttactaccgtcgttctactctcgctaaatttaaattctacgcgcttctacgtaatcctctacgccgacctacctctctctactacccgcttaacctcgctatcgacctataatcctcgaatcgcgtaaactacgtatcgatttcgtcccgtccgtccctacgccgtatcgctaacgcgtctttcctaacgttcgcctccccgtattctataccctctctcgctccgtacctctcgtataccgccgccgacgccgacttatctacgtcttcgcgccgtaacgcgccctcgttcttctaccctataccgccctacgtctcgcacctcctctccgcgctctcctccgccccgtatccgcccgtccgtaccctcctataacgtactaccgtacctcgtacccgtttttctcgatcgacgaccttctacgccgacctctatttacctcccccgatactcttaccgtctatcgaccgtcaactaacgcgtcgctcgctctccgcgtccgctaatacgtaatataa

SEQ ID NO: 38459 - DNA, 610 bp, Artificial Sequence
  chemically treated genomic DNA (Homo sapiens) CpG-island No: 38459
ggtagggtttcgttgtggattcggtttgagttgattatggtagtggtttttttttgcggtttattttttttgcgttgtattgtttttcgttttgttgtcgtcgttttgttttcgttggatttgggttttgcgcgtttttgcgtagttttttgcgtcggtttgtttttttttgttgttcgtttggtttcgttgtcggtttgtagttttcgggtcgcgtgggttgcgtgtcggtttcgtttcgttcgtttttgcgtcgtgtcgttggcgcgttttttttggcgttcgttttttcgtgttttgtgttttttttcgtttcgtgtttttcgtgtgtcgtcgtcggcgtcggtttgtttgcgttttcgcgtcgtggcgcgttttcgtttttttgttttgtgtcgttttgcgtttcgtatttttttttcgcgttttttttcgtttcgtgttcgttcgttcgtgtttttttgtggcgtgttgtcgtgtttcgtgttcgtttttttcggtcggcggttttttgcgtcggtttttgtttgtttttttcggtgtttttgtcgtttgtcggtcgttagttggcgcgtcgttcgtttttcgcgttcgttgatgcgtggtgtgg

SEQ ID NO: 38460 - DNA, 610 bp, Artificial Sequence
  chemically treated genomic DNA (Homo sapiens) CpG-island No: 38460
ccacaccacgcatcaacgaacgcgaaaaacgaacgacgcgccaactaacgaccgacaaacgacaaaaacaccgaaaaaaacaaacaaaaaccgacgcaaaaaaccgccgaccgaaaaaaacgaacacgaaacacgacaacacgccacaaaaaaacacgaacgaacgaacacgaaacgaaaaaaaacgcgaaaaaaaaatacgaaacgcaaaacgacacaaaacaaaaaaacgaaaacgcgccacgacgcgaaaacgcaaacaaaccgacgccgacgacgacacacgaaaaacacgaaacgaaaaaaaacacaaaacacgaaaaaacgaacgccaaaaaaaacgcgccaacgacacgacgcaaaaacgaacgaaacgaaaccgacacgcaacccacgcgacccgaaaactacaaaccgacaacgaaaccaaacgaacaacaaaaaaaaacaaaccgacgcaaaaaactacgcaaaaacgcgcaaaacccaaatccaacgaaaacaaaacgacgacaacaaaacgaaaaacaatacaacgcaaaaaaaataaaccgcaaaaaaaaaccactaccataatcaactcaaaccgaatccacaacgaaaccctacc

SEQ ID NO: 38461 - DNA, 515 bp, Artificial Sequence
  chemically treated genomic DNA (Homo sapiens) CpG-island No: 38461
agagcgcgtcgagttttttcgtaaggtaggacgttaacgtgagttttgggagaataagaggaggtagagtatagtttttcgcgttaaaatttcgtcggaaagttgttggttattggtcgatgggattttttagtatttttttcgggttagattttttcgatttcgggttttcgatagtggaaattttggttttggtttgttcgaagtagttttttaaagttcgtttggtattatacgtcggcgttgcgtcggtatcgcgggtcgtcgggagtttcgaaagatttatttatatttattttttggtcgagttattcggttcggtagattttatttgtcggggttcgttcgttggaaattgtgtagcgttgagggtagtttcggggattcgttcgttttgtagtcgtatcgtattatatcgttttaggttgcgttttttgaagtagattgttcggaagttttagaggaaagattggggggcgttgttgttattttttcgttttcgtttttcgtttggg

SEQ ID NO: 38462 - DNA, 515 bp, Artificial Sequence
  chemically treated genomic DNA (Homo sapiens) CpG-island No: 38462
cccaaacgaaaaacgaaaacgaaaaaataacaacaacgccccccaatctttcctctaaaacttccgaacaatctacttcaaaaaacgcaacctaaaacgatataatacgatacgactacaaaacgaacgaatccccgaaactaccctcaacgctacacaatttccaacgaacgaaccccgacaaataaaatctaccgaaccgaataactcgaccaaaaaataaatataaataaatctttcgaaactcccgacgacccgcgataccgacgcaacgccgacgtataataccaaacgaactttaaaaaactacttcgaacaaaccaaaaccaaaatttccactatcgaaaacccgaaatcgaaaaaatctaacccgaaaaaaatactaaaaaatcccatcgaccaataaccaacaactttccgacgaaattttaacgcgaaaaactatactctacctcctcttattctcccaaaactcacgttaacgtcctaccttacgaaaaaactcgacgcgctct

SEQ ID NO: 38463 - DNA, 515 bp, Artificial Sequence
  chemically treated genomic DNA (Homo sapiens) CpG-island No: 38463
tttaggcgaggggcggggacgagaaagtagtagtagcgttttttagttttttttttgaagttttcgaatagtttgttttagggagcgtagtttgaggcggtgtggtgcggtgcggttgtagggcgggcgagttttcggagttgtttttagcgttgtatagtttttagcgagcggatttcggtagatgaggtttgtcgagtcgggtggttcgattaaggagtgggtgtgggtgggtttttcggggttttcggcgattcgcggtgtcgacgtaacgtcgacgtatggtgttaagcgaattttaaaaagttgtttcggataaattagagttaggatttttattgtcggggattcgggatcggaagggtttagttcgagggaaatgttggaagattttatcggttagtgattagtaatttttcggcgagattttgacgcggagaattgtgttttgtttttttttatttttttaaagtttacgttggcgttttgttttgcgggggaattcggcgcgtttt

SEQ ID NO: 38464 - DNA, 515 bp, Artificial Sequence
  chemically treated genomic DNA (Homo sapiens) CpG-island No: 38464
aaaacgcgccgaattcccccgcaaaacaaaacgccaacgtaaactttaaaaaaataaaaaaaaacaaaacacaattctccgcgtcaaaatctcgccgaaaaattactaatcactaaccgataaaatcttccaacatttccctcgaactaaacccttccgatcccgaatccccgacaataaaaatcctaactctaatttatccgaaacaactttttaaaattcgcttaacaccatacgtcgacgttacgtcgacaccgcgaatcgccgaaaaccccgaaaaacccacccacacccactccttaatcgaaccacccgactcgacaaacctcatctaccgaaatccgctcgctaaaaactatacaacgctaaaaacaactccgaaaactcgcccgccctacaaccgcaccgcaccacaccgcctcaaactacgctccctaaaacaaactattcgaaaacttcaaaaaaaaaactaaaaaacgctactactactttctcgtccccgcccctcgcctaaa

SEQ ID NO: 38465 - DNA, 783 bp, Artificial Sequence
  chemically treated genomic DNA (Homo sapiens) CpG-island No: 38465
  misc_feature (294)..(294): n is either a, c, g or t
ttttcgttttttttttcgtttttttttttttcgcgtgtgttttttttttttttttttttgcgttttttgttgcgtttttggtcgtgttttgtttttttggtttcgttgttttgcgcgttgtttgtcgttcgttttttagtttttttttttttttttttgtttgggtttcgttttttttcgttttcgtcgttttcgttttttttttttttttttttcgtcgtttcgtttttcgttttttttgtttttttttttttcgtcggcgttcgtttttcgttttttttttttttttttttngcgttgtttttttttttcgtttcgttttttttttgttcgcgtttttttcgcgttggtcgttttttttttttttttcgtcgcgtgtttcgtttttttcgcggcgtggtttatgcgtgtttttcgtgtcgttttttttcgtttcggttttttggttcgtttgtttttcgtttcgttcgcgtttttttttttttttttcgtttagttttttcgttttttgtgcgcgcgtcgcgtttttgtcgttgtgcgttttgcgttttatttttcgtttttgttcgcgcgttacgcgtttagcgttatatttttttttgtttacgtagtatttcggagaaggggattatttgcgtagttttcgtttgcgttacgttcggagtgttgcgttttattattgttgttgtgcgcgcgttttatgagtcgtgtgtcgtgcgtatttgtgtttggcgtttagtcggcgttgatcgtttgttcgtgtcgtcgatatagtatatcgga

SEQ ID NO: 38466 - DNA, 783 bp, Artificial Sequence
  chemically treated genomic DNA (Homo sapiens) CpG-island No: 38466
  misc_feature (490)..(490): n is either a, c, g or t
tccgatatactatatcgacgacacgaacaaacgatcaacgccgactaaacgccaaacacaaatacgcacgacacacgactcataaaacgcgcgcacaacaacaataataaaacgcaacactccgaacgtaacgcaaacgaaaactacgcaaataatccccttctccgaaatactacgtaaacaaaaaaaaatataacgctaaacgcgtaacgcgcgaacaaaaacgaaaaataaaacgcaaaacgcacaacgacaaaaacgcgacgcgcgcacaaaaaacgaaaaaactaaacgaaaaaaaaaaaaaaaaacgcgaacgaaacgaaaaacaaacgaaccaaaaaaccgaaacgaaaaaaaacgacacgaaaaacacgcataaaccacgccgcgaaaaaaacgaaacacgcgacgaaaaaaaaaaaaaaaacgaccaacgcgaaaaaaacgcgaacaaaaaaaaaacgaaacgaaaaaaaaaaacaacgcnaaaaaaaaaaaaaaaaaaaacgaaaaacgaacgccgacgaaaaaaaaaaaaacaaaaaaaacgaaaaacgaaacgacgaaaaaaaaaaaaaaaaaaaacgaaaacgacgaaaacgaaaaaaaacgaaacccaaacaaaaaaaaaaaaaaaaaaactaaaaaacgaacgacaaacaacgcgcaaaacaacgaaaccaaaaaaacaaaacacgaccaaaaacgcaacaaaaaacgcaaaaaaaaaaaaaaaaaaaacacacgcgaaaaaaaaaaaaacgaaaaaaaaaacgaaaa

SEQ ID NO: 38467 - DNA, 783 bp, Artificial Sequence
  chemically treated genomic DNA (Homo sapiens) CpG-island No: 38467
  misc_feature (490)..(490): n is either a, c, g or t
ttcgatgtattgtgtcggcgatacgagtaggcgattaacgtcgattagacgttagatataagtacgtacgatatacgatttataaggcgcgcgtataatagtagtgatagaacgtaatatttcgggcgtggcgtaagcggaggttgcgtaggtagttttttttttcgaaatattacgtgagtaggggaaggtgtggcgttggacgcgtggcgcgcggatagaggcgggaaatggaacgtaagacgtatagcgataagggcgcgacgcgcgtataaggggcggaaaggttaggcgagaaaagggggaggggacgcgagcggaacggaagataagcgggttagaagatcggggcgggagggaacgatacgggaggtacgtatgggttacgtcgcgagggaagcggggtacgcgacggggggaaaggagagagcggttaacgcggaggaggcgcgggtagaggagaagcgggacgggggaggggagtagcgtngggaggggagagggaaggagcggggagcggacgtcggcgggagagaaaggagtaaggggggcgggaggcggggcggcgggagaaagagaagagaaggacgaagacggcgaagacgggggggggcggagtttaagtaagagaggaagagggggggttggaagacgggcgataggtagcgcgtagggtagcgggattagaaagataaggtacgattaagagcgtaataaaaggcgtaaaaaaggaaggaaaaaaagtatacgcgaaaggggggggggcggaggggagggcggggg

SEQ ID NO: 38468 - DNA, 783 bp, Artificial Sequence
  chemically treated genomic DNA (Homo sapiens) CpG-island No: 38468
  misc_feature (294)..(294): n is either a, c, g or t
cccccgccctcccctccgcccccccccctttcgcgtatactttttttccttccttttttacgccttttattacgctcttaatcgtaccttatctttctaatcccgctaccctacgcgctacctatcgcccgtcttccaaccccccctcttcctctcttacttaaactccgcccccccccgtcttcgccgtcttcgtccttctcttctctttctcccgccgccccgcctcccgccccccttactcctttctctcccgccgacgtccgctccccgctccttccctctcccctcccnacgctactcccctcccccgtcccgcttctcctctacccgcgcctcctccgcgttaaccgctctctcctttccccccgtcgcgtaccccgcttccctcgcgacgtaacccatacgtacctcccgtatcgttccctcccgccccgatcttctaacccgcttatcttccgttccgctcgcgtcccctcccccttttctcgcctaacctttccgccccttatacgcgcgtcgcgcccttatcgctatacgtcttacgttccatttcccgcctctatccgcgcgccacgcgtccaacgccacaccttcccctactcacgtaatatttcgaaaaaaaaaactacctacgcaacctccgcttacgccacgcccgaaatattacgttctatcactactattatacgcgcgccttataaatcgtatatcgtacgtacttatatctaacgtctaatcgacgttaatcgcctactcgtatcgccgacacaatacatcgaa

SEQ ID NO: 38469 - DNA, 593 bp, Artificial Sequence
  chemically treated genomic DNA (Homo sapiens) CpG-island No: 38469
tgggcgtagacggagcgttaggatacgggttttaggtttttggttagcggtgtggcgagtcggtatagcgtttatacgattatcgttataagttatttgtcgagttaacgttgtttaggtcgagttattttttcgggggtagattgtatttcgggattttttggcgtttttttattaaagttcgtttcgtttttttttgtcgcgttgcgttcggagtcgtttaggcgtttatttttcgtagtcgtcggttttgaagtgtttttttttcgtcggtttcggtgtcgttttttttcgttcggtcggttaggaggatttattgggtagtcgtttttaattcgggtatgggtttcggttttcgagggttcgtttttttgggtttttcgttgtcgtacgaggcgcgacgggggttttgcgttttcgggtgatttcgttcgatttcgttcgatttttcgagacgtttcggggttgcgcgtttttttttcgacggggttttttcgtagaggtttcggtgatcgtttcgacgtttcgatcgtttcgggatcgttgttattttggaagaagtgggggtttttttatagtataagttcggtttt

SEQ ID NO: 38470 - DNA, 593 bp, Artificial Sequence
  chemically treated genomic DNA (Homo sapiens) CpG-island No: 38470
aaaaccgaacttatactataaaaaaacccccacttcttccaaaataacaacgatcccgaaacgatcgaaacgtcgaaacgatcaccgaaacctctacgaaaaaaccccgtcgaaaaaaaaacgcgcaaccccgaaacgtctcgaaaaatcgaacgaaatcgaacgaaatcacccgaaaacgcaaaacccccgtcgcgcctcgtacgacaacgaaaaacccaaaaaaacgaaccctcgaaaaccgaaacccatacccgaattaaaaacgactacccaataaatcctcctaaccgaccgaacgaaaaaaaacgacaccgaaaccgacgaaaaaaaaacacttcaaaaccgacgactacgaaaaataaacgcctaaacgactccgaacgcaacgcgacaaaaaaaaacgaaacgaactttaataaaaaaacgccaaaaaatcccgaaatacaatctacccccgaaaaaataactcgacctaaacaacgttaactcgacaaataacttataacgataatcgtataaacgctataccgactcgccacaccgctaaccaaaaacctaaaacccgtatcctaacgctccgtctacgccca

SEQ ID NO: 38471 - DNA, 593 bp, Artificial Sequence
  chemically treated genomic DNA (Homo sapiens) CpG-island No: 38471
gggatcgagtttgtgttgtggggaaatttttattttttttaaggtgatagcgatttcgggacggtcgaggcgtcggggcggttatcgagatttttgcgggaagatttcgtcggggagagggcgcgtagtttcgaagcgtttcgggaagtcgagcggaatcgggcgggattattcgggggcgtagagttttcgtcgcgtttcgtgcggtagcggagagtttaggagaacgagttttcgggggtcgaagtttatgttcgggttgggggcggttgtttagtgagtttttttggtcggtcgggcggagaagagcgatatcgaagtcggcgggaggggagtattttaaggtcggcggttgcggaggatgggcgtttgagcggtttcgagcgtagcgcggtagaggaaggcgaggcgagttttggtgaggaggcgttaagggatttcgaagtgtagtttgttttcgggaagatggttcggtttgggtagcgttggttcggtaagtggtttgtggcgatggtcgtgtgggcgttgtgtcggttcgttatatcgttggttaagaatttggagttcgtattttgacgtttcgtttacgttta

SEQ ID NO: 38472 - DNA, 593 bp, Artificial Sequence
  chemically treated genomic DNA (Homo sapiens) CpG-island No: 38472
taaacgtaaacgaaacgtcaaaatacgaactccaaattcttaaccaacgatataacgaaccgacacaacgcccacacgaccatcgccacaaaccacttaccgaaccaacgctacccaaaccgaaccatcttcccgaaaacaaactacacttcgaaatcccttaacgcctcctcaccaaaactcgcctcgccttcctctaccgcgctacgctcgaaaccgctcaaacgcccatcctccgcaaccgccgaccttaaaatactcccctcccgccgacttcgatatcgctcttctccgcccgaccgaccaaaaaaactcactaaacaaccgcccccaacccgaacataaacttcgacccccgaaaactcgttctcctaaactctccgctaccgcacgaaacgcgacgaaaactctacgcccccgaataatcccgcccgattccgctcgacttcccgaaacgcttcgaaactacgcgccctctccccgacgaaatcttcccgcaaaaatctcgataaccgccccgacgcctcgaccgtcccgaaatcgctatcaccttaaaaaaaataaaaatttccccacaacacaaactcgatccc

SEQ ID NO: 38473 - DNA, 517 bp, Artificial Sequence
  chemically treated genomic DNA (Homo sapiens) CpG-island No: 38473
tacgtagacgattcggtaattgggttgtaggttcgcggttgcggagtgcgtaggcgcgtcgagatggtcgcgtttttggtcgtttagagtcggagcggttcgcggagttgcggaggtagttatggtcggggcgttgtgcggttgttggtttcgtttgggcggggttcgttcgtttatttcgttgggttcggtgagtttttcgggggagggaggtcggtcggtggtttaggggagggtcgtttttatttcgttttttgtttcggcgtttcggggtagagtttcgcggaagaagtagacgttggggtcgcgaatgtgtatgtgcgcgcgtgtaatgtgtgtgcgcgcgtagggtttgtatatgtttttgggggtttgggtgtatgtgtacgtttgtgtgtttgtatggtgttcgttagtgggtttttgcgcgtttatatttttggggggggggtgtgttcgttgatgtttgtttgtttgtgttagcgttatgtttttcgagtgtatttttgtgtgcgtg

SEQ ID NO: 38474 - DNA, 517 bp, Artificial Sequence
  chemically treated genomic DNA (Homo sapiens) CpG-island No: 38474
cacgcacacaaaaatacactcgaaaaacataacgctaacacaaacaaacaaacatcaacgaacacaccccccccccaaaaatataaacgcgcaaaaacccactaacgaacaccatacaaacacacaaacgtacacatacacccaaacccccaaaaacatatacaaaccctacgcgcgcacacacattacacgcgcgcacatacacattcgcgaccccaacgtctacttcttccgcgaaactctaccccgaaacgccgaaacaaaaaacgaaataaaaacgaccctcccctaaaccaccgaccgacctccctcccccgaaaaactcaccgaacccaacgaaataaacgaacgaaccccgcccaaacgaaaccaacaaccgcacaacgccccgaccataactacctccgcaactccgcgaaccgctccgactctaaacgaccaaaaacgcgaccatctcgacgcgcctacgcactccgcaaccgcgaacctacaacccaattaccgaatcgtctacgta

SEQ ID NO: 38475 - DNA, 517 bp, Artificial Sequence
  chemically treated genomic DNA (Homo sapiens) CpG-island No: 38475
tacgtatatagaaatatattcggaagatataacgttgatataagtaggtagatattaacgaatatattttttttttaaaaatataagcgcgtagaaatttattgacggatattatgtagatatataagcgtatatatatatttagatttttaagaatatatgtagattttgcgcgcgtatatatattatacgcgcgtatatgtatattcgcggttttagcgtttgtttttttcgcgggattttgtttcggggcgtcggggtaaggggcggggtaaagacggtttttttttgggttatcggtcggtttttttttttcgggagatttatcgggtttaacgggatgagcgggcgggtttcgtttaggcggaattagtagtcgtatagcgtttcgattatggttgttttcgtagtttcgcgggtcgtttcggttttaggcggttaggagcgcggttatttcggcgcgtttgcgtatttcgtagtcgcgggtttgtaatttagttatcgagtcgtttgcgtg

SEQ ID NO: 38476 - DNA, 517 bp, Artificial Sequence
  chemically treated genomic DNA (Homo sapiens) CpG-island No: 38476
cacgcaaacgactcgataactaaattacaaacccgcgactacgaaatacgcaaacgcgccgaaataaccgcgctcctaaccgcctaaaaccgaaacgacccgcgaaactacgaaaacaaccataatcgaaacgctatacgactactaattccgcctaaacgaaacccgcccgctcatcccgttaaacccgataaatctcccgaaaaaaaaaaaccgaccgataacccaaaaaaaaaccgtctttaccccgccccttaccccgacgccccgaaacaaaatcccgcgaaaaaaacaaacgctaaaaccgcgaatatacatatacgcgcgtataatatatatacgcgcgcaaaatctacatatattcttaaaaatctaaatatatatatacgcttatatatctacataatatccgtcaataaatttctacgcgcttatatttttaaaaaaaaaatatattcgttaatatctacctacttatatcaacgttatatcttccgaatatatttctatatacgta

SEQ ID NO: 38477 - DNA, 541 bp, Artificial Sequence
  chemically treated genomic DNA (Homo sapiens) CpG-island No: 38477
cgtgacgcgttagggtttttagcgtttttcgtttaggaggaggtttttttcggttttgtatttgatttgtttcgtcgtttgacggtttaagcggtcggagcggtttgtgggtgtttatgcggtcgggttagttcgggtaggaggagtaggggcgcgaacgcggatcggagatataggcggttcgggacgcggcggcggggtcggggcgcggagtagagtcgggtaggggagcgatacggaacggttggttatttgcggttcgggatagggagttttagaattttagttagtttttagttttaataatataagatggtcgatacgtcgttacgtacgttacgtgatcgcgttttcgtttcgttacgttttattgttgcgttttcgttttttttcgtttttttttttattttttagttttttacgatatttttttttttcgttattattcgtttttttgtttagatacgtttttgttcgagattcggatgaaaggttggaagagggcggggtcgtggtagtgcgtaggttttcgttgattttt

SEQ ID NO: 38478 - DNA, 541 bp, Artificial Sequence
  chemically treated genomic DNA (Homo sapiens) CpG-island No: 38478
aaaaatcaacgaaaacctacgcactaccacgaccccgccctcttccaacctttcatccgaatctcgaacaaaaacgtatctaaacaaaaaaacgaataataacgaaaaaaaaaaatatcgtaaaaaactaaaaaataaaaaaaaaaacgaaaaaaaacgaaaacgcaacaataaaacgtaacgaaacgaaaacgcgatcacgtaacgtacgtaacgacgtatcgaccatcttatattattaaaactaaaaactaactaaaattctaaaactccctatcccgaaccgcaaataaccaaccgttccgtatcgctcccctacccgactctactccgcgccccgaccccgccgccgcgtcccgaaccgcctatatctccgatccgcgttcgcgcccctactcctcctacccgaactaacccgaccgcataaacacccacaaaccgctccgaccgcttaaaccgtcaaacgacgaaacaaatcaaatacaaaaccgaaaaaaacctcctcctaaacgaaaaacgctaaaaaccctaacgcgtcacg

SEQ ID NO: 38479 - DNA, 541 bp, Artificial Sequence
  chemically treated genomic DNA (Homo sapiens) CpG-island No: 38479
aggggttagcgggagtttgcgtattgttacggtttcgtttttttttaattttttattcgggtttcgggtaggggcgtgtttgggtagaggggcgggtggtggcggaaaggaaggatgtcgtgggagattggagagtggggggggaagcgggaaggggcgggggcgtagtagtggggcgtggcggagcgggagcgcggttacgtgacgtgcgtggcgacgtgtcggttattttgtgttgttgaggttgaggattgattggggttttgagattttttgtttcggatcgtaggtaattagtcgtttcgtgtcgtttttttgttcggttttgtttcgcgtttcggtttcgtcgtcgcgtttcgggtcgtttgtgttttcggttcgcgttcgcgtttttgttttttttgttcgagttggttcggtcgtatggatatttataggtcgtttcggtcgtttgggtcgttaggcgacgggataggttaggtgtagggtcggagggagtttttttttgggcgaggggcgttgagggttttggcgcgttacg

SEQ ID NO: 38480 - DNA, 541 bp, Artificial Sequence
  chemically treated genomic DNA (Homo sapiens) CpG-island No: 38480
cgtaacgcgccaaaaccctcaacgcccctcgcccaaaaaaaaactccctccgaccctacacctaacctatcccgtcgcctaacgacccaaacgaccgaaacgacctataaatatccatacgaccgaaccaactcgaacaaaaaaaacaaaaacgcgaacgcgaaccgaaaacacaaacgacccgaaacgcgacgacgaaaccgaaacgcgaaacaaaaccgaacaaaaaaacgacacgaaacgactaattacctacgatccgaaacaaaaaatctcaaaaccccaatcaatcctcaacctcaacaacacaaaataaccgacacgtcgccacgcacgtcacgtaaccgcgctcccgctccgccacgccccactactacgcccccgccccttcccgcttccccccccactctccaatctcccacgacatccttcctttccgccaccacccgcccctctacccaaacacgcccctacccgaaacccgaataaaaaattaaaaaaaaacgaaaccgtaacaatacgcaaactcccgctaacccct

SEQ ID NO: 38481 - DNA, 681 bp, Artificial Sequence
  chemically treated genomic DNA (Homo sapiens) CpG-island No: 38481
ggggtcgtgtcgcgtttttttttttagtaatattcgttcgcgtatagttttggaggcgcggtttcgcggtattttcggttacgttttatttcgttttgttttcgttcgtcgagcgttcggtaggggcggtggttgcggcgttgcgattcgttcgcgttttttttcggtcgatttgggcgtagcgggcggggttcgggtaattcgttttttttttatttttttgtttcgtttttttcgtttttttcgcgtttttttatttagcgcggggtcggcgcggttgcggttggtttttattttggggtcggatggggagacgtgattgttacggttcgggttgcgtcgggaataggcgcgggggtgggaggggaggtcgggtttcggggtatttggcggtcgaggcgtttggagggggtagcggtcgggtttcgtttttagtatcgcgtttttaggcgcgggggaagggaaatgggcgtttttttggcgttcgaattttgtttgggtttcggcgagtgcgcgttaagttcgtttttttcgttttttgtttcgtcgcgttcgggtcgtttcgtagtagggagagttcggtttgggacggcgggcgggtttttttttggtgcgtagtaggttgttagggttttttttcgagattaggtgaagaatttgtgggttggagttagatttatt

SEQ ID NO: 38482 - DNA, 681 bp, Artificial Sequence
  chemically treated genomic DNA (Homo sapiens) CpG-island No: 38482
aataaatctaactccaacccacaaattcttcacctaatctcgaaaaaaaaccctaacaacctactacgcaccaaaaaaaaacccgcccgccgtcccaaaccgaactctccctactacgaaacgacccgaacgcgacgaaacaaaaaacgaaaaaaacgaacttaacgcgcactcgccgaaacccaaacaaaattcgaacgccaaaaaaacgcccatttcccttcccccgcgcctaaaaacgcgatactaaaaacgaaacccgaccgctaccccctccaaacgcctcgaccgccaaataccccgaaacccgacctcccctcccacccccgcgcctattcccgacgcaacccgaaccgtaacaatcacgtctccccatccgaccccaaaataaaaaccaaccgcaaccgcgccgaccccgcgctaaataaaaaaacgcgaaaaaaacgaaaaaaacgaaacaaaaaaataaaaaaaaaacgaattacccgaaccccgcccgctacgcccaaatcgaccgaaaaaaaacgcgaacgaatcgcaacgccgcaaccaccgcccctaccgaacgctcgacgaacgaaaacaaaacgaaataaaacgtaaccgaaaataccgcgaaaccgcgcctccaaaactatacgcgaacgaatattactaaaaaaaaaaacgcgacacgacccc

SEQ ID NO: 38483 - DNA, 681 bp, Artificial Sequence
  chemically treated genomic DNA (Homo sapiens) CpG-island No: 38483
aatggatttgattttaatttataaattttttatttggtttcgaaaagaggttttggtaatttattgcgtattagaggggaattcgttcgtcgttttaggtcgggttttttttgttgcggagcggttcgggcgcggcgggatagggaacggaaggaacgggtttggcgcgtattcgtcgaggtttaggtaggattcgagcgttagggaggcgtttattttttttttttcgcgtttgggaacgcggtgttgggggcggggttcgatcgttgttttttttaaacgtttcgatcgttaggtgtttcgaagttcggtttttttttttattttcgcgtttgttttcggcgtagttcgagtcgtggtagttacgtttttttattcggttttaaagtaagagttagtcgtagtcgcgtcgatttcgcgttgggtgggagggcgcggggagggcggggagggcggggtaaggaggtgaggggagggcgggttgttcgggtttcgttcgttgcgtttaggtcggtcggggagaggcgcgggcgagtcgtagcgtcgtaattatcgtttttgtcgggcgttcggcgagcgggggtagggcggggtgaggcgtggtcggggatgtcgcgaggtcgcgtttttagggttgtgcgcgggcgggtgttgttggggagaaaagcgcggtacggtttt

SEQ ID NO: 38484 - DNA, 681 bp, Artificial Sequence
  chemically treated genomic DNA (Homo sapiens) CpG-island No: 38484
aaaaccgtaccgcgcttttctccccaacaacacccgcccgcgcacaaccctaaaaacgcgacctcgcgacatccccgaccacgcctcaccccgccctacccccgctcgccgaacgcccgacaaaaacgataattacgacgctacgactcgcccgcgcctctccccgaccgacctaaacgcaacgaacgaaacccgaacaacccgccctcccctcacctccttaccccgccctccccgccctccccgcgccctcccacccaacgcgaaatcgacgcgactacgactaactcttactttaaaaccgaataaaaaaacgtaactaccacgactcgaactacgccgaaaacaaacgcgaaaataaaaaaaaaaaccgaacttcgaaacacctaacgatcgaaacgtttaaaaaaaacaacgatcgaaccccgcccccaacaccgcgttcccaaacgcgaaaaaaaaaaaataaacgcctccctaacgctcgaatcctacctaaacctcgacgaatacgcgccaaacccgttccttccgttccctatcccgccgcgcccgaaccgctccgcaacaaaaaaaacccgacctaaaacgacgaacgaattcccctctaatacgcaataaattaccaaaacctcttttcgaaaccaaataaaaaatttataaattaaaatcaaatccatt

SEQ ID NO: 38485 - DNA, 618 bp, Artificial Sequence
  chemically treated genomic DNA (Homo sapiens) CpG-island No: 38485
aacgtagcgcgagcgatacggggcgggggcgtttcgggcgcgttggttgggggttcgcggggcgtcgtttcgtagtggaagggggtagatttcggaagcggtcgtcggttgttgggggtgggagatttgtttttttttttagtcgttcgtcgttagttcgcgttgtaggtgatttggttagtgtcgatcgtttcgttttcgtttagtcgttttcgtggggtttttcggttttgcgcgttttaaacgatttcggttgtcgtttgttcggtagtttttcgcggttttttacgttttttcgtttttcgggtcgcgcggtaggtttttttgatgagttagcgggagttcgggagtttttaatcgtttcgggtatttgtttcggtgacgtattttgagttacgggcgttcgggtcgtcgtcgaggtcgagcgcgtagtcgggagcgtcgagcgtagtttttacgtttgtcgcgggcgtttatttagttcggttcggtttcgtattttttttttttcgtttttagcgtcgttcgttttgtattttttggtttagttttaggttgatattagacgttggtcgttcggttattttttgagttaatagttttcgaagtagagttcgt

SEQ ID NO: 38486 - DNA, 618 bp, Artificial Sequence
  chemically treated genomic DNA (Homo sapiens) CpG-island No: 38486
acgaactctacttcgaaaactattaactcaaaaaataaccgaacgaccaacgtctaatatcaacctaaaactaaaccaaaaaatacaaaacgaacgacgctaaaaacgaaaaaaaaaaaatacgaaaccgaaccgaactaaataaacgcccgcgacaaacgtaaaaactacgctcgacgctcccgactacgcgctcgacctcgacgacgacccgaacgcccgtaactcaaaatacgtcaccgaaacaaatacccgaaacgattaaaaactcccgaactcccgctaactcatcaaaaaaacctaccgcgcgacccgaaaaacgaaaaaacgtaaaaaaccgcgaaaaactaccgaacaaacgacaaccgaaatcgtttaaaacgcgcaaaaccgaaaaaccccacgaaaacgactaaacgaaaacgaaacgatcgacactaaccaaatcacctacaacgcgaactaacgacgaacgactaaaaaaaaaaacaaatctcccacccccaacaaccgacgaccgcttccgaaatctacccccttccactacgaaacgacgccccgcgaacccccaaccaacgcgcccgaaacgcccccgccccgtatcgctcgcgctacgtt

SEQ ID NO: 38487 - DNA, 618 bp, Artificial Sequence
  chemically treated genomic DNA (Homo sapiens) CpG-island No: 38487
gcgggttttgtttcggaaattgttgatttagagggtggtcgggcggttagcgtttgatgttagtttggagttgggttagggagtgtagggcgggcggcgttgggagcgagggaggaagggtgcggggtcgggtcgggttgggtgggcgttcgcggtaggcgtaggggttgcgttcggcgttttcggttgcgcgttcggtttcggcggcggttcgggcgttcgtgatttagggtgcgttatcggagtagatgttcggggcggttggaggttttcgggttttcgttgatttattagaaaggtttgtcgcgcggttcggggggcgggggaacgtgggggatcgcggggagttgtcgggtaggcggtagtcgaggtcgtttgaggcgcgtagagtcggaaaattttacggagacggttgggcgggggcggggcgatcggtattgattaggttatttgtagcgcgggttgacggcgggcgattgaaggagggagtaagttttttatttttagtagtcggcggtcgttttcgaagtttgtttttttttattgcggagcggcgtttcgcgggtttttagttagcgcgttcgaggcgttttcgtttcgtgtcgttcgcgttgcgtt

SEQ ID NO: 38488 - DNA, 618 bp, Artificial Sequence
  chemically treated genomic DNA (Homo sapiens) CpG-island No: 38488
aacgcaacgcgaacgacacgaaacgaaaacgcctcgaacgcgctaactaaaaacccgcgaaacgccgctccgcaataaaaaaaaacaaacttcgaaaacgaccgccgactactaaaaataaaaaacttactccctccttcaatcgcccgccgtcaacccgcgctacaaataacctaatcaataccgatcgccccgcccccgcccaaccgtctccgtaaaattttccgactctacgcgcctcaaacgacctcgactaccgcctacccgacaactccccgcgatcccccacgttcccccgccccccgaaccgcgcgacaaacctttctaataaatcaacgaaaacccgaaaacctccaaccgccccgaacatctactccgataacgcaccctaaatcacgaacgcccgaaccgccgccgaaaccgaacgcgcaaccgaaaacgccgaacgcaacccctacgcctaccgcgaacgcccacccaacccgacccgaccccgcacccttcctccctcgctcccaacgccgcccgccctacactccctaacccaactccaaactaacatcaaacgctaaccgcccgaccaccctctaaatcaacaatttccgaaacaaaacccgc

SEQ ID NO: 38489 - DNA, 896 bp, Artificial Sequence
  chemically treated genomic DNA (Homo sapiens) CpG-island No: 38489
agtggcggcggcggtcgaaggagaaatagaatagcgtaggtaaaagaagaaaggcgcgggttgggtgggaagaggattcggattcgttatattgtagagtagtagagcgagaaaggatgagaaaaggtagagaaggcgacggtagaagaaaaaaggaaaaattgcggtcgcgattagagtttgaaagtgtgagaaggcggcgttagcgacgttagtatttatattagggggcgtggtttggtgatattatagttggtcgggtagtcgcgcgagcggggcggaattcggttgtagttcggagaaaagggagggggacggaagaggaaggaggattgagttcgggagagagaggggaggggtcggcgcgcgatcgggttatgtaggtgtagattggtcggtcgtttttcgttttttagttattcgtagtttttcggtaggcgaagggcggtcgcgcgggtgtgggtcgagagagggaggcggttcggttggagcgcgtcgttcgttcgattttcgtcgtttttcgggcgtttgcgtttacgttgcggggtttagcgtattgtgagtcgggtcgagttttatgttggtagcgtttgagagttgttttgggtcggaggtggcgcgaattttgtgcggtttagagtgggtttggggtaagtttgtcggcgtcgttgtcgagttttcgcgtttagtttttttcgttttgtgaggtttgtagtttattttggggagtgttttttcgggttgaggcgttcgttttcggtgatgcggtatttttttagggaagcgagtttttcgtggttagaaaggatcggtttagtgttcgggtgttaaaaagggttgtgattacgtgaaaatgtttttagtgttcgaacgttgtaatacggtgtagtggaaat

SEQ ID NO: 38490 - DNA, 896 bp, Artificial Sequence
  chemically treated genomic DNA (Homo sapiens) CpG-island No: 38490
atttccactacaccgtattacaacgttcgaacactaaaaacattttcacgtaatcacaaccctttttaacacccgaacactaaaccgatcctttctaaccacgaaaaactcgcttccctaaaaaaataccgcatcaccgaaaacgaacgcctcaacccgaaaaaacactccccaaaataaactacaaacctcacaaaacgaaaaaaactaaacgcgaaaactcgacaacgacgccgacaaacttaccccaaacccactctaaaccgcacaaaattcgcgccacctccgacccaaaacaactctcaaacgctaccaacataaaactcgacccgactcacaatacgctaaaccccgcaacgtaaacgcaaacgcccgaaaaacgacgaaaatcgaacgaacgacgcgctccaaccgaaccgcctccctctctcgacccacacccgcgcgaccgcccttcgcctaccgaaaaactacgaataactaaaaaacgaaaaacgaccgaccaatctacacctacataacccgatcgcgcgccgacccctcccctctctctcccgaactcaatcctccttcctcttccgtccccctcccttttctccgaactacaaccgaattccgccccgctcgcgcgactacccgaccaactataatatcaccaaaccacgccccctaatataaatactaacgtcgctaacgccgccttctcacactttcaaactctaatcgcgaccgcaatttttccttttttcttctaccgtcgccttctctaccttttctcatcctttctcgctctactactctacaatataacgaatccgaatcctcttcccacccaacccgcgcctttcttcttttacctacgctattctatttctccttcgaccgccgccgccact

SEQ ID NO: 38491 - DNA, 896 bp, Artificial Sequence
  chemically treated genomic DNA (Homo sapiens) CpG-island No: 38491
atttttattgtatcgtattgtaacgttcgagtattgaggatatttttacgtggttataattttttttaatattcggatattgggtcggttttttttggttacgaggaattcgtttttttaaaggagtatcgtattatcgagggcgggcgttttagttcgggaggatattttttagggtaaattataggttttataaagcggagggagttggacgcgaaggttcggtagcggcgtcgataggtttattttaggtttattttaggtcgtatagggttcgcgttattttcggtttaggatagtttttagacgttgttagtatggagttcgattcggtttataatgcgttgggtttcgtagcgtgagcgtaggcgttcgagaggcggcgggggtcgggcggacggcgcgttttagtcgagtcgtttttttttttcggtttatattcgcgcggtcgtttttcgtttgtcggggagttgcgggtggttggagggcgggaagcgatcggttagtttgtatttgtatgattcggtcgcgcgtcgattttttttttttttttttcgggtttagtttttttttttttttcgtttttttttttttttttcgggttgtaatcgggtttcgtttcgttcgcgcggttgttcggttagttgtgatgttattaggttacgttttttaatataaatattggcgtcgttggcgtcgtttttttatatttttaggttttgatcgcggtcgtagttttttttttttttttttgtcgtcgttttttttgtttttttttattttttttcgttttgttgttttgtagtgtgacgagttcgaattttttttttatttagttcgcgtttttttttttttgtttgcgttgttttatttttttttcggtcgtcgtcgttatt

SEQ ID NO: 38492 - DNA, 896 bp, Artificial Sequence
  chemically treated genomic DNA (Homo sapiens) CpG-island No: 38492
aataacgacgacgaccgaaaaaaaaataaaacaacgcaaacaaaaaaaaaaaaacgcgaactaaataaaaaaaaaattcgaactcgtcacactacaaaacaacaaaacgaaaaaaaataaaaaaaaacaaaaaaaacgacgacaaaaaaaaaaaaaaaaaactacgaccgcgatcaaaacctaaaaatataaaaaaacgacgccaacgacgccaatatttatattaaaaaacgtaacctaataacatcacaactaaccgaacaaccgcgcgaacgaaacgaaacccgattacaacccgaaaaaaaaaaaaaaaaacgaaaaaaaaaaaaaaactaaacccgaaaaaaaaaaaaaaaaaatcgacgcgcgaccgaatcatacaaatacaaactaaccgatcgcttcccgccctccaaccacccgcaactccccgacaaacgaaaaacgaccgcgcgaatataaaccgaaaaaaaaaaacgactcgactaaaacgcgccgtccgcccgacccccgccgcctctcgaacgcctacgctcacgctacgaaacccaacgcattataaaccgaatcgaactccatactaacaacgtctaaaaactatcctaaaccgaaaataacgcgaaccctatacgacctaaaataaacctaaaataaacctatcgacgccgctaccgaaccttcgcgtccaactccctccgctttataaaacctataatttaccctaaaaaatatcctcccgaactaaaacgcccgccctcgataatacgatactcctttaaaaaaacgaattcctcgtaaccaaaaaaaaccgacccaatatccgaatattaaaaaaaattataaccacgtaaaaatatcctcaatactcgaacgttacaatacgatacaataaaaat

SEQ ID NO: 38493 - DNA, 526 bp, Artificial Sequence
  chemically treated genomic DNA (Homo sapiens) CpG-island No: 38493
  misc_feature (47)..(47): n is either a, c, g or t
  misc_feature (251)..(251): n is either a, c, g or t
  misc_feature (363)..(363): n is either a, c, g or t
  misc_feature (444)..(444): n is either a, c, g or t
tttttttttttttttttttttttttttttttttttttttttcgtcgntggtttttttttttcgtttttttttttcgtcgttcgcgttcgtcgtggttttttttttttttttgtcgttttttcgtttttttcgttttcgtttcgtcgtttttttttttcgtcgttttttttcgtttttttgttcggtgcgttcgtgtttttcgttgttcgttttttttttgttttttcgtcgttttttcgcgtcgttttttncgtcgttttttttttttttttgttttcgtttttgtgttttgtttcgtttttttcgttttttcgtttttttttttttcgttttcgcgtgttcgtcgcgttcgtcgtcgttttnttttttttttcgtttttttttcgtttttttttttttttttttcgttttttttttcgtttttcgttttgttttttttttcgntttttttttttcgttttttttttttttgttttttttttcgtattttttttttttcgattttttttttttattgagtttcgtt

SEQ ID NO: 38494 - DNA, 526 bp, Artificial Sequence
  chemically treated genomic DNA (Homo sapiens) CpG-island No: 38494
  misc_feature (83)..(83): n is either a, c, g or t
  misc_feature (164)..(164): n is either a, c, g or t
  misc_feature (276)..(276): n is either a, c, g or t
  misc_feature (480)..(480): n is either a, c, g or t
aacgaaactcaataaaaaaaaaaaatcgaaaaaaaaaaaatacgaaaaaaaaaacaaaaaaaaaaaaaacgaaaaaaaaaaancgaaaaaaaaaacaaaacgaaaaacgaaaaaaaaaacgaaaaaaaaaaaaaaaaaaacgaaaaaaaaacgaaaaaaaaaanaaaacgacgacgaacgcgacgaacacgcgaaaacgaaaaaaaaaaaaacgaaaaaacgaaaaaaacgaaacaaaacacaaaaacgaaaacaaaaaaaaaaaaaaaacgacgnaaaaaacgacgcgaaaaaacgacgaaaaaacaaaaaaaaaacgaacaacgaaaaacacgaacgcaccgaacaaaaaaacgaaaaaaaacgacgaaaaaaaaaaacgacgaaacgaaaacgaaaaaaacgaaaaaacgacaaaaaaaaaaaaaaaaccacgacgaacgcgaacgacgaaaaaaaaaaacgaaaaaaaaaaaccancgacgaaaaaaaaaaaaaaaaaaaaaaaaaaaaaaaaaaaaaaaaa

SEQ ID NO: 38495 - DNA, 526 bp, Artificial Sequence
  chemically treated genomic DNA (Homo sapiens) CpG-island No: 38495
  misc_feature (83)..(83): n is either a, c, g or t
  misc_feature (164)..(164): n is either a, c, g or t
  misc_feature (276)..(276): n is either a, c, g or t
  misc_feature (480)..(480): n is either a, c, g or t
ggcgaaatttagtggaaaagaggaatcggaaaagaggggatacgaaaaaagggataagggggaggggagcggaaagaggggancggaaggggaaataggacggggagcgaagaaaggggcggaagggaagaggaaaagaacggaggggggacgaggaagaagangagacggcggcggacgcggcgaatacgcgaggacgaagggaaggaaaacgggggggcgggaagggcgggatagaatataaggacggggataaagaagagaaaggagcggcgngagagacggcgcggaggaacgacggagggataggaggaaagcgggtagcgaggaatacgggcgtatcgggtaaaaaggcgagagagaacgacgggagaagaagacgacgggacggggacgggaaagacgggagggcggtaaaggaaaaggaaggattacggcgagcgcgggcgacgagaagaaagggcgaggaaaggaaattancgacggggaagggaaaggagaggggaagaggagaaagggaaagggg

SEQ ID NO: 38496 - DNA, 526 bp, Artificial Sequence
  chemically treated genomic DNA (Homo sapiens) CpG-island No: 38496
  misc_feature (47)..(47): n is either a, c, g or t
  misc_feature (251)..(251): n is either a, c, g or t
  misc_feature (363)..(363): n is either a, c, g or t
  misc_feature (444)..(444): n is either a, c, g or t
cccctttccctttctcctcttcccctctcctttcccttccccgtcgntaatttcctttcctcgccctttcttctcgtcgcccgcgctcgccgtaatccttccttttcctttaccgccctcccgtctttcccgtccccgtcccgtcgtcttcttctcccgtcgttctctctcgcctttttacccgatacgcccgtattcctcgctacccgctttcctcctatccctccgtcgttcctccgcgccgtctctcncgccgctcctttctcttctttatccccgtccttatattctatcccgcccttcccgcccccccgttttccttcccttcgtcctcgcgtattcgccgcgtccgccgccgtctcntcttcttcctcgtcccccctccgttcttttcctcttcccttccgcccctttcttcgctccccgtcctatttccccttccgntcccctctttccgctcccctcccccttatcccttttttcgtatcccctcttttccgattcctcttttccactaaatttcgcc

SEQ ID NO: 38497 - DNA, 524 bp, Artificial Sequence
  chemically treated genomic DNA (Homo sapiens) CpG-island No: 38497
ggtggtcgcgtagtagtgagataattgcgaagtggttgatggaggaagcgggtaatttagtgtgggaggtcgggaaggagaggcggcgagtgtgtcgaggcgatagtgtgacgcggcgtgggcgattggttaagggagtaagatagagtggagcgagaatagtggagtttgcgattgttgggggtacgcggagtgcgggttggtggtggcgtttcggttttagacgtcgtggtggtagatagtggagcggtgtggtcggtgaggtgtagaggttgttggcgttagcggtagcgtatacgtgttgagttggggtttatgggtcgttagttgttggttgagggtgtggagggcgatatggttgggtgtaagtattggtgagtaagcggtgtcgattattgcgggttggagttgatttaaggtggcgtagcgtcgatgttacggggaatgtaggtgtgagttattatagttggtcgtttgaatttatttgcgggttatgtgttacggtgtgtagaggagtgcgtggt

SEQ ID NO: 38498 - DNA, 524 bp, Artificial Sequence
  chemically treated genomic DNA (Homo sapiens) CpG-island No: 38498
accacgcactcctctacacaccgtaacacataacccgcaaataaattcaaacgaccaactataataactcacacctacattccccgtaacatcgacgctacgccaccttaaatcaactccaacccgcaataatcgacaccgcttactcaccaatacttacacccaaccatatcgccctccacaccctcaaccaacaactaacgacccataaaccccaactcaacacgtatacgctaccgctaacgccaacaacctctacacctcaccgaccacaccgctccactatctaccaccacgacgtctaaaaccgaaacgccaccaccaacccgcactccgcgtacccccaacaatcgcaaactccactattctcgctccactctatcttactcccttaaccaatcgcccacgccgcgtcacactatcgcctcgacacactcgccgcctctccttcccgacctcccacactaaattacccgcttcctccatcaaccacttcgcaattatctcactactacgcgaccacc

SEQ ID NO: 38499 - DNA, 524 bp, Artificial Sequence
  chemically treated genomic DNA (Homo sapiens) CpG-island No: 38499
attacgtatttttttatatatcgtaatatatggttcgtaagtaagtttaaacgattagttatggtggtttatatttatatttttcgtagtatcgacgttgcgttattttgaattagttttagttcgtaataatcgatatcgtttgtttattaatgtttatatttaattatatcgttttttatatttttaattaatagttggcggtttataaattttagtttaatacgtgtacgttatcgttaacgttaataatttttgtattttatcggttatatcgttttattatttattattacgacgtttggaatcggagcgttattattaattcgtatttcgcgtgtttttagtaatcgtaaattttattattttcgttttattttattttatttttttggttaatcgtttacgtcgcgttatattatcgtttcgatatattcgtcgtttttttttttcgattttttatattgaattattcgttttttttattagttatttcgtagttattttattattgcgcgattatt

SEQ ID NO: 38500 - DNA, 524 bp, Artificial Sequence
  chemically treated genomic DNA (Homo sapiens) CpG-island No: 38500
aataatcgcgcaataataaaataactacgaaataactaataaaaaaaacgaataattcaatataaaaaatcgaaaaaaaaaaacgacgaatatatcgaaacgataatataacgcgacgtaaacgattaaccaaaaaaataaaataaaataaaacgaaaataataaaatttacgattactaaaaacacgcgaaatacgaattaataataacgctccgattccaaacgtcgtaataataaataataaaacgatataaccgataaaatacaaaaattattaacgttaacgataacgtacacgtattaaactaaaatttataaaccgccaactattaattaaaaatataaaaaacgatataattaaatataaacattaataaacaaacgatatcgattattacgaactaaaactaattcaaaataacgcaacgtcgatactacgaaaaatataaatataaaccaccataactaatcgtttaaacttacttacgaaccatatattacgatatataaaaaaatacgtaat

SEQ ID NO: 38501 - DNA, 572 bp, Artificial Sequence
  chemically treated genomic DNA (Homo sapiens) CpG-island No: 38501
  misc_feature (87)..(87): n is either a, c, g or t
  misc_feature (182)..(186): n is either a, c, g or t
  misc_feature (414)..(414): n is either a, c, g or t
  misc_feature (424)..(425): n is either a, c, g or t
  misc_feature (427)..(427): n is either a, c, g or t
  misc_feature (465)..(468): n is either a, c, g or t
attcgcggagaacgtttggatttggacgcgcgtttgttttttgtgttttcgttattatagcggcgcgggttttttcgacgtttcgtnagagttcggttagttttcggaagcggggtttttagttcgttaggaagtcgaagttttgtttcgagttcgacgtggtcgattgtagggagtttagnnnnntcgttatagagtcgtttttttcgaatatatacgtttggagggagtcgaagggcggtgtttataggtttatgtcggtttcgtagagtttggttagtacgtagttgtggatagtgttgtttattgcgtacgtttgaggtacgtagcgggagaggttttcgatttcgggtagtatgttttgtcgcgttttgggggcggttttcgtttgcgtttttcgggggttttatatgntcgcgatgtnnanggtttcggtgtttttttcgtcgtcgttttcgtcgtcgnnnnggacgatgttttcgtggatgtttttttcgtcgtcgatgatgtatggttgttttcggtgtcgttttatggataaaatgagtaatattagtattgttaggaataaa

SEQ ID NO: 38502 - DNA, 572 bp, Artificial Sequence
  chemically treated genomic DNA (Homo sapiens) CpG-island No: 38502
  misc_feature (105)..(108): n is either a, c, g or t
  misc_feature (146)..(146): n is either a, c, g or t
  misc_feature (148)..(149): n is either a, c, g or t
  misc_feature (159)..(159): n is either a, c, g or t
  misc_feature (387)..(391): n is either a, c, g or t
  misc_feature (486)..(486): n is either a, c, g or t
tttattcctaacaatactaatattactcattttatccataaaacgacaccgaaaacaaccatacatcatcgacgacgaaaaaaacatccacgaaaacatcgtccnnnncgacgacgaaaacgacgacgaaaaaaacaccgaaaccntnnacatcgcgancatataaaacccccgaaaaacgcaaacgaaaaccgcccccaaaacgcgacaaaacatactacccgaaatcgaaaacctctcccgctacgtacctcaaacgtacgcaataaacaacactatccacaactacgtactaaccaaactctacgaaaccgacataaacctataaacaccgcccttcgactccctccaaacgtatatattcgaaaaaaacgactctataacgannnnnctaaactccctacaatcgaccacgtcgaactcgaaacaaaacttcgacttcctaacgaactaaaaaccccgcttccgaaaactaaccgaactctnacgaaacgtcgaaaaaacccgcgccgctataataacgaaaacacaaaaaacaaacgcgcgtccaaatccaaacgttctccgcgaat

SEQ ID NO: 38503 - DNA, 572 bp, Artificial Sequence
  chemically treated genomic DNA (Homo sapiens) CpG-island No: 38503
  misc_feature (105)..(108): n is either a, c, g or t
  misc_feature (146)..(146): n is either a, c, g or t
  misc_feature (148)..(149): n is either a, c, g or t
  misc_feature (159)..(159): n is either a, c, g or t
  misc_feature (387)..(391): n is either a, c, g or t
  misc_feature (486)..(486): n is either a, c, g or t
tttgtttttggtagtgttggtgttgtttattttgtttatgaggcggtatcggaaataattatatattatcgacgacgaggaaaatatttacgagaatatcgtttnnnncgacgacgagggcggcggcgaggaggatatcgaggttntnnatatcgcggntatgtggaattttcgggaggcgtaggcgggggtcgtttttaagacgcggtaggatatgttgttcgagatcgagagtttttttcgttacgtgttttagacgtgcgtagtgaatagtattgtttatagttacgtgttggttaagttttacgaggtcgatatggatttgtgggtatcgtttttcgattttttttagacgtatatgttcgagggggacggttttgtggcggnnnnnttgagttttttgtagtcggttacgtcggattcggaatagagtttcgattttttgacggattgggggtttcgttttcggaagttggtcgagttttnacggggcgtcggagggattcgcgtcgttgtggtgacggaagtataggaggtaggcgcgcgtttaaatttagacgtttttcgcgggt

SEQ ID NO: 38504 - DNA, 572 bp, Artificial Sequence
  chemically treated genomic DNA (Homo sapiens) CpG-island No: 38504
  misc_feature (87)..(87): n is either a, c, g or t
  misc_feature (182)..(186): n is either a, c, g or t
  misc_feature (414)..(414): n is either a, c, g or t
  misc_feature (424)..(425): n is either a, c, g or t
  misc_feature (427)..(427): n is either a, c, g or t
  misc_feature (465)..(468): n is either a, c, g or t
acccgcgaaaaacgtctaaatttaaacgcgcgcctacctcctatacttccgtcaccacaacgacgcgaatccctccgacgccccgtnaaaactcgaccaacttccgaaaacgaaacccccaatccgtcaaaaaatcgaaactctattccgaatccgacgtaaccgactacaaaaaactcaannnnnccgccacaaaaccgtccccctcgaacatatacgtctaaaaaaaatcgaaaaacgatacccacaaatccatatcgacctcgtaaaacttaaccaacacgtaactataaacaatactattcactacgcacgtctaaaacacgtaacgaaaaaaactctcgatctcgaacaacatatcctaccgcgtcttaaaaacgacccccgcctacgcctcccgaaaattccacatanccgcgatatnnanaacctcgatatcctcctcgccgccgccctcgtcgtcgnnnnaaacgatattctcgtaaatattttcctcgtcgtcgataatatataattatttccgataccgcctcataaacaaaataaacaacaccaacactaccaaaaacaaa

SEQ ID NO: 38505 - DNA, 855 bp, Artificial Sequence
  chemically treated genomic DNA (Homo sapiens) CpG-island No: 38505
cgtacgtttagtcgtttcgagagtcgtattcggcggattcggtttttaggttcgttttcggggtatttggcgggcgtttatttttcggggggtacgtgttttcgtacgtagcgcgagggtagcgggtgtttggttatttattaggaaaagtttcgcgcggatttttcggattgaggagggtgggaaattcggttgtttagcgttttattcgggcggtcggggttggcgtttttttgttttcggtcggcggttttattttgggataggtaattatgagttattcgtttcgcgggttatatgggtaacgtgattaaaataaagtttcggtattttaagtcgttagaaaaggggataacggagtttatcgggggcgggtataggaggcgggcgtaggcgggcggcgtcggggtcgtggggacgcggcgtcgagggggcggggtttggcgggaggttcgttttttttttacggtcggtagcgacgttcggatttttaggtagtcggattttagggcggggtatttttgcggattttagtttcgagagtttttcgcgttcggttttttatcggtagcggcggcgggttgcgggatttcggagatttcggcgcgttttttatagttatcgggattttacgcgttagtagcggttttttcgggaacgttttttagtttcgggagtacgcgggaaaagttttagcgtgttaatgagggagcgttttttttattacggttacgttcgggggtaggggttttttttagtcgtttttgagtttcgttagtttttttaatgtgataatgaacgaattgggaggtcgttgtatttacggttaattaaaacgttacgtttcggtttcga

SEQ ID NO: 38506 - DNA, 855 bp, Artificial Sequence
  chemically treated genomic DNA (Homo sapiens) CpG-island No: 38506
tcgaaaccgaaacgtaacgttttaattaaccgtaaatacaacgacctcccaattcgttcattatcacattaaaaaaactaacgaaactcaaaaacgactaaaaaaaacccctacccccgaacgtaaccgtaataaaaaaaacgctccctcattaacacgctaaaacttttcccgcgtactcccgaaactaaaaaacgttcccgaaaaaaccgctactaacgcgtaaaatcccgataactataaaaaacgcgccgaaatctccgaaatcccgcaacccgccgccgctaccgataaaaaaccgaacgcgaaaaactctcgaaactaaaatccgcaaaaataccccgccctaaaatccgactacctaaaaatccgaacgtcgctaccgaccgtaaaaaaaaaacgaacctcccgccaaaccccgccccctcgacgccgcgtccccacgaccccgacgccgcccgcctacgcccgcctcctatacccgcccccgataaactccgttatccccttttctaacgacttaaaataccgaaactttattttaatcacgttacccatataacccgcgaaacgaataactcataattacctatcccaaaataaaaccgccgaccgaaaacaaaaaaacgccaaccccgaccgcccgaataaaacgctaaacaaccgaatttcccaccctcctcaatccgaaaaatccgcgcgaaacttttcctaataaataaccaaacacccgctaccctcgcgctacgtacgaaaacacgtaccccccgaaaaataaacgcccgccaaataccccgaaaacgaacctaaaaaccgaatccgccgaatacgactctcgaaacgactaaacgtacg

SEQ ID NO: 38507 - DNA, 855 bp, Artificial Sequence
  chemically treated genomic DNA (Homo sapiens) CpG-island No: 38507
tcgaggtcgagacgtggcgttttgattggtcgtaagtatagcgattttttaattcgtttattattatattaagggagttaacggaatttaggagcgattaagggaagtttttgttttcgagcgtgatcgtaatgaggaaggcgtttttttattggtacgttggggtttttttcgcgtgttttcggggttgaaggacgttttcggggaagtcgttgttggcgcgtggggtttcggtggttgtgggggacgcgtcgggattttcgggatttcgtagttcgtcgtcgttgtcggtggggagtcggacgcggggggttttcggggttgaggttcgtaggggtgtttcgttttggagttcgattgtttaggagttcgggcgtcgttgtcggtcgtgggggaggggcgagtttttcgttaggtttcgttttttcggcgtcgcgtttttacggtttcggcgtcgttcgtttgcgttcgttttttgtgttcgttttcggtgagtttcgttgtttttttttttggcggtttaaaatatcgaaattttattttggttacgttgtttatgtgattcgcggagcggatgatttatggttgtttgttttaggatgaggtcgtcggtcgaaagtagagaagcgttagtttcggtcgttcgggtggagcgttgggtagtcgagttttttattttttttaattcggagagttcgcgcggggttttttttaataaatagttaggtattcgttgttttcgcgttgcgtacgggagtacgtgtttttcgggaggtgggcgttcgttaggtgtttcgggaacgagtttaggaatcgggttcgtcgagtgcggttttcggggcggttaggcgtgcg

SEQ ID NO: 38508 - DNA, 855 bp, Artificial Sequence
  chemically treated genomic DNA (Homo sapiens) CpG-island No: 38508
cgcacgcctaaccgccccgaaaaccgcactcgacgaacccgattcctaaactcgttcccgaaacacctaacgaacgcccacctcccgaaaaacacgtactcccgtacgcaacgcgaaaacaacgaatacctaactatttattaaaaaaaaccccgcgcgaactctccgaattaaaaaaaataaaaaactcgactacccaacgctccacccgaacgaccgaaactaacgcttctctactttcgaccgacgacctcatcctaaaacaaacaaccataaatcatccgctccgcgaatcacataaacaacgtaaccaaaataaaatttcgatattttaaaccgccaaaaaaaaaaacaacgaaactcaccgaaaacgaacacaaaaaacgaacgcaaacgaacgacgccgaaaccgtaaaaacgcgacgccgaaaaaacgaaacctaacgaaaaactcgcccctcccccacgaccgacaacgacgcccgaactcctaaacaatcgaactccaaaacgaaacacccctacgaacctcaaccccgaaaaccccccgcgtccgactccccaccgacaacgacgacgaactacgaaatcccgaaaatcccgacgcgtcccccacaaccaccgaaaccccacgcgccaacaacgacttccccgaaaacgtccttcaaccccgaaaacacgcgaaaaaaaccccaacgtaccaataaaaaaacgccttcctcattacgatcacgctcgaaaacaaaaacttcccttaatcgctcctaaattccgttaactcccttaatataataataaacgaattaaaaaatcgctatacttacgaccaatcaaaacgccacgtctcgacctcga

SEQ ID NO: 38509 - DNA, 752 bp, Artificial Sequence
  chemically treated genomic DNA (Homo sapiens) CpG-island No: 38509
tttcgcgtagcgcgtcgttttcgttttttttttcgtcgtcgttcgtttttttcgagttcgcggtttgtacgtcgttcgcgttttcggagtttatgagcgcgttggtttttcgtttcgttttcgttatgtagtttttcggtttttttaattacgcgcgttttaagtagtttatcgtcgcgtagaatttcgggttcgcgtcgggttacggtacgtcggtttttagttttagttcgtttagtttttcgtcgtttatgttttcgacgtcgaggtagttcggtcgcgttttcgtgtcgtttttcgcgtagtttttcggcgttgagttcgaggtttcgtggggttttttttcgtcgtcgttttcgttttcgttattttcggtttttagttttacggttgttttttcggtgttcgacgtgtttttattgtcgtcgttattatcgtcgttttcgagttcgggataggcgttttattgttcgtcgtttgttattcgtttcggttatagttagacgttcgcggttttttttagcgttttgttgttttcgtagtcgtcgtcggcggtcgttaacgttttggggttgtttaagggtgttattttcgcgtgagtaatcgtcgcggttttttatttttttgttttttcgtttcgggtcgttttgggatttttatatttttatatacgcgtttttattagtttgtaatttagagcgttttagtaatattttatatattttttttcgtgcgatgtaaaaatttttaat

SEQ ID NO: 38510 - DNA, 752 bp, Artificial Sequence
  chemically treated genomic DNA (Homo sapiens) CpG-island No: 38510
attaaaaatttttacatcgcacgaaaaaaaatatataaaatattactaaaacgctctaaattacaaactaataaaaacgcgtatataaaaatataaaaatcccaaaacgacccgaaacgaaaaaacaaaaaaataaaaaaccgcgacgattactcacgcgaaaataacacccttaaacaaccccaaaacgttaacgaccgccgacgacgactacgaaaacaacaaaacgctaaaaaaaaccgcgaacgtctaactataaccgaaacgaataacaaacgacgaacaataaaacgcctatcccgaactcgaaaacgacgataataacgacgacaataaaaacacgtcgaacaccgaaaaaacaaccgtaaaactaaaaaccgaaaataacgaaaacgaaaacgacgacgaaaaaaaaccccacgaaacctcgaactcaacgccgaaaaactacgcgaaaaacgacacgaaaacgcgaccgaactacctcgacgtcgaaaacataaacgacgaaaaactaaacgaactaaaactaaaaaccgacgtaccgtaacccgacgcgaacccgaaattctacgcgacgataaactacttaaaacgcgcgtaattaaaaaaaccgaaaaactacataacgaaaacgaaacgaaaaaccaacgcgctcataaactccgaaaacgcgaacgacgtacaaaccgcgaactcgaaaaaaacgaacgacgacgaaaaaaaaaacgaaaacgacgcgctacgcgaaa

SEQ ID NO: 38511 - DNA, 752 bp, Artificial Sequence
  chemically treated genomic DNA (Homo sapiens) CpG-island No: 38511
gttaagaatttttatatcgtacggagagaaatgtgtgaaatgttattggggcgttttgggttgtaggttgatgggagcgcgtgtatggagatgtgggagttttagggcgattcgaggcggaggggtagggaagtggaggatcgcggcggttatttacgcgggggtgatatttttgggtagttttagggcgttgacggtcgtcggcggcggttgcgagggtagtagagcgttgaggaaggtcgcgggcgtttggttgtggtcgaagcgggtggtaggcgacgagtagtgggacgtttgtttcgggttcgggagcggcggtggtggcggcggtagtgggaatacgtcgggtatcgggaaggtagtcgtggggttgaagatcgggggtggcgggggcgggggcgacggcgaggaggagttttacggggtttcgggtttagcgtcgaagggttgcgcgaagggcggtacgggggcgcggtcgaattgtttcggcgtcggggatatgggcgacgggaggttggacgagttggggttggaggtcggcgtgtcgtggttcgacgcgggttcgaggttttgcgcggcgatgaattgtttggggcgcgcgtagttgaaggagtcggaggattgtatggcgggggcggagcgggaggttagcgcgtttatgggtttcggggacgcgggcggcgtgtaggtcgcgagttcggggaaggcgggcggcggcgggaaggggggcgagggcggcgcgttgcgcgggg

SEQ ID NO: 38512 - DNA, 752 bp, Artificial Sequence
  chemically treated genomic DNA (Homo sapiens) CpG-island No: 38512
ccccgcgcaacgcgccgccctcgccccccttcccgccgccgcccgccttccccgaactcgcgacctacacgccgcccgcgtccccgaaacccataaacgcgctaacctcccgctccgcccccgccatacaatcctccgactccttcaactacgcgcgccccaaacaattcatcgccgcgcaaaacctcgaacccgcgtcgaaccacgacacgccgacctccaaccccaactcgtccaacctcccgtcgcccatatccccgacgccgaaacaattcgaccgcgcccccgtaccgcccttcgcgcaacccttcgacgctaaacccgaaaccccgtaaaactcctcctcgccgtcgcccccgcccccgccacccccgatcttcaaccccacgactaccttcccgatacccgacgtattcccactaccgccgccaccaccgccgctcccgaacccgaaacaaacgtcccactactcgtcgcctaccacccgcttcgaccacaaccaaacgcccgcgaccttcctcaacgctctactaccctcgcaaccgccgccgacgaccgtcaacgccctaaaactacccaaaaatatcacccccgcgtaaataaccgccgcgatcctccacttccctacccctccgcctcgaatcgccctaaaactcccacatctccatacacgcgctcccatcaacctacaacccaaaacgccccaataacatttcacacatttctctccgtacgatataaaaattcttaac

SEQ ID NO: 38513 - DNA, 652 bp, Artificial Sequence
  chemically treated genomic DNA (Homo sapiens) CpG-island No: 38513
aggggattggttggcgataatattttggcgataaggtggatagtgattttcgttcggttcgagttcgtttagtaggggaagtaattttattatcgttttcgcgtatcgttacgtgacgggaagagggcgtggtcgaagttcgtgattcggggggcgggcggggtagggggagggtattagaatgtgaaggattttcgcggttttgggtgtttagaaaggcggcgacgcggcggatgataatattaggtcgcgacgcgtttttggttaggcggcggttgtagtgttagttttggacgtcgtagtagtcgttgtcggtagtaagtcgattgagggaaggtgggggttcgttcgggttggtggatttcggggtcgaaagttttcgtttcgttcgggggttgagtcggtagtgttttcgcggtcgttgggtagcgtttttcgtttaggttcgcgttttagttgtcgtcgacgatagcggtcgagagaagttggggtttgattagacgtttacggggtttcggatttcggcgtcgcggcgatttcggaggaatcggttttttgcgtttcgtttttttgggagtttcgtacgggtgagtgttgttttatttttgaggttggggtgttgggttcgtattttttagggcgattgcgtatt

SEQ ID NO: 38514 - DNA, 652 bp, Artificial Sequence
  chemically treated genomic DNA (Homo sapiens) CpG-island No: 38514
aatacgcaatcgccctaaaaaatacgaacccaacaccccaacctcaaaaataaaacaacactcacccgtacgaaactcccaaaaaaacgaaacgcaaaaaaccgattcctccgaaatcgccgcgacgccgaaatccgaaaccccgtaaacgtctaatcaaaccccaacttctctcgaccgctatcgtcgacgacaactaaaacgcgaacctaaacgaaaaacgctacccaacgaccgcgaaaacactaccgactcaacccccgaacgaaacgaaaactttcgaccccgaaatccaccaacccgaacgaacccccaccttccctcaatcgacttactaccgacaacgactactacgacgtccaaaactaacactacaaccgccgcctaaccaaaaacgcgtcgcgacctaatattatcatccgccgcgtcgccgcctttctaaacacccaaaaccgcgaaaatccttcacattctaataccctccccctaccccgcccgccccccgaatcacgaacttcgaccacgccctcttcccgtcacgtaacgatacgcgaaaacgataataaaattacttcccctactaaacgaactcgaaccgaacgaaaatcactatccaccttatcgccaaaatattatcgccaaccaatcccct

SEQ ID NO: 38515 - DNA, 652 bp, Artificial Sequence
  chemically treated genomic DNA (Homo sapiens) CpG-island No: 38515
ggtgcgtagtcgttttgaggggtgcgaatttagtattttaattttaggaatggagtaatatttattcgtgcggagtttttagggaggcgggacgtaaggagtcggttttttcgaggtcgtcgcggcgtcggggttcgaggtttcgtaagcgtttagttagattttaatttttttcggtcgttgtcgtcggcggtagttggggcgcgagtttggacgaagggcgttgtttagcggtcgcggaggtattgtcggtttagttttcgagcggggcgggaattttcggtttcgaggtttattagttcgggcggatttttatttttttttagtcggtttgttatcggtagcggttattgcggcgtttaaagttaatattatagtcgtcgtttggttaggagcgcgtcgcggtttaatgttgttattcgtcgcgtcgtcgtttttttgggtatttagaatcgcgaagattttttatattttagtgttttttttttgtttcgttcgtttttcggattacgggtttcggttacgtttttttttcgttacgtgacggtgcgcggaggcggtggtggagttgttttttttgttaggcgggttcgaatcgggcgggagttattgtttattttgtcgttagggtgttatcgttagttagtttttt

SEQ ID NO: 38516 - DNA, 652 bp, Artificial Sequence
  chemically treated genomic DNA (Homo sapiens) CpG-island No: 38516
aaaaaactaactaacgataacaccctaacgacaaaataaacaataactcccgcccgattcgaacccgcctaacaaaaaaaacaactccaccaccgcctccgcgcaccgtcacgtaacgaaaaaaaaacgtaaccgaaacccgtaatccgaaaaacgaacgaaacaaaaaaaaaacactaaaatataaaaaatcttcgcgattctaaatacccaaaaaaacgacgacgcgacgaataacaacattaaaccgcgacgcgctcctaaccaaacgacgactataatattaactttaaacgccgcaataaccgctaccgataacaaaccgactaaaaaaaaataaaaatccgcccgaactaataaacctcgaaaccgaaaattcccgccccgctcgaaaactaaaccgacaatacctccgcgaccgctaaacaacgcccttcgtccaaactcgcgccccaactaccgccgacgacaacgaccgaaaaaaattaaaatctaactaaacgcttacgaaacctcgaaccccgacgccgcgacgacctcgaaaaaaccgactccttacgtcccgcctccctaaaaactccgcacgaataaatattactccattcctaaaattaaaatactaaattcgcacccctcaaaacgactacgcacc

SEQ ID NO: 38517 - DNA, 584 bp, Artificial Sequence
  chemically treated genomic DNA (Homo sapiens) CpG-island No: 38517
gtcgtcgtcgagggcgtttcgagcggtcgggtatttatattaacgcgtggtaaagtagcgtttagtttcgcggtttttttagggcgtcgtagattaaagtttggatgcgtcggtatttggcgttgttttttttgattgggcggtttagcggggttttggttaggagttcgatgttttgcggggtttttcgttgtttttcgtcgcggtcgtcgttttttagtagtagggtttcgtttttgtcggtttcggtttcgagcgttaaggtgatttgttttacgtcgtcgggcgttagttttatttttcgtttttcgtcgtcggtcgtcgtcgcgtttttttcggttgggttagtcgtttcgtcgttttcgtcgttttcgtcgtcgtcgtcgttagtcgttttcgtcgttttgcgcgttttgagttttatttgtttcgttttcgaagaacgtttcgtttttttcgttgttgttttgggaagaaggggcgttcggggtgcgtgaacgaggcggcggcggcggttgtaagttcgggaattttaatgttatgattcgcgcgtttttttttatttttttttaaaagtaggtaaa

SEQ ID NO: 38518 - DNA, 584 bp, Artificial Sequence
  chemically treated genomic DNA (Homo sapiens) CpG-island No: 38518
tttacctacttttaaaaaaaaataaaaaaaaacgcgcgaatcataacattaaaattcccgaacttacaaccgccgccgccgcctcgttcacgcaccccgaacgccccttcttcccaaaacaacaacgaaaaaaacgaaacgttcttcgaaaacgaaacaaataaaactcaaaacgcgcaaaacgacgaaaacgactaacgacgacgacgacgaaaacgacgaaaacgacgaaacgactaacccaaccgaaaaaaacgcgacgacgaccgacgacgaaaaacgaaaaataaaactaacgcccgacgacgtaaaacaaatcaccttaacgctcgaaaccgaaaccgacaaaaacgaaaccctactactaaaaaacgacgaccgcgacgaaaaacaacgaaaaaccccgcaaaacatcgaactcctaaccaaaaccccgctaaaccgcccaatcaaaaaaaacaacgccaaataccgacgcatccaaactttaatctacgacgccctaaaaaaaccgcgaaactaaacgctactttaccacgcgttaatataaatacccgaccgctcgaaacgccctcgacgacgac

SEQ ID NO: 38519 - DNA, 584 bp, Artificial Sequence
  chemically treated genomic DNA (Homo sapiens) CpG-island No: 38519
tttgtttgtttttgggggggggtggggaggggcgcgcggattatggtattggagttttcgggtttgtagtcgtcgtcgtcgtttcgtttacgtatttcgagcgttttttttttttagagtagtagcggagaaggcgaagcgtttttcgggggcgaggtagatggggtttaaggcgcgtagggcggcgggggcggttggcggcggcggcgacgggggcggcggaggcggcggggcggttaatttagtcggaggggacgcggcggcggtcggcgacgaggagcggaaagtggggttggcgttcggcgacgtggagtaagttattttggcgttcggggtcggagtcgataaagacgggattttgttgttggagggcggcggtcgcgacgaggggtagcggaggatttcgtagggtatcgggtttttggttaagatttcgttgagtcgtttagttaagagaaataacgttaagtatcggcgtatttaaattttgatttacgacgttttggagagatcgcggggttgggcgttgttttattacgcgttggtgtgagtattcggtcgttcggggcgttttcggcggcggt

SEQ ID NO: 38520 - DNA, 584 bp, Artificial Sequence
  chemically treated genomic DNA (Homo sapiens) CpG-island No: 38520
accgccgccgaaaacgccccgaacgaccgaatactcacaccaacgcgtaataaaacaacgcccaaccccgcgatctctccaaaacgtcgtaaatcaaaatttaaatacgccgatacttaacgttatttctcttaactaaacgactcaacgaaatcttaaccaaaaacccgataccctacgaaatcctccgctacccctcgtcgcgaccgccgccctccaacaacaaaatcccgtctttatcgactccgaccccgaacgccaaaataacttactccacgtcgccgaacgccaaccccactttccgctcctcgtcgccgaccgccgccgcgtcccctccgactaaattaaccgccccgccgcctccgccgcccccgtcgccgccgccgccaaccgcccccgccgccctacgcgccttaaaccccatctacctcgcccccgaaaaacgcttcgccttctccgctactactctaaaaaaaaaaaacgctcgaaatacgtaaacgaaacgacgacgacgactacaaacccgaaaactccaataccataatccgcgcgcccctccccacccccccccaaaaacaaacaaa

SEQ ID NO: 38521 - DNA, 505 bp, Artificial Sequence
  chemically treated genomic DNA (Homo sapiens) CpG-island No: 38521
cgagtcggcggcggcgagggtaagtttttttttgcggtacgatgtcgtttttgttggtgtttatttttttttcgtgcgtattattcggttgggcgttgttggtcggcggtatcggtggcggtggcgttggcggcggcggcggtggcgcgggtataggcggcggacgttaggagagagaggcgttgtcgttatagaagatcgaggtgttggtgttattgttttaggatgattcgtatttgtttttatttattcgggtgcggtcggttatcgagtatgttttgcgtagcgtggagggtaacgggattgggaggcggtttttgtcgtcgggtattcgtttttaggtggtttacgaggatttagattgtgggaatcgtgcgttttttagtttggtggatcgcgtggcggcggcgcggggcgttaagttagattttattttggggttagtgtgcgagtatgtagtagcgttagtggttcggtttgtatcgtattgggatttgtttatgtt

SEQ ID NO: 38522 - DNA, 505 bp, Artificial Sequence
  chemically treated genomic DNA (Homo sapiens) CpG-island No: 38522
aacataaacaaatcccaatacgatacaaaccgaaccactaacgctactacatactcgcacactaaccccaaaataaaatctaacttaacgccccgcgccgccgccacgcgatccaccaaactaaaaaacgcacgattcccacaatctaaatcctcgtaaaccacctaaaaacgaatacccgacgacaaaaaccgcctcccaatcccgttaccctccacgctacgcaaaacatactcgataaccgaccgcacccgaataaataaaaacaaatacgaatcatcctaaaacaataacaccaacacctcgatcttctataacgacaacgcctctctctcctaacgtccgccgcctatacccgcgccaccgccgccgccgccaacgccaccgccaccgataccgccgaccaacaacgcccaaccgaataatacgcacgaaaaaaaaataaacaccaacaaaaacgacatcgtaccgcaaaaaaaaacttaccctcgccgccgccgactcg

SEQ ID NO: 38523 - DNA, 505 bp, Artificial Sequence
  chemically treated genomic DNA (Homo sapiens) CpG-island No: 38523
agtatgggtaggttttagtgcgatgtaagtcgggttattggcgttgttgtatattcgtatattggttttaggataaggtttggtttggcgtttcgcgtcgtcgttacgcggtttattaagttgaagagcgtacggtttttatagtttgaattttcgtaagttatttggaagcgagtgttcggcggtagaagtcgttttttagtttcgttgttttttacgttgcgtagagtatattcgatggtcggtcgtattcgggtgagtgaaaataagtacgagttattttggggtagtaatattagtatttcgattttttgtggcggtagcgttttttttttttggcgttcgtcgtttatgttcgcgttatcgtcgtcgtcgttaacgttatcgttatcggtgtcgtcggttagtaacgtttagtcgagtagtacgtacggggagaaagtgagtattagtagagacggtatcgtgtcgtaagaaagagtttgttttcgtcgtcgtcgattcg

SEQ ID NO: 38524 - DNA, 505 bp, Artificial Sequence
  chemically treated genomic DNA (Homo sapiens) CpG-island No: 38524
cgaatcgacgacgacgaaaacaaactctttcttacgacacgataccgtctctactaatactcactttctccccgtacgtactactcgactaaacgttactaaccgacgacaccgataacgataacgttaacgacgacgacgataacgcgaacataaacgacgaacgccaaaaaaaaaaaacgctaccgccacaaaaaatcgaaatactaatattactaccccaaaataactcgtacttattttcactcacccgaatacgaccgaccatcgaatatactctacgcaacgtaaaaaacaacgaaactaaaaaacgacttctaccgccgaacactcgcttccaaataacttacgaaaattcaaactataaaaaccgtacgctcttcaacttaataaaccgcgtaacgacgacgcgaaacgccaaaccaaaccttatcctaaaaccaatatacgaatatacaacaacgccaataacccgacttacatcgcactaaaacctacccatact

SEQ ID NO: 38525 - DNA, 518 bp, Artificial Sequence
  chemically treated genomic DNA (Homo sapiens) CpG-island No: 38525
attttacgcgcgtggcgttcgtttacgttaagatgggcgagatgatgttcgttttgtttcgttattattattggagtcgcgttgtattggtttatagcgacgataagttggagcggaattgttattttattttcgagggggtttacgaggttttttaggaggagggtttgtatacgtttatttatagtttcgacgagattaaagatttggatttggaagatatcgtgcgtaatatttaggttagtgagagaggtgagtaggggcgcgtttcgggtttcgggttttaatttaatcgtttttcgcggttttttttgtatattcgtttattttgtagattttattttttattgcggcgttgaggtcgggtgcgcgcgggtattcgtttaggtatgcgtcgtgtggttgcgataatttttgacgatcgtttatcgcggtgtacgtagagggttttagggaggtgaaggggttggaggagagggcgtttgtagtttttgcgtgtttaggtttaataggtgttg

SEQ ID NO: 38526 - DNA, 518 bp, Artificial Sequence
  chemically treated genomic DNA (Homo sapiens) CpG-island No: 38526
caacacctattaaacctaaacacgcaaaaactacaaacgccctctcctccaaccccttcacctccctaaaaccctctacgtacaccgcgataaacgatcgtcaaaaattatcgcaaccacacgacgcatacctaaacgaatacccgcgcgcacccgacctcaacgccgcaataaaaaataaaatctacaaaataaacgaatatacaaaaaaaaccgcgaaaaacgattaaattaaaacccgaaacccgaaacgcgcccctactcacctctctcactaacctaaatattacgcacgatatcttccaaatccaaatctttaatctcgtcgaaactataaataaacgtatacaaaccctcctcctaaaaaacctcgtaaaccccctcgaaaataaaataacaattccgctccaacttatcgtcgctataaaccaatacaacgcgactccaataataataacgaaacaaaacgaacatcatctcgcccatcttaacgtaaacgaacgccacgcgcgtaaaat

SEQ ID NO: 38527 - DNA, 518 bp, Artificial Sequence
  chemically treated genomic DNA (Homo sapiens) CpG-island No: 38527
tagtatttgttggatttgggtacgtaggagttatagacgtttttttttttaatttttttatttttttgggattttttacgtatatcgcgatgggcggtcgttaaaggttgtcgtagttatacggcgtatatttgaacgagtgttcgcgcgtattcgattttagcgtcgtagtggggagtggggtttgtagagtggacgagtgtgtagggagagtcgcggagagcggttgggttagggttcggggttcgggacgcgtttttgtttattttttttattggtttggatattgcgtacgatgttttttagatttaagtttttggtttcgtcgaaattgtagatggacgtgtgtaaattttttttttggaagatttcgtggattttttcgagggtgaagtagtagtttcgttttagtttgtcgtcgttgtagattagtgtagcgcggttttagtggtggtggcggaatagggcgagtattatttcgtttattttggcgtaggcgggcgttacgcgcgtgaggt

SEQ ID NO: 38528 - DNA, 518 bp, Artificial Sequence
  chemically treated genomic DNA (Homo sapiens) CpG-island No: 38528
acctcacgcgcgtaacgcccgcctacgccaaaataaacgaaataatactcgccctattccgccaccaccactaaaaccgcgctacactaatctacaacgacgacaaactaaaacgaaactactacttcaccctcgaaaaaatccacgaaatcttccaaaaaaaaaatttacacacgtccatctacaatttcgacgaaaccaaaaacttaaatctaaaaaacatcgtacgcaatatccaaaccaataaaaaaaataaacaaaaacgcgtcccgaaccccgaaccctaacccaaccgctctccgcgactctccctacacactcgtccactctacaaaccccactccccactacgacgctaaaatcgaatacgcgcgaacactcgttcaaatatacgccgtataactacgacaacctttaacgaccgcccatcgcgatatacgtaaaaaatcccaaaaaaataaaaaaattaaaaaaaaaaacgtctataactcctacgtacccaaatccaacaaatacta

SEQ ID NO: 38529 - DNA, 521 bp, Artificial Sequence
  chemically treated genomic DNA (Homo sapiens) CpG-island No: 38529
ttttttttttttttttattggtgagttttttgtcgttcgcgtttagttttttttttttatattttttcgtttttttttttttttaattttttcgttttttttttattgcgtttttttttttttgaagtttcgcgcgttgtcgcggtttttttttttgtcgtttattttttatattgtttttttatttattttttcggttgtatttttaatgtgcgtttgtcgttttttttttgttgttttcgcgtcgcgcgttttttcgttttttttttcgtatttttcgtttattttcgattttcgttcgtgttagtcgttttttcgttcgttttttttttttcgtcgtttttcgtataatttcgttttcgtattgcgttttttttatttttttttttttttcgcgtttcgtttcgcgttttttttttattcgttttttttttcgttttttatttatttttttttttttttttttattcgtagtttagttttttcgcgtattcgttttttttcgtgtttttttttttcgt

SEQ ID NO: 38530 - DNA, 521 bp, Artificial Sequence
  chemically treated genomic DNA (Homo sapiens) CpG-island No: 38530
acgaaaaaaaaaaacacgaaaaaaaacgaatacgcgaaaaaactaaactacgaataaaaaaaaaaaaaaaaaaataaataaaaaacgaaaaaaaaaacgaataaaaaaaaaacgcgaaacgaaacgcgaaaaaaaaaaaaaaataaaaaaaacgcaatacgaaaacgaaattatacgaaaaacgacgaaaaaaaaaaaacgaacgaaaaaacgactaacacgaacgaaaatcgaaaataaacgaaaaatacgaaaaaaaaaacgaaaaaacgcgcgacgcgaaaacaacaaaaaaaaaacgacaaacgcacattaaaaatacaaccgaaaaaataaataaaaaaacaatataaaaaataaacgacaaaaaaaaaaaccgcgacaacgcgcgaaacttcaaaaaaaaaaaaacgcaataaaaaaaaaacgaaaaaattaaaaaaaaaaaaaaacgaaaaaatataaaaaaaaaaaactaaacgcgaacgacaaaaaactcaccaataaaaaaaaaaaaaaaa

SEQ ID NO: 38531 - DNA, 521 bp, Artificial Sequence
  chemically treated genomic DNA (Homo sapiens) CpG-island No: 38531
acggggaaaagggatacgggggggggcgaatacgcgaaagggttggattgcgggtgggggggggaaggaaagaataagtggggggcgggggggggaacgaatagggggggaacgcggggcggggcgcgaaaaaagggggggggtgaagaaaacgtaatgcggggacggggttgtgcggggggcggcgggaaaagaggggcgggcgaaggggcggttgatacgggcgggaatcggggatgggcgggggatgcgaaaagaaaagcgggggggcgcgcggcgcggaaataataaaggaaaagcggtaaacgtatattgggaatataatcggggggatagatagggggataatatgggggataaacgatagggggggggatcgcgatagcgcgcgggattttagggggaaggaagcgtaatggggggggggcgggaggattaaaaaagggagggggcggaaaaatatggggggggggggttggacgcgggcggtaaggggtttattagtggaaaaaaaagagagg

SEQ ID NO: 38532 - DNA, 521 bp, Artificial Sequence
  chemically treated genomic DNA (Homo sapiens) CpG-island No: 38532
cctctcttttttttccactaataaaccccttaccgcccgcgtccaaccccccccccccatatttttccgccccctcccttttttaatcctcccgccccccccccattacgcttccttccccctaaaatcccgcgcgctatcgcgatccccccccctatcgtttatcccccatattatccccctatctatccccccgattatattcccaatatacgtttaccgcttttcctttattatttccgcgccgcgcgcccccccgcttttcttttcgcatcccccgcccatccccgattcccgcccgtatcaaccgccccttcgcccgcccctcttttcccgccgccccccgcacaaccccgtccccgcattacgttttcttcacccccccccttttttcgcgccccgccccgcgttccccccctattcgttcccccccccgccccccacttattctttccttcccccccccacccgcaatccaaccctttcgcgtattcgcccccccccgtatcccttttccccgt

SEQ ID NO: 38533 - DNA, 553 bp, Artificial Sequence
  chemically treated genomic DNA (Homo sapiens) CpG-island No: 38533
tgttacgtcgttttgagattttagagggaaagtgtttttaggataaagtcgttttttattttcgtcggaggttgagcgtttcggggagtttggtcgtttcgcgggtttttttttcgtaagtttggtttttggggtgggtaagaacgttttgtgtcgttcggtttcgggagtaggcggtttcggaacgggttttttttttaattcggggtcgtaagtttgagttttaggcggtcggatttacgattcgggattcggattaaggatcggttttggattagcgttgggagtagtttaaaggttcgggggttgcgtaggcggtttttttttttcggcggcgggcgggtaggcgggtttcggcggttttttcggtcgttggggtggattattacggtagtttttgtaaaagacgttcgttcgttagttatcgacgatttcggattttatagtttataggtttcgtttttagtgtgggtttttcgtttaagttttagatttaggcgattttagagcgcggttggggttttcgttcgaggtcgtcggtattatttttttt

SEQ ID NO: 38534 - DNA, 553 bp, Artificial Sequence
  chemically treated genomic DNA (Homo sapiens) CpG-island No: 38534
aaaaaaaataataccgacgacctcgaacgaaaaccccaaccgcgctctaaaatcgcctaaatctaaaacttaaacgaaaaacccacactaaaaacgaaacctataaactataaaatccgaaatcgtcgataactaacgaacgaacgtcttttacaaaaactaccgtaataatccaccccaacgaccgaaaaaaccgccgaaacccgcctacccgcccgccgccgaaaaaaaaaaaccgcctacgcaacccccgaacctttaaactactcccaacgctaatccaaaaccgatccttaatccgaatcccgaatcgtaaatccgaccgcctaaaactcaaacttacgaccccgaattaaaaaaaaaacccgttccgaaaccgcctactcccgaaaccgaacgacacaaaacgttcttacccaccccaaaaaccaaacttacgaaaaaaaaacccgcgaaacgaccaaactccccgaaacgctcaacctccgacgaaaataaaaaacgactttatcctaaaaacactttccctctaaaatctcaaaacgacgtaaca

SEQ ID NO: 38535 - DNA, 553 bp, Artificial Sequence
  chemically treated genomic DNA (Homo sapiens) CpG-island No: 38535
agaaggggtggtgtcgacggtttcgggcggagattttagtcgcgttttggggtcgtttgggtttggggtttaggcggggggtttatattgggggcggggtttatggattgtgaagttcgaggtcgtcggtaattggcgggcgggcgttttttgtagaggttgtcgtagtaatttattttaacggtcggaggagtcgtcggagttcgtttgttcgttcgtcgtcgaaggagaggagtcgtttgcgtagttttcgggtttttgagttgtttttagcgttggtttagagtcgatttttgattcgggtttcggatcgtggattcggtcgtttagggtttagatttgcggtttcgggttgggaggaaaattcgtttcggagtcgtttgttttcggaatcggacggtatagggcgtttttgtttattttaggggttaggtttgcggagggggagttcgcggagcggttagatttttcggggcgtttagttttcggcgagggtgggagacggttttgttttggggatattttttttttggaattttaagacgacgtggta

SEQ ID NO: 38536 - DNA, 553 bp, Artificial Sequence
  chemically treated genomic DNA (Homo sapiens) CpG-island No: 38536
taccacgtcgtcttaaaattccaaaaaaaaaatatccccaaaacaaaaccgtctcccaccctcgccgaaaactaaacgccccgaaaaatctaaccgctccgcgaactccccctccgcaaacctaacccctaaaataaacaaaaacgccctataccgtccgattccgaaaacaaacgactccgaaacgaattttcctcccaacccgaaaccgcaaatctaaaccctaaacgaccgaatccacgatccgaaacccgaatcaaaaatcgactctaaaccaacgctaaaaacaactcaaaaacccgaaaactacgcaaacgactcctctccttcgacgacgaacgaacaaacgaactccgacgactcctccgaccgttaaaataaattactacgacaacctctacaaaaaacgcccgcccgccaattaccgacgacctcgaacttcacaatccataaaccccgcccccaatataaaccccccgcctaaaccccaaacccaaacgaccccaaaacgcgactaaaatctccgcccgaaaccgtcgacaccaccccttct

SEQ ID NO: 38537 - DNA, 801 bp, Artificial Sequence
  chemically treated genomic DNA (Homo sapiens) CpG-island No: 38537
agcggcggcggcgattgagagtcggggtcgcggcggcgttttttaggaagggtcgtacgaggcggcgggttcggcgggtttttcggaggaggcggttgcgttatggacgagttattttttagcgaggcggttttggagtaggcgttgggcgagtcgtgcgatttggacgcggcgttgttgatcgatatcgaaggtgcgttagggcgggtagggtttgaagttgcgtcgggtggcgcgagtagggggcgcgtaggtgtttttttggtttttgttttttttacgggcgttagtttcgtgttgtgttcgcgcgggatttttcggtgtttttgagttcggtgtttcgagttttatcgagtttttttggttttcgcgttagcgtttcgggtcgcgcgtttgtgggtgagggtttttgggtcgggtcggggttttttggcggtttcgggtcgggatacgtgcgtttttacgcgttttaggtcgggtgtcgttcgatcggtgattttttagttttgtgatggttacggttgaagttggggatttaggcgtcgtcgaagtttcgttttagttttagtcgtgacgtaattgcgaggttatttacggttatttttttcggttcgagagtttagttcggcgtcggagtttttgcgtatgcgtatgggcgttgtttcgcgtttttttttcgtttcgtgtcgggttttttcggtttgcgacgggtatagttttcgtatttatttattgatatttatcgaatgttaggtttcgttttaggtatcgagggtttatagatagatttgggtatttttt

SEQ ID NO: 38538 - DNA, 801 bp, Artificial Sequence
  chemically treated genomic DNA (Homo sapiens) CpG-island No: 38538
aaaaaatacccaaatctatctataaaccctcgatacctaaaacgaaacctaacattcgataaatatcaataaataaatacgaaaactatacccgtcgcaaaccgaaaaaacccgacacgaaacgaaaaaaaaacgcgaaacaacgcccatacgcatacgcaaaaactccgacgccgaactaaactctcgaaccgaaaaaaataaccgtaaataacctcgcaattacgtcacgactaaaactaaaacgaaacttcgacgacgcctaaatccccaacttcaaccgtaaccatcacaaaactaaaaaatcaccgatcgaacgacacccgacctaaaacgcgtaaaaacgcacgtatcccgacccgaaaccgccaaaaaaccccgacccgacccaaaaaccctcacccacaaacgcgcgacccgaaacgctaacgcgaaaaccaaaaaaactcgataaaactcgaaacaccgaactcaaaaacaccgaaaaatcccgcgcgaacacaacacgaaactaacgcccgtaaaaaaaacaaaaaccaaaaaaacacctacgcgccccctactcgcgccacccgacgcaacttcaaaccctacccgccctaacgcaccttcgatatcgatcaacaacgccgcgtccaaatcgcacgactcgcccaacgcctactccaaaaccgcctcgctaaaaaataactcgtccataacgcaaccgcctcctccgaaaaacccgccgaacccgccgcctcgtacgacccttcctaaaaaacgccgccgcgaccccgactctcaatcgccgccgccgct

SEQ ID NO: 38539 - DNA, 801 bp, Artificial Sequence
  chemically treated genomic DNA (Homo sapiens) CpG-island No: 38539
agggggtatttaggtttgtttgtaaattttcggtgtttaagacggggtttggtattcggtggatgttagtgaatgagtgcggaggttgtgttcgtcgtagatcgggagaattcgatacgaggcgggggaagggcgcgaggtagcgtttatgcgtatgcgtaagagtttcgacgtcgagttgaattttcgggtcggagggaatgatcgtgagtaatttcgtaattacgttacggttggggttggggcggagtttcggcgacgtttgggtttttagttttagtcgtggttattatagggttggagagttatcggtcgggcggtattcggtttgggacgcgtagaggcgtacgtgtttcggttcggagtcgttaagggatttcggttcggtttaggagtttttatttataagcgcgcggttcgagacgttagcgcgggaattagggaggttcggtgaggttcgggatatcgagtttagagatatcgggaagtttcgcgcgagtatagtacggagttggcgttcgtgggggagataaaggttagggagatatttgcgcgttttttattcgcgttattcggcgtagttttaagttttgttcgttttgacgtattttcgatgtcggttagtagcgtcgcgtttagatcgtacggttcgtttagcgtttgttttaaagtcgtttcgttgaagggtggttcgtttatggcgtagtcgtttttttcgggaggttcgtcgggttcgtcgtttcgtacggttttttttagggagcgtcgtcgcggtttcggtttttagtcgtcgtcgtcgtt

SEQ ID NO: 38540 - DNA, 801 bp, Artificial Sequence
  chemically treated genomic DNA (Homo sapiens) CpG-island No: 38540
aacgacgacgacgactaaaaaccgaaaccgcgacgacgctccctaaaaaaaaccgtacgaaacgacgaacccgacgaacctcccgaaaaaaacgactacgccataaacgaaccacccttcaacgaaacgactttaaaacaaacgctaaacgaaccgtacgatctaaacgcgacgctactaaccgacatcgaaaatacgtcaaaacgaacaaaacttaaaactacgccgaataacgcgaataaaaaacgcgcaaatatctccctaacctttatctcccccacgaacgccaactccgtactatactcgcgcgaaacttcccgatatctctaaactcgatatcccgaacctcaccgaacctccctaattcccgcgctaacgtctcgaaccgcgcgcttataaataaaaactcctaaaccgaaccgaaatcccttaacgactccgaaccgaaacacgtacgcctctacgcgtcccaaaccgaataccgcccgaccgataactctccaaccctataataaccacgactaaaactaaaaacccaaacgtcgccgaaactccgccccaaccccaaccgtaacgtaattacgaaattactcacgatcattccctccgacccgaaaattcaactcgacgtcgaaactcttacgcatacgcataaacgctacctcgcgcccttcccccgcctcgtatcgaattctcccgatctacgacgaacacaacctccgcactcattcactaacatccaccgaataccaaaccccgtcttaaacaccgaaaatttacaaacaaacctaaataccccct

SEQ ID NO: 38541 - DNA, 1154 bp, Artificial Sequence
  chemically treated genomic DNA (Homo sapiens) CpG-island No: 38541
tcggtaagggcgaggacgcgaaggatagaggtcgagagtaaaatttaaggttcgtgttgtttttttggcgttttgagtagtttcgacggtcggcggtgtggagaaatttgacggagaggtgcgttcggttcgtcgggttttaggtcgagatttttttttttaggtcgcggtatagtttcgttttcgtttttttttttttttttttatttttttttttaatgtttcggtttttattgggttttcgtcgttttttttaatttttcgttttcgtggtttaaatttattaacgttcgtaaataatgaataatggagcgtttttttttagtcgcgtaaggttgcgggcggggggttattgttagatgcgttcggttttggggagggggtatttatcgatcgggtgtagagggggttcgggcgcgcggtttcgtatacgtgtaatcgcggcgcgtaggcgggtatttcgttcggcggaggagggggaatttcgttttgttttttttaacgttattttttttggagttttttggtatcgaacgaggcgagagagcgcgcgcgagttttttagtcggagagggttatttttaatttgtttttttttttatatttgtttttcgggtttgcgcgttcgttcgttcgttttattagtcgaggacgcgggttttttatttcgttcggcggtttcggattttgagcgttttttttggttcgcggttttcgtttttgcgcgggtatcgtacggttaaattttagtttggaaaagatcgattaggagtcgcgtgtttttttgcgaaatattggaatcgggtgggatgggggcggggagttcggcgttgtcgttttttcgttttttttttttttttttatttcgcgcgtagagtggttgcgagaggcggtttttgtttttttttcgtaaaaagggggcggtcggttcggggtttcgagtttttcgttggttttcggttttttttttttaacgtttattttttttcggttatttacgaagttggggtttttaatacgtagatttttcggtagcggtggcgttaagtggggcgttgttttcgttttttatttttagttttttttttaagtcgttttaaataaatatattatttaaatagtagcgggttggtcgtattaataattttgaggta

SEQ ID NO: 38542 - DNA, 1154 bp, Artificial Sequence
  chemically treated genomic DNA (Homo sapiens) CpG-island No: 38542
tacctcaaaattattaatacgaccaacccgctactatttaaataatatatttatttaaaacgacttaaaaaaaaaactaaaaataaaaaacgaaaacaacgccccacttaacgccaccgctaccgaaaaatctacgtattaaaaaccccaacttcgtaaataaccgaaaaaaaataaacgttaaaaaaaaaaaaccgaaaaccaacgaaaaactcgaaaccccgaaccgaccgccccctttttacgaaaaaaaaacaaaaaccgcctctcgcaaccactctacgcgcgaaataaaaaaaaaaaaaaaaaacgaaaaaacgacaacgccgaactccccgcccccatcccacccgattccaatatttcgcaaaaaaacacgcgactcctaatcgatcttttccaaactaaaatttaaccgtacgatacccgcgcaaaaacgaaaaccgcgaaccaaaaaaaacgctcaaaatccgaaaccgccgaacgaaataaaaaacccgcgtcctcgactaataaaacgaacgaacgaacgcgcaaacccgaaaaacaaatataaaaaaaaaaacaaattaaaaataaccctctccgactaaaaaactcgcgcgcgctctctcgcctcgttcgataccaaaaaactccaaaaaaaataacgttaaaaaaaacaaaacgaaattccccctcctccgccgaacgaaatacccgcctacgcgccgcgattacacgtatacgaaaccgcgcgcccgaaccccctctacacccgatcgataaataccccctccccaaaaccgaacgcatctaacaataaccccccgcccgcaaccttacgcgactaaaaaaaaacgctccattattcattatttacgaacgttaataaatttaaaccacgaaaacgaaaaattaaaaaaaacgacgaaaacccaataaaaaccgaaacattaaaaaaaaaaataaaaaaaaaaaaaaaaaaacgaaaacgaaactataccgcgacctaaaaaaaaaaatctcgacctaaaacccgacgaaccgaacgcacctctccgtcaaatttctccacaccgccgaccgtcgaaactactcaaaacgccaaaaaaacaacacgaaccttaaattttactctcgacctctatccttcgcgtcctcgcccttaccga

SEQ ID NO: 38543 - DNA, 1154 bp, Artificial Sequence
  chemically treated genomic DNA (Homo sapiens) CpG-island No: 38543
tgttttaaagttgttggtacggttagttcgttgttgtttaaatggtgtgtttgtttagagcggtttagggagggaattggaaatggggggcgggggtagcgttttatttggcgttatcgttgtcggagggtttgcgtgttagaagttttagtttcgtaaatgatcgaagaagggtgggcgttgaggagggaaggtcgaaaattaacggagggttcggggtttcgggtcggtcgttttttttttgcggggggagagtaggagtcgtttttcgtagttattttgcgcgcggggtgggagggagagagggaggcgaagggacgatagcgtcgggtttttcgtttttattttattcggttttaatatttcgtagaaaggtacgcggtttttaatcggttttttttaggttgagatttagtcgtgcgatgttcgcgtaggggcgggggtcgcgggttaggggaggcgtttagagttcggagtcgtcgagcgaggtgaggagttcgcgttttcggttggtggagcgggcgggcgggcgcgtaaattcgagaggtagatatagaaaggggggtaggttaaaaataatttttttcggttgggaagttcgcgcgcgttttttcgtttcgttcggtgttagaggattttaggggaggtggcgttggggagggtagagcgggattttttttttttcgtcgggcggggtgttcgtttgcgcgtcgcggttgtacgtgtgcggggtcgcgcgttcgggttttttttgtattcggtcggtgggtgttttttttttaggatcgggcgtatttggtagtggtttttcgttcgtagttttgcgcggttggagggaagcgttttattatttattatttacgagcgttaataggtttgagttacgggggcggggggttggggggggcgacgaggatttagtggggatcgaagtattagaagaagggatagggagggagggggaagggcgggggcggggttgtgtcgcggtttggaggaagaggtttcggtttggggttcggcgagtcgggcgtattttttcgttaggtttttttatatcgtcggtcgtcgaggttgtttagggcgttaagagggtagtacgggttttagattttgttttcggtttttgtttttcgcgttttcgtttttatcga

SEQ ID NO: 38544 - DNA, 1154 bp, Artificial Sequence
  chemically treated genomic DNA (Homo sapiens) CpG-island No: 38544
tcgataaaaacgaaaacgcgaaaaacaaaaaccgaaaacaaaatctaaaacccgtactaccctcttaacgccctaaacaacctcgacgaccgacgatataaaaaaacctaacgaaaaaatacgcccgactcgccgaaccccaaaccgaaacctcttcctccaaaccgcgacacaaccccgcccccgcccttccccctccctccctatcccttcttctaatacttcgatccccactaaatcctcgtcgccccccccaaccccccgcccccgtaactcaaacctattaacgctcgtaaataataaataataaaacgcttccctccaaccgcgcaaaactacgaacgaaaaaccactaccaaatacgcccgatcctaaaaaaaaaacacccaccgaccgaatacaaaaaaaacccgaacgcgcgaccccgcacacgtacaaccgcgacgcgcaaacgaacaccccgcccgacgaaaaaaaaaaaatcccgctctaccctccccaacgccacctcccctaaaatcctctaacaccgaacgaaacgaaaaaacgcgcgcgaacttcccaaccgaaaaaaattatttttaacctacccccctttctatatctacctctcgaatttacgcgcccgcccgcccgctccaccaaccgaaaacgcgaactcctcacctcgctcgacgactccgaactctaaacgcctcccctaacccgcgacccccgcccctacgcgaacatcgcacgactaaatctcaacctaaaaaaaaccgattaaaaaccgcgtacctttctacgaaatattaaaaccgaataaaataaaaacgaaaaacccgacgctatcgtcccttcgcctccctctctccctcccaccccgcgcgcaaaataactacgaaaaacgactcctactctccccccgcaaaaaaaaaacgaccgacccgaaaccccgaaccctccgttaattttcgaccttccctcctcaacgcccacccttcttcgatcatttacgaaactaaaacttctaacacgcaaaccctccgacaacgataacgccaaataaaacgctacccccgccccccatttccaattccctccctaaaccgctctaaacaaacacaccatttaaacaacaacgaactaaccgtaccaacaactttaaaaca

SEQ ID NO: 38545 - DNA, 975 bp, Artificial Sequence
  chemically treated genomic DNA (Homo sapiens) CpG-island No: 38545
ggtcgcgtcgttttttgtttaaattagagattatttttatttgttaagggttttttaaatttttcgtttttaggtcgttaacgattatcgttttagttttagttttaggcgtcgtttggcggttgttttcggaagtcgtttgcgagtttcggggttttgatcgttgttgggtttgttcgtagatttgtttgattttagcgaatttggtttcgttttttttttattatacgttgaggattttaagacggcgatgaaagggttgaggttgtggcgacgggggcgtttagcggtatttttatttttttaaggatggcggaattaggtcgttgtcgggtagttttcgattcggaagtcgttcgcggcgcgaggttttcgttgtcgagcgcgggcgcggggggcggagttcggcggagacggggaaggggtcgtcgtggttgtcggttttcgagttgggggttgtcgcggatattgttaggtagacggcgagtatcgagcgcgggtggtcgcggtgttcgtgggttacgtttagttgcggttagaggcgatatgagtgtcgcggggttgttggtttcggtttcggtttaggttggagcgtcgtcggttttcgagtattatttcgaggaggatgaagagttggagagcgtcgaggacgacgagcgtagttgtcggggtcgcgagtcggacgaaggtgagttttgtcgttcgttcggtcgttcggagcggaggtgggatcgttgggggagggggtggggttgttcgggagaggggcggggcggttttcggggtttggggttgcgtggaggggtcgtcgggagttgcggggttcggggaagttatttttattcgtgttggagtagcggggaagttttgggtgcgttatattcgatcgtgatggggagaggggatttagatgttgttacgttgggggtttttttaagatttcgtttttttttttagtcgtttttgattgaattt

SEQ ID NO: 38546 - DNA, 975 bp, Artificial Sequence
  chemically treated genomic DNA (Homo sapiens) CpG-island No: 38546
aaattcaatcaaaaacgactaaaaaaaaaaacgaaatcttaaaaaaacccccaacgtaacaacatctaaatcccctctccccatcacgatcgaatataacgcacccaaaacttccccgctactccaacacgaataaaaataacttccccgaaccccgcaactcccgacgacccctccacgcaaccccaaaccccgaaaaccgccccgcccctctcccgaacaaccccaccccctcccccaacgatcccacctccgctccgaacgaccgaacgaacgacaaaactcaccttcgtccgactcgcgaccccgacaactacgctcgtcgtcctcgacgctctccaactcttcatcctcctcgaaataatactcgaaaaccgacgacgctccaacctaaaccgaaaccgaaaccaacaaccccgcgacactcatatcgcctctaaccgcaactaaacgtaacccacgaacaccgcgaccacccgcgctcgatactcgccgtctacctaacaatatccgcgacaacccccaactcgaaaaccgacaaccacgacgaccccttccccgtctccgccgaactccgccccccgcgcccgcgctcgacaacgaaaacctcgcgccgcgaacgacttccgaatcgaaaactacccgacaacgacctaattccgccatccttaaaaaaataaaaataccgctaaacgcccccgtcgccacaacctcaaccctttcatcgccgtcttaaaatcctcaacgtataataaaaaaaaaacgaaaccaaattcgctaaaatcaaacaaatctacgaacaaacccaacaacgatcaaaaccccgaaactcgcaaacgacttccgaaaacaaccgccaaacgacgcctaaaactaaaactaaaacgataatcgttaacgacctaaaaacgaaaaatttaaaaaacccttaacaaataaaaataatctctaatttaaacaaaaaacgacgcgacc

SEQ ID NO: 38547 - DNA, 975 bp, Artificial Sequence
  chemically treated genomic DNA (Homo sapiens) CpG-island No: 38547
aggtttaattagaaacggttgggagggaggacggggttttaaagggatttttagcgtgataatatttaagttttttttttttattacggtcgagtgtaacgtatttagggttttttcgttattttagtacggatgggggtaattttttcgagtttcgtaattttcggcggtttttttacgtagttttaggtttcggaggtcgtttcgtttttttttcgaatagttttatttttttttttagcggttttattttcgtttcgggcggtcgggcgagcggtaggatttattttcgttcgattcgcggtttcgatagttgcgttcgtcgttttcggcgttttttagttttttatttttttcggggtagtattcgggggtcggcggcgttttagtttgggtcggggtcggggttagtagtttcgcggtatttatgtcgtttttgatcgtagttgagcgtggtttacggatatcgcggttattcgcgttcggtattcgtcgtttgtttagtagtgttcgcggtagtttttaattcgaggatcggtagttacggcgatttttttttcgttttcgtcgagtttcgtttttcgcgttcgcgttcggtaacgggggtttcgcgtcgcgagcgattttcgggtcgagagttgttcgataacggtttgatttcgttatttttgggggagtggagatgtcgttggacgttttcgtcgttataattttagtttttttatcgtcgttttaaaatttttaacgtatagtgggggaggggcggagttaggttcgttagagttaggtaaatttacgggtaggtttagtagcggttaggatttcgaggttcgtaggcgattttcggagatagtcgttaggcggcgtttggagttagaattaaagcggtgatcgttagcgatttaggggcggagggtttgaagggtttttggtaggtggaggtggtttttaatttaagtagggaacgacgcgatt

SEQ ID NO: 38548 - DNA, 975 bp, Artificial Sequence
  chemically treated genomic DNA (Homo sapiens) CpG-island No: 38548
aatcgcgtcgttccctacttaaattaaaaaccacctccacctaccaaaaacccttcaaaccctccgcccctaaatcgctaacgatcaccgctttaattctaactccaaacgccgcctaacgactatctccgaaaatcgcctacgaacctcgaaatcctaaccgctactaaacctacccgtaaatttacctaactctaacgaacctaactccgcccctcccccactatacgttaaaaattttaaaacgacgataaaaaaactaaaattataacgacgaaaacgtccaacgacatctccactcccccaaaaataacgaaatcaaaccgttatcgaacaactctcgacccgaaaatcgctcgcgacgcgaaacccccgttaccgaacgcgaacgcgaaaaacgaaactcgacgaaaacgaaaaaaaaatcgccgtaactaccgatcctcgaattaaaaactaccgcgaacactactaaacaaacgacgaataccgaacgcgaataaccgcgatatccgtaaaccacgctcaactacgatcaaaaacgacataaataccgcgaaactactaaccccgaccccgacccaaactaaaacgccgccgacccccgaatactaccccgaaaaaaataaaaaactaaaaaacgccgaaaacgacgaacgcaactatcgaaaccgcgaatcgaacgaaaataaatcctaccgctcgcccgaccgcccgaaacgaaaataaaaccgctaaaaaaaaaaataaaactattcgaaaaaaaaacgaaacgacctccgaaacctaaaactacgtaaaaaaaccgccgaaaattacgaaactcgaaaaaattacccccatccgtactaaaataacgaaaaaaccctaaatacgttacactcgaccgtaataaaaaaaaaaaacttaaatattatcacgctaaaaatccctttaaaaccccgtcctccctcccaaccgtttctaattaaacct

SEQ ID NO: 38549 - DNA, 706 bp, Artificial Sequence
  chemically treated genomic DNA (Homo sapiens) CpG-island No: 38549
gtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgttggggtcggatcgtgaaacgttgttgtgcggtgtgaaagcgttgtttgtcggttatgaggtttttgggttggtgatcggatttgtgggggttgggggtcgtatcgggtttgcgtttttcggttagggtggttaggggttggggatgggtcgggggttttatcggttttttcggggttcgttgttgtttggaaaaatttggtcgatttgaatgtttttt

SEQ ID NO: 38550 - DNA, 706 bp, Artificial Sequence
  chemically treated genomic DNA (Homo sapiens) CpG-island No: 38550
aaaaaacattcaaatcgaccaaatttttccaaacaacaacgaaccccgaaaaaaccgataaaacccccgacccatccccaacccctaaccaccctaaccgaaaaacgcaaacccgatacgacccccaacccccacaaatccgatcaccaacccaaaaacctcataaccgacaaacaacgctttcacaccgcacaacaacgtttcacgatccgaccccaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccac

SEQ ID NO: 38551 - DNA, 706 bp, Artificial Sequence
  chemically treated genomic DNA (Homo sapiens) CpG-island No: 38551
aaaaggtatttaggtcggttaagtttttttaggtaatagcgaatttcgaaaaagtcggtaaagttttcggtttatttttagtttttgattattttgatcggaaaacgtaaattcgatgcggtttttagtttttatagattcggttattaatttagaagttttatgatcggtagatagcgtttttatatcgtataataacgttttacggttcgattttagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattat

SEQ ID NO: 38552 - DNA, 706 bp, Artificial Sequence
  chemically treated genomic DNA (Homo sapiens) CpG-island No: 38552
ataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatactaaaatcgaaccgtaaaacgttattatacgatataaaaacgctatctaccgatcataaaacttctaaattaataaccgaatctataaaaactaaaaaccgcatcgaatttacgttttccgatcaaaataatcaaaaactaaaaataaaccgaaaactttaccgactttttcgaaattcgctattacctaaaaaaacttaaccgacctaaatacctttt

SEQ ID NO: 38553 - DNA, 575 bp, Artificial Sequence
  chemically treated genomic DNA (Homo sapiens) CpG-island No: 38553
gtcggtttcgttttgttttcgttcgcgttgtcgtttttcgtttttttttttcgtcgtttttttcgttttcgtttttttttttttttttttcgtttcgtttttttttttttttttttttcggtcgtttttttttttttttttttttttttttttgttttttcgtcgtttcgttttttttttttttcgttttttgttgttcggttgtgcgttttttttttgttttttgtgttttgtttttgtcgttttttttttttcgtttttttttttttttcgtttttttttttttgggttttttttcgtttttttttgttttttttttcgtttttttttttttttttttcggttttttcgttttttttttgtttttttcgtttcggttcgttttttgttcgttttttttttttttgttcgtttttttcgttcgtttttcgtttttttttcggtttttcgtttttttttttttttttttttgttgttttttttttgttttttttttttttttttttttttgtttttcgtttgtttgttttcgtttttcgtttttttttttttcgtttttttttcgtgtgtgtttt

SEQ ID NO: 38554 - DNA, 575 bp, Artificial Sequence
  chemically treated genomic DNA (Homo sapiens) CpG-island No: 38554
aaaacacacacgaaaaaaaaacgaaaaaaaaaaaaacgaaaaacgaaaacaaacaaacgaaaaacaaaaaaaaaaaaaaaaaaaaaaaacaaaaaaaaaacaacaaaaaaaaaaaaaaaaaaaaacgaaaaaccgaaaaaaaaacgaaaaacgaacgaaaaaaacgaacaaaaaaaaaaaaaacgaacaaaaaacgaaccgaaacgaaaaaaacaaaaaaaaaacgaaaaaaccgaaaaaaaaaaaaaaaaaaacgaaaaaaaaaacaaaaaaaaacgaaaaaaaacccaaaaaaaaaaaaacgaaaaaaaaaaaaaaacgaaaaaaaaaaaacgacaaaaacaaaacacaaaaaacaaaaaaaaaacgcacaaccgaacaacaaaaaacgaaaaaaaaaaaaaacgaaacgacgaaaaaacaaaaaaaaaaaaaaaaaaaaaaaaaaaaacgaccgaaaaaaaaaaaaaaaaaaaaacgaaacgaaaaaaaaaaaaaaaaaaacgaaaacgaaaaaaacgacgaaaaaaaaaaacgaaaaacgacaacgcgaacgaaaacaaaacgaaaccgac

SEQ ID NO: 38555 - DNA, 575 bp, Artificial Sequence
  chemically treated genomic DNA (Homo sapiens) CpG-island No: 38555
aagatatatacgaaaagagagcgagggaaagggagacggagaacggagatagatagacgaaaagtagaaagagaggagggagggaagaatagagaaagggtaataggagggagaaagagaagagacgagaggtcggagagagggcgaagggcgaacgggggaggcgggtagaaggagaagaggcggataagaaacggatcggagcgaaagaagtaagggaggggcgaaaaggtcgggggggaaggagaggggaacgaaggagggagtaaagagaaacggaggaggatttaggggagaaggagcggaggagggaggggaacggaagagaggaaacgatagaggtagggtataagaagtaaaggggaaacgtatagtcgggtagtaagagacgggggaggaggaggacgaggcggcgaaggagtaaaggagaggagagaagggggaaagaaggcgatcgggggggaggaaaaaaggagagcggggcggaaggggaaggggggggggcggaggcggagggggcgacggggaaggggagcgggaagcggtagcgcgagcgagggtaagacggggtcggt

SEQ ID NO: 38556 - DNA, 575 bp, Artificial Sequence
  chemically treated genomic DNA (Homo sapiens) CpG-island No: 38556
accgaccccgtcttaccctcgctcgcgctaccgcttcccgctccccttccccgtcgccccctccgcctccgccccccccccttccccttccgccccgctctccttttttcctcccccccgatcgccttctttcccccttctctcctctcctttactccttcgccgcctcgtcctcctcctcccccgtctcttactacccgactatacgtttcccctttacttcttataccctacctctatcgtttcctctcttccgttcccctccctcctccgctccttctcccctaaatcctcctccgtttctctttactccctccttcgttcccctctccttcccccccgaccttttcgcccctcccttacttctttcgctccgatccgtttcttatccgcctcttctccttctacccgcctcccccgttcgcccttcgccctctctccgacctctcgtctcttctctttctccctcctattaccctttctctattcttccctccctcctctctttctacttttcgtctatctatctccgttctccgtctccctttccctcgctctcttttcgtatatatctt

SEQ ID NO: 38557 - DNA, 647 bp, Artificial Sequence
  chemically treated genomic DNA (Homo sapiens) CpG-island No: 38557
tcggttaagtcgaatatcggttatacgtaagcggcggcgggtgtggttggtgtgattaagatggtgatggcgatgcggtacgggtagttgttacgttcgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgttggggtcggatcgtgaaacgttgttgtgcggtgtgaaagcgttgtttgtcggatatgaggttttttggttgatgatcgaatttgtgagggtttgggggtcgtatacgatttgtgatttttcgaataggatgtattaatgatttggagatgagatcgaagagttttatcg

SEQ ID NO: 38558 - DNA, 647 bp, Artificial Sequence
  chemically treated genomic DNA (Homo sapiens) CpG-island No: 38558
cgataaaactcttcgatctcatctccaaatcattaatacatcctattcgaaaaatcacaaatcgtatacgacccccaaaccctcacaaattcgatcatcaaccaaaaaacctcatatccgacaaacaacgctttcacaccgcacaacaacgtttcacgatccgaccccaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgaacgtaacaactacccgtaccgcatcgccatcaccatcttaatcacaccaaccacacccgccgccgcttacgtataaccgatattcgacttaaccga

SEQ ID NO: 38559 - DNA, 647 bp, Artificial Sequence
  chemically treated genomic DNA (Homo sapiens) CpG-island No: 38559
cggtaaagtttttcggttttatttttaagttattggtgtattttgttcgaaaaattataaatcgtatgcggtttttaggtttttatagattcggttattaattaagaagttttatgttcggtagatagcgtttttatatcgtataataacgttttacggttcgattttagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgagcgtggtagttgttcgtgtcgtatcgttattattattttgattatattagttatattcgtcgtcgtttgcgtatgatcgatgttcgatttgatcga

SEQ ID NO: 38560 - DNA, 647 bp, Artificial Sequence
  chemically treated genomic DNA (Homo sapiens) CpG-island No: 38560
tcgatcaaatcgaacatcgatcatacgcaaacgacgacgaatataactaatataatcaaaataataataacgatacgacacgaacaactaccacgctcgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatactaaaatcgaaccgtaaaacgttattatacgatataaaaacgctatctaccgaacataaaacttcttaattaataaccgaatctataaaaacctaaaaaccgcatacgatttataatttttcgaacaaaatacaccaataacttaaaaataaaaccgaaaaactttaccg

SEQ ID NO: 38561 - DNA, 576 bp, Artificial Sequence
  chemically treated genomic DNA (Homo sapiens) CpG-island No: 38561
cgcgtataggtttagggcgtgcgcggggttcgagaagggaagtacggttagggggtcggtcgttttatggcgttttcgataggttgtcgaggacgtcgcggtcggggttgcgagagacgcggcgtttaggtatcgttgttataaataggcgggcgcgcggttttcgaggggcgggatgggcggggagacgtttgtatcgtttttttaatttttttgtgtcgggcgttatttgttttcgcgagcgcgcgttcgttgtttttcgcgcggcgttcgttttcggtttcgtaggttgagttatcgttgttcgcggtcggtttttttttttcgtttttttgcgttttttcgttgacgttcgggtcgggatagcgagtgataagtgttaggttcgagggcggttttcgtcgtcgggatcgggggtttttcggggttgtttacgatttattcggttcggttgttgaatttaattcgggagaggcgagttcggttttgaaattaaagttatttttttttttacgttagattttttaagggcgtcggtttaggtttcggggcggttgggtataatggttttttgtt

SEQ ID NO: 38562 - DNA, 576 bp, Artificial Sequence
  chemically treated genomic DNA (Homo sapiens) CpG-island No: 38562
aacaaaaaaccattatacccaaccgccccgaaacctaaaccgacgcccttaaaaaatctaacgtaaaaaaaaaaataactttaatttcaaaaccgaactcgcctctcccgaattaaattcaacaaccgaaccgaataaatcgtaaacaaccccgaaaaacccccgatcccgacgacgaaaaccgccctcgaacctaacacttatcactcgctatcccgacccgaacgtcaacgaaaaaacgcaaaaaaacgaaaaaaaaaaaccgaccgcgaacaacgataactcaacctacgaaaccgaaaacgaacgccgcgcgaaaaacaacgaacgcgcgctcgcgaaaacaaataacgcccgacacaaaaaaattaaaaaaacgatacaaacgtctccccgcccatcccgcccctcgaaaaccgcgcgcccgcctatttataacaacgatacctaaacgccgcgtctctcgcaaccccgaccgcgacgtcctcgacaacctatcgaaaacgccataaaacgaccgaccccctaaccgtacttcccttctcgaaccccgcgcacgccctaaacctatacgcg

SEQ ID NO: 38563 - DNA, 576 bp, Artificial Sequence
  chemically treated genomic DNA (Homo sapiens) CpG-island No: 38563
aataaaaagttattgtatttagtcgtttcgggatttgggtcggcgtttttgggaagtttggcgtgaaaggaggggtggttttggttttagggtcgagttcgtttttttcgggttgggtttagtagtcgggtcgggtgggtcgtgggtaatttcgggaggttttcggtttcggcgacggaggtcgttttcggatttggtatttgttattcgttgtttcggttcgggcgttagcggggagacgtagaagggcggagggagggagtcggtcgcggatagcggtgatttagtttgcggagtcgggggcgggcgtcgcgcgggggatagcgaacgcgcgttcgcgggggtaggtggcgttcggtatagaggggttaagggggcggtgtagacgttttttcgtttatttcgtttttcgagagtcgcgcgttcgtttatttatagtagcggtgtttaggcgtcgcgtttttcgtagtttcggtcgcggcgttttcgataatttatcgaaggcgttatggagcgatcggttttttggtcgtgttttttttttcggatttcgcgtacgttttgagtttgtgcgcg

SEQ ID NO: 38564 - DNA, 576 bp, Artificial Sequence
  chemically treated genomic DNA (Homo sapiens) CpG-island No: 38564
cgcgcacaaactcaaaacgtacgcgaaatccgaaaaaaaaaacacgaccaaaaaaccgatcgctccataacgccttcgataaattatcgaaaacgccgcgaccgaaactacgaaaaacgcgacgcctaaacaccgctactataaataaacgaacgcgcgactctcgaaaaacgaaataaacgaaaaaacgtctacaccgcccccttaacccctctataccgaacgccacctacccccgcgaacgcgcgttcgctatcccccgcgcgacgcccgcccccgactccgcaaactaaatcaccgctatccgcgaccgactccctccctccgcccttctacgtctccccgctaacgcccgaaccgaaacaacgaataacaaataccaaatccgaaaacgacctccgtcgccgaaaccgaaaacctcccgaaattacccacgacccacccgacccgactactaaacccaacccgaaaaaaacgaactcgaccctaaaaccaaaaccacccctcctttcacgccaaacttcccaaaaacgccgacccaaatcccgaaacgactaaatacaataactttttatt

SEQ ID NO: 38565 - DNA, 536 bp, Artificial Sequence
  chemically treated genomic DNA (Homo sapiens) CpG-island No: 38565
ggcgttagcgttacgagcgtaggaaattataggttttaaaatgtagcgcggttaattcgtcgattcgcggtttcgagggcggtttggggtttgtcgggagttgtagtttcgaaaaatcgtaacgcgtttacgagtcgttcgggtaaaagaattatttgtagggttattgcgatttattgtttatttgttttcgcggcgaattttttagaatcggggttttttaggaatttaatcgattttagtcgagggtcgttattcgtttttagttgttagttagtttagagttttcgcgggtagaggcgcgtagtcggcgttgagtttattgtattttcgttttttattttcggttcgttgttttgtgttttcggcggaaattgttttttcgcggagggggttcgtttgtttttcggtttttttaggtttatacggcgttttgcgcgttttgtgttcggtttcgttggttagtgaattttatttttatcgtttataggtagaaatttggggtttcgttcgtttttttttttgatgttattttt

SEQ ID NO: 38566 - DNA, 536 bp, Artificial Sequence
  chemically treated genomic DNA (Homo sapiens) CpG-island No: 38566
aaaaataacatcaaaaaaaaaaacgaacgaaaccccaaatttctacctataaacgataaaaataaaattcactaaccaacgaaaccgaacacaaaacgcgcaaaacgccgtataaacctaaaaaaaccgaaaaacaaacgaaccccctccgcgaaaaaacaatttccgccgaaaacacaaaacaacgaaccgaaaataaaaaacgaaaatacaataaactcaacgccgactacgcgcctctacccgcgaaaactctaaactaactaacaactaaaaacgaataacgaccctcgactaaaatcgattaaattcctaaaaaaccccgattctaaaaaattcgccgcgaaaacaaataaacaataaatcgcaataaccctacaaataattcttttacccgaacgactcgtaaacgcgttacgatttttcgaaactacaactcccgacaaaccccaaaccgccctcgaaaccgcgaatcgacgaattaaccgcgctacattttaaaacctataatttcctacgctcgtaacgctaacgcc

SEQ ID NO: 38567 - DNA, 536 bp, Artificial Sequence
  chemically treated genomic DNA (Homo sapiens) CpG-island No: 38567
gggaatgatattaagggaggagacgggcgggattttagatttttgtttgtgggcgatggaagtgaggtttattggttagcggagtcggatatagaacgcgtaaaacgtcgtgtaggtttggaggagtcgaagagtaggcggatttttttcgcgggggaatagttttcgtcgggagtataaagtaacggatcggaagtggggggcggaagtgtagtgggtttagcgtcgattgcgcgtttttgttcgcgaaaattttgagttggttgatagttggggacgggtggcggttttcgattggagtcggttgagtttttgagggatttcggttttggaaggttcgtcgcggagataagtgagtagtgagtcgtagtgattttataagtggtttttttattcgagcggttcgtaggcgcgttgcggtttttcgaaattatagttttcggtaggttttaagtcgttttcggggtcgcgggtcggcggattggtcgcgttgtattttgggatttgtagttttttgcgttcgtggcgttggcgtt

SEQ ID NO: 38568 - DNA, 536 bp, Artificial Sequence
  chemically treated genomic DNA (Homo sapiens) CpG-island No: 38568
aacgccaacgccacgaacgcaaaaaactacaaatcccaaaatacaacgcgaccaatccgccgacccgcgaccccgaaaacgacttaaaacctaccgaaaactataatttcgaaaaaccgcaacgcgcctacgaaccgctcgaataaaaaaaccacttataaaatcactacgactcactactcacttatctccgcgacgaaccttccaaaaccgaaatccctcaaaaactcaaccgactccaatcgaaaaccgccacccgtccccaactatcaaccaactcaaaattttcgcgaacaaaaacgcgcaatcgacgctaaacccactacacttccgccccccacttccgatccgttactttatactcccgacgaaaactattcccccgcgaaaaaaatccgcctactcttcgactcctccaaacctacacgacgttttacgcgttctatatccgactccgctaaccaataaacctcacttccatcgcccacaaacaaaaatctaaaatcccgcccgtctcctcccttaatatcattccc

SEQ ID NO: 38569 - DNA, 782 bp, Artificial Sequence
  chemically treated genomic DNA (Homo sapiens) CpG-island No: 38569
tttttttttttttttttttatatttttttttcgttttcgtagttttttttttttttttttttttttttttaattttttttttttttttttttcgtttttttttttaattttttttttttttttttttgtttttttttttttttttttttcgtcgcgttcgtttttcgttcgttttcgttttttttattttttttttttttttttttcggtattgtagtattagtcgtttgtagtttcggtcgttatttgcgtttttttagttttcgtaggtttaatcgtcgttagtattatggttagtattattttcggtaggtttcggggttacgggttttgtggggcggcgggatttgagtagaggtttcgtttggtttcgtttggggtagcggtcggtagcggacgttaatttttttttttttattttgcgcgttgtaagtttgggttcgattcgttcgaggttggggtttgcggcgtcggcggggttggtggggcgttgggttgcgaggcgtcgcgtcggggagcgttcgggatcgggacgtcgggcgggggcgtttcgtttttgggggagtagcgtgttacgtagggcgcgattgtcgtagggtggtttttagattcgggcgtgggttcgcgatcgggtgggcgcgttcgcgatgtgcgggcggggtttttggggcgttcggcgattcgagatttgggttcgttagagttttcgtggggaggcggggagagggtgggattttttgttaaagttttagtcgggaattcggcgtttttcgcgttagtgt

SEQ ID NO: 38570 - DNA, 782 bp, Artificial Sequence
  chemically treated genomic DNA (Homo sapiens) CpG-island No: 38570
acactaacgcgaaaaacgccgaattcccgactaaaactttaacaaaaaatcccaccctctccccgcctccccacgaaaactctaacgaacccaaatctcgaatcgccgaacgccccaaaaaccccgcccgcacatcgcgaacgcgcccacccgatcgcgaacccacgcccgaatctaaaaaccaccctacgacaatcgcgccctacgtaacacgctactcccccaaaaacgaaacgcccccgcccgacgtcccgatcccgaacgctccccgacgcgacgcctcgcaacccaacgccccaccaaccccgccgacgccgcaaaccccaacctcgaacgaatcgaacccaaacttacaacgcgcaaaataaaaaaaaaaaaattaacgtccgctaccgaccgctaccccaaacgaaaccaaacgaaacctctactcaaatcccgccgccccacaaaacccgtaaccccgaaacctaccgaaaataatactaaccataatactaacgacgattaaacctacgaaaactaaaaaaacgcaaataacgaccgaaactacaaacgactaatactacaataccgaaaaaaaaaaaaaaaaaaaataaaaaaaacgaaaacgaacgaaaaacgaacgcgacgaaaaaaaaaaaaaaaaaaaaacaaaaaaaaaaaaaaaaaaaattaaaaaaaaaaacgaaaaaaaaaaaaaaaaaaaattaaaaaaaaaaaaaaaaaaaaaaaaaaaactacgaaaacgaaaaaaaaatataaaaaaaaaaaaaaaaaaa

SEQ ID NO: 38571 - DNA, 782 bp, Artificial Sequence
  chemically treated genomic DNA (Homo sapiens) CpG-island No: 38571
gtattggcgcggggagcgtcgggttttcggttggggttttggtagagggttttatttttttttcgtttttttacgaaggttttggcggatttagatttcgggtcgtcggacgttttagggatttcgttcgtatatcgcgagcgcgtttattcggtcgcgagtttacgttcgggtttgggagttattttgcggtagtcgcgttttgcgtggtacgttgtttttttaggggcgaggcgttttcgttcgacgtttcggtttcgagcgtttttcggcgcggcgtttcgtagtttagcgttttattagtttcgtcggcgtcgtagattttagtttcgggcgggtcgggtttaggtttgtaacgcgtagggtaggagaagggaaattggcgttcgttgtcggtcgttgttttaggcgaggttagacgaggtttttgtttagatttcgtcgttttataaagttcgtggtttcggagtttatcggaaatggtgttggttatggtgttggcggcggttgggtttgcggaggttggagaggcgtaagtggcggtcggagttgtagacggttggtgttgtagtgtcggggaggggaggggagaggagtggagggagcgagggcgggcgggaggcgggcgcggcgggagagagagagggagggagatagagggagagagagagagggttgggggaaggagcggggggaggagggagggagggttgggggaaggagagagagagagagagagattgcgggggcgggggaaggatgtaaggaggaagggagggaga

SEQ ID NO: 38572 - DNA, 782 bp, Artificial Sequence
  chemically treated genomic DNA (Homo sapiens) CpG-island No: 38572
tctccctcccttcctccttacatccttcccccgcccccgcaatctctctctctctctctctccttcccccaaccctccctccctcctccccccgctccttcccccaaccctctctctctctccctctatctccctccctctctctctcccgccgcgcccgcctcccgcccgccctcgctccctccactcctctcccctcccctccccgacactacaacaccaaccgtctacaactccgaccgccacttacgcctctccaacctccgcaaacccaaccgccgccaacaccataaccaacaccatttccgataaactccgaaaccacgaactttataaaacgacgaaatctaaacaaaaacctcgtctaacctcgcctaaaacaacgaccgacaacgaacgccaatttcccttctcctaccctacgcgttacaaacctaaacccgacccgcccgaaactaaaatctacgacgccgacgaaactaataaaacgctaaactacgaaacgccgcgccgaaaaacgctcgaaaccgaaacgtcgaacgaaaacgcctcgcccctaaaaaaacaacgtaccacgcaaaacgcgactaccgcaaaataactcccaaacccgaacgtaaactcgcgaccgaataaacgcgctcgcgatatacgaacgaaatccctaaaacgtccgacgacccgaaatctaaatccgccaaaaccttcgtaaaaaaacgaaaaaaaaataaaaccctctaccaaaaccccaaccgaaaacccgacgctccccgcgccaatac

SEQ ID NO: 38573 - DNA, 519 bp, Artificial Sequence
  chemically treated genomic DNA (Homo sapiens) CpG-island No: 38573
ttttcgggcggcgcggcgcgggcggcggtcggatttagggcgggggtcggcggttcggttagttcggttcggttcggggtcgcgttttgagagttagttttcgtcgttgtagtttcggcgttcggtcggtcggttatggagcgtttttcgtttcgcgtcgtcggtcgggattttagtgcgttgcgggtcgaggcgtcgtggttgcgcgcggagggttcggggtcgcgcgtcgcgttcgtgacggtgtttacgtcgtcgtaggtatcgggcgtcggtgggcgggggcgtcgattaagtttttttcgttgtaaagatggcgttagtgttgtttaaatttcgggttttcgggggcggggtagcggggagggcggtcgcgtcggttcgcgcgtgttcgtgggtttcgtcggggttgcgtcgggcggtcggggagtttttttcgtcgcgtcgggttgcgggcgtattaaaacgtaggtattatttatttttttttattttaaattttattttatgatttttttt

SEQ ID NO: 38574 - DNA, 519 bp, Artificial Sequence
  chemically treated genomic DNA (Homo sapiens) CpG-island No: 38574
aaaaaaaatcataaaataaaatttaaaataaaaaaaaataaataatacctacgttttaatacgcccgcaacccgacgcgacgaaaaaaactccccgaccgcccgacgcaaccccgacgaaacccacgaacacgcgcgaaccgacgcgaccgccctccccgctaccccgcccccgaaaacccgaaatttaaacaacactaacgccatctttacaacgaaaaaaacttaatcgacgcccccgcccaccgacgcccgatacctacgacgacgtaaacaccgtcacgaacgcgacgcgcgaccccgaaccctccgcgcgcaaccacgacgcctcgacccgcaacgcactaaaatcccgaccgacgacgcgaaacgaaaaacgctccataaccgaccgaccgaacgccgaaactacaacgacgaaaactaactctcaaaacgcgaccccgaaccgaaccgaactaaccgaaccgccgacccccgccctaaatccgaccgccgcccgcgccgcgccgcccgaaaa

SEQ ID NO: 38575 - DNA, 519 bp, Artificial Sequence
  chemically treated genomic DNA (Homo sapiens) CpG-island No: 38575
agaaggaattataaaataaaatttggaataaaaaggaatagatggtgtttgcgttttgatacgttcgtagttcggcgcggcgggaagggtttttcggtcgttcggcgtagtttcggcgggatttacggatacgcgcggatcgacgcggtcgtttttttcgttgtttcgttttcgggggttcgaagtttgggtagtattgacgttatttttgtagcgagagaaatttggtcggcgttttcgtttatcggcgttcggtatttgcggcggcgtgggtatcgttacgggcgcggcgcgcggtttcggatttttcgcgcgtagttacggcgtttcggttcgtagcgtattggggtttcggtcggcggcgcggggcggggggcgttttatggtcggtcggtcgggcgtcgaggttgtagcggcgagggttgatttttaggacgcggtttcgggtcgggtcgggttggtcgggtcgtcgattttcgttttggattcggtcgtcgttcgcgtcgcgtcgttcggagg

SEQ ID NO: 38576 - DNA, 519 bp, Artificial Sequence
  chemically treated genomic DNA (Homo sapiens) CpG-island No: 38576
cctccgaacgacgcgacgcgaacgacgaccgaatccaaaacgaaaatcgacgacccgaccaacccgacccgacccgaaaccgcgtcctaaaaatcaaccctcgccgctacaacctcgacgcccgaccgaccgaccataaaacgccccccgccccgcgccgccgaccgaaaccccaatacgctacgaaccgaaacgccgtaactacgcgcgaaaaatccgaaaccgcgcgccgcgcccgtaacgatacccacgccgccgcaaataccgaacgccgataaacgaaaacgccgaccaaatttctctcgctacaaaaataacgtcaatactacccaaacttcgaacccccgaaaacgaaacaacgaaaaaaacgaccgcgtcgatccgcgcgtatccgtaaatcccgccgaaactacgccgaacgaccgaaaaacccttcccgccgcgccgaactacgaacgtatcaaaacgcaaacaccatctattcctttttattccaaattttattttataattccttct

SEQ ID NO: 38577 - DNA, 753 bp, Artificial Sequence
  chemically treated genomic DNA (Homo sapiens) CpG-island No: 38577
cggggtggtttttatgggtcgcgtttttgcgggtcgggtgtttgcggggtggtttttgggaatcgcgtttttgcgggtcgggtgtttgcggggtggtttttggggatcgcgtttttgcgggtcgggtgtttgcggggtggtttttggggatcgcgtttttgcgggtcgggtgtttgcggggtggtttttgtgggtcgcgtttttgtggggtggtttttgtgggtcgcgtttttgtggggtggtttttgcgggtcgcgtggtggtttttgcgggtcgggtgtttgcggggtggtttttgtgggtcgcgtttttgcgggtcgggtgtttgcggggtggtttttgcgggtcgtatttttgcggcgtggttttttcgggatgggtttatcgaggaggtcgttggaggtcgagttcgcgttcgttcgcggcgttaagatggaggtaggaagcgtcgtcgttcgcgttcgttatcgttcgcgtcgttcgtttgacgtcgtcgttgcgtttgacgtcgtcgttcgcgcggtcgttttttcgtcggttttttttttttttcgtcgtaacgttttgacgtttcgtagggatttttgattggacggcggcgcgtgagcggagcgagaggtttcgtcgcgggggggtcgcgggttcgtcggcgtcgtttatttggggtcgcgtcgggtttgtttaggtattcggcgggggcggcggcgtcgggagttgcggcggcggcgggcggcggcggcggtcgcgggtttt

SEQ ID NO: 38578 - DNA, 753 bp, Artificial Sequence
  chemically treated genomic DNA (Homo sapiens) CpG-island No: 38578
aaaacccgcgaccgccgccgccgcccgccgccgccgcaactcccgacgccgccgcccccgccgaatacctaaacaaacccgacgcgaccccaaataaacgacgccgacgaacccgcgacccccccgcgacgaaacctctcgctccgctcacgcgccgccgtccaatcaaaaatccctacgaaacgtcaaaacgttacgacgaaaaaaaaaaaaaaccgacgaaaaaacgaccgcgcgaacgacgacgtcaaacgcaacgacgacgtcaaacgaacgacgcgaacgataacgaacgcgaacgacgacgcttcctacctccatcttaacgccgcgaacgaacgcgaactcgacctccaacgacctcctcgataaacccatcccgaaaaaaccacgccgcaaaaatacgacccgcaaaaaccaccccgcaaacacccgacccgcaaaaacgcgacccacaaaaaccaccccgcaaacacccgacccgcaaaaaccaccacgcgacccgcaaaaaccaccccacaaaaacgcgacccacaaaaaccaccccacaaaaacgcgacccacaaaaaccaccccgcaaacacccgacccgcaaaaacgcgatccccaaaaaccaccccgcaaacacccgacccgcaaaaacgcgatccccaaaaaccaccccgcaaacacccgacccgcaaaaacgcgattcccaaaaaccaccccgcaaacacccgacccgcaaaaacgcgacccataaaaaccaccccg

SEQ ID NO: 38579 - DNA, 753 bp, Artificial Sequence
  chemically treated genomic DNA (Homo sapiens) CpG-island No: 38579
gaagttcgcggtcgtcgtcgtcgttcgtcgtcgtcgtagttttcgacgtcgtcgttttcgtcgggtgtttaagtaggttcggcgcggttttaggtaagcggcgtcggcgagttcgcggttttttcgcggcgaggtttttcgtttcgtttacgcgtcgtcgtttagttaggggtttttgcggagcgttaggacgttacggcggggggaggggagggtcggcggaggggcggtcgcgcgggcggcggcgttaggcgtaacggcggcgttaggcgggcggcgcgggcggtggcgggcgcgggcggcggcgttttttgtttttattttggcgtcgcgggcgggcgcgggttcggtttttagcggttttttcggtggatttatttcggggggattacgtcgtaggggtgcgattcgtagggattatttcgtaggtattcgattcgtagggacgcgatttatagggattatttcgtaggtattcgattcgtaggggttattacgcgattcgtaggggttattttatagggacgcgatttatagggattattttatagggacgcgatttataaggattatttcgtaggtattcgattcgtagggacgcgatttttaggggttatttcgtaggtattcgattcgtagggacgcgatttttaggggttatttcgtaggtattcgattcgtagggacgcgatttttaggggttatttcgtaggtattcgattcgtagggacgcgatttatagggattatttcg

SEQ ID NO: 38580 - DNA, 753 bp, Artificial Sequence
  chemically treated genomic DNA (Homo sapiens) CpG-island No: 38580
cgaaataatccctataaatcgcgtccctacgaatcgaatacctacgaaataacccctaaaaatcgcgtccctacgaatcgaatacctacgaaataacccctaaaaatcgcgtccctacgaatcgaatacctacgaaataacccctaaaaatcgcgtccctacgaatcgaatacctacgaaataatccttataaatcgcgtccctataaaataatccctataaatcgcgtccctataaaataacccctacgaatcgcgtaataacccctacgaatcgaatacctacgaaataatccctataaatcgcgtccctacgaatcgaatacctacgaaataatccctacgaatcgcacccctacgacgtaatccccccgaaataaatccaccgaaaaaaccgctaaaaaccgaacccgcgcccgcccgcgacgccaaaataaaaacaaaaaacgccgccgcccgcgcccgccaccgcccgcgccgcccgcctaacgccgccgttacgcctaacgccgccgcccgcgcgaccgcccctccgccgaccctcccctccccccgccgtaacgtcctaacgctccgcaaaaacccctaactaaacgacgacgcgtaaacgaaacgaaaaacctcgccgcgaaaaaaccgcgaactcgccgacgccgcttacctaaaaccgcgccgaacctacttaaacacccgacgaaaacgacgacgtcgaaaactacgacgacgacgaacgacgacgacgaccgcgaacttc

SEQ ID NO: 38581 - DNA, 536 bp, Artificial Sequence
  chemically treated genomic DNA (Homo sapiens) CpG-island No: 38581
atagggagattattgtcggggggggggtaaaaaatcgtcgggcgattagatagaaaaaataagaatagggacgggggggcggtacggggggggtggtggcgtgatatttaggcggggagacgaggaagtttcggcgcggaaaaagatgaggtacggagacgggagaaggcgtgcgaagttgcgaatagaatcggggttgggcggggaagggcggtatacgttttgataggagaggaattggggtattttatgggggaggggggggcgatagttcggcgtgggatagggggtcgtaacgtttcgaatttatttaagatcgcggatgcgttattaaataaaagttttcgagggaacgtgacggacgataggaaaagagggggcggggtttaggaggagaggttggaaaataattcgcgcgttgaggagggtacgggtttcggcgcgtcggggagacgtaggcggcgttgtaattgcgtcgggagatgtgttagcggatttattgtcgcgattttttgagtatattcgtatttgttgtt

SEQ ID NO: 38582 - DNA, 536 bp, Artificial Sequence
  chemically treated genomic DNA (Homo sapiens) CpG-island No: 38582
aacaacaaatacgaatatactcaaaaaatcgcgacaataaatccgctaacacatctcccgacgcaattacaacgccgcctacgtctccccgacgcgccgaaacccgtaccctcctcaacgcgcgaattattttccaacctctcctcctaaaccccgccccctcttttcctatcgtccgtcacgttccctcgaaaacttttatttaataacgcatccgcgatcttaaataaattcgaaacgttacgaccccctatcccacgccgaactatcgcccccccctcccccataaaataccccaattcctctcctatcaaaacgtataccgcccttccccgcccaaccccgattctattcgcaacttcgcacgccttctcccgtctccgtacctcatctttttccgcgccgaaacttcctcgtctccccgcctaaatatcacgccaccaccccccccgtaccgcccccccgtccctattcttattttttctatctaatcgcccgacgattttttaccccccccccgacaataatctccctat

SEQ ID NO: 38583 - DNA, 536 bp, Artificial Sequence
  chemically treated genomic DNA (Homo sapiens) CpG-island No: 38583
gatagtaagtacgaatatatttaaagaatcgcggtaatgggttcgttgatatatttttcggcgtagttgtagcgtcgtttgcgttttttcggcgcgtcggagttcgtgttttttttagcgcgcgggttgttttttagtttttttttttgaatttcgttttttttttttttgtcgttcgttacgttttttcgggagtttttgtttggtaacgtattcgcggttttgggtagattcgagacgttgcgattttttattttacgtcggattgtcgttttttttttttttataggatgttttagttttttttttgttagagcgtgtatcgttttttttcgtttagtttcgattttattcgtaatttcgtacgttttttttcgttttcgtgttttattttttttcgcgtcgggattttttcgttttttcgtttaggtattacgttattatttttttcgtgtcgttttttcgtttttatttttattttttttgtttgatcgttcggcgattttttatttttttttcggtagtagtttttttgt

SEQ ID NO: 38584 - DNA, 536 bp, Artificial Sequence
  chemically treated genomic DNA (Homo sapiens) CpG-island No: 38584
acaaaaaaactactaccgaaaaaaaaataaaaaatcgccgaacgatcaaacaaaaaaaataaaaataaaaacgaaaaaacgacacgaaaaaaataataacgtaatacctaaacgaaaaaacgaaaaaatcccgacgcgaaaaaaaataaaacacgaaaacgaaaaaaaacgtacgaaattacgaataaaatcgaaactaaacgaaaaaaaacgatacacgctctaacaaaaaaaaaactaaaacatcctataaaaaaaaaaaaaacgacaatccgacgtaaaataaaaaatcgcaacgtctcgaatctacccaaaaccgcgaatacgttaccaaacaaaaactcccgaaaaaacgtaacgaacgacaaaaaaaaaaaaaacgaaattcaaaaaaaaaaactaaaaaacaacccgcgcgctaaaaaaaacacgaactccgacgcgccgaaaaaacgcaaacgacgctacaactacgccgaaaaatatatcaacgaacccattaccgcgattctttaaatatattcgtacttactatc

SEQ ID NO: 38585 - DNA, 1099 bp, Artificial Sequence
  chemically treated genomic DNA (Homo sapiens) CpG-island No: 38585
taggcgcgttttttttttcggggttttatgtgtcgtcggttttcggacggtaaattagggttcgggtgggggcgatggggggttcgcggtttcggtgtttttggttagtttcggaggcgtacgggttaggtcgcggggcgagaagcgagcgcgggagggcggtagttggcggagcgggaagggagcggggcggttgcggttgcggcgcggaggagcgttatttacgttcgggttcgcgttaggcgttgacgtgggcggttttgtttcggttttcgggttcgtagggttttcggggcggacggcgttttcgttagcggcgttgagttcggttcgattttgttcgattttttcggggataggcggtttagaacgtgcggaatattaggttcggggttttcgtcgggttgtagtttcgcgagtttttcgttaggttttcgtttcgtttcgtttcgtagtcgcgtttcggtcgggcgggttttgagtcgttcgcgtgagttcgtgcgtcgttcgcgttgggaattaggagattaatcgcgaggtttcgttcgcgcgcgtcgtcgtgttttcgttcgcgcggtcgtcggagcgcggtttagcggcgcggcggagattcggtacggcggcggttaggcgtaggcgggcgggcggagtagcggacggcgtcgaggtcgttttacgcgtcgggttcgcggcggcgtagcgcgtcggagtggtcggggttcgcggtcgttcgcgtttttcgatgggtagttcgtatttgtttaataagggtttgtcgtttggtaaggtcgcgcgcgcgcgcgttttcggtcgcgggcgggggcggggcggggcgggtgtcgcgcgggcggggggcgcgggggcggatcgagcgcgcgttcgcgggtcgtcggttttgtgtgcgagtgcgcgtgcgcgtcggcgttcgcgcgtggtcgcggtcgggggcgggatcgcgggaagggttttgcgtatgcgcgggtcgttgcgtgtgcgcgagcgtcgtagtttgtttttttcgttcgcggttcgtgtaggtgatataaaagggtttgtgggtttttgggttgtttcgtcggatttttagttttatcgattt

SEQ ID NO: 38586 - DNA, 1099 bp, Artificial Sequence
  chemically treated genomic DNA (Homo sapiens) CpG-island No: 38586
aaatcgataaaactaaaaatccgacgaaacaacccaaaaacccacaaacccttttatatcacctacacgaaccgcgaacgaaaaaaacaaactacgacgctcgcgcacacgcaacgacccgcgcatacgcaaaacccttcccgcgatcccgcccccgaccgcgaccacgcgcgaacgccgacgcgcacgcgcactcgcacacaaaaccgacgacccgcgaacgcgcgctcgatccgcccccgcgccccccgcccgcgcgacacccgccccgccccgcccccgcccgcgaccgaaaacgcgcgcgcgcgcgaccttaccaaacgacaaacccttattaaacaaatacgaactacccatcgaaaaacgcgaacgaccgcgaaccccgaccactccgacgcgctacgccgccgcgaacccgacgcgtaaaacgacctcgacgccgtccgctactccgcccgcccgcctacgcctaaccgccgccgtaccgaatctccgccgcgccgctaaaccgcgctccgacgaccgcgcgaacgaaaacacgacgacgcgcgcgaacgaaacctcgcgattaatctcctaattcccaacgcgaacgacgcacgaactcacgcgaacgactcaaaacccgcccgaccgaaacgcgactacgaaacgaaacgaaacgaaaacctaacgaaaaactcgcgaaactacaacccgacgaaaaccccgaacctaatattccgcacgttctaaaccgcctatccccgaaaaaatcgaacaaaatcgaaccgaactcaacgccgctaacgaaaacgccgtccgccccgaaaaccctacgaacccgaaaaccgaaacaaaaccgcccacgtcaacgcctaacgcgaacccgaacgtaaataacgctcctccgcgccgcaaccgcaaccgccccgctcccttcccgctccgccaactaccgccctcccgcgctcgcttctcgccccgcgacctaacccgtacgcctccgaaactaaccaaaaacaccgaaaccgcgaaccccccatcgcccccacccgaaccctaatttaccgtccgaaaaccgacgacacataaaaccccgaaaaaaaaaacgcgccta

SEQ ID NO: 38587 - DNA, 1099 bp, Artificial Sequence
  chemically treated genomic DNA (Homo sapiens) CpG-island No: 38587
gggtcggtggagttgggggttcggcggggtagtttagaggtttataggtttttttgtgttatttgtacgggtcgcgggcggggagagtagattgcggcgttcgcgtatacgtagcggttcgcgtatgcgtaagatttttttcgcggtttcgttttcgatcgcggttacgcgcggacgtcggcgcgtacgcgtattcgtatataaagtcggcggttcgcgggcgcgcgttcggttcgttttcgcgtttttcgttcgcgcggtattcgtttcgtttcgttttcgttcgcggtcggaaacgcgcgcgcgcgcggttttattaagcggtaggtttttgttgagtaagtgcgagttgtttatcgagaggcgcgagcggtcgcgggtttcgattatttcggcgcgttgcgtcgtcgcgagttcggcgcgtggggcggtttcggcgtcgttcgttgtttcgttcgttcgtttgcgtttggtcgtcgtcgtgtcgagttttcgtcgcgtcgttgagtcgcgtttcgacgatcgcgcgggcggggatacggcggcgcgcgcgggcggggtttcgcggttggttttttggtttttagcgcgggcggcgtacggatttacgcgggcggtttagggttcgttcggtcgggacgcggttgcggggcggggcggggcgggagtttggcgggaagttcgcggggttgtagttcggcggaggtttcgggtttggtgtttcgtacgttttaaatcgtttgttttcgaggaagtcgggtagggtcgggtcggatttagcgtcgttggcgggagcgtcgttcgtttcgaggattttgcgggttcggaagtcgagatagggtcgtttacgttagcgtttggcgcgggttcgaacgtaaatggcgttttttcgcgtcgtagtcgtagtcgtttcgtttttttttcgtttcgttagttgtcgttttttcgcgttcgtttttcgtttcgcggtttggttcgtgcgttttcgaggttggttaggggtatcgaggtcgcgggttttttatcgtttttattcgagttttgatttatcgttcgagagtcggcggtatatgggatttcgagaggagaagcgcgtttg

SEQ ID NO: 38588 - DNA, 1099 bp, Artificial Sequence
  chemically treated genomic DNA (Homo sapiens) CpG-island No: 38588
caaacgcgcttctcctctcgaaatcccatataccgccgactctcgaacgataaatcaaaactcgaataaaaacgataaaaaacccgcgacctcgatacccctaaccaacctcgaaaacgcacgaaccaaaccgcgaaacgaaaaacgaacgcgaaaaaacgacaactaacgaaacgaaaaaaaaacgaaacgactacgactacgacgcgaaaaaacgccatttacgttcgaacccgcgccaaacgctaacgtaaacgaccctatctcgacttccgaacccgcaaaatcctcgaaacgaacgacgctcccgccaacgacgctaaatccgacccgaccctacccgacttcctcgaaaacaaacgatttaaaacgtacgaaacaccaaacccgaaacctccgccgaactacaaccccgcgaacttcccgccaaactcccgccccgccccgccccgcaaccgcgtcccgaccgaacgaaccctaaaccgcccgcgtaaatccgtacgccgcccgcgctaaaaaccaaaaaaccaaccgcgaaaccccgcccgcgcgcgccgccgtatccccgcccgcgcgatcgtcgaaacgcgactcaacgacgcgacgaaaactcgacacgacgacgaccaaacgcaaacgaacgaacgaaacaacgaacgacgccgaaaccgccccacgcgccgaactcgcgacgacgcaacgcgccgaaataatcgaaacccgcgaccgctcgcgcctctcgataaacaactcgcacttactcaacaaaaacctaccgcttaataaaaccgcgcgcgcgcgcgtttccgaccgcgaacgaaaacgaaacgaaacgaataccgcgcgaacgaaaaacgcgaaaacgaaccgaacgcgcgcccgcgaaccgccgactttatatacgaatacgcgtacgcgccgacgtccgcgcgtaaccgcgatcgaaaacgaaaccgcgaaaaaaatcttacgcatacgcgaaccgctacgtatacgcgaacgccgcaatctactctccccgcccgcgacccgtacaaataacacaaaaaaacctataaacctctaaactaccccgccgaacccccaactccaccgaccc

SEQ ID NO: 38589 - DNA, 750 bp, Artificial Sequence
  chemically treated genomic DNA (Homo sapiens) CpG-island No: 38589
tttcgtcggattcgggacggtatttcgggtttcgattttcggtcgttatttcgttttcggttatgatttcgtggttgggtttgcggggtcgggatggggcgggagtcgtgcgtagttcggggtgttttggggcgcgcgttttcgggttattcgcgggagcgcgtttttcgcggggaggtcgtcggcgatcgtggtcgcgcgttgtgggggaaggggacggggcgcgggtgtcgggtatgatcgtggaggaggtcgttgtttttagatcgggtttaaagcgtagttttcggcggtgacgcgggagggttcggggttttcgttttcgcgaatttcgcgaggtttcggatcggtttagcgtttttatttgtttttgtttgggttcgtttaggtttcggggcgtttttttcgcgggttgcggtcgcggaagtagggagtacgggcgggcgtcgggtttgttattatcgttattttgtagcgttcgcgttttgggtcggttcgagtcgttgcgcggagtttttttttttttcgattcggttgtaaaggtagagttcgtgcgtttgagtttcgggtcgagattggagcgttttttggcggtttttaagggcgtcggtgtttggaagttcggtttgggttagattttttttgttgtcgttttcgtgattgtcgggatagaatttttttttagtggggaaaagggaaggcggtcgcgtttttttcggtgttttgagtggggaggtgaaattttgagag

SEQ ID NO: 38590 - DNA, 750 bp, Artificial Sequence
  chemically treated genomic DNA (Homo sapiens) CpG-island No: 38590
ctctcaaaatttcacctccccactcaaaacaccgaaaaaaacgcgaccgccttcccttttccccactaaaaaaaaattctatcccgacaatcacgaaaacgacaacaaaaaaaatctaacccaaaccgaacttccaaacaccgacgcccttaaaaaccgccaaaaaacgctccaatctcgacccgaaactcaaacgcacgaactctacctttacaaccgaatcgaaaaaaaaaaaaactccgcgcaacgactcgaaccgacccaaaacgcgaacgctacaaaataacgataataacaaacccgacgcccgcccgtactccctacttccgcgaccgcaacccgcgaaaaaaacgccccgaaacctaaacgaacccaaacaaaaacaaataaaaacgctaaaccgatccgaaacctcgcgaaattcgcgaaaacgaaaaccccgaaccctcccgcgtcaccgccgaaaactacgctttaaacccgatctaaaaacaacgacctcctccacgatcatacccgacacccgcgccccgtccccttcccccacaacgcgcgaccacgatcgccgacgacctccccgcgaaaaacgcgctcccgcgaataacccgaaaacgcgcgccccaaaacaccccgaactacgcacgactcccgccccatcccgaccccgcaaacccaaccacgaaatcataaccgaaaacgaaataacgaccgaaaatcgaaacccgaaataccgtcccgaatccgacgaaa

SEQ ID NO: 38591 - DNA, 750 bp, Artificial Sequence
  chemically treated genomic DNA (Homo sapiens) CpG-island No: 38591
tttttagggttttatttttttatttagggtatcgggaagggcgcgatcgtttttttttttttttattggaagggaattttgtttcggtaattacggagacgatagtaaaagggatttggtttaggtcgggtttttagatatcggcgtttttggaggtcgttagagaacgttttagtttcggttcggggtttaggcgtacggattttgtttttgtagtcgggtcgagggaaagagaggtttcgcgtagcggttcgggtcggtttaggacgcgggcgttgtaagatggcgatggtggtaagttcggcgttcgttcgtgttttttgttttcgcggtcgtagttcgcgaggaaggcgtttcgggatttgggcgggtttaggtaagggtaggtgggggcgttgggtcggttcgggatttcgcggagttcgcgggaacggagatttcgggttttttcgcgttatcgtcgggggttgcgttttgggttcggtttgagggtagcggttttttttacggttatattcggtattcgcgtttcgttttttttttttatagcgcgcggttacggtcgtcggcggttttttcgcgggaggcgcgttttcgcgagtggttcgggagcgcgcgttttaggatatttcgagttgcgtacggttttcgttttatttcggtttcgtaggtttagttacggggttatgatcggggacggggtagcggtcggggatcgggattcggggtgtcgtttcgggttcgacgggg

SEQ ID NO: 38592 - DNA, 750 bp, Artificial Sequence
  chemically treated genomic DNA (Homo sapiens) CpG-island No: 38592
ccccgtcgaacccgaaacgacaccccgaatcccgatccccgaccgctaccccgtccccgatcataaccccgtaactaaacctacgaaaccgaaataaaacgaaaaccgtacgcaactcgaaatatcctaaaacgcgcgctcccgaaccactcgcgaaaacgcgcctcccgcgaaaaaaccgccgacgaccgtaaccgcgcgctataaaaaaaaaaaacgaaacgcgaataccgaatataaccgtaaaaaaaaccgctaccctcaaaccgaacccaaaacgcaacccccgacgataacgcgaaaaaacccgaaatctccgttcccgcgaactccgcgaaatcccgaaccgacccaacgcccccacctacccttacctaaacccgcccaaatcccgaaacgccttcctcgcgaactacgaccgcgaaaacaaaaaacacgaacgaacgccgaacttaccaccatcgccatcttacaacgcccgcgtcctaaaccgacccgaaccgctacgcgaaacctctctttccctcgacccgactacaaaaacaaaatccgtacgcctaaaccccgaaccgaaactaaaacgttctctaacgacctccaaaaacgccgatatctaaaaacccgacctaaaccaaatcccttttactatcgtctccgtaattaccgaaacaaaattcccttccaataaaaaaaaaaaaaaacgatcgcgcccttcccgataccctaaataaaaaaataaaaccctaaaaa

SEQ ID NO: 38593 - DNA, 874 bp, Artificial Sequence
  chemically treated genomic DNA (Homo sapiens) CpG-island No: 38593
cggttatcgtgttttgcgggatggtggcgaagttgggggaggagaaggtgaagtcgttgttcgtttcggcgtcgtaggggtataggtttagcgtcgtttgttttcgttaacggttttcgtcgtataggtttaggttgtttacgtttacgaattagtcggggttgggtacgatgcgtattataaacgagatttgcggcgatagcggtttagcgcgtttggtttcggtttttcggatttcgttttcggtcggtttcgcgtttattagcgagtgtttgcgttgtatttttagtttcgtcgacgtttgttcggtgtcgttggggacggcgggcgtcgaaaatatcgcgtgtacgttttgtagcgtttttttcgtcgtttcgattttttttattagcgtttaggtttcgtcgcgtttcgtaaagtcgcgtagttcgttattgacgtattggttttttttttatatgttgtagtcggagttatgcgcggtttttgtaggattattcggtcgcgtcgcggattatggttagatattgcggtcgggtttggattttagggggcgttttaggaaattttttttcgtcgttcgtagggaattatggtttttagttacgtcggatcgtgatattttgtggttgtttttgtcgcgatttatttgcgtttttttcgtgagcgttttttgtttttatcgtattttcggaatcgtatatcgtaggcgttcggtaaatattttggtgttagagtttttcgacgttagtacgttttagattgggaagcgtcgtcgtgtagttgtgcggggggtttcggcgtcgtagtttttttggtggagtaggaggcgaggagggggttgtatttatttagtagcgaagattattgcgta

SEQ ID NO: 38594 - DNA, 874 bp, Artificial Sequence
  chemically treated genomic DNA (Homo sapiens) CpG-island No: 38594
tacgcaataatcttcgctactaaataaatacaaccccctcctcgcctcctactccaccaaaaaaactacgacgccgaaaccccccgcacaactacacgacgacgcttcccaatctaaaacgtactaacgtcgaaaaactctaacaccaaaatatttaccgaacgcctacgatatacgattccgaaaatacgataaaaacaaaaaacgctcacgaaaaaaacgcaaataaatcgcgacaaaaacaaccacaaaatatcacgatccgacgtaactaaaaaccataattccctacgaacgacgaaaaaaaatttcctaaaacgccccctaaaatccaaacccgaccgcaatatctaaccataatccgcgacgcgaccgaataatcctacaaaaaccgcgcataactccgactacaacatataaaaaaaaaaccaatacgtcaataacgaactacgcgactttacgaaacgcgacgaaacctaaacgctaataaaaaaaatcgaaacgacgaaaaaaacgctacaaaacgtacacgcgatattttcgacgcccgccgtccccaacgacaccgaacaaacgtcgacgaaactaaaaatacaacgcaaacactcgctaataaacgcgaaaccgaccgaaaacgaaatccgaaaaaccgaaaccaaacgcgctaaaccgctatcgccgcaaatctcgtttataatacgcatcgtacccaaccccgactaattcgtaaacgtaaacaacctaaacctatacgacgaaaaccgttaacgaaaacaaacgacgctaaacctatacccctacgacgccgaaacgaacaacgacttcaccttctcctcccccaacttcgccaccatcccgcaaaacacgataaccg

SEQ ID NO: 38595 - DNA, 874 bp, Artificial Sequence
  chemically treated genomic DNA (Homo sapiens) CpG-island No: 38595
tgcgtagtggttttcgttgttgggtaagtatagtttttttttcgttttttgttttattaggagggttgcggcgtcggagtttttcgtatagttgtacggcggcgttttttagtttggggcgtgttgacgtcgggagattttaatattagaatgtttgtcgagcgtttgcggtgtgcggtttcggggatgcggtgggggtagggggcgtttacggggagggcgtaggtgggtcgcggtaggggtagttatagggtgttacggttcgacgtgattgggggttatggttttttgcgggcggcggggagggattttttggggcgttttttggaatttaagttcgatcgtagtgtttgattatggttcgcggcgcggtcgggtggttttgtaggggtcgcgtatagtttcgattatagtatgtggaggaagaattagtacgttagtaacgggttgcgcgattttgcggagcgcggcgaggtttgggcgttgatgaaggagatcgaggcggcgggggaggcgttgtagagcgtgtacgcggtgttttcggcgttcgtcgtttttagcggtatcgggtagacgtcggcggagttggaggtgtagcgtaggtattcgttggtgagcgcggggtcggtcgggggcggggttcggggggtcggggttaggcgcgttgagtcgttgtcgtcgtaggtttcgtttgtggtgcgtatcgtgtttagtttcgattggttcgtgggcgtggatagtttggatttgtgcgacggggatcgttggcgggaataggcggcgttggatttgtatttttacgacgtcgggacggatagcggttttattttttttttttttaatttcgttattatttcgtaggatacggtgatcg

SEQ ID NO: 38596 - DNA, 874 bp, Artificial Sequence
  chemically treated genomic DNA (Homo sapiens) CpG-island No: 38596
cgatcaccgtatcctacgaaataataacgaaattaaaaaaaaaaaaaataaaaccgctatccgtcccgacgtcgtaaaaatacaaatccaacgccgcctattcccgccaacgatccccgtcgcacaaatccaaactatccacgcccacgaaccaatcgaaactaaacacgatacgcaccacaaacgaaacctacgacgacaacgactcaacgcgcctaaccccgaccccccgaaccccgcccccgaccgaccccgcgctcaccaacgaatacctacgctacacctccaactccgccgacgtctacccgataccgctaaaaacgacgaacgccgaaaacaccgcgtacacgctctacaacgcctcccccgccgcctcgatctccttcatcaacgcccaaacctcgccgcgctccgcaaaatcgcgcaacccgttactaacgtactaattcttcctccacatactataatcgaaactatacgcgacccctacaaaaccacccgaccgcgccgcgaaccataatcaaacactacgatcgaacttaaattccaaaaaacgccccaaaaaatccctccccgccgcccgcaaaaaaccataacccccaatcacgtcgaaccgtaacaccctataactacccctaccgcgacccacctacgccctccccgtaaacgccccctacccccaccgcatccccgaaaccgcacaccgcaaacgctcgacaaacattctaatattaaaatctcccgacgtcaacacgccccaaactaaaaaacgccgccgtacaactatacgaaaaactccgacgccgcaaccctcctaataaaacaaaaaacgaaaaaaaaactatacttacccaacaacgaaaaccactacgca

SEQ ID NO: 38597 - DNA, 518 bp, Artificial Sequence
  chemically treated genomic DNA (Homo sapiens) CpG-island No: 38597
tttcgtttttttttggttttttgcgttttcgtttttttttggttttttgcgttttcgtttttttttggttttttgcgttttcgtttttttttggttttttgcgttttcgtttttttttggttttttgcgttttcgtttttttttggttttttgcgttttcgtttttttttggttttttgcgttttcgtttttttttggttttttgcgttttcgtttttttttggttttttgcgttttcgtttttttttggttttttgcgttttcgtttttttttggttttttgcgttttcgtttttttttggttttttgcgttttcgtttttttttggttttttgcgttttcgtttttttttggttttttgcgttttcgtttttttttggttttttgcgttttcgtttttttttggttttttgcgttttcgtttttttttggttttttgcgttttcgtttttttttggttttttgcgttttcgtttttttttggttaagggttgtatttttgcgttttgtgagttttg

SEQ ID NO: 38598 - DNA, 518 bp, Artificial Sequence
  chemically treated genomic DNA (Homo sapiens) CpG-island No: 38598
caaaactcacaaaacgcaaaaatacaacccttaaccaaaaaaaaacgaaaacgcaaaaaaccaaaaaaaaacgaaaacgcaaaaaaccaaaaaaaaacgaaaacgcaaaaaaccaaaaaaaaacgaaaacgcaaaaaaccaaaaaaaaacgaaaacgcaaaaaaccaaaaaaaaacgaaaacgcaaaaaaccaaaaaaaaacgaaaacgcaaaaaaccaaaaaaaaacgaaaacgcaaaaaaccaaaaaaaaacgaaaacgcaaaaaaccaaaaaaaaacgaaaacgcaaaaaaccaaaaaaaaacgaaaacgcaaaaaaccaaaaaaaaacgaaaacgcaaaaaaccaaaaaaaaacgaaaacgcaaaaaaccaaaaaaaaacgaaaacgcaaaaaaccaaaaaaaaacgaaaacgcaaaaaaccaaaaaaaaacgaaaacgcaaaaaaccaaaaaaaaacgaaaacgcaaaaaaccaaaaaaaaacgaaaacgcaaaaaaccaaaaaaaaacgaaa

SEQ ID NO: 38599 - DNA, 518 bp, Artificial Sequence
  chemically treated genomic DNA (Homo sapiens) CpG-island No: 38599
tagagtttatagaacgtaaggatgtagtttttgattagggaggagcgaggacgtagaggattagggaggagcgaggacgtagaggattagggaggagcgaggacgtagaggattagggaggagcgaggacgtagaggattagggaggagcgaggacgtagaggattagggaggagcgaggacgtagaggattagggaggagcgaggacgtagaggattagggaggagcgaggacgtagaggattagggaggagcgaggacgtagaggattagggaggagcgaggacgtagaggattagggaggagcgaggacgtagaggattagggaggagcgaggacgtagaggattagggaggagcgaggacgtagaggattagggaggagcgaggacgtagaggattagggaggagcgaggacgtagaggattagggaggagcgaggacgtagaggattagggaggagcgaggacgtagaggattagggaggagcgaggacgtagaggattagggaggagcgagg

SEQ ID NO: 38600 - DNA, 518 bp, Artificial Sequence
  chemically treated genomic DNA (Homo sapiens) CpG-island No: 38600
cctcgctcctccctaatcctctacgtcctcgctcctccctaatcctctacgtcctcgctcctccctaatcctctacgtcctcgctcctccctaatcctctacgtcctcgctcctccctaatcctctacgtcctcgctcctccctaatcctctacgtcctcgctcctccctaatcctctacgtcctcgctcctccctaatcctctacgtcctcgctcctccctaatcctctacgtcctcgctcctccctaatcctctacgtcctcgctcctccctaatcctctacgtcctcgctcctccctaatcctctacgtcctcgctcctccctaatcctctacgtcctcgctcctccctaatcctctacgtcctcgctcctccctaatcctctacgtcctcgctcctccctaatcctctacgtcctcgctcctccctaatcctctacgtcctcgctcctccctaatcctctacgtcctcgctcctccctaatcaaaaactacatccttacgttctataaactcta

SEQ ID NO: 38601 - DNA, 623 bp, Artificial Sequence
  chemically treated genomic DNA (Homo sapiens) CpG-island No: 38601
tcgacggggagagtttaggacgtcgtggatattatggaaatggtatcgacggggagagtttaggacgtcgtggatattatggaaatggtatcgacggggagagtttaggacgtcgtggatattatggaaatggtatcgacggggagagtttaggacgtcgtggatattatggaaatggtatcgacggggagagtttaggacgttttggatattatggaaatggtatcgacggggagagtttaggacgtcgtggatattatggaaatggtatcgacggggagagtttaggacgtcgtggatattatggaaatggtatcgacggggagagtttaggacgtcgtggatattatggaaatggtatcgacggggagagtttaggacgtcgcggatattatggaaatggtatcgacggggagagtttaggacgtcgtggatattatggaaatggtatcgacggggagagtttaggacgtcgcggatattatggaaatggtatcgacggggagagttcggaaatggtattaacggggagagtttagaatatcgtggatattttggaaatggtatcgatggggagagtttagaacgtcgtggatattatggaaatagtatttatagcgaga

SEQ ID NO: 38602 - DNA, 623 bp, Artificial Sequence
  chemically treated genomic DNA (Homo sapiens) CpG-island No: 38602
tctcgctataaatactatttccataatatccacgacgttctaaactctccccatcgataccatttccaaaatatccacgatattctaaactctccccgttaataccatttccgaactctccccgtcgataccatttccataatatccgcgacgtcctaaactctccccgtcgataccatttccataatatccacgacgtcctaaactctccccgtcgataccatttccataatatccgcgacgtcctaaactctccccgtcgataccatttccataatatccacgacgtcctaaactctccccgtcgataccatttccataatatccacgacgtcctaaactctccccgtcgataccatttccataatatccacgacgtcctaaactctccccgtcgataccatttccataatatccaaaacgtcctaaactctccccgtcgataccatttccataatatccacgacgtcctaaactctccccgtcgataccatttccataatatccacgacgtcctaaactctccccgtcgataccatttccataatatccacgacgtcctaaactctccccgtcgataccatttccataatatccacgacgtcctaaactctccccgtcga

SEQ ID NO: 38603 - DNA, 623 bp, Artificial Sequence
  chemically treated genomic DNA (Homo sapiens) CpG-island No: 38603
tttcgttatgggtgttatttttatgatatttacggcgttttaagttttttttatcggtgttatttttaagatatttacggtgttttgaatttttttcgttggtgttattttcgagtttttttcgtcggtgttatttttatgatattcgcggcgttttgagtttttttcgtcggtgttatttttatgatatttacggcgttttgagtttttttcgtcggtgttatttttatgatattcgcggcgttttgagtttttttcgtcggtgttatttttatgatatttacggcgttttgagtttttttcgtcggtgttatttttatgatatttacggcgttttgagtttttttcgtcggtgttatttttatgatatttacggcgttttgagtttttttcgtcggtgttatttttatgatatttagggcgttttgagtttttttcgtcggtgttatttttatgatatttacggcgttttgagtttttttcgtcggtgttatttttatgatatttacggcgttttgagtttttttcgtcggtgttatttttatgatatttacggcgttttgagtttttttcgtcggtgttatttttatgatatttacggcgttttgagtttttttcgtcgg

SEQ ID NO: 38604 - DNA, 623 bp, Artificial Sequence
  chemically treated genomic DNA (Homo sapiens) CpG-island No: 38604
ccgacgaaaaaaactcaaaacgccgtaaatatcataaaaataacaccgacgaaaaaaactcaaaacgccgtaaatatcataaaaataacaccgacgaaaaaaactcaaaacgccgtaaatatcataaaaataacaccgacgaaaaaaactcaaaacgccgtaaatatcataaaaataacaccgacgaaaaaaactcaaaacgccctaaatatcataaaaataacaccgacgaaaaaaactcaaaacgccgtaaatatcataaaaataacaccgacgaaaaaaactcaaaacgccgtaaatatcataaaaataacaccgacgaaaaaaactcaaaacgccgtaaatatcataaaaataacaccgacgaaaaaaactcaaaacgccgcgaatatcataaaaataacaccgacgaaaaaaactcaaaacgccgtaaatatcataaaaataacaccgacgaaaaaaactcaaaacgccgcgaatatcataaaaataacaccgacgaaaaaaactcgaaaataacaccaacgaaaaaaattcaaaacaccgtaaatatcttaaaaataacaccgataaaaaaaacttaaaacgccgtaaatatcataaaaataacacccataacgaaa

SEQ ID NO: 38605 - DNA, 746 bp, Artificial Sequence
  chemically treated genomic DNA (Homo sapiens) CpG-island No: 38605
gcgttatcgcgggagttaggtttcgtagtagagggtttcgggttcgtttcggggtgggggcgttcggggtgtgtcgcgttttcggggtttacgtttcgggcgggttttcgggtttcggtagggcgcgaggcggcggcggggtcggttggtaggttgatgatgatgatgttttgtgttcgtagtcgatgggaggtagcgtgagttcgagagagtttagagtagtcgcggtggtagcgttggagcgtagttttttttcgtttttataatgtatagggcggcggcggtggcggcggcggtagcggaggtagtatcgcgggtcgtcgaagtggttgcggcggcggcggcgatttttaggatttcgggtaggtggagcgttcgcggttgttcgcggcgagttcgggagtgatggcgaggtttttgcgggcggttagcgtttgaggcgtttcgtttcgtttcgtttcgcgcggtttttttcgttcggttttgttttgttttgttttttgtcggcggttgcgggcgttttttagttcgttcgggcggtcgtttaggcgaggtgcggttttcgtataggcggggggcgtaggcgcgcggggttcgttatggttgcgtcggagttttatataaaggtaaggtatttcgcggtcggcgtcgaggattggggttgtgcggttttcgtcgttagttgttaggttggggagggggcgggagcgtcgggtttaggcgagttttattagcgttattttttt

SEQ ID NO: 38606 - DNA, 746 bp, Artificial Sequence
  chemically treated genomic DNA (Homo sapiens) CpG-island No: 38606
aaaaaaataacgctaataaaactcgcctaaacccgacgctcccgccccctccccaacctaacaactaacgacgaaaaccgcacaaccccaatcctcgacgccgaccgcgaaataccttacctttatataaaactccgacgcaaccataacgaaccccgcgcgcctacgccccccgcctatacgaaaaccgcacctcgcctaaacgaccgcccgaacgaactaaaaaacgcccgcaaccgccgacaaaaaacaaaacaaaacaaaaccgaacgaaaaaaaccgcgcgaaacgaaacgaaacgaaacgcctcaaacgctaaccgcccgcaaaaacctcgccatcactcccgaactcgccgcgaacaaccgcgaacgctccacctacccgaaatcctaaaaatcgccgccgccgccgcaaccacttcgacgacccgcgatactacctccgctaccgccgccgccaccgccgccgccctatacattataaaaacgaaaaaaaactacgctccaacgctaccaccgcgactactctaaactctctcgaactcacgctacctcccatcgactacgaacacaaaacatcatcatcatcaacctaccaaccgaccccgccgccgcctcgcgccctaccgaaacccgaaaacccgcccgaaacgtaaaccccgaaaacgcgacacaccccgaacgcccccaccccgaaacgaacccgaaaccctctactacgaaacctaactcccgcgataacgc

SEQ ID NO: 38607 - DNA, 746 bp, Artificial Sequence
  chemically treated genomic DNA (Homo sapiens) CpG-island No: 38607
aaggggatggcgttggtggggttcgtttgggttcggcgttttcgttttttttttagtttgatagttggcggcgagggtcgtatagttttagttttcgacgtcggtcgcggggtgttttatttttgtgtagagtttcgacgtagttatggcgggtttcgcgcgtttacgtttttcgtttgtgcggaggtcgtatttcgtttgggcggtcgttcgagcggattaggaagcgttcgtagtcgtcggtagggagtagggtagggtagggtcgggcggggagggtcgcgcggggcggggcggggcggggcgttttaggcgttggtcgttcgtaggggtttcgttattattttcgggttcgtcgcgagtagtcgcgagcgttttatttgttcggggttttaggggtcgtcgtcgtcgtcgtagttatttcggcggttcgcgatgttgttttcgttgtcgtcgtcgttatcgtcgtcgttttgtgtattatgggagcgggaggaggttgcgttttagcgttgttatcgcggttgttttgggttttttcgggtttacgttgttttttatcggttacgagtatagagtattattattattagtttgttagtcggtttcgtcgtcgtttcgcgttttgtcgaggttcggaaattcgttcgggacgtgagtttcgagggcgcggtatatttcgggcgtttttatttcgaagcgagttcggggttttttgttgcggagtttagttttcgcggtagcgt

SEQ ID NO: 38608 - DNA, 746 bp, Artificial Sequence
  chemically treated genomic DNA (Homo sapiens) CpG-island No: 38608
acgctaccgcgaaaactaaactccgcaacaaaaaaccccgaactcgcttcgaaataaaaacgcccgaaatataccgcgccctcgaaactcacgtcccgaacgaatttccgaacctcgacaaaacgcgaaacgacgacgaaaccgactaacaaactaataataataatactctatactcgtaaccgataaaaaacaacgtaaacccgaaaaaacccaaaacaaccgcgataacaacgctaaaacgcaacctcctcccgctcccataatacacaaaacgacgacgataacgacgacgacaacgaaaacaacatcgcgaaccgccgaaataactacgacgacgacgacgacccctaaaaccccgaacaaataaaacgctcgcgactactcgcgacgaacccgaaaataataacgaaacccctacgaacgaccaacgcctaaaacgccccgccccgccccgccccgcgcgaccctccccgcccgaccctaccctaccctactccctaccgacgactacgaacgcttcctaatccgctcgaacgaccgcccaaacgaaatacgacctccgcacaaacgaaaaacgtaaacgcgcgaaacccgccataactacgtcgaaactctacacaaaaataaaacaccccgcgaccgacgtcgaaaactaaaactatacgaccctcgccgccaactatcaaactaaaaaaaaaacgaaaacgccgaacccaaacgaaccccaccaacgccatcccctt

SEQ ID NO: 38609 - DNA, 546 bp, Artificial Sequence
  chemically treated genomic DNA (Homo sapiens) CpG-island No: 38609
gttgacgaagattgtcgggatatttattcgtttttattttcgttgttttttacgggatacgggttgttgtgatttcgcgggtattgttatttcgttttatgtttttaatttttttcgtttatcgtagttatatttttttagtttatttattaatattttttatatattttttttatttcgtgattattcgtcgatattatcgcggttcgttacggcgtttagatgttgtttttttatttttttcgcgtaagataattagttttttcgtttattttttatcgttttcgtttaggttcgatatatatcgtttttttttttttttaaattatacgagttttcgttattcgcgcgttttttattttacgtttttataatttttaagttttttttcgcgtcgtcggtcgtcgtttcgcgaggttttcgcgttaggttttttatatttttttttttttaaatattaacgtaataatttatagaggatatacgagggcgtttacgagattcgtgggtattattttcgtgggagcgttcgtgcgtttcgatcgg

SEQ ID NO: 38610 - DNA, 546 bp, Artificial Sequence
  chemically treated genomic DNA (Homo sapiens) CpG-island No: 38610
ccgatcgaaacgcacgaacgctcccacgaaaataatacccacgaatctcgtaaacgccctcgtatatcctctataaattattacgttaatatttaaaaaaaaaaaaatataaaaaacctaacgcgaaaacctcgcgaaacgacgaccgacgacgcgaaaaaaaacttaaaaattataaaaacgtaaaataaaaaacgcgcgaataacgaaaactcgtataatttaaaaaaaaaaaaaaacgatatatatcgaacctaaacgaaaacgataaaaaataaacgaaaaaactaattatcttacgcgaaaaaaataaaaaaacaacatctaaacgccgtaacgaaccgcgataatatcgacgaataatcacgaaataaaaaaaatatataaaaaatattaataaataaactaaaaaaatataactacgataaacgaaaaaaattaaaaacataaaacgaaataacaatacccgcgaaatcacaacaacccgtatcccgtaaaaaacaacgaaaataaaaacgaataaatatcccgacaatcttcgtcaac

SEQ ID NO: 38611 - DNA, 546 bp, Artificial Sequence
  chemically treated genomic DNA (Homo sapiens) CpG-island No: 38611
tcggtcggggcgtacgagcgtttttacgggggtggtgtttacgggtttcgtgggcgttttcgtgtgttttttgtgggttgttgcgttggtgtttgggggggggggggtgtggggggtttggcgcgggggtttcgcggggcggcggtcggcggcgcggaggggggtttgagggttgtgggggcgtggggtggggggcgcgcgggtggcgggggttcgtgtggtttgggggggggggggggcggtgtgtgtcggatttgggcgggggcggtggggggtgggcggggaggttggttgttttgcgcggggggggtgggggggtaatatttgggcgtcgtggcgggtcgcggtagtgtcggcgggtggttacgaggtagggggggtatgtagggggtgttagtgggtgggttgggggggtgtggttacggtaggcggagaggattgagggtatggggcggagtggtagtgttcgcgaagttataataattcgtgtttcgtgggaaatagcgagggtgggggcgggtgagtgtttcggtaattttcgttagt

SEQ ID NO: 38612 - DNA, 546 bp, Artificial Sequence
  chemically treated genomic DNA (Homo sapiens) CpG-island No: 38612
actaacgaaaattaccgaaacactcacccgcccccaccctcgctatttcccacgaaacacgaattattataacttcgcgaacactaccactccgccccataccctcaatcctctccgcctaccgtaaccacacccccccaacccacccactaacaccccctacataccccccctacctcgtaaccacccgccgacactaccgcgacccgccacgacgcccaaatattacccccccaccccccccgcgcaaaacaaccaacctccccgcccaccccccaccgcccccgcccaaatccgacacacaccgcccccccccccccccaaaccacacgaacccccgccacccgcgcgccccccaccccacgcccccacaaccctcaaacccccctccgcgccgccgaccgccgccccgcgaaacccccgcgccaaaccccccacacccccccccccccaaacaccaacgcaacaacccacaaaaaacacacgaaaacgcccacgaaacccgtaaacaccacccccgtaaaaacgctcgtacgccccgaccga

SEQ ID NO: 38613 - DNA, 507 bp, Artificial Sequence
  chemically treated genomic DNA (Homo sapiens) CpG-island No: 38613
tttttttcgtttttttgtcgcgtttcgttttttttgttttttttttttttttttttttttttttcgttttttcgttttttcgttttttttgttttttttgttgtttttttgtgtcgcgggtttttttcgttcgtcgttcgttttttttgcgtcgcgcgttttttttttcgtttttttttcgttgcgcgtcgtttgggtttcgcggtttcgcgcgtcgtcgtttcgttcggcgacgcgggtcggtgttttcgttttttgtttgtttcgcgttttttcgttcgttttggttcggtcgtcgggtttttggtttttttgttgtcgtgcgcggcgtttgtttcgcggcgcgttttttcggcggtttcgtcgtcgcgtttcgttttcgcgtttttttcgtttttcgttttcgttcgcgttgcgtttcgtttttgtttttttttttcgtgggtcggcgttcgtgttcggcgcgttgtttcggtttttttgggttttcgtcgtcgttttcgtttt

SEQ ID NO: 38614 - DNA, 507 bp, Artificial Sequence
  chemically treated genomic DNA (Homo sapiens) CpG-island No: 38614
aaaacgaaaacgacgacgaaaacccaaaaaaaccgaaacaacgcgccgaacacgaacgccgacccacgaaaaaaaaaaacaaaaacgaaacgcaacgcgaacgaaaacgaaaaacgaaaaaaacgcgaaaacgaaacgcgacgacgaaaccgccgaaaaaacgcgccgcgaaacaaacgccgcgcacgacaacaaaaaaaccaaaaacccgacgaccgaaccaaaacgaacgaaaaaacgcgaaacaaacaaaaaacgaaaacaccgacccgcgtcgccgaacgaaacgacgacgcgcgaaaccgcgaaacccaaacgacgcgcaacgaaaaaaaaacgaaaaaaaaaacgcgcgacgcaaaaaaaacgaacgacgaacgaaaaaaacccgcgacacaaaaaaacaacaaaaaaaacaaaaaaaacgaaaaaacgaaaaaacgaaaaaaaaaaaaaaaaaaaaaaaaaaaacaaaaaaaacgaaacgcgacaaaaaaacgaaaaaaa

SEQ ID NO: 38615 - DNA, 507 bp, Artificial Sequence
  chemically treated genomic DNA (Homo sapiens) CpG-island No: 38615
gaggcgagagcgacggcgaggatttagggggatcggagtaacgcgtcgggtacgagcgtcggtttacgagggaggggggtagaggcggggcgtagcgcgagcgggggcggggagcggggggagcgcgggggcggggcgcggcggcggaatcgtcgggggggcgcgtcgcgaagtaaacgtcgcgtacggtagtagagaggttaggggttcgacgatcgggttagaacgggcgggggagcgcgaagtagatagggagcgggaatatcggttcgcgtcgtcgagcgaggcgacggcgcgcgggatcgcgaggtttaaacgacgcgtaacgaggaaggagcgaggagaggggcgcgcggcgtagggagagcgagcggcgagcgggggggattcgcggtatagggaggtaataaaagaagtaggaagggcggggaagcgaaggagcgagagaaagagagggaaaaaaaagggggatagggaaggcgaggcgcgataaaagagcgaagaggg

SEQ ID NO: 38616 - DNA, 507 bp, Artificial Sequence
  chemically treated genomic DNA (Homo sapiens) CpG-island No: 38616
ccctcttcgctcttttatcgcgcctcgccttccctatcccccttttttttccctctctttctctcgctccttcgcttccccgcccttcctacttcttttattacctccctataccgcgaatcccccccgctcgccgctcgctctccctacgccgcgcgcccctctcctcgctccttcctcgttacgcgtcgtttaaacctcgcgatcccgcgcgccgtcgcctcgctcgacgacgcgaaccgatattcccgctccctatctacttcgcgctcccccgcccgttctaacccgatcgtcgaacccctaacctctctactaccgtacgcgacgtttacttcgcgacgcgcccccccgacgattccgccgccgcgccccgcccccgcgctccccccgctccccgcccccgctcgcgctacgccccgcctctacccccctccctcgtaaaccgacgctcgtacccgacgcgttactccgatccccctaaatcctcgccgtcgctctcgcctc

SEQ ID NO: 38617 - DNA, 615 bp, Artificial Sequence
  chemically treated genomic DNA (Homo sapiens) CpG-island No: 38617
gttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtgttgatgtcggatcgtgatacgttgatgtgcgtggtgatagtgttgtttgtcggatatgaggtttttggattgttgatcgatttgtggcggttggaggttagatcgtttttgggttttagttaggg

SEQ ID NO: 38618 - DNA, 615 bp, Artificial Sequence
  chemically treated genomic DNA (Homo sapiens) CpG-island No: 38618
ccctaactaaaacccaaaaacgatctaacctccaaccgccacaaatcgatcaacaatccaaaaacctcatatccgacaaacaacactatcaccacgcacatcaacgtatcacgatccgacatcaacaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaac

SEQ ID NO: 38619 - DNA, 615 bp, Artificial Sequence
  chemically treated genomic DNA (Homo sapiens) CpG-island No: 38619
ttttgattgaaatttaaaaacgatttggtttttagtcgttatagatcggttagtaatttagaagttttatgttcggtagatagtattattattacgtatattaacgtgttacggttcgatattagtattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataat

SEQ ID NO: 38620 - DNA, 615 bp, Artificial Sequence
  chemically treated genomic DNA (Homo sapiens) CpG-island No: 38620
attataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataatactaatatcgaaccgtaacacgttaatatacgtaataataatactatctaccgaacataaaacttctaaattactaaccgatctataacgactaaaaaccaaatcgtttttaaatttcaatcaaaa

SEQ ID NO: 38621 - DNA, 545 bp, Artificial Sequence
  chemically treated genomic DNA (Homo sapiens) CpG-island No: 38621
gttttgtcggggtttagggcgtgaaggatcgtgggggattcgatggattttggggcgttcgttgggggtttcgcgcggggatttttcggttgtttgagaggcggaggtagtaagaagtaggaaaaggaattggggggacgcgagcgagtggtaggtttttttcggtggtcgtcgagcgcgcgtttagtttggggaacgcgttgtttgcgtattcgggcgcgttcgggaaggtcggttcgttggtatcgcgttagttttcgagttgtttgtgtatgtttattttttttattagaggttgtttatttttattttttggtttttttcgttttttttgacggtttcgggagcgtttgtgcgcgcgcgtgtgtgcgtgttcgtgtgttcgcgcgcgatcggcgatttcgtttcgcgtttttgtttttaaagggaagggcgtttcgtcgggcgtcgcggggtttaaatgaatatgggaatttgcgttggggaaggttcgttaggttttgttggtttaggaggttcggattatagtttagtttgcgtcgttg

SEQ ID NO: 38622 - DNA, 545 bp, Artificial Sequence
  chemically treated genomic DNA (Homo sapiens) CpG-island No: 38622
caacgacgcaaactaaactataatccgaacctcctaaaccaacaaaacctaacgaaccttccccaacgcaaattcccatattcatttaaaccccgcgacgcccgacgaaacgcccttccctttaaaaacaaaaacgcgaaacgaaatcgccgatcgcgcgcgaacacacgaacacgcacacacgcgcgcgcacaaacgctcccgaaaccgtcaaaaaaaacgaaaaaaaccaaaaaataaaaataaacaacctctaataaaaaaaataaacatacacaaacaactcgaaaactaacgcgataccaacgaaccgaccttcccgaacgcgcccgaatacgcaaacaacgcgttccccaaactaaacgcgcgctcgacgaccaccgaaaaaaacctaccactcgctcgcgtccccccaattccttttcctacttcttactacctccgcctctcaaacaaccgaaaaatccccgcgcgaaacccccaacgaacgccccaaaatccatcgaatcccccacgatccttcacgccctaaaccccgacaaaac

SEQ ID NO: 38623 - DNA, 545 bp, Artificial Sequence
  chemically treated genomic DNA (Homo sapiens) CpG-island No: 38623
tagcgacgtagattgggttgtaattcgggttttttgggttagtagggtttggcgggttttttttagcgtaggtttttatgtttatttaggtttcgcgacgttcggcgggacgtttttttttttagggataggggcgcggggcggggtcgtcggtcgcgcgcgggtatacgggtacgtatatacgcgcgcgtatagacgttttcggagtcgttagaggaggcgaaaggaattaagaagtgaaagtgagtaatttttagtgaaagaaatagatatgtatagatagttcggaaattgacgcggtgttagcgagtcggttttttcgggcgcgttcgggtgcgtaggtagcgcgttttttaagttgggcgcgcgttcggcggttatcgaggagggtttgttattcgttcgcgtttttttagtttttttttttgttttttgttgttttcgttttttaagtagtcgggaggttttcgcgcgaggtttttagcgggcgttttaggatttatcgggttttttacgattttttacgttttggatttcggtaaagt

SEQ ID NO: 38624 - DNA, 545 bp, Artificial Sequence
  chemically treated genomic DNA (Homo sapiens) CpG-island No: 38624
actttaccgaaatccaaaacgtaaaaaatcgtaaaaaacccgataaatcctaaaacgcccgctaaaaacctcgcgcgaaaacctcccgactacttaaaaaacgaaaacaacaaaaaacaaaaaaaaaaactaaaaaaacgcgaacgaataacaaaccctcctcgataaccgccgaacgcgcgcccaacttaaaaaacgcgctacctacgcacccgaacgcgcccgaaaaaaccgactcgctaacaccgcgtcaatttccgaactatctatacatatctatttctttcactaaaaattactcactttcacttcttaattcctttcgcctcctctaacgactccgaaaacgtctatacgcgcgcgtatatacgtacccgtatacccgcgcgcgaccgacgaccccgccccgcgcccctatccctaaaaaaaaaaacgtcccgccgaacgtcgcgaaacctaaataaacataaaaacctacgctaaaaaaaacccgccaaaccctactaacccaaaaaacccgaattacaacccaatctacgtcgcta

SEQ ID NO: 38625 - DNA, 700 bp, Artificial Sequence
  chemically treated genomic DNA (Homo sapiens) CpG-island No: 38625
gatcgtttcgattataatgataatttttatattaacgtacgttcgcgtgcggggtgtttttttttttttttttacgttttttatttaaaagttgtataatttggttcgagtttacggtggcggttgtcgttttagtatcgttcgttaggtaattgttttggcgaattattcggtttaaggagtaaaataggtttttcgagtaaaatcgtgcgtttcggtacgtttagtttttcggttttcggttttttacgtttttatttttaatagggattttagttttagggatatcgggcgcgtgcgcgattttaattagttatttatgggcgaattaattatgtagttgttatgggcgggggggtcggtaggggttatgcgacgcggagattattcggtcgcggtggcggtttttttgtcgggtttcggggtcgggaggcgtttttacgtcgttcggggaggatttcgttgtgagaaagttgtttcggggtggggttcgggaggagcgcgggggaatttgaggaagcgggagagacggttcggagattttttaattagattgggaggggagaggggggcgggcgacggagttggaaagagcgggtcgcggagatcggggcgtgggaagagtttggtttaggtattttttttttttttttttttttttatttttatttttattgcgagtttattacgtgttattgcg

SEQ ID NO: 38626 - DNA, 700 bp, Artificial Sequence
  chemically treated genomic DNA (Homo sapiens) CpG-island No: 38626
cgcaataacacgtaataaactcgcaataaaaataaaaataaaaaaaaaaaaaaaaaaaaaaaatacctaaaccaaactcttcccacgccccgatctccgcgacccgctctttccaactccgtcgcccgcccccctctcccctcccaatctaattaaaaaatctccgaaccgtctctcccgcttcctcaaattcccccgcgctcctcccgaaccccaccccgaaacaactttctcacaacgaaatcctccccgaacgacgtaaaaacgcctcccgaccccgaaacccgacaaaaaaaccgccaccgcgaccgaataatctccgcgtcgcataacccctaccgacccccccgcccataacaactacataattaattcgcccataaataactaattaaaatcgcgcacgcgcccgatatccctaaaactaaaatccctattaaaaataaaaacgtaaaaaaccgaaaaccgaaaaactaaacgtaccgaaacgcacgattttactcgaaaaacctattttactccttaaaccgaataattcgccaaaacaattacctaacgaacgatactaaaacgacaaccgccaccgtaaactcgaaccaaattatacaacttttaaataaaaaacgtaaaaaaaaaaaaaaaaacaccccgcacgcgaacgtacgttaatataaaaattatcattataatcgaaacgatc

SEQ ID NO: 38627 - DNA, 700 bp, Artificial Sequence
  chemically treated genomic DNA (Homo sapiens) CpG-island No: 38627
cgtagtggtacgtagtgggttcgtagtaaggatggggatgaaggaaggaaggaagggaagaaatgtttaggttaggttttttttacgtttcggttttcgcggttcgttttttttagtttcgtcgttcgtttttttttttttttttagtttaattgggaggttttcgagtcgtttttttcgtttttttaggttttttcgcgtttttttcggattttatttcgaggtagtttttttataacgggatttttttcgggcggcgtggggacgtttttcgatttcgaggttcggtaggagagtcgttatcgcggtcgggtggttttcgcgtcgtatggtttttgtcggttttttcgtttatggtagttatataattaattcgtttataaataattgattggggtcgcgtacgcgttcggtgtttttaggattgggatttttgttaggggtaggggcgtggggggtcgggggtcgaggggttgggcgtgtcggggcgtacggttttgttcggggggtttgttttgttttttaggtcgggtggttcgttaaagtagttgtttgacgagcggtgttggagcgatagtcgttatcgtaagttcggattagattgtatagtttttgagtaagaggcgtgggagagggaaagaggatatttcgtacgcgggcgtgcgttggtatagaagttattattgtgatcggagcggtt

SEQ ID NO: 38628 - DNA, 700 bp, Artificial Sequence
  chemically treated genomic DNA (Homo sapiens) CpG-island No: 38628
aaccgctccgatcacaataataacttctataccaacgcacgcccgcgtacgaaatatcctctttccctctcccacgcctcttactcaaaaactatacaatctaatccgaacttacgataacgactatcgctccaacaccgctcgtcaaacaactactttaacgaaccacccgacctaaaaaacaaaacaaaccccccgaacaaaaccgtacgccccgacacgcccaacccctcgacccccgaccccccacgcccctacccctaacaaaaatcccaatcctaaaaacaccgaacgcgtacgcgaccccaatcaattatttataaacgaattaattatataactaccataaacgaaaaaaccgacaaaaaccatacgacgcgaaaaccacccgaccgcgataacgactctcctaccgaacctcgaaatcgaaaaacgtccccacgccgcccgaaaaaaatcccgttataaaaaaactacctcgaaataaaatccgaaaaaaacgcgaaaaaacctaaaaaaacgaaaaaaacgactcgaaaacctcccaattaaactaaaaaaaaaaaaaaaaacgaacgacgaaactaaaaaaaacgaaccgcgaaaaccgaaacgtaaaaaaaacctaacctaaacatttcttcccttccttccttccttcatccccatccttactacgaacccactacgtaccactacg

SEQ ID NO: 38629 - DNA, 691 bp, Artificial Sequence
  chemically treated genomic DNA (Homo sapiens) CpG-island No: 38629
cggggtcgttttaggttttgttagtttgacgttaagttcggtcggcggggtttcgttttgtataaatagacgtcgtaggttagcgtcggggtcgggggcggcgatgatttagggtttcgagacgggtcgggaagcggaaagttgtgtgtagatgatattagtcggtcgcgagggcgggagggggtcggtttcgggaaacggcggtttggcgggcggttcggggtagggcgtggagaggcggtcgcggggcgggggcggggacgtcgggacgggacgttcgggattacgaaaaatgtttttattttcgttcgtttcggatttaggtttcggagttcggtttcgtttttcgtcggcgaggagcgggttttattcgtttgtaaagatttcgcgttttttcgcgtttcggaggtagtcgtatttattttgttgcgtttttgtattttaattatcgtcgtattaatatttatgagtcgggattcgagggggatcgcgggttgttatttttttcgttcgttttttttttatcgtattttttttttcgggttgagtcgtgggttttttttttttcgtttttaatttcgttcgtattaatcgttggtgcgtagtagatttgggggaggggggttggtgtgagtgtgagtatgagtgtgagcgagtgtgagtggggaggggtcgagtgtgagtttgtgtt

SEQ ID NO: 38630 - DNA, 691 bp, Artificial Sequence
  chemically treated genomic DNA (Homo sapiens) CpG-island No: 38630
aacacaaactcacactcgacccctccccactcacactcgctcacactcatactcacactcacaccaacccccctcccccaaatctactacgcaccaacgattaatacgaacgaaattaaaaacgaaaaaaaaaaaacccacgactcaacccgaaaaaaaaaatacgataaaaaaaaaacgaacgaaaaaaataacaacccgcgatccccctcgaatcccgactcataaatattaatacgacgataattaaaatacaaaaacgcaacaaaataaatacgactacctccgaaacgcgaaaaaacgcgaaatctttacaaacgaataaaacccgctcctcgccgacgaaaaacgaaaccgaactccgaaacctaaatccgaaacgaacgaaaataaaaacatttttcgtaatcccgaacgtcccgtcccgacgtccccgcccccgccccgcgaccgcctctccacgccctaccccgaaccgcccgccaaaccgccgtttcccgaaaccgaccccctcccgccctcgcgaccgactaatatcatctacacacaactttccgcttcccgacccgtctcgaaaccctaaatcatcgccgcccccgaccccgacgctaacctacgacgtctatttatacaaaacgaaaccccgccgaccgaacttaacgtcaaactaacaaaacctaaaacgaccccg

SEQ ID NO: 38631 - DNA, 691 bp, Artificial Sequence
  chemically treated genomic DNA (Homo sapiens) CpG-island No: 38631
ggtatagatttatattcggtttttttttatttatattcgtttatatttatgtttatatttatattaattttttttttttaaatttgttgcgtattaacggttggtgcgagcggggttgagaacgggaggaaaaaagtttacgatttagttcgggaagaggggtgcggtgggggaagggcgggcgagggaaatgatagttcgcggtttttttcgagtttcggtttatgaatattaatacggcggtaattaaaatgtagggacgtagtaggatggatgcggttgttttcggagcgcgggggagcgcggagtttttgtaggcgggtgaagttcgtttttcgtcggcgaaaagcggggtcgggtttcggggtttgggttcggggcgggcgggagtggggatatttttcgtggtttcgagcgtttcgtttcggcgttttcgttttcgtttcgcggtcgtttttttacgttttgtttcgggtcgttcgttaggtcgtcgtttttcggagtcggttttttttcgttttcgcggtcggttgatgttatttgtatataatttttcgtttttcggttcgtttcggggttttgagttatcgtcgttttcggtttcgacgttggtttgcggcgtttgtttgtgtagagcgaggtttcgtcggtcgggtttgacgttaggttggtagggtttggaacggtttcg

SEQ ID NO: 38632 - DNA, 691 bp, Artificial Sequence
  chemically treated genomic DNA (Homo sapiens) CpG-island No: 38632
cgaaaccgttccaaaccctaccaacctaacgtcaaacccgaccgacgaaacctcgctctacacaaacaaacgccgcaaaccaacgtcgaaaccgaaaacgacgataactcaaaaccccgaaacgaaccgaaaaacgaaaaattatatacaaataacatcaaccgaccgcgaaaacgaaaaaaaaccgactccgaaaaacgacgacctaacgaacgacccgaaacaaaacgtaaaaaaacgaccgcgaaacgaaaacgaaaacgccgaaacgaaacgctcgaaaccacgaaaaatatccccactcccgcccgccccgaacccaaaccccgaaacccgaccccgcttttcgccgacgaaaaacgaacttcacccgcctacaaaaactccgcgctcccccgcgctccgaaaacaaccgcatccatcctactacgtccctacattttaattaccgccgtattaatattcataaaccgaaactcgaaaaaaaccgcgaactatcatttccctcgcccgcccttcccccaccgcacccctcttcccgaactaaatcgtaaacttttttcctcccgttctcaaccccgctcgcaccaaccgttaatacgcaacaaatttaaaaaaaaaaaattaatataaatataaacataaatataaacgaatataaataaaaaaaaaccgaatataaatctatacc

SEQ ID NO: 38633 - DNA, 639 bp, Artificial Sequence
  chemically treated genomic DNA (Homo sapiens) CpG-island No: 38633
agattcgggtaaaggatcggagaggtgattagatatttcgggtaggtagcggaggtcggttttgttgagcgattttcgttagcgacgatttttaggggtttaggttttacgtttattaattgggtattagttttttttatttcggggagtcgagtttttgggaagtagcgtttgggggcgtcggcgatcggttggggtcgtttttttgttttttcgttttgggttcgatcgtcgggcgcgaggcgtgtagggcgcggcgcgggttcgggcgtttagtttagcggaaaggaatgttttgttcggcgggggaggtcgtggtttcgaggtcgtgtttattttcgttcgtttcgggttttatttattgcggttttgaagttcggttcgtttcgttcgtcgggtttcgcggggtgattttttttacgattgcggtttttcgtttttcgttcggtcgtcgttggcggattttaaagtcggggcgagtttttaaatcggggagtcggtttcgtttttacgtcgcggcggcgttttttttttttttttttcgtcgttcgttttttttttttttttttttataatttaaaagtttgttaagttggttttagatttttggcgtcgggtttcgttttaggaaagaaaaat

SEQ ID NO: 38634 - DNA, 639 bp, Artificial Sequence
  chemically treated genomic DNA (Homo sapiens) CpG-island No: 38634
atttttctttcctaaaacgaaacccgacgccaaaaatctaaaaccaacttaacaaacttttaaattataaaaaaaaaaaaaaaaaaaacgaacgacgaaaaaaaaaaaaaaaaaacgccgccgcgacgtaaaaacgaaaccgactccccgatttaaaaactcgccccgactttaaaatccgccaacgacgaccgaacgaaaaacgaaaaaccgcaatcgtaaaaaaaatcaccccgcgaaacccgacgaacgaaacgaaccgaacttcaaaaccgcaataaataaaacccgaaacgaacgaaaataaacacgacctcgaaaccacgacctcccccgccgaacaaaacattcctttccgctaaactaaacgcccgaacccgcgccgcgccctacacgcctcgcgcccgacgatcgaacccaaaacgaaaaaacaaaaaaacgaccccaaccgatcgccgacgcccccaaacgctacttcccaaaaactcgactccccgaaataaaaaaaactaatacccaattaataaacgtaaaacctaaacccctaaaaatcgtcgctaacgaaaatcgctcaacaaaaccgacctccgctacctacccgaaatatctaatcacctctccgatcctttacccgaatct

SEQ ID NO: 38635 - DNA, 639 bp, Artificial Sequence
  chemically treated genomic DNA (Homo sapiens) CpG-island No: 38635
gttttttttttttggagcggagttcggcgttaggagtttggaattagtttgataggtttttgagttatggaggggggagggggagaggcgggcggcgggaagggggaagggagggcgtcgtcgcggcgtgggggcggggtcggtttttcggtttggagattcgtttcgattttggggttcgttagcggcggtcgggcggagggcgggggatcgtaatcgtggggggagttatttcgcggggttcggcgggcgaaacgggtcgggttttagagtcgtagtaaatgaggttcggggcgggcgggggtggatacggtttcggggttacggtttttttcgtcgagtaaggtattttttttcgttgaattgggcgttcgggttcgcgtcgcgttttgtacgtttcgcgttcggcgatcgggtttagggcgggggagtagggaggcggttttagtcggtcgtcggcgtttttaggcgttgttttttaggagttcggtttttcgggatggaagggattgatatttagttaatgggcgtggagtttgagtttttgagggtcgtcgttaacgggggtcgtttagtagggtcggttttcgttgtttgttcggggtgtttaattattttttcgattttttgttcggattt

SEQ ID NO: 38636 - DNA, 639 bp, Artificial Sequence
  chemically treated genomic DNA (Homo sapiens) CpG-island No: 38636
aaatccgaacaaaaaatcgaaaaaataattaaacaccccgaacaaacaacgaaaaccgaccctactaaacgacccccgttaacgacgaccctcaaaaactcaaactccacgcccattaactaaatatcaatcccttccatcccgaaaaaccgaactcctaaaaaacaacgcctaaaaacgccgacgaccgactaaaaccgcctccctactcccccgccctaaacccgatcgccgaacgcgaaacgtacaaaacgcgacgcgaacccgaacgcccaattcaacgaaaaaaaataccttactcgacgaaaaaaaccgtaaccccgaaaccgtatccacccccgcccgccccgaacctcatttactacgactctaaaacccgacccgtttcgcccgccgaaccccgcgaaataactccccccacgattacgatcccccgccctccgcccgaccgccgctaacgaaccccaaaatcgaaacgaatctccaaaccgaaaaaccgaccccgcccccacgccgcgacgacgccctcccttcccccttcccgccgcccgcctctccccctcccccctccataactcaaaaacctatcaaactaattccaaactcctaacgccgaactccgctccaaaaaaaaaaaac

SEQ ID NO: 38637 - DNA, 578 bp, Artificial Sequence
  chemically treated genomic DNA (Homo sapiens) CpG-island No: 38637
gcggtcgttttttttttttttttcgttttttttttttttttttttttttcgttttttttttttttttttttgtttttttttttttttttttttgttttttttttttttttttttttttcgtcgttttttttttgtttcgttttttttttttttgtttttcgtcgttcgtttttttttttttcgttttttttttttttcgttttttttttttttttttttttttttttttcgttttttttttttttttttttttcgttcgtttttttttttcgttcggttttcggtttttcgtttttttttttttttttttttttcggttcgttttttttcgttttttcgtttttttttcgtttttgttcgtgtttttttcgttttttttttttcgttttttttttttttcgtttcgttcgttttttttcgtttttcgttttttttttttttttttgttttttttttcgcgttcgtgtgtcgcgttggttcgcgttttttttttttttttttttttttcgtcgtcgtttttttttttttcgcgtcgtttttcgtcgtttttgttttttttcgcgttttttcgtttgtcg

SEQ ID NO: 38638 - DNA, 578 bp, Artificial Sequence
  chemically treated genomic DNA (Homo sapiens) CpG-island No: 38638
cgacaaacgaaaaaacgcgaaaaaaaacaaaaacgacgaaaaacgacgcgaaaaaaaaaaaaacgacgacgaaaaaaaaaaaaaaaaaaaaaaaacgcgaaccaacgcgacacacgaacgcgaaaaaaaaaacaaaaaaaaaaaaaaaaaacgaaaaacgaaaaaaaacgaacgaaacgaaaaaaaaaaaaaacgaaaaaaaaaaaacgaaaaaaacacgaacaaaaacgaaaaaaaaacgaaaaaacgaaaaaaaacgaaccgaaaaaaaaaaaaaaaaaaaaaaacgaaaaaccgaaaaccgaacgaaaaaaaaaaacgaacgaaaaaaaaaaaaaaaaaaaaaacgaaaaaaaaaaaaaaaaaaaaaaaaaaaaaacgaaaaaaaaaaaaaacgaaaaaaaaaaaaacgaacgacgaaaaacaaaaaaaaaaaaaacgaaacaaaaaaaaaacgacgaaaaaaaaaaaaaaaaaaaaaaaacaaaaaaaaaaaaaaaaaaaaacaaaaaaaaaaaaaaaaaaaacgaaaaaaaaaaaaaaaaaaaaaaaacgaaaaaaaaaaaaaaaacgaccgc

SEQ ID NO: 38639 - DNA, 578 bp, Artificial Sequence
  chemically treated genomic DNA (Homo sapiens) CpG-island No: 38639
cggtaagcgggggaacgcgaaagaaaataggggcggcggagaacggcgcgagaaaaaagagaacgacggcggggaaaggaaaaaaaaaaaaaaggcgcggattagcgcggtatacgggcgcgaaaaaaaaaataaaggggggagagaaagacggggggcggaaagaaacgggcggggcggaaaggaaagggggcggaaaaaagagggcgaaggaaatacgggtaagggcgggaaaaaagcggggagacgaaaaagggcggatcgggaggagggaaagagaaaaaaggcggggaatcggagatcgggcggggaaagaaaacgggcggaaaaaggagagagaaaaagaacggggggagaagggagaaaaaggaaaaaggggcgggggggggggagggcgaaaggggggaaaacggacggcgggggatagggggggggaaaacggggtagaagggaagcggcggggaaagggggggaaagggggagataagggggggggggggggaaaataagggaagggggggaaaaggcggggggaaaagggaggggaggggggcggaagggaaagggggggcgatcgt

SEQ ID NO: 38640 - DNA, 578 bp, Artificial Sequence
  chemically treated genomic DNA (Homo sapiens) CpG-island No: 38640
acgatcgccccccctttcccttccgcccccctcccctcccttttccccccgccttttcccccccttcccttattttcccccccccccccccttatctccccctttccccccctttccccgccgcttcccttctaccccgttttccccccccctatcccccgccgtccgttttcccccctttcgccctcccccccccccgcccctttttcctttttctcccttctccccccgttctttttctctctcctttttccgcccgttttctttccccgcccgatctccgattccccgccttttttctctttccctcctcccgatccgccctttttcgtctccccgcttttttcccgcccttacccgtatttccttcgccctcttttttccgccccctttcctttccgccccgcccgtttctttccgccccccgtctttctctcccccctttattttttttttcgcgcccgtataccgcgctaatccgcgccttttttttttttttcctttccccgccgtcgttctcttttttctcgcgccgttctccgccgcccctattttctttcgcgttcccccgcttaccg

SEQ ID NO: 38641 - DNA, 506 bp, Artificial Sequence
  chemically treated genomic DNA (Homo sapiens) CpG-island No: 38641
  misc_feature (61)..(61): n is either a, c, g or t
tttttttttttcgttttttttttttttttttttttttttttttcgtttttgtttttttttntttttgttgtttttttttttttttttcgtcgttttttttttgttttttttcggttttttcgtttttttttgtttttttttgttttttttttgtttttcgttttttttttttttttttttttcgtttttttttcgttttttttttttttcgttgtttttgcggtttttttttttcgttttcgttcgttttttttttttttttcgcgttttttttcgttttttttttttcgtgttttttttcgttgtttttttttgtttttcgtttttttcgtttgttggtttttttttttttcgttttttcgtttttttcgtttttttttttttttttttttgtttttttttttttttcggtttttcgtttttttttttcgtttttttgtttttttttgtttttttttcgttttcgttttttttttttttttttttttcgttttgtgttttcgttt

SEQ ID NO: 38642 - DNA, 506 bp, Artificial Sequence
  chemically treated genomic DNA (Homo sapiens) CpG-island No: 38642
  misc_feature (446)..(446): n is either a, c, g or t
aaacgaaaacacaaaacgaaaaaaaaaaaaaaaaaaaaaacgaaaacgaaaaaaaaacaaaaaaaaacaaaaaaacgaaaaaaaaaaacgaaaaaccgaaaaaaaaaaaaaaacaaaaaaaaaaaaaaaaaaaaacgaaaaaaacgaaaaaacgaaaaaaaaaaaaaccaacaaacgaaaaaaacgaaaaacaaaaaaaaacaacgaaaaaaaacacgaaaaaaaaaaaacgaaaaaaaacgcgaaaaaaaaaaaaaaaacgaacgaaaacgaaaaaaaaaaaccgcaaaaacaacgaaaaaaaaaaaaaacgaaaaaaaaacgaaaaaaaaaaaaaaaaaaaaaacgaaaaacaaaaaaaaaacaaaaaaaaacaaaaaaaaacgaaaaaaccgaaaaaaaacaaaaaaaaaacgacgaaaaaaaaaaaaaaaaacaacaaaaanaaaaaaaaacaaaaacgaaaaaaaaaaaaaaaaaaaaaaaaaaaaaacgaaaaaaaaaaa

SEQ ID NO: 38643 - DNA, 506 bp, Artificial Sequence
  chemically treated genomic DNA (Homo sapiens) CpG-island No: 38643
  misc_feature (446)..(446): n is either a, c, g or t
aaacggaaatataagacgggggagggggggagaaaaaaagcgggaacgagaaaaaagtaaaaaaaaatagggaagcgaggaggggaagcgaggaatcggagggggggggaaaataaaaggggagaaaagggggaacgagaaaagcgggggggcgaaaggaaaagaggttaataggcgaaaaaagcggaaggtaggaaaggataacggaaaagaatacggggaggagggggcgaagaggaacgcgaaaagaaagaggggaacgggcggagacggggaagaagaatcgtaaaaataacgggaaagaaggggggcggaaagaaagcgaaagggggaaaggggagaaaagcggggaataaagggagaatagaggagggtagggaaaaacgggggggtcgggggaaaataaaggaagggcggcgggaaaaggaaagagggataataaagangggggggaataggagcgggaaggaaaggggaggggaagggaaaaaggcggaaggggggga

SEQ ID NO: 38644 - DNA, 506 bp, Artificial Sequence
  chemically treated genomic DNA (Homo sapiens) CpG-island No: 38644
  misc_feature (61)..(61): n is either a, c, g or t
tcccccccttccgcctttttcccttcccctcccctttccttcccgctcctattcccccccntctttattatccctctttccttttcccgccgcccttcctttattttcccccgacccccccgtttttccctaccctcctctattctccctttattccccgcttttctcccctttccccctttcgctttctttccgccccccttctttcccgttatttttacgattcttcttccccgtctccgcccgttcccctctttcttttcgcgttcctcttcgccccctcctccccgtattcttttccgttatcctttcctaccttccgcttttttcgcctattaacctcttttcctttcgcccccccgcttttctcgttcccccttttctccccttttattttccccccccctccgattcctcgcttcccctcctcgcttccctatttttttttacttttttctcgttcccgctttttttctccccccctcccccgtcttatatttccgttt

SEQ ID NO: 38645 - DNA, 518 bp, Artificial Sequence
  chemically treated genomic DNA (Homo sapiens) CpG-island No: 38645
tgttcgcgcgtttttttttttgtttttttttttttttttttttttttttttttttttttttttttttttttttttttttttttttcgttttttttgttttttttttttttcgtttttttttttttcgttttttcgttttttttttttttttttttcgttttttttttttttttttttttttttcgtttttttcggtttcgttcgttttttgttttttttttcgttttttcggtttttttttttggtttttttttcgttttttttcgttttttttttttttttttttttttttttttttttttttttttttttttgttttttttttttttttttcgttttttcgtttgcggtttttttcgttttttcgtttgcgttttttcgttgttttttttttttttttttttttttttttcgtttttttggtttttttcgtttttttttttttttttttcgtttttcgtttttcgtttttttttttcgtttttttttttttttttttcgttttcgtttattcggcg

SEQ ID NO: 38646 - DNA, 518 bp, Artificial Sequence
  chemically treated genomic DNA (Homo sapiens) CpG-island No: 38646
cgccgaataaacgaaaacgaaaaaaaaaaaaaaaaaaacgaaaaaaaaaaacgaaaaacgaaaaacgaaaaaaaaaaaaaaaaaaacgaaaaaaaccaaaaaaacgaaaaaaaaaaaaaaaaaaaaaaaaaaaacaacgaaaaaacgcaaacgaaaaaacgaaaaaaaccgcaaacgaaaaaacgaaaaaaaaaaaaaaaaaacaaaaaaaaaaaaaaaaaaaaaaaaaaaaaaaaaaaaaaaaaaaaaaaacgaaaaaaaacgaaaaaaaaaccaaaaaaaaaaaccgaaaaaacgaaaaaaaaaacaaaaaacgaacgaaaccgaaaaaaacgaaaaaaaaaaaaaaaaaaaaaaaaaacgaaaaaaaaaaaaaaaaaaaacgaaaaaacgaaaaaaaaaaaaacgaaaaaaaaaaaaaacaaaaaaaacgaaaaaaaaaaaaaaaaaaaaaaaaaaaaaaaaaaaaaaaaaaaaaaaaaaaaaaaaaaaaaaacaaaaaaaaaaacgcgcgaaca

SEQ ID NO: 38647 - DNA, 518 bp, Artificial Sequence
  chemically treated genomic DNA (Homo sapiens) CpG-island No: 38647
cgtcgagtaggcgggggcgaaagggaaaagaagggggacgggggggggaaacggggggcggggggcgggggggagaagaaggggggcggggaggattaggaaaacgggggaaaaaagggggggggggggggagataacggggaaacgtaaacggaagaacgagggggatcgtagacgagagggcggaaaaggggggggggagataaaggggggaaaggggaagggaagggggggggggaaagggaaagggaacgggggaagacggggggggggttaggaagggaagtcggggaaacgggggaaggggtaagaggcgagcggggtcgggggggacggggaggaaggggaagaagggggggggcggggggagaaaaaaggggaaacggggaaacgggggaggaggggacggaggagagggggaatagggggggcggagggagaagaagggaaggggggggaaagggaaaaggaagaaaagggggggggaagggaggggtaggggggggggcgcgcggata

SEQ ID NO: 38648 - DNA, 518 bp, Artificial Sequence
  chemically treated genomic DNA (Homo sapiens) CpG-island No: 38648
tatccgcgcgcccccccccctacccctcccttcccccccccttttcttccttttccctttccccccccttcccttcttctccctccgccccccctattccccctctcctccgtcccctcctcccccgtttccccgtttccccttttttctccccccgcccccccccttcttccccttcctccccgtcccccccgaccccgctcgcctcttaccccttcccccgtttccccgacttcccttcctaaccccccccccgtcttcccccgttccctttccctttcccccccccccttcccttcccctttcccccctttatctccccccccccttttccgccctctcgtctacgatccccctcgttcttccgtttacgtttccccgttatctcccccccccccccccttttttcccccgttttcctaatcctccccgccccccttcttctcccccccgccccccgccccccgtttcccccccccgtcccccttcttttccctttcgcccccgcctactcgacg

SEQ ID NO: 38649 - DNA, 573 bp, Artificial Sequence
  chemically treated genomic DNA (Homo sapiens) CpG-island No: 38649
ttttttcgttttttttttcgtttcgcggtttcgcgtttcgttcgtttttttttttcgttttttcgcgtcgtcgttttttttttttcgttttttttcgttttttcgtttttttttttttttttttcgttttttgttttttttttcgtttcgcgttcgcgttttttgtcgtgtttgttttttgttttttttttttttttttttttttttttttttttttcgttttttttttttttcgttcgttcgtcgtttttgttttttttcgcgtttttcgttttcgtgttgtcgtttttttttgtgtttcgttttttttttttttttttttttgtttttttttttttttttttttttttttcgtttttcgtttttcgtgtgtgcgtgttttttttttttcgcgttttttttttttttttcgtttttttttttttttcgtttttcgtttttttcgtcgttttttttttttcgattttttttcgttttcgtttttttttcgcgtttgcgtttggtcgttttcgtttttttgtttcgttttttcgttttttttttttttttttttttttttttttttttcgtttt

SEQ ID NO: 38650 - DNA, 573 bp, Artificial Sequence
  chemically treated genomic DNA (Homo sapiens) CpG-island No: 38650
aaaacgaaaaaaaaaaaaaaaaaaaaaaaaaaaaaaaaaacgaaaaaacgaaacaaaaaaacgaaaacgaccaaacgcaaacgcgaaaaaaaaacgaaaacgaaaaaaaatcgaaaaaaaaaaaacgacgaaaaaaacgaaaaacgaaaaaaaaaaaaaaacgaaaaaaaaaaaaaaaacgcgaaaaaaaaaaaacacgcacacacgaaaaacgaaaaacgaaaaaaaaaaaaaaaaaaaaaaaaaaacaaaaaaaaaaaaaaaaaaaaaacgaaacacaaaaaaaaacgacaacacgaaaacgaaaaacgcgaaaaaaaacaaaaacgacgaacgaacgaaaaaaaaaaaaaacgaaaaaaaaaaaaaaaaaaaaaaaaaaaaaaaaaaaacaaaaaacaaacacgacaaaaaacgcgaacgcgaaacgaaaaaaaaaacaaaaaacgaaaaaaaaaaaaaaaaaaacgaaaaaacgaaaaaaaacgaaaaaaaaaaaacgacgacgcgaaaaaacgaaaaaaaaaaacgaacgaaacgcgaaaccgcgaaacgaaaaaaaaaacgaaaaaa

SEQ ID NO: 38651 - DNA, 573 bp, Artificial Sequence
  chemically treated genomic DNA (Homo sapiens) CpG-island No: 38651
aggacgaaaaggggggggggagggggggagaaaaaggagacggggggacgaaataaaaaaacgggggcgattaggcgtaggcgcggaaaaaaaacggaagcgggagaaaatcgggaaagaagaaacggcgggaggaacgagaaacgggggggaaagaaagacggaggaaaagagggaagcgcggaagaaagggggtacgtatatacggggagcggggagcggaaaggagaaaaggggggggggaagagtaagaggaggagaaaagaaaaggcggagtataggaaagagcgatagtacgggggcgagaaacgcgaaaaaaaataaaaacggcgggcgggcggggagaggggaaagcgggaaaaaagggagggggggaaaaaggggggggggaataagaggtaaatacggtaaggggcgcggacgcggggcggaaggggggataaaaggcgggggggggggggagaagaacgggaaggcggggaaaaacggggggggggaaacgacggcgcgggggggcgggaggaaaaagcgagcggagcgcggaatcgcgggacggagggaagaacgaggggg

SEQ ID NO: 38652 - DNA, 573 bp, Artificial Sequence
  chemically treated genomic DNA (Homo sapiens) CpG-island No: 38652
ccccctcgttcttccctccgtcccgcgattccgcgctccgctcgctttttcctcccgcccccccgcgccgtcgtttccccccccccgtttttccccgccttcccgttcttctcccccccccccccgccttttatccccccttccgccccgcgtccgcgccccttaccgtatttacctcttattcccccccccctttttccccccctcccttttttcccgctttcccctctccccgcccgcccgccgtttttattttttttcgcgtttctcgcccccgtactatcgctctttcctatactccgccttttcttttctcctcctcttactcttccccccccccttttctcctttccgctccccgctccccgtatatacgtaccccctttcttccgcgcttccctcttttcctccgtctttctttcccccccgtttctcgttcctcccgccgtttcttctttcccgattttctcccgcttccgttttttttccgcgcctacgcctaatcgcccccgtttttttatttcgtccccccgtctcctttttctccccccctccccccccccttttcgtcct

SEQ ID NO: 38653 - DNA, 553 bp, Artificial Sequence
  chemically treated genomic DNA (Homo sapiens) CpG-island No: 38653
  misc_feature (459)..(459): n is either a, c, g or t
tttcgttttgtgttttttttttacgcgtcgggtttgcggttttttttttttttttttttttttttttttcgtttttttcgtttgcgtttttcgttttcggtggtttgttttcgttttttttcgtttttttttcgttttttttttttttttcgtttttttttttttttcgtttttgtttttcgtgttttttcggtgtcgggcggtttcgttttttcgtgttttttttttgtgtttttttcgttgtcgttcggttttttgtttttttcgtttcggtgttgttttttttttttttttttgtttttttttttttggtgcgcgtttttttttttttttttcgtttttttcgcgttttttttttcgttttcgttcgtttttttttttttcgttttttttttttttttttttttttcgtttttttttttttttttttttttttcgtttgtttttttttttttgttnttttttttttgtttttgtcgcgcggttgcgttgtttcgttttgttttgtgtgttcgtcgttttttttttcgtttttcgtttttttttttttttt

SEQ ID NO: 38654 - DNA, 553 bp, Artificial Sequence
  chemically treated genomic DNA (Homo sapiens) CpG-island No: 38654
  misc_feature (95)..(95): n is either a, c, g or t
aaaaaaaaaaaaaaaacgaaaaacgaaaaaaaaaacgacgaacacacaaaacaaaacgaaacaacgcaaccgcgcgacaaaaacaaaaaaaaaanaacaaaaaaaaaaaaacaaacgaaaaaaaaaaaaaaaaaaaaaaaaacgaaaaaaaaaaaaaaaaaaaaaaaacgaaaaaaaaaaaaacgaacgaaaacgaaaaaaaaaacgcgaaaaaaacgaaaaaaaaaaaaaaaaacgcgcaccaaaaaaaaaaaaacaaaaaaaaaaaaaaaaaacaacaccgaaacgaaaaaaacaaaaaaccgaacgacaacgaaaaaaacacaaaaaaaaaacacgaaaaaacgaaaccgcccgacaccgaaaaaacacgaaaaacaaaaacgaaaaaaaaaaaaaaacgaaaaaaaaaaaaaaaacgaaaaaaaaacgaaaaaaaacgaaaacaaaccaccgaaaacgaaaaacgcaaacgaaaaaaacgaaaaaaaaaaaaaaaaaaaaaaaaaaaaaaccgcaaacccgacgcgtaaaaaaaaaacacaaaacgaaa

SEQ ID NO: 38655 - DNA, 553 bp, Artificial Sequence
  chemically treated genomic DNA (Homo sapiens) CpG-island No: 38655
  misc_feature (95)..(95): n is either a, c, g or t
aggaggaaaagaggggcggggggcggaaaaagagacggcgggtatataaaataaaacggggtaacgtagtcgcgcgataaaaataaaaggggggnaatagggaagggaagataggcggggaaaagaaaggggggggaaaaagcggggaaaagagggaaaggggaaaaacggggagaggaaaggcgaacgggggcggaagggaaaacgcggggggagcggagggagggaaaagaagcgcgtattaaaaaagggaagatagggggggaagggaaaaataatatcggggcggggggggtaggggatcgggcgataacggagggggtataggggggggatacgaggggacgggatcgttcggtatcggaggggtacggggaataaaggcgggggggggaaaaaaacggagggggggaaaagggcggggggaagacgggggggggcggaggtagattatcgggagcggaaggcgtaggcggggagggcggaaagaaaaaggggaagagggggggggggatcgtaaattcgacgcgtaagggaaggatataaagcgggg

SEQ ID NO: 38656 - DNA, 553 bp, Artificial Sequence
  chemically treated genomic DNA (Homo sapiens) CpG-island No: 38656
  misc_feature (459)..(459): n is either a, c, g or t
ccccgctttatatccttcccttacgcgtcgaatttacgatccccccccccctcttcccctttttctttccgccctccccgcctacgccttccgctcccgataatctacctccgcccccccccgtcttccccccgcccttttccccccctccgtttttttcccccccccgcctttattccccgtacccctccgataccgaacgatcccgtcccctcgtatcccccccctataccccctccgttatcgcccgatcccctaccccccccgccccgatattatttttcccttccccccctatcttcccttttttaatacgcgcttcttttccctccctccgctccccccgcgttttcccttccgcccccgttcgcctttcctctccccgtttttcccctttccctcttttccccgctttttcccccccctttcttttccccgcctatcttcccttccctattnccccccttttatttttatcgcgcgactacgttaccccgttttattttatatacccgccgtctctttttccgccccccgcccctcttttcctcct

SEQ ID NO: 38657 - DNA, 1092 bp, Artificial Sequence
  chemically treated genomic DNA (Homo sapiens) CpG-island No: 38657
tttaggtgcgggttcgagtgataagaacgtttacgtattttcgggagagaacgaaaaggtgttcgggtttggcgggggcggggaacgttaggggttggtgggaattgaggggttttcggttttcgggaagcggagtttcgggtcggtcgcgggtcgcgggttacgtagggagtacggggttttcgtcgtttttaggtcgcgttttttagcgttttttgcggttcgtgtttagcgcggtcgtcgtagtttcgacgtcgtagtcggacgtggggtttagggggcgttgtggtttagcggcgtcggcggtaggagcggttattcgacgttggaggtttcgttgaggattttcgtttgtcgtatttcggtcgtttcgtcgtagttttgcgttttcggttcggttcggcggcgttttttcgggattcgcgtggttgtcgcggttcgggcgtcgatgcggttgggcgggtgtcgggttttagtagtagtagtagtcgtagttgcggttatcgtagtttttataggagtgggaggtttcgcggcggcgtttggggtcgcgtcggtgtttttcggaggaggttttcggtttagggacgattttcgtggttatgttgaagcggaggcggtcgttgttcgaggtgagtgtggcgcggcgtggttcggggttcgttcgtttttcgtcgtttgtgggggttttggcggtagatcgcgggtcgggcggacggggcgttttgttattgcggtcgttttttttattttgcggttttggggttttagtttttttttttcgcgtttttcgggaggttgaaggtcgtggggggcgattaggtttcgcgtcgttgggaagttttcgtttcggtttcggtttcggcgcggtcgggtgtgtggagttgggggtcggtaggagtacggtcgtttttcgggtttgtatgggttcgggtcgagcgtagttttttagttcgggttttgtacgtatatttcggagggaggtagatgacgtttgtttgtaaataagttttggtttttacgcgttttatatcgagttttttagaatttcggttgtggcggggaaagggggaggagaggaaggttagggtg

SEQ ID NO: 38658 - DNA, 1092 bp, Artificial Sequence
  chemically treated genomic DNA (Homo sapiens) CpG-island No: 38658
caccctaaccttcctctcctccccctttccccgccacaaccgaaattctaaaaaactcgatataaaacgcgtaaaaaccaaaacttatttacaaacaaacgtcatctacctccctccgaaatatacgtacaaaacccgaactaaaaaactacgctcgacccgaacccatacaaacccgaaaaacgaccgtactcctaccgacccccaactccacacacccgaccgcgccgaaaccgaaaccgaaacgaaaacttcccaacgacgcgaaacctaatcgccccccacgaccttcaacctcccgaaaaacgcgaaaaaaaaaaactaaaaccccaaaaccgcaaaataaaaaaaacgaccgcaataacaaaacgccccgtccgcccgacccgcgatctaccgccaaaacccccacaaacgacgaaaaacgaacgaaccccgaaccacgccgcgccacactcacctcgaacaacgaccgcctccgcttcaacataaccacgaaaatcgtccctaaaccgaaaacctcctccgaaaaacaccgacgcgaccccaaacgccgccgcgaaacctcccactcctataaaaactacgataaccgcaactacgactactactactactaaaacccgacacccgcccaaccgcatcgacgcccgaaccgcgacaaccacgcgaatcccgaaaaaacgccgccgaaccgaaccgaaaacgcaaaactacgacgaaacgaccgaaatacgacaaacgaaaatcctcaacgaaacctccaacgtcgaataaccgctcctaccgccgacgccgctaaaccacaacgccccctaaaccccacgtccgactacgacgtcgaaactacgacgaccgcgctaaacacgaaccgcaaaaaacgctaaaaaacgcgacctaaaaacgacgaaaaccccgtactccctacgtaacccgcgacccgcgaccgacccgaaactccgcttcccgaaaaccgaaaacccctcaattcccaccaacccctaacgttccccgcccccgccaaacccgaacaccttttcgttctctcccgaaaatacgtaaacgttcttatcactcgaacccgcacctaaa

SEQ ID NO: 38659 - DNA, 1092 bp, Artificial Sequence
  chemically treated genomic DNA (Homo sapiens) CpG-island No: 38659
tattttggtttttttttttttttttttttttcgttataatcgggattttgagggattcggtatgggacgcgtggaagttaaagtttgtttgtaaataggcgttatttgttttttttcgggatgtacgtgtagggttcgggttaagaggttgcgttcggttcgggtttatgtaaattcgaaaggcggtcgtgtttttgtcggtttttagttttatatattcggtcgcgtcggaatcgaggtcggagcgagggttttttaacggcgcggggtttaatcgttttttacggtttttagtttttcgggggacgcggggagaaagggttgaggttttaggatcgtagggtgggggaggcgatcgtagtggtaggacgtttcgttcgttcggttcgcggtttgtcgttagggtttttataggcggcgggaggcgggcgagtttcggattacgtcgcgttatatttatttcgagtagcggtcgttttcgttttagtatggttacgggggtcgtttttgagtcgaaagtttttttcggagggtatcggcgcggttttaggcgtcgtcgcgaaattttttatttttgtaggagttgcggtagtcgtagttgcggttgttattgttgttaaggttcggtattcgtttagtcgtatcggcgttcgggtcgcggtagttacgcggatttcggaggagcgtcgtcgagtcgggtcgggggcgtaaggttgcggcgggacgatcgaggtgcggtaggcggggatttttagcgaagtttttagcgtcgggtggtcgtttttgtcgtcggcgtcgttgggttatagcgttttttggattttacgttcggttacggcgtcgggattgcggcggtcgcgttgggtacgagtcgtagggaacgttaaggagcgcggtttgggggcggcgagggtttcgtgttttttgcgtagttcgcggttcgcggtcggttcgggatttcgtttttcgggaatcggaagttttttagtttttattaatttttggcgtttttcgttttcgttagattcgagtattttttcgttttttttcgaagatacgtgaacgtttttgttattcggattcgtatttgag

SEQ ID NO: 38660 - DNA, 1092 bp, Artificial Sequence
  chemically treated genomic DNA (Homo sapiens) CpG-island No: 38660
ctcaaatacgaatccgaataacaaaaacgttcacgtatcttcgaaaaaaaacgaaaaaatactcgaatctaacgaaaacgaaaaacgccaaaaattaataaaaactaaaaaacttccgattcccgaaaaacgaaatcccgaaccgaccgcgaaccgcgaactacgcaaaaaacacgaaaccctcgccgcccccaaaccgcgctccttaacgttccctacgactcgtacccaacgcgaccgccgcaatcccgacgccgtaaccgaacgtaaaatccaaaaaacgctataacccaacgacgccgacgacaaaaacgaccacccgacgctaaaaacttcgctaaaaatccccgcctaccgcacctcgatcgtcccgccgcaaccttacgcccccgacccgactcgacgacgctcctccgaaatccgcgtaactaccgcgacccgaacgccgatacgactaaacgaataccgaaccttaacaacaataacaaccgcaactacgactaccgcaactcctacaaaaataaaaaatttcgcgacgacgcctaaaaccgcgccgataccctccgaaaaaaactttcgactcaaaaacgacccccgtaaccatactaaaacgaaaacgaccgctactcgaaataaatataacgcgacgtaatccgaaactcgcccgcctcccgccgcctataaaaaccctaacgacaaaccgcgaaccgaacgaacgaaacgtcctaccactacgatcgcctcccccaccctacgatcctaaaacctcaaccctttctccccgcgtcccccgaaaaactaaaaaccgtaaaaaacgattaaaccccgcgccgttaaaaaaccctcgctccgacctcgattccgacgcgaccgaatatataaaactaaaaaccgacaaaaacacgaccgcctttcgaatttacataaacccgaaccgaacgcaacctcttaacccgaaccctacacgtacatcccgaaaaaaaacaaataacgcctatttacaaacaaactttaacttccacgcgtcccataccgaatccctcaaaatcccgattataacgaaaaaaaaaaaaaaaaaaaaaaaccaaaata

SEQ ID NO: 38661 - DNA, 560 bp, Artificial Sequence
  chemically treated genomic DNA (Homo sapiens) CpG-island No: 38661
tagcggggttgtgaagtgtaaatcgtttcgaggtaattcgagaacgggaggattgttattagttcgttaggagagtgcgatgtttcggttcgtttcggagtagggaaatttttgcgggaggttgcgttggtatcggtcgtttggcgcggttcgcgcggattcgggcgacgggatacgtagcgcggtattgttattttgtgggtatcggcggtagcggcgcggcggggcgaagtcggcgagcgagcgattcgcggttcggagttcgacgtcggttagcgaacgttcgtaggaacgcgtcggtcgagcgggagttcgcgggggcggggcgcgcggtttcggttacgtgggttagtaataggtagtagttaatgagaacgcgagttaggtggtgcgtgcgttcgtcgcgcgcggaaggtaaggggttcgggagaaggcgtgggcgcgttacgggttcggtgggatcgcgggtggggaagtttagaaagtttgtttttttttgttaggagtcgtttgtcgtaggcgggatgaacgagagttgtaaaatgggattgttttatttt

SEQ ID NO: 38662 - DNA, 560 bp, Artificial Sequence
  chemically treated genomic DNA (Homo sapiens) CpG-island No: 38662
aaaataaaacaatcccattttacaactctcgttcatcccgcctacgacaaacgactcctaacaaaaaaaaacaaactttctaaacttccccacccgcgatcccaccgaacccgtaacgcgcccacgccttctcccgaaccccttaccttccgcgcgcgacgaacgcacgcaccacctaactcgcgttctcattaactactacctattactaacccacgtaaccgaaaccgcgcgccccgcccccgcgaactcccgctcgaccgacgcgttcctacgaacgttcgctaaccgacgtcgaactccgaaccgcgaatcgctcgctcgccgacttcgccccgccgcgccgctaccgccgatacccacaaaataacaataccgcgctacgtatcccgtcgcccgaatccgcgcgaaccgcgccaaacgaccgataccaacgcaacctcccgcaaaaatttccctactccgaaacgaaccgaaacatcgcactctcctaacgaactaataacaatcctcccgttctcgaattacctcgaaacgatttacacttcacaaccccgcta

SEQ ID NO: 38663 - DNA, 560 bp, Artificial Sequence
  chemically treated genomic DNA (Homo sapiens) CpG-island No: 38663
ggaatgggatagttttattttatagttttcgtttatttcgtttgcggtaggcggtttttgatagggaagagtaagttttttggatttttttattcgcggttttatcgggttcgtggcgcgtttacgttttttttcgggttttttatttttcgcgcgcggcgggcgtacgtattatttgattcgcgtttttattggttgttgtttgttgttaatttacgtgatcggagtcgcgcgtttcgttttcgcgggttttcgttcggtcggcgcgtttttgcgggcgttcgttggtcggcgtcgggtttcgagtcgcgggtcgttcgttcgtcggtttcgtttcgtcgcgtcgttgtcgtcgatgtttataaggtggtagtgtcgcgttgcgtgtttcgtcgttcgggttcgcgcgagtcgcgttaggcggtcggtgttagcgtagtttttcgtaaaagtttttttgtttcggaacggatcggggtatcgtatttttttggcgggttggtgatagttttttcgttttcgggttgtttcggggcgatttgtattttatagtttcgttg

SEQ ID NO: 38664 - DNA, 560 bp, Artificial Sequence
  chemically treated genomic DNA (Homo sapiens) CpG-island No: 38664
caacgaaactataaaatacaaatcgccccgaaacaacccgaaaacgaaaaaactatcaccaacccgccaaaaaaatacgataccccgatccgttccgaaacaaaaaaacttttacgaaaaactacgctaacaccgaccgcctaacgcgactcgcgcgaacccgaacgacgaaacacgcaacgcgacactaccaccttataaacatcgacgacaacgacgcgacgaaacgaaaccgacgaacgaacgacccgcgactcgaaacccgacgccgaccaacgaacgcccgcaaaaacgcgccgaccgaacgaaaacccgcgaaaacgaaacgcgcgactccgatcacgtaaattaacaacaaacaacaaccaataaaaacgcgaatcaaataatacgtacgcccgccgcgcgcgaaaaataaaaaacccgaaaaaaaacgtaaacgcgccacgaacccgataaaaccgcgaataaaaaaatccaaaaaacttactcttccctatcaaaaaccgcctaccgcaaacgaaataaacgaaaactataaaataaaactatcccattcc

SEQ ID NO: 38665 - DNA, 590 bp, Artificial Sequence
  chemically treated genomic DNA (Homo sapiens) CpG-island No: 38665
ttcgtttagatttattttgagtaggatggacggcggtagttggttgatgtttggggtttcggggggcggttttttgtgatagtcgtaggggttttcgggggattttcgatagttcgcgtcgttatatttatgttgttgttgggcggataagggggcggtgttttcggttcggatagcgttttcgttagtttcggtgggggtattttcggaggtgggagaagagggcggagggtagagcggttgcgggggttgtttcggggtttggtagtagtcggcgtcggggggtcggggcggcgaagcgttttttttcgtaggttatttatttcgttatcgtcgtcgtcgtcgttagttagtcgtagttttcgtcgtcgtagcggggttgtttgtagggggtgtaggcggggatttcggttttttttcgtttgtatattatttcggggggcgtagggagttcggtcggtgacggtgtcggttttcggaagagttgtacggcggcgggcggttttaggaagcgtatcggttttaagttggttaggaagagatttcggttttgttgtttttaggcggcggtcgtagttagttttaatttt

SEQ ID NO: 38666 - DNA, 590 bp, Artificial Sequence
  chemically treated genomic DNA (Homo sapiens) CpG-island No: 38666
aaaattaaaactaactacgaccgccgcctaaaaacaacaaaaccgaaatctcttcctaaccaacttaaaaccgatacgcttcctaaaaccgcccgccgccgtacaactcttccgaaaaccgacaccgtcaccgaccgaactccctacgccccccgaaataatatacaaacgaaaaaaaaccgaaatccccgcctacaccccctacaaacaaccccgctacgacgacgaaaactacgactaactaacgacgacgacgacgataacgaaataaataacctacgaaaaaaaacgcttcgccgccccgaccccccgacgccgactactaccaaaccccgaaacaacccccgcaaccgctctaccctccgccctcttctcccacctccgaaaatacccccaccgaaactaacgaaaacgctatccgaaccgaaaacaccgcccccttatccgcccaacaacaacataaatataacgacgcgaactatcgaaaatcccccgaaaacccctacgactatcacaaaaaaccgccccccgaaaccccaaacatcaaccaactaccgccgtccatcctactcaaaataaatctaaacgaa

SEQ ID NO: 38667 - DNA, 590 bp, Artificial Sequence
  chemically treated genomic DNA (Homo sapiens) CpG-island No: 38667
agagttggggttggttgcggtcgtcgtttgggagtagtagggtcgaagtttttttttggttagtttggggtcggtgcgttttttggggtcgttcgtcgtcgtgtagttttttcgggggtcgatatcgttatcggtcgagttttttacgtttttcgaaatggtgtgtaagcggaagggggtcggggttttcgtttgtattttttgtaagtagtttcgttgcggcggcgggggttgcggttggttggcggcggcggcggcggtggcggggtgagtggtttgcggggggaggcgtttcgtcgtttcggtttttcgacgtcggttgttgttaggtttcggagtagttttcgtagtcgttttgtttttcgttttttttttttattttcgaaggtgtttttatcgaagttggcggggacgttgttcgagtcgggggtatcgtttttttgttcgtttagtagtagtatgaatgtggcgacgcggattgtcgggagtttttcgaaaatttttgcgattgttatagggagtcgtttttcgaaattttagatattaattagttgtcgtcgtttattttgtttaaggtgggtttgggcgag

SEQ ID NO: 38668 - DNA, 590 bp, Artificial Sequence
  chemically treated genomic DNA (Homo sapiens) CpG-island No: 38668
ctcgcccaaacccaccttaaacaaaataaacgacgacaactaattaatatctaaaatttcgaaaaacgactccctataacaatcgcaaaaattttcgaaaaactcccgacaatccgcgtcgccacattcatactactactaaacgaacaaaaaaacgatacccccgactcgaacaacgtccccgccaacttcgataaaaacaccttcgaaaataaaaaaaaaaaacgaaaaacaaaacgactacgaaaactactccgaaacctaacaacaaccgacgtcgaaaaaccgaaacgacgaaacgcctccccccgcaaaccactcaccccgccaccgccgccgccgccgccaaccaaccgcaacccccgccgccgcaacgaaactacttacaaaaaatacaaacgaaaaccccgacccccttccgcttacacaccatttcgaaaaacgtaaaaaactcgaccgataacgatatcgacccccgaaaaaactacacgacgacgaacgaccccaaaaaacgcaccgaccccaaactaaccaaaaaaaaacttcgaccctactactcccaaacgacgaccgcaaccaaccccaactct

SEQ ID NO: 38669 - DNA, 1210 bp, Artificial Sequence
  chemically treated genomic DNA (Homo sapiens) CpG-island No: 38669
gggcgacgaagtcgaggcggtagcggcggcggcggcggcggtcgaggatagtaggaagcggcgggtagtagcggcgtagttttcggcggttagggtcgcgtagcgtcgcgttaggtgttgagaggaggaggcggtagcgtaggtttcgtttcgcggcggcggcgagagcggcggttttttttttgggtcggcgggggcgggcgcgtcgggattgtgtacgatgaagtagagtatgtagggttcgcggaagaagtagtttcggtttcggggcgtcgtcggttgagggggtattttggttggggttcggcggggtagtttgaggagagggcgtcggcggcggtattaattgtaatagcgaggttttttttggttcgggcggttacgcggttttttcgagagaaggtggtttatatagaaggtttcgaggagggggatcgggacgggagggagggagatttagagaggcgggttttcggtagcggggtaggtcgttcgttggttcggttttcggaggggtcgttttttttgcgtatatatacgtatatacgggtatatacgcgacggtggggggtgggcgttagttgcgggtcgtcggagtgttcgacgggggttatatgttttgtttagggaagtcgggagaacgatgggcgcgagttttggggacgcgagggagggagcgagcgagtttgtcggttaggcgattagttcgggttcggttagtcggtttagttagttagcggagcggtcggggaaaggtcgggtttcgttcggattattttaattgcggattcgtcgtcggcgcgcgtattcgcgattttgttcggagtcgtaggagcgcgcggttcgtttcggtagggggcggagttagttgcggtggcgcgttcgtggcggggacgtcggtattcggttgtttattcgggacggtcgttatatcggtattacgggaagaagtcggtcggttagggtacggagttttgggtttgcggggtgcggcgtacgttttttttttttatcgtttaaggttttttcgaagttgttgggcgtgcgtcgcgtttttgaggcgggaggagatattttcgagttagttgtgtgatattcgtttatatagtcgcgttgacgtttcgaggtgtaagtttaagagttgttattggtcgggagtcgttgggtttttttttttattttttatttttgttattatttttgattcgga

SEQ ID NO: 38670 - DNA, 1210 bp, Artificial Sequence
  chemically treated genomic DNA (Homo sapiens) CpG-island No: 38670
tccgaatcaaaaataataacaaaaataaaaaataaaaaaaaaaacccaacgactcccgaccaataacaactcttaaacttacacctcgaaacgtcaacgcgactatataaacgaatatcacacaactaactcgaaaatatctcctcccgcctcaaaaacgcgacgcacgcccaacaacttcgaaaaaaccttaaacgataaaaaaaaaaaacgtacgccgcaccccgcaaacccaaaactccgtaccctaaccgaccgacttcttcccgtaataccgatataacgaccgtcccgaataaacaaccgaataccgacgtccccgccacgaacgcgccaccgcaactaactccgccccctaccgaaacgaaccgcgcgctcctacgactccgaacaaaatcgcgaatacgcgcgccgacgacgaatccgcaattaaaataatccgaacgaaacccgacctttccccgaccgctccgctaactaactaaaccgactaaccgaacccgaactaatcgcctaaccgacaaactcgctcgctccctccctcgcgtccccaaaactcgcgcccatcgttctcccgacttccctaaacaaaacatataacccccgtcgaacactccgacgacccgcaactaacgcccaccccccaccgtcgcgtatatacccgtatatacgtatatatacgcaaaaaaaacgacccctccgaaaaccgaaccaacgaacgacctaccccgctaccgaaaacccgcctctctaaatctccctccctcccgtcccgatccccctcctcgaaaccttctatataaaccaccttctctcgaaaaaaccgcgtaaccgcccgaaccaaaaaaaacctcgctattacaattaataccgccgccgacgccctctcctcaaactaccccgccgaaccccaaccaaaataccccctcaaccgacgacgccccgaaaccgaaactacttcttccgcgaaccctacatactctacttcatcgtacacaatcccgacgcgcccgcccccgccgacccaaaaaaaaaaccgccgctctcgccgccgccgcgaaacgaaacctacgctaccgcctcctcctctcaacacctaacgcgacgctacgcgaccctaaccgccgaaaactacgccgctactacccgccgcttcctactatcctcgaccgccgccgccgccgccgctaccgcctcgacttcgtcgccc

SEQ ID NO: 38671 - DNA, 1210 bp, Artificial Sequence
  chemically treated genomic DNA (Homo sapiens) CpG-island No: 38671
ttcgagttaggggtggtgataggggtggaaggtgaggggaagagtttagcggttttcggttaatggtagtttttgaatttatatttcgagacgttagcgcggttgtgtaaacggatgttatatagttggttcggaagtgttttttttcgttttagaaacgcggcgtacgtttagtagtttcggaaaaattttaggcggtgggagggaggggcgtgcgtcgtatttcgtaagtttagagtttcgtgttttagtcggtcggttttttttcgtagtgtcggtgtgacggtcgtttcgggtgagtagtcgggtgtcggcgttttcgttacgagcgcgttatcgtaattggtttcgttttttgtcggaacgggtcgcgcgtttttgcggtttcgagtagagtcgcgggtgcgcgcgtcggcggcggattcgtagttaaaatggttcgagcgggattcggttttttttcggtcgtttcgttgattgattgagtcggttggtcgggttcggattggtcgtttagtcggtaggttcgttcgttttttttttcgcgtttttaaagttcgcgtttatcgttttttcggtttttttgggtaaagtatgtagttttcgtcgggtatttcggcggttcgtagttgacgtttattttttatcgtcgcgtgtgtgttcgtgtgtgcgtgtgtgtgcgtaggaagggcgattttttcgggggtcgagttagcgagcggtttgtttcgttgtcgggagttcgtttttttgggtttttttttttttcgtttcggttttttttttcggggttttttatatgggttattttttttcgaaggagtcgcgtaatcgttcgagttagaagaggtttcgttgttgtagttggtgtcgtcgtcggcgttttttttttaggttgtttcgtcggattttagttaaggtgtttttttagtcggcggcgtttcggagtcgggattgtttttttcgcgggttttgtatgttttgttttatcgtgtatagtttcggcgcgttcgttttcgtcggtttagaggaggagtcgtcgttttcgtcgtcgtcgcgggacggggtttacgttgtcgttttttttttttagtatttggcgcggcgttacgcggttttggtcgtcgaggattgcgtcgttgttgttcgtcgttttttgttattttcggtcgtcgtcgtcgtcgtcgttgtcgtttcggtttcgtcgttt

SEQ ID NO: 38672 - DNA, 1210 bp, Artificial Sequence
  chemically treated genomic DNA (Homo sapiens) CpG-island No: 38672
aaacgacgaaaccgaaacgacaacgacgacgacgacgacgaccgaaaataacaaaaaacgacgaacaacaacgacgcaatcctcgacgaccaaaaccgcgtaacgccgcgccaaatactaaaaaaaaaaaacgacaacgtaaaccccgtcccgcgacgacgacgaaaacgacgactcctcctctaaaccgacgaaaacgaacgcgccgaaactatacacgataaaacaaaacatacaaaacccgcgaaaaaaacaatcccgactccgaaacgccgccgactaaaaaaacaccttaactaaaatccgacgaaacaacctaaaaaaaaaacgccgacgacgacaccaactacaacaacgaaacctcttctaactcgaacgattacgcgactccttcgaaaaaaaataacccatataaaaaaccccgaaaaaaaaaaccgaaacgaaaaaaaaaaaaacccaaaaaaacgaactcccgacaacgaaacaaaccgctcgctaactcgacccccgaaaaaatcgcccttcctacgcacacacacgcacacacgaacacacacgcgacgataaaaaataaacgtcaactacgaaccgccgaaatacccgacgaaaactacatactttacccaaaaaaaccgaaaaaacgataaacgcgaactttaaaaacgcgaaaaaaaaaacgaacgaacctaccgactaaacgaccaatccgaacccgaccaaccgactcaatcaatcaacgaaacgaccgaaaaaaaaccgaatcccgctcgaaccattttaactacgaatccgccgccgacgcgcgcacccgcgactctactcgaaaccgcaaaaacgcgcgacccgttccgacaaaaaacgaaaccaattacgataacgcgctcgtaacgaaaacgccgacacccgactactcacccgaaacgaccgtcacaccgacactacgaaaaaaaaccgaccgactaaaacacgaaactctaaacttacgaaatacgacgcacgcccctccctcccaccgcctaaaatttttccgaaactactaaacgtacgccgcgtttctaaaacgaaaaaaaacacttccgaaccaactatataacatccgtttacacaaccgcgctaacgtctcgaaatataaattcaaaaactaccattaaccgaaaaccgctaaactcttcccctcaccttccacccctatcaccacccctaactcgaa

SEQ ID NO: 38673 - DNA, 683 bp, Artificial Sequence
  chemically treated genomic DNA (Homo sapiens) CpG-island No: 38673
gggaacgcgttgttatggtttcggtttggtttttttttttttggggatcggtttagttcgtttttcgggggtcggtttagagcggttttcgattcgggatttatgttttagcgggatttcggttttgtcgtaggttggggtatttcgggaaggtcgggttttaggggtttcgcggttagtttagcggacggagaatcgggattaggtgggagttttagggcgggtcgattttcggttttacggattcggacgtttagttattttcgatcgttcggaggtttttagggggattcggttggtcgtagttacgtcgacgttagattttcgttgtgcgtgttcggtttcgagggtagggggagacggttaggttttattcgtcgcgttcgttttgttcgggcgttcggttttttcgttgtatttagtttttatcggggcggtcgggattcggcggttaagttgttgcgcgttgcgggtatcggcgcggacgggggttcgggcgtttcgtcgtcgtatgtagacgattcgttgttcgtaagttgttgcgtcgttcgtttgtttcgtttttttgtaatggttcggtcgcgtatttcgggtttacgatttttttttttttttacgatttcgggtttttggttgatttggcgttggcgttgggtttagtgtaggcgtgggtttggtaatgg

SEQ ID NO: 38674 - DNA, 683 bp, Artificial Sequence
  chemically treated genomic DNA (Homo sapiens) CpG-island No: 38674
ccattaccaaacccacgcctacactaaacccaacgccaacgccaaatcaaccaaaaacccgaaatcgtaaaaaaaaaaaaaaatcgtaaacccgaaatacgcgaccgaaccattacaaaaaaacgaaacaaacgaacgacgcaacaacttacgaacaacgaatcgtctacatacgacgacgaaacgcccgaacccccgtccgcgccgatacccgcaacgcgcaacaacttaaccgccgaatcccgaccgccccgataaaaactaaatacaacgaaaaaaccgaacgcccgaacaaaacgaacgcgacgaataaaacctaaccgtctccccctaccctcgaaaccgaacacgcacaacgaaaatctaacgtcgacgtaactacgaccaaccgaatccccctaaaaacctccgaacgatcgaaaataactaaacgtccgaatccgtaaaaccgaaaatcgacccgccctaaaactcccacctaatcccgattctccgtccgctaaactaaccgcgaaacccctaaaacccgaccttcccgaaataccccaacctacgacaaaaccgaaatcccgctaaaacataaatcccgaatcgaaaaccgctctaaaccgacccccgaaaaacgaactaaaccgatccccaaaaaaaaaaaaaccaaaccgaaaccataacaacgcgttccc

SEQ ID NO: 38675 - DNA, 683 bp, Artificial Sequence
  chemically treated genomic DNA (Homo sapiens) CpG-island No: 38675
ttattgttaggtttacgtttgtattaagtttagcgttagcgttaggttagttaagaattcggggtcgtggaggaggaaggaagtcgtgggttcgggatgcgcggtcggattattgtaggagagcggggtaggcggacggcgtagtagtttgcgggtagcgagtcgtttgtatgcggcggcgaagcgttcgggttttcgttcgcgtcggtgttcgtagcgcgtagtaatttggtcgtcgggtttcggtcgtttcggtagaggttgggtatagcgagggggtcgggcgttcgggtaggacgggcgcggcgggtggggtttggtcgtttttttttgttttcggggtcgaatacgtatagcgagagtttagcgtcggcgtggttgcggttagtcgggtttttttggaggttttcggacgatcggaagtgattgagcgttcgggttcgtgaggtcgggggtcggttcgttttaagatttttatttggtttcggtttttcgttcgttaggttggtcgcggggtttttggggttcgattttttcggggtgttttaatttgcggtaaggtcgaggtttcgttgaggtatgagtttcgggtcggggatcgttttgggtcgattttcggaggacggattaggtcgatttttagagggaagggggttaggtcgaggttatggtagcgcgttttt

SEQ ID NO: 38676 - DNA, 683 bp, Artificial Sequence
  chemically treated genomic DNA (Homo sapiens) CpG-island No: 38676
aaaaacgcgctaccataacctcgacctaacccccttccctctaaaaatcgacctaatccgtcctccgaaaatcgacccaaaacgatccccgacccgaaactcatacctcaacgaaacctcgaccttaccgcaaattaaaacaccccgaaaaaatcgaaccccaaaaaccccgcgaccaacctaacgaacgaaaaaccgaaaccaaataaaaatcttaaaacgaaccgacccccgacctcacgaacccgaacgctcaatcacttccgatcgtccgaaaacctccaaaaaaacccgactaaccgcaaccacgccgacgctaaactctcgctatacgtattcgaccccgaaaacaaaaaaaaacgaccaaaccccacccgccgcgcccgtcctacccgaacgcccgaccccctcgctatacccaacctctaccgaaacgaccgaaacccgacgaccaaattactacgcgctacgaacaccgacgcgaacgaaaacccgaacgcttcgccgccgcatacaaacgactcgctacccgcaaactactacgccgtccgcctaccccgctctcctacaataatccgaccgcgcatcccgaacccacgacttccttcctcctccacgaccccgaattcttaactaacctaacgctaacgctaaacttaatacaaacgtaaacctaacaataa

SEQ ID NO: 38677 - DNA, 1428 bp, Artificial Sequence
  chemically treated genomic DNA (Homo sapiens) CpG-island No: 38677
gggagaagtggcgcgcgtgttttttgttaggggcgggcggcggggcgggggtaggggcggggtcggggttcgggtcgtttttttcgtttttgtagtggtgggcggagcggtttagtagcggcgcgattagcgtgttcgtggtcgtttttttgcgcgcgggtttcggttttttcgttttgttgttttttacgcgtatgatggttagcggttttttgaagggttgcggaagcgggttgttggtggggatttattttatttttttgcgcggtcgtttgattacgggcggttcggcggcgtcgtcgggttcggcggggttggcgttggggtttacggtttgtattttcgagtcgcgtatcgtgggggtggcgtcgtggttggattgcgttagcgtcgttagtagttgtcggattacgttgtcgtatatgaggtcgttttcgttggtgatgaagtttagtcggttgagcgatttgatgtggtcgcggttttcgttgtagaatatggttaggatgttgatgtcgtagaattgcgagcggcgttattgtcggcgcgttttgatgtttattttgtgtagtttgtcgaagatgaagttgtttttgcggaagatgaagaggtggatgaggttgacgaggatgatgaggtttatgacgtatagtagtacgatgtttacgttcgcgatgatgcgttgtagttgtacggacgggagtttgtagtttacgcgtatcgcgggtttcgtatttgtcgtttcgttcggggacgcgtttagcgcgtaggtgaattcgttttgtttttgcgtggcgtagtaggtgtataggtaggagatgggtacggcgtttagtagtaggattagtacgtgtcgcgttaggtatagtttggttaggaagttgttgcggtcgcggcgttttaggtatttttcgaataggttttgtttcgggttttttttttttttcgcgttttcgatgatttcgcgtttttcgcgtttcgtgatgttcgggtttttggattggatttgtttttcgattttgggcgcgcggttttcggtcgttcggtggtaatagttgtcgattttttgtagtaggaagttgagttcggaggtgaggcgcgtggaggttaggaatttttagtttagcgcgggtacgtatatgatggcggcgaaggttagtagcgcgtagggtaggaatttgtgtttaaatagcgacggttataggttggcgtttacgtcgggtagcgcgtttcgtagtttcgtttagtagtagtcgcgggcgtatagcgtttggtcgcgcgtgaagttgtgcggggtgtaatagtaaatgggtttttttgggggtaaagaggagatacgggttggggcggggaggcgtacgggttgggttgaagaaatcgggttggatttgatcgcgtttttgtcgaattttttttaggagttttttt

SEQ ID NO: 38678 - DNA, 1428 bp, Artificial Sequence
  chemically treated genomic DNA (Homo sapiens) CpG-island No: 38678
aaaaaaactcctaaaaaaaattcgacaaaaacgcgatcaaatccaacccgatttcttcaacccaacccgtacgcctccccgccccaacccgtatctcctctttacccccaaaaaaacccatttactattacaccccgcacaacttcacgcgcgaccaaacgctatacgcccgcgactactactaaacgaaactacgaaacgcgctacccgacgtaaacgccaacctataaccgtcgctatttaaacacaaattcctaccctacgcgctactaaccttcgccgccatcatatacgtacccgcgctaaactaaaaattcctaacctccacgcgcctcacctccgaactcaacttcctactacaaaaaatcgacaactattaccaccgaacgaccgaaaaccgcgcgcccaaaatcgaaaaacaaatccaatccaaaaacccgaacatcacgaaacgcgaaaaacgcgaaatcatcgaaaacgcgaaaaaaaaaaaaaacccgaaacaaaacctattcgaaaaatacctaaaacgccgcgaccgcaacaacttcctaaccaaactatacctaacgcgacacgtactaatcctactactaaacgccgtacccatctcctacctatacacctactacgccacgcaaaaacaaaacgaattcacctacgcgctaaacgcgtccccgaacgaaacgacaaatacgaaacccgcgatacgcgtaaactacaaactcccgtccgtacaactacaacgcatcatcgcgaacgtaaacatcgtactactatacgtcataaacctcatcatcctcgtcaacctcatccacctcttcatcttccgcaaaaacaacttcatcttcgacaaactacacaaaataaacatcaaaacgcgccgacaataacgccgctcgcaattctacgacatcaacatcctaaccatattctacaacgaaaaccgcgaccacatcaaatcgctcaaccgactaaacttcatcaccaacgaaaacgacctcatatacgacaacgtaatccgacaactactaacgacgctaacgcaatccaaccacgacgccacccccacgatacgcgactcgaaaatacaaaccgtaaaccccaacgccaaccccgccgaacccgacgacgccgccgaaccgcccgtaatcaaacgaccgcgcaaaaaaataaaataaatccccaccaacaacccgcttccgcaacccttcaaaaaaccgctaaccatcatacgcgtaaaaaacaacaaaacgaaaaaaccgaaacccgcgcgcaaaaaaacgaccacgaacacgctaatcgcgccgctactaaaccgctccgcccaccactacaaaaacgaaaaaaacgacccgaaccccgaccccgcccctacccccgccccgccgcccgcccctaacaaaaaacacgcgcgccacttctccc

SEQ ID NO: 38679 - DNA, 1428 bp, Artificial Sequence
  chemically treated genomic DNA (Homo sapiens) CpG-island No: 38679
ggagaggtttttgggaggggttcggtagggacgcggttaggtttagttcggtttttttagtttagttcgtgcgttttttcgttttagttcgtgttttttttttgtttttagaggaatttatttattgttatatttcgtataattttacgcgcgattaggcgttgtacgttcgcggttattgttggacggagttgcgggacgcgttgttcggcgtggacgttagtttgtggtcgtcgttgtttgagtataagtttttgttttacgcgttgttggttttcgtcgttattatgtacgtgttcgcgttgggttgggagtttttggtttttacgcgttttattttcgagtttaattttttgttgtaggagatcgataattgttattatcgggcggtcgagggtcgcgcgtttaagatcgagaagtagatttagtttaagggttcgggtattacggagcgcgagaagcgcgagattatcgagaacgcggagaaggagaagagttcggagtagaatttgttcgagaagtatttggagcgtcgcggtcgtagtaattttttggttaagttgtatttggcgcggtacgtgttgattttgttgttgagcgtcgtgtttattttttatttgtgtatttattacgttacgtagaagtagaacgagtttatttgcgcgttgggcgcgttttcggacggggcggtaggtgcggggttcgcggtgcgcgtgagttgtaagttttcgttcgtgtaattgtagcgtattatcgcgggcgtggatatcgtgttgttgtgcgttatgaattttattattttcgttaattttatttatttttttatttttcgtaagagtaattttattttcgataagttgtataaggtgggtattaagacgcgtcggtagtggcgtcgttcgtagttttgcgatattaatattttggttatgttttgtaacgagaatcgcgattatattaagtcgtttaatcggttggattttattattaacgagagcgattttatgtacgataacgtggttcggtagttgttggcggcgttggcgtagtttaattacgacgttatttttacggtgcgcgattcgggggtgtagatcgtggattttagcgttaatttcgtcgagttcgacggcgtcgtcgagtcgttcgtggttaagcggtcgcgtaagaagatgaagtggatttttattagtaattcgttttcgtagttttttaaggagtcgttggttattatgcgcgtggagaatagtaaggcggagaagtcgaagttcgcgcgtaggaagacggttacggatacgttgatcgcgtcgttgttggatcgtttcgtttattattataagggcggagggggcgattcgggtttcggtttcgtttttgttttcgtttcgtcgttcgtttttgataagaagtacgcgcgttatttttttt

SEQ ID NO: 38680 - DNA, 1428 bp, Artificial Sequence
  chemically treated genomic DNA (Homo sapiens) CpG-island No: 38680
aaaaaaaataacgcgcgtacttcttatcaaaaacgaacgacgaaacgaaaacaaaaacgaaaccgaaacccgaatcgccccctccgcccttataataataaacgaaacgatccaacaacgacgcgatcaacgtatccgtaaccgtcttcctacgcgcgaacttcgacttctccgccttactattctccacgcgcataataaccaacgactccttaaaaaactacgaaaacgaattactaataaaaatccacttcatcttcttacgcgaccgcttaaccacgaacgactcgacgacgccgtcgaactcgacgaaattaacgctaaaatccacgatctacacccccgaatcgcgcaccgtaaaaataacgtcgtaattaaactacgccaacgccgccaacaactaccgaaccacgttatcgtacataaaatcgctctcgttaataataaaatccaaccgattaaacgacttaatataatcgcgattctcgttacaaaacataaccaaaatattaatatcgcaaaactacgaacgacgccactaccgacgcgtcttaatacccaccttatacaacttatcgaaaataaaattactcttacgaaaaataaaaaaataaataaaattaacgaaaataataaaattcataacgcacaacaacacgatatccacgcccgcgataatacgctacaattacacgaacgaaaacttacaactcacgcgcaccgcgaaccccgcacctaccgccccgtccgaaaacgcgcccaacgcgcaaataaactcgttctacttctacgtaacgtaataaatacacaaataaaaaataaacacgacgctcaacaacaaaatcaacacgtaccgcgccaaatacaacttaaccaaaaaattactacgaccgcgacgctccaaatacttctcgaacaaattctactccgaactcttctccttctccgcgttctcgataatctcgcgcttctcgcgctccgtaatacccgaacccttaaactaaatctacttctcgatcttaaacgcgcgaccctcgaccgcccgataataacaattatcgatctcctacaacaaaaaattaaactcgaaaataaaacgcgtaaaaaccaaaaactcccaacccaacgcgaacacgtacataataacgacgaaaaccaacaacgcgtaaaacaaaaacttatactcaaacaacgacgaccacaaactaacgtccacgccgaacaacgcgtcccgcaactccgtccaacaataaccgcgaacgtacaacgcctaatcgcgcgtaaaattatacgaaatataacaataaataaattcctctaaaaacaaaaaaaaaacacgaactaaaacgaaaaaacgcacgaactaaactaaaaaaaccgaactaaacctaaccgcgtccctaccgaacccctcccaaaaacctctcc

SEQ ID NO: 38681 - DNA, 1155 bp, Artificial Sequence
  chemically treated genomic DNA (Homo sapiens) CpG-island No: 38681
tcgttagttaatggtcggggttttataaacgttacggttcgcgcgttttttggtaagaggtaagaggtagtaatcgcgagcgtgtcggtcgttagtcgcgggttttcgagtgagtacgttagggagtaggagattaaacgacgggggtcggagttagagtcgtagtgggagttttcggatcggagtacgagtttgagcgggagagcgtcgttcgtacgttcgtcgttattcgcgtattcggcgtagttagagttattagcgtagcgttgttatggagtttagtagtaaggtgagtcgcgcgttcgcgggttttttcgttaggaataaaggcgtagatttttgttcgttttacgtcggttagggtttttttcgtcgtttcgttgcgttgtgcgttcggggcgggtcgcgcgttttttcgagtttggttcggtgcgggtttcgagcgtagcgtttcgtcgggtcgttggtcgtagtggggatgggtttcggatttagcgggtcggagggcgtcgcgtgcgtagttggcgtcggtattgagtatatggttttttttcgggggcgtcgcgtcgtttacgcggttttgttggggttggggatatagggttcgggagcggtacgtcgtatacgatttcggtagcggtagtttagtttcggtttttttcggtgcgggggagggggttcgagcgcggcgtttattggttgagcgggtcgagttttcggttcggtttcggtttcggcgcgcggaggagttaggagtcgttttcgtttttcgtttgtttttttagttcggacgtttttgtaggtgggcggtttggtgcgaggtgttttatcggttttttttatttttttcgttagtttttcgcggtgacgaggtcgaggtcgaggggagggtatttttttttaggttcgggttcgaacgcgggggttgagatgaattttcggtttcggaggtttttttttgcgaggagtgtaggttttaaagttttggtttagtttcgcggagatgtgtttcgcggaggtaggtttattttcggggttaggcggggagcgtaatcggaggggcgggggatttgggggttaggaaagagttttaggttgaagtttagcgggaagcgcgtacgttacggggttggggaatgagggatggggattttg

SEQ ID NO: 38682 - DNA, 1155 bp, Artificial Sequence
  chemically treated genomic DNA (Homo sapiens) CpG-island No: 38682
caaaatccccatccctcattccccaaccccgtaacgtacgcgcttcccgctaaacttcaacctaaaactctttcctaacccccaaatcccccgcccctccgattacgctccccgcctaaccccgaaaataaacctacctccgcgaaacacatctccgcgaaactaaaccaaaactttaaaacctacactcctcgcaaaaaaaaacctccgaaaccgaaaattcatctcaacccccgcgttcgaacccgaacctaaaaaaaaataccctcccctcgacctcgacctcgtcaccgcgaaaaactaacgaaaaaaataaaaaaaaccgataaaacacctcgcaccaaaccgcccacctacaaaaacgtccgaactaaaaaaacaaacgaaaaacgaaaacgactcctaactcctccgcgcgccgaaaccgaaaccgaaccgaaaactcgacccgctcaaccaataaacgccgcgctcgaaccccctcccccgcaccgaaaaaaaccgaaactaaactaccgctaccgaaatcgtatacgacgtaccgctcccgaaccctatatccccaaccccaacaaaaccgcgtaaacgacgcgacgcccccgaaaaaaaaccatatactcaataccgacgccaactacgcacgcgacgccctccgacccgctaaatccgaaacccatccccactacgaccaacgacccgacgaaacgctacgctcgaaacccgcaccgaaccaaactcgaaaaaacgcgcgacccgccccgaacgcacaacgcaacgaaacgacgaaaaaaaccctaaccgacgtaaaacgaacaaaaatctacgcctttattcctaacgaaaaaacccgcgaacgcgcgactcaccttactactaaactccataacaacgctacgctaataactctaactacgccgaatacgcgaataacgacgaacgtacgaacgacgctctcccgctcaaactcgtactccgatccgaaaactcccactacgactctaactccgacccccgtcgtttaatctcctactccctaacgtactcactcgaaaacccgcgactaacgaccgacacgctcgcgattactacctcttacctcttaccaaaaaacgcgcgaaccgtaacgtttataaaaccccgaccattaactaacga

SEQ ID NO: 38683 - DNA, 1155 bp, Artificial Sequence
  chemically treated genomic DNA (Homo sapiens) CpG-island No: 38683
tagagtttttattttttattttttaatttcgtggcgtgcgcgtttttcgttagattttagtttggggtttttttttggtttttagatttttcgttttttcggttgcgtttttcgtttggtttcgagggtaaatttgttttcgcggaatatattttcgcgagattgggttaaagttttggggtttgtatttttcgtaaaggagagttttcgagatcggaggtttattttaattttcgcgttcgagttcgggtttggagaaaagtgtttttttttcggtttcggtttcgttatcgcgggggattggcgggaggagtaggggaggtcggtgggatatttcgtattaggtcgtttatttataggggcgttcgggttaggggagtagacggagagcgggggcggtttttgattttttcgcgcgtcggggtcggggtcgggtcgggggttcggttcgtttagttaatgggcgtcgcgttcgggttttttttttcgtatcgggaggggtcgaggttgggttgtcgttgtcgaggtcgtgtgcgacgtgtcgttttcgggttttgtgtttttagttttagtagggtcgcgtggacggcgcggcgttttcggaaggaggttatgtgtttagtgtcggcgttaattacgtacgcggcgtttttcggttcgttagattcgaagtttatttttattgcggttagcggttcggcggggcgttgcgttcgggattcgtatcgagttaggttcggagaggcgcgcggttcgtttcgggcgtatagcgtagcggggcggcgggggaggttttggtcggcgtaaggcgggtaggagtttgcgtttttgtttttggcgggagggttcgcgggcgcgcgatttattttgttgttgggttttatggtagcgttgcgttggtggttttggttgcgtcgggtacgcgggtggcgacgggcgtgcgagcggcgttttttcgtttaggttcgtgtttcggttcggggatttttattgcgattttgatttcgattttcgtcgtttggttttttgttttttggcgtgtttattcggggattcgcgattagcgatcggtacgttcgcggttgttattttttgttttttgttagagagcgcgcggatcgtagcgtttataggatttcggttattggttggcga

SEQ ID NO: 38684 - DNA, 1155 bp, Artificial Sequence
  chemically treated genomic DNA (Homo sapiens) CpG-island No: 38684
tcgccaaccaataaccgaaatcctataaacgctacgatccgcgcgctctctaacaaaaaacaaaaaataacaaccgcgaacgtaccgatcgctaatcgcgaatccccgaataaacacgccaaaaaacaaaaaaccaaacgacgaaaatcgaaatcaaaatcgcaataaaaatccccgaaccgaaacacgaacctaaacgaaaaaacgccgctcgcacgcccgtcgccacccgcgtacccgacgcaaccaaaaccaccaacgcaacgctaccataaaacccaacaacaaaataaatcgcgcgcccgcgaaccctcccgccaaaaacaaaaacgcaaactcctacccgccttacgccgaccaaaacctcccccgccgccccgctacgctatacgcccgaaacgaaccgcgcgcctctccgaacctaactcgatacgaatcccgaacgcaacgccccgccgaaccgctaaccgcaataaaaataaacttcgaatctaacgaaccgaaaaacgccgcgtacgtaattaacgccgacactaaacacataacctccttccgaaaacgccgcgccgtccacgcgaccctactaaaactaaaaacacaaaacccgaaaacgacacgtcgcacacgacctcgacaacgacaacccaacctcgacccctcccgatacgaaaaaaaaaacccgaacgcgacgcccattaactaaacgaaccgaacccccgacccgaccccgaccccgacgcgcgaaaaaatcaaaaaccgcccccgctctccgtctactcccctaacccgaacgcccctataaataaacgacctaatacgaaatatcccaccgacctcccctactcctcccgccaatcccccgcgataacgaaaccgaaaccgaaaaaaaaacacttttctccaaacccgaactcgaacgcgaaaattaaaataaacctccgatctcgaaaactctcctttacgaaaaatacaaaccccaaaactttaacccaatctcgcgaaaatatattccgcgaaaacaaatttaccctcgaaaccaaacgaaaaacgcaaccgaaaaaacgaaaaatctaaaaaccaaaaaaaaaccccaaactaaaatctaacgaaaaacgcgcacgccacgaaattaaaaaataaaaaataaaaactcta

SEQ ID NO: 38685 - DNA, 750 bp, Artificial Sequence
  chemically treated genomic DNA (Homo sapiens) CpG-island No: 38685
acgaggacgagggtaggttcgcgttagtttttcgtttttcgagttttagtcgatttttcgtattcgcgttttgtttagattttatcgtattttatttttttaggtcgcgtcgtttcgtagtattttattttagacggagattttgagggtttcgttggttagttgcggttgaggcggttttttttttcgtcgttcgtcgtttattttttcgtcgcgtcgttcgggtcgggtttggggcgcgcgggttgagttaaagggagtcggggtttagggtcgtaggttacggcgcggggcggttgtaggtttagcggttcggttttgcggcgcgttgcggttttttataatttggttaagttattcggtttcgtcggttttatagagtaggcgtcgcgaagggaggggcggtgtagtgtcgcgcgttttttcgtcgacgtgtttacgtagttaatcggcgatcgcgaagttattcgagtgaaatagcgatcggcgttttggcgtaagcgcgttattcgtggcggaaatgacgttagtattcgtcgggttcgcggtaaggtgtgaggggagggataattttggtagaacggtgatatgggcgttaggaggcgttgtggagatcgaggaggtaggggaaaatcgaggttggacgttagcgtcgtttagtcggttatagttgtttttcgagtagcgagtggggtaggagcggttttatttttttttgcgatttattcgtttgttgagtttagattttgt

SEQ ID NO: 38686 - DNA, 750 bp, Artificial Sequence
  chemically treated genomic DNA (Homo sapiens) CpG-island No: 38686
acaaaatctaaactcaacaaacgaataaatcgcaaaaaaaaataaaaccgctcctaccccactcgctactcgaaaaacaactataaccgactaaacgacgctaacgtccaacctcgattttcccctacctcctcgatctccacaacgcctcctaacgcccatatcaccgttctaccaaaattatccctcccctcacaccttaccgcgaacccgacgaatactaacgtcatttccgccacgaataacgcgcttacgccaaaacgccgatcgctatttcactcgaataacttcgcgatcgccgattaactacgtaaacacgtcgacgaaaaaacgcgcgacactacaccgcccctcccttcgcgacgcctactctataaaaccgacgaaaccgaataacttaaccaaattataaaaaaccgcaacgcgccgcaaaaccgaaccgctaaacctacaaccgccccgcgccgtaacctacgaccctaaaccccgactccctttaactcaacccgcgcgccccaaacccgacccgaacgacgcgacgaaaaaataaacgacgaacgacgaaaaaaaaaaccgcctcaaccgcaactaaccaacgaaaccctcaaaatctccgtctaaaataaaatactacgaaacgacgcgacctaaaaaaataaaatacgataaaatctaaacaaaacgcgaatacgaaaaatcgactaaaactcgaaaaacgaaaaactaacgcgaacctaccctcgtcctcgt

SEQ ID NO: 38687 - DNA, 750 bp, Artificial Sequence
  chemically treated genomic DNA (Homo sapiens) CpG-island No: 38687
gtaaggtttgggtttagtaggcgagtaggtcgtaaggaaaggtagagtcgtttttgttttattcgttgttcgaggggtagttgtggtcgattgggcgacgttgacgtttagtttcggtttttttttattttttcggtttttatagcgttttttggcgtttatgttatcgttttattaagattgtttttttttttatattttatcgcgagttcggcggatgttgacgttattttcgttacgagtagcgcgtttgcgttaaggcgtcggtcgttgttttattcggatggtttcgcggtcgtcgattggttgcgtgagtacgtcggcgggagggcgcgcgatattgtatcgttttttttttcgcggcgtttgttttgtagagtcggcggaatcgggtagtttggttaggttgtgaggaatcgtagcgcgtcgtaggatcgggtcgttgagtttgtagtcgtttcgcgtcgtgatttgcgattttagatttcgattttttttggtttagttcgcgcgttttaggttcggttcgggcggcgcgacgggaggatgagcggcgggcggcggaaggaggagtcgttttagtcgtagttggttaacggggtttttaaagttttcgtttggagtaaggtgttgcggagcgacgcggtttgggaggataaggtacggtggagtttgaatagggcgcgggtgcgaggagtcggttgggattcggggaacggaagattggcgcgggtttgttttcgttttcgt

SEQ ID NO: 38688 - DNA, 750 bp, Artificial Sequence
  chemically treated genomic DNA (Homo sapiens) CpG-island No: 38688
acgaaaacgaaaacaaacccgcgccaatcttccgttccccgaatcccaaccgactcctcgcacccgcgccctattcaaactccaccgtaccttatcctcccaaaccgcgtcgctccgcaacaccttactccaaacgaaaactttaaaaaccccgttaaccaactacgactaaaacgactcctccttccgccgcccgccgctcatcctcccgtcgcgccgcccgaaccgaacctaaaacgcgcgaactaaaccaaaaaaaatcgaaatctaaaatcgcaaatcacgacgcgaaacgactacaaactcaacgacccgatcctacgacgcgctacgattcctcacaacctaaccaaactacccgattccgccgactctacaaaacaaacgccgcgaaaaaaaaaacgatacaatatcgcgcgccctcccgccgacgtactcacgcaaccaatcgacgaccgcgaaaccatccgaataaaacaacgaccgacgccttaacgcaaacgcgctactcgtaacgaaaataacgtcaacatccgccgaactcgcgataaaatataaaaaaaaaaacaatcttaataaaacgataacataaacgccaaaaaacgctataaaaaccgaaaaaataaaaaaaaaccgaaactaaacgtcaacgtcgcccaatcgaccacaactacccctcgaacaacgaataaaacaaaaacgactctacctttccttacgacctactcgcctactaaacccaaaccttac

SEQ ID NO: 38689 - DNA, 588 bp, Artificial Sequence
  chemically treated genomic DNA (Homo sapiens) CpG-island No: 38689
tatttatacgttgtcgtcggcgggttgggcgcggggagcggtcgaggaaagtcgggttgatttgggttcggcgggcgggcggggcggggtagagggtttcgggggtacgggggaggtaagtagtacgggttattagggtttcgtcgtgtcgcggagatgatgcggggaaggagtagggtaaaggagcggcgttttcgaatgcggcgtcgcgcgtttttcgcgggtcgggcggaggcgtttatttatttgaggcgcgggtattcgtcgttagtgtagtagtagcggcggcggcggcggcggcggcggcggcggcggcggcgagaggggcgggggaggtgttgcggttcgcgtaggcgcgtcgaggacgttagggcggcgtatgagtgttgtgttcgtttatttcgggaattatcgagaagatggtggttgagttaggagaggtcggcggcgttatttttgatgtagttttttttgttgcggagtttttttagagaagaattttagattttggaggcgttgggcggtagggttattgagttttgcgtttggagcgttttttttagttttttgagtcgtatttttatgaag

SEQ ID NO: 38690 - DNA, 588 bp, Artificial Sequence
  chemically treated genomic DNA (Homo sapiens) CpG-island No: 38690
cttcataaaaatacgactcaaaaaactaaaaaaaacgctccaaacgcaaaactcaataaccctaccgcccaacgcctccaaaatctaaaattcttctctaaaaaaactccgcaacaaaaaaaactacatcaaaaataacgccgccgacctctcctaactcaaccaccatcttctcgataattcccgaaataaacgaacacaacactcatacgccgccctaacgtcctcgacgcgcctacgcgaaccgcaacacctcccccgcccctctcgccgccgccgccgccgccgccgccgccgccgccgccgctactactacactaacgacgaatacccgcgcctcaaataaataaacgcctccgcccgacccgcgaaaaacgcgcgacgccgcattcgaaaacgccgctcctttaccctactccttccccgcatcatctccgcgacacgacgaaaccctaataacccgtactacttacctcccccgtacccccgaaaccctctaccccgccccgcccgcccgccgaacccaaatcaacccgactttcctcgaccgctccccgcgcccaacccgccgacgacaacgtataaata

SEQ ID NO: 38691 - DNA, 588 bp, Artificial Sequence
  chemically treated genomic DNA (Homo sapiens) CpG-island No: 38691
ttttataaggatgcgatttagggaattgagggaagcgttttagacgtagagtttaatggttttgtcgtttagcgtttttaaaatttgagatttttttttgaggaaatttcgtagtaagaaaaattatattaaagatggcgtcgtcggttttttttggtttagttattattttttcggtagttttcgaggtggacgggtatagtatttatgcgtcgttttggcgttttcggcgcgtttgcgcggatcgtagtatttttttcgtttttttcgtcgtcgtcgtcgtcgtcgtcgtcgtcgtcgtcgtcgttgttgttgtattgacggcgggtgttcgcgttttaggtgagtgagcgttttcgttcggttcgcggggggcgcgcggcgtcgtattcgggggcgtcgtttttttgttttgtttttttttcgtattattttcgcggtacggcgaggttttggtggttcgtgttgtttgtttttttcgtgttttcggggttttttgtttcgtttcgttcgttcgtcggatttaggttagttcggtttttttcggtcgtttttcgcgtttagttcgtcggcgatagcgtgtgggta

SEQ ID NO: 38692 - DNA, 588 bp, Artificial Sequence
  chemically treated genomic DNA (Homo sapiens) CpG-island No: 38692
tacccacacgctatcgccgacgaactaaacgcgaaaaacgaccgaaaaaaaccgaactaacctaaatccgacgaacgaacgaaacgaaacaaaaaaccccgaaaacacgaaaaaaacaaacaacacgaaccaccaaaacctcgccgtaccgcgaaaataatacgaaaaaaaaacaaaacaaaaaaacgacgcccccgaatacgacgccgcgcgccccccgcgaaccgaacgaaaacgctcactcacctaaaacgcgaacacccgccgtcaatacaacaacaacgacgacgacgacgacgacgacgacgacgacgacgacgaaaaaaacgaaaaaaatactacgatccgcgcaaacgcgccgaaaacgccaaaacgacgcataaatactatacccgtccacctcgaaaactaccgaaaaaataataactaaaccaaaaaaaaccgacgacgccatctttaatataatttttcttactacgaaatttcctcaaaaaaaaatctcaaattttaaaaacgctaaacgacaaaaccattaaactctacgtctaaaacgcttccctcaattccctaaatcgcatccttataaaa

SEQ ID NO: 38693 - DNA, 502 bp, Artificial Sequence
  chemically treated genomic DNA (Homo sapiens) CpG-island No: 38693
gcgtcgggaaatggcggcggggggtaggatggaggacgtgagtgtacggaggcggcgggcggttggtttcggaattcgtttttttttgtgtcggggcgtacggggcggagatttagagagggaagttatttttggcgattgcggtcgcggtcgaaggggcgtcgtttgtgttcggggaggtttgggcgcggggttttgggagggttttaggcggttgtgggattcgcgatacgttggtttcgggttaatttttttagtggaggttggggtgggtttttgggcggtggcgcgcggttttcgggggttttacgtggcgtttagtttacgtgcggggtacgtttttgatttcggaattggtagttttacgtgatgcgcgtttgtttgatagtttttttttttcgcgagttttcgggagtcgggtcgatgggtttcgttcggacgttttaggggtatagggggcgaatttttttttttggtgaggttttttgttttggttttagag

SEQ ID NO: 38694 - DNA, 502 bp, Artificial Sequence
  chemically treated genomic DNA (Homo sapiens) CpG-island No: 38694
ctctaaaaccaaaacaaaaaacctcaccaaaaaaaaaaattcgccccctatacccctaaaacgtccgaacgaaacccatcgacccgactcccgaaaactcgcgaaaaaaaaaaactatcaaacaaacgcgcatcacgtaaaactaccaattccgaaatcaaaaacgtaccccgcacgtaaactaaacgccacgtaaaacccccgaaaaccgcgcgccaccgcccaaaaacccaccccaacctccactaaaaaaattaacccgaaaccaacgtatcgcgaatcccacaaccgcctaaaaccctcccaaaaccccgcgcccaaacctccccgaacacaaacgacgccccttcgaccgcgaccgcaatcgccaaaaataacttccctctctaaatctccgccccgtacgccccgacacaaaaaaaaacgaattccgaaaccaaccgcccgccgcctccgtacactcacgtcctccatcctaccccccgccgccatttcccgacgc

SEQ ID NO: 38695 - DNA, 502 bp, Artificial Sequence
  chemically treated genomic DNA (Homo sapiens) CpG-island No: 38695
ttttagagttaaggtaagggattttattaggaagggagattcgttttttgtgtttttgggacgttcgagcggaatttatcggttcggttttcggagattcgcggggaggaagggttgttaggtaggcgcgtattacgtgaagttgttagtttcgggattaaagacgtatttcgtacgtgggttgggcgttacgtgggattttcgggggtcgcgcgttatcgtttaggagtttattttagtttttattgggaaaattagttcggagttaacgtgtcgcggattttatagtcgtttggagtttttttaaagtttcgcgtttaggttttttcgggtataggcggcgttttttcggtcgcggtcgtagtcgttaagggtggtttttttttttgagttttcgtttcgtgcgtttcggtataagaaaaagcggatttcggggttaatcgttcgtcgttttcgtgtatttacgttttttattttgtttttcgtcgttatttttcgacgt

SEQ ID NO: 38696 - DNA, 502 bp, Artificial Sequence
  chemically treated genomic DNA (Homo sapiens) CpG-island No: 38696
acgtcgaaaaataacgacgaaaaacaaaataaaaaacgtaaatacacgaaaacgacgaacgattaaccccgaaatccgctttttcttataccgaaacgcacgaaacgaaaactcaaaaaaaaaaaccacccttaacgactacgaccgcgaccgaaaaaacgccgcctatacccgaaaaaacctaaacgcgaaactttaaaaaaactccaaacgactataaaatccgcgacacgttaactccgaactaattttcccaataaaaactaaaataaactcctaaacgataacgcgcgacccccgaaaatcccacgtaacgcccaacccacgtacgaaatacgtctttaatcccgaaactaacaacttcacgtaatacgcgcctacctaacaacccttcctccccgcgaatctccgaaaaccgaaccgataaattccgctcgaacgtcccaaaaacacaaaaaacgaatctcccttcctaataaaatcccttaccttaactctaaaa

SEQ ID NO: 38697 - DNA, 670 bp, Artificial Sequence
  chemically treated genomic DNA (Homo sapiens) CpG-island No: 38697
agttttcgttcgcgttcgtttaggattgcgggtatagcgtttcgttacgtttcgtattttttatttttcgtcggtttcggttttgtttttagagttgcgttcgcggtcggcgatacgcgcgtagcgtcgttattcgtagcggcgtagtcgttcgttcgtttatttacgcgggaggtagcggcggcgtttttattgtggtttttttcgggttttagaacgtaggtatcgattaatatagttagtattattttagtcgcggacgtcggtattgttcgttcgtcgagtcgcgttttattcgtttcggaggggggtcgcgttttttttatcgcgcgttattatttgcggcggcggttttcgcggttatgtgtcgttcggtcgggcgcgtttcgtttattgcgcggttttcgttcgttcgagtgcggggcggcggcgacgggatcggcgggcgcgcgggttcggttattttcgggttcggtttcgtcggcgtcgacgttgtgacgggattgcgatgcggtttttcgcggcggtcgagtatttttttttcggcgtttttttttttttttgttgttgttgttgtcgttgtcgttgtcgtttttgtttttggaggcgggcgggcgggcgttagtcgggtgcggggcgggcgtgtttagacgttggttcgtaggtcggg

SEQ ID NO: 38698 - DNA, 670 bp, Artificial Sequence
  chemically treated genomic DNA (Homo sapiens) CpG-island No: 38698
cccgacctacgaaccaacgtctaaacacgcccgccccgcacccgactaacgcccgcccgcccgcctccaaaaacaaaaacgacaacgacaacgacaacaacaacaacaaaaaaaaaaaaaaacgccgaaaaaaaaatactcgaccgccgcgaaaaaccgcatcgcaatcccgtcacaacgtcgacgccgacgaaaccgaacccgaaaataaccgaacccgcgcgcccgccgatcccgtcgccgccgccccgcactcgaacgaacgaaaaccgcgcaataaacgaaacgcgcccgaccgaacgacacataaccgcgaaaaccgccgccgcaaataataacgcgcgataaaaaaaacgcgacccccctccgaaacgaataaaacgcgactcgacgaacgaacaataccgacgtccgcgactaaaataatactaactatattaatcgatacctacgttctaaaacccgaaaaaaaccacaataaaaacgccgccgctacctcccgcgtaaataaacgaacgaacgactacgccgctacgaataacgacgctacgcgcgtatcgccgaccgcgaacgcaactctaaaaacaaaaccgaaaccgacgaaaaataaaaaatacgaaacgtaacgaaacgctatacccgcaatcctaaacgaacgcgaacgaaaact

SEQ ID NO: 38699 - DNA, 670 bp, Artificial Sequence
  chemically treated genomic DNA (Homo sapiens) CpG-island No: 38699
ttcggtttgcgggttagcgtttgggtacgttcgtttcgtattcggttggcgttcgttcgttcgtttttagaagtagaagcggtagcggtagcggtagtagtagtagtaggaggaaggggaggcgtcgagggaggggtattcggtcgtcgcgggaggtcgtatcgtagtttcgttatagcgtcggcgtcggcggggtcgaattcggaagtggtcgagttcgcgcgttcgtcggtttcgtcgtcgtcgtttcgtattcgggcgaacgggagtcgcgtagtagacggagcgcgttcggtcgagcggtatatggtcgcgggggtcgtcgtcgtaggtggtggcgcgcggtgaggagagcgcggttttttttcggggcggatggaacgcggttcggcgggcgggtagtgtcggcgttcgcggttggaatggtgttggttgtgttggtcggtgtttgcgttttgaagttcgagaggagttataatggagacgtcgtcgttgtttttcgcgtgagtgagcgggcgggcggttgcgtcgttgcggataacggcgttgcgcgcgtgtcgtcggtcgcgggcgtagttttggggataaggtcggggtcggcgggaggtgggagatgcggggcgtgacgaggcgttgtgttcgtagttttgagcggacgcggacggaaatt

SEQ ID NO: 38700 - DNA, 670 bp, Artificial Sequence
  chemically treated genomic DNA (Homo sapiens) CpG-island No: 38700
aatttccgtccgcgtccgctcaaaactacgaacacaacgcctcgtcacgccccgcatctcccacctcccgccgaccccgaccttatccccaaaactacgcccgcgaccgacgacacgcgcgcaacgccgttatccgcaacgacgcaaccgcccgcccgctcactcacgcgaaaaacaacgacgacgtctccattataactcctctcgaacttcaaaacgcaaacaccgaccaacacaaccaacaccattccaaccgcgaacgccgacactacccgcccgccgaaccgcgttccatccgccccgaaaaaaaaccgcgctctcctcaccgcgcgccaccacctacgacgacgacccccgcgaccatataccgctcgaccgaacgcgctccgtctactacgcgactcccgttcgcccgaatacgaaacgacgacgacgaaaccgacgaacgcgcgaactcgaccacttccgaattcgaccccgccgacgccgacgctataacgaaactacgatacgacctcccgcgacgaccgaatacccctccctcgacgcctccccttcctcctactactactactaccgctaccgctaccgcttctacttctaaaaacgaacgaacgaacgccaaccgaatacgaaacgaacgtacccaaacgctaacccgcaaaccgaa

SEQ ID NO: 38701 - DNA, 615 bp, Artificial Sequence
  chemically treated genomic DNA (Homo sapiens) CpG-island No: 38701
tacgcgcgacggttcgggagtacggatttttgtttttcgtagtatcgtttttcgggtggagtcggcggtttcgtttcgtagagttggggttgtatttggggtaacggggtcgggtttggacgttaggtcggaggagtagtatttgttaggagtacgtttcgtcggtaggtcgtaggagttttgggagtcgtcgttatgggtacgttcggcgggtggggggtcggtcgggttaaagattcggagttacgcggggcgggggtcggtatcgagggtcgggaggcgcgaagggtacgcggcggcgggaagcggggcgattcgaaggtttacgggggtcgggaggttgcggggcgttcgggattttttttcgggtggttatcgtgcggtcggggcgcggaagttagaggtgtttagaggcgtcgatttcgtcgaggttgcgattttggttcgttcgttcgtggggtattgtaattttcgtatttttattttgcgggtcgggagtgcgtttggagcgggacgggatttagcgggtgacggtaggggcggtagaaatatcgtttaattggcggaagttttgtggttgtttttgtatttgttttgtttttggttggcgaggtg

SEQ ID NO: 38702 - DNA, 615 bp, Artificial Sequence
  chemically treated genomic DNA (Homo sapiens) CpG-island No: 38702
cacctcgccaaccaaaaacaaaacaaatacaaaaacaaccacaaaacttccgccaattaaacgatatttctaccgcccctaccgtcacccgctaaatcccgtcccgctccaaacgcactcccgacccgcaaaataaaaatacgaaaattacaataccccacgaacgaacgaaccaaaatcgcaacctcgacgaaatcgacgcctctaaacacctctaacttccgcgccccgaccgcacgataaccacccgaaaaaaaatcccgaacgccccgcaacctcccgacccccgtaaaccttcgaatcgccccgcttcccgccgccgcgtacccttcgcgcctcccgaccctcgataccgacccccgccccgcgtaactccgaatctttaacccgaccgaccccccacccgccgaacgtacccataacgacgactcccaaaactcctacgacctaccgacgaaacgtactcctaacaaatactactcctccgacctaacgtccaaacccgaccccgttaccccaaatacaaccccaactctacgaaacgaaaccgccgactccacccgaaaaacgatactacgaaaaacaaaaatccgtactcccgaaccgtcgcgcgta

SEQ ID NO: 38703 - DNA, 615 bp, Artificial Sequence
  chemically treated genomic DNA (Homo sapiens) CpG-island No: 38703
tatttcgttagttagaggtaagataagtgtaaaggtagttataaggttttcgttagttagacggtgtttttgtcgtttttgtcgttattcgttgggtttcgtttcgttttaagcgtattttcggttcgtagggtgggaatacgaggattatagtgttttacgggcgggcgggttaggatcgtaatttcggcggagtcggcgtttttgggtatttttggttttcgcgtttcggtcgtacggtgattattcgggaggggatttcgggcgtttcgtaatttttcggttttcgtgggttttcgggtcgtttcgtttttcgtcgtcgcgtatttttcgcgtttttcggttttcggtgtcggttttcgtttcgcgtagtttcgagtttttagttcggtcggttttttattcgtcgagcgtatttatggcggcggtttttagggtttttgcgatttgtcggcgggacgtgtttttggtaggtgttattttttcgatttgacgtttaggttcggtttcgttgttttaggtatagttttagttttgcgaggcggggtcgtcggttttattcggggggcggtgttgcggggagtagaggttcgtgttttcgagtcgtcgcgcgtg

SEQ ID NO: 38704 - DNA, 615 bp, Artificial Sequence
  chemically treated genomic DNA (Homo sapiens) CpG-island No: 38704
cacgcgcgacgactcgaaaacacgaacctctactccccgcaacaccgccccccgaataaaaccgacgaccccgcctcgcaaaactaaaactatacctaaaacaacgaaaccgaacctaaacgtcaaatcgaaaaaataacacctaccaaaaacacgtcccgccgacaaatcgcaaaaaccctaaaaaccgccgccataaatacgctcgacgaataaaaaaccgaccgaactaaaaactcgaaactacgcgaaacgaaaaccgacaccgaaaaccgaaaaacgcgaaaaatacgcgacgacgaaaaacgaaacgacccgaaaacccacgaaaaccgaaaaattacgaaacgcccgaaatcccctcccgaataatcaccgtacgaccgaaacgcgaaaaccaaaaatacccaaaaacgccgactccgccgaaattacgatcctaacccgcccgcccgtaaaacactataatcctcgtattcccaccctacgaaccgaaaatacgcttaaaacgaaacgaaacccaacgaataacgacaaaaacgacaaaaacaccgtctaactaacgaaaaccttataactacctttacacttatcttacctctaactaacgaaata

SEQ ID NO: 38705 - DNA, 666 bp, Artificial Sequence
  chemically treated genomic DNA (Homo sapiens) CpG-island No: 38705
  misc_feature (174)..(174): n is either a, c, g or t
ggggatttacgggtcgatttgtaatttaatataagttttttaagttttgcggttttaaaataacgtttattcggcggtgcgtcgttttcgttatttttacgtttgtttggattcggattcgagattttggcggcgggtcgggtttttttcgtttgagtagggacgcggcgagtnattttacgattttcggtagtcgttgtaggtttggcggatttatattttatatttttacggtcgcgttttcgtcgcggggtagggcgaggatacggcgttttgcgtatttagtgatcgggtcgttttggttttcgtgcgtacgtagtattacgtgatttattgttagtatttaagatggacgtcgcgagtttggtcggtttttcgcgttagttttattttattgtgtgttttttaagcgcgaattaggttcgtagatagtcgggtcgtgatcgttaggtagttatgcgggttatcgagtgcgattagagaacgtcggggttcgtgttatacgtattattgttttcgttttcgtttttttaatcggaagtatttacgtcggttttggagcgttttttgtacgttttattttttagaattgtagttttagtagttaatgaggtttaggacgcgtgcggggaggcggataggggtaagtttttttgtcgtttatag

SEQ ID NO: 38706 - DNA, 666 bp, Artificial Sequence
  chemically treated genomic DNA (Homo sapiens) CpG-island No: 38706
  misc_feature (493)..(493): n is either a, c, g or t
ctataaacgacaaaaaaacttacccctatccgcctccccgcacgcgtcctaaacctcattaactactaaaactacaattctaaaaaataaaacgtacaaaaaacgctccaaaaccgacgtaaatacttccgattaaaaaaacgaaaacgaaaacaataatacgtataacacgaaccccgacgttctctaatcgcactcgataacccgcataactacctaacgatcacgacccgactatctacgaacctaattcgcgcttaaaaaacacacaataaaataaaactaacgcgaaaaaccgaccaaactcgcgacgtccatcttaaatactaacaataaatcacgtaatactacgtacgcacgaaaaccaaaacgacccgatcactaaatacgcaaaacgccgtatcctcgccctaccccgcgacgaaaacgcgaccgtaaaaatataaaatataaatccgccaaacctacaacgactaccgaaaatcgtaaaatnactcgccgcgtccctactcaaacgaaaaaaacccgacccgccgccaaaatctcgaatccgaatccaaacaaacgtaaaaataacgaaaacgacgcaccgccgaataaacgttattttaaaaccgcaaaacttaaaaaacttatattaaattacaaatcgacccgtaaatcccc

SEQ ID NO: 38707 - DNA, 666 bp, Artificial Sequence
  chemically treated genomic DNA (Homo sapiens) CpG-island No: 38707
  misc_feature (493)..(493): n is either a, c, g or t
ttatgagcggtagagaggtttatttttgttcgttttttcgtacgcgttttggattttattggttgttggagttgtaattttagagggtggggcgtataaaagacgttttagggtcgacgtgggtgttttcggttgaggaggcgaggacgggggtagtagtgcgtataatacgggtttcggcgttttttggtcgtattcggtagttcgtatggttgtttagcggttacgattcgattgtttgcgagtttaattcgcgtttagagggtatataatggggtgaggttaacgcggggagtcggttaggttcgcggcgtttattttggatattggtagtgggttacgtggtgttgcgtgcgtacggaggttagggcggttcggttattgagtgcgtaaggcgtcgtgttttcgttttgtttcgcggcgggaacgcggtcgtgagggtgtggggtgtaggttcgttaggtttgtaacggttgtcgagggtcgtgggatngttcgtcgcgtttttgtttaggcggagggagttcggttcgtcgttagggtttcgagttcgggtttaggtaggcgtggaggtggcgggaacggcgtatcgtcgggtgggcgttgttttaaggtcgtagggtttgggaggtttgtgttgagttataggtcggttcgtagattttt

SEQ ID NO: 38708 - DNA, 666 bp, Artificial Sequence
  chemically treated genomic DNA (Homo sapiens) CpG-island No: 38708
  misc_feature (174)..(174): n is either a, c, g or t
aaaaatctacgaaccgacctataactcaacacaaacctcccaaaccctacgaccttaaaacaacgcccacccgacgatacgccgttcccgccacctccacgcctacctaaacccgaactcgaaaccctaacgacgaaccgaactccctccgcctaaacaaaaacgcgacgaacnatcccacgaccctcgacaaccgttacaaacctaacgaacctacaccccacaccctcacgaccgcgttcccgccgcgaaacaaaacgaaaacacgacgccttacgcactcaataaccgaaccgccctaacctccgtacgcacgcaacaccacgtaacccactaccaatatccaaaataaacgccgcgaacctaaccgactccccgcgttaacctcaccccattatataccctctaaacgcgaattaaactcgcaaacaatcgaatcgtaaccgctaaacaaccatacgaactaccgaatacgaccaaaaaacgccgaaacccgtattatacgcactactacccccgtcctcgcctcctcaaccgaaaacacccacgtcgaccctaaaacgtcttttatacgccccaccctctaaaattacaactccaacaaccaataaaatccaaaacgcgtacgaaaaaacgaacaaaaataaacctctctaccgctcataa

SEQ ID NO: 38709 - DNA, 738 bp, Artificial Sequence
  chemically treated genomic DNA (Homo sapiens) CpG-island No: 38709
gtttcgtagtggcgttttattttttcggtttttttcggttgtaggaattttacggaacggttcggttcggttgagacgtcggtttaggttgtttttcgttttttaggttcgaatttttttttttcgttcgttaggtttcgtttcgggatttcgtgtttttgttagtcggttgcgttcgtatttgtcggattcggtgtagggtatttacgaagttttcggtttttatttttataggagcgttttgtttttgtattagtttcgttattatcgttttcgtcgtcgtcgtcgtcgtcgtcgacgtcgtcgacgtcgtcgttcggtttttcggttcggtttttcgtttcgtttggggattcgtagtcggaaaaggaaagtcgttttattttcggcggaagggaaagtcgggacgttcgtagttggaggagtcgcgtttgcggggcggggttagggtacgtgattttcgatcgatcggaagtgggggcgggacggtagcgtcggggtgggtttagatcgttaggtagtcgtgggtttttagggttcggtcgcgattttttttttttcgggcgggatttggtttaggatcgtcgatggcgttttgataggttttcgaggtttggatgtggtttcgaggtgttcgttgtcggtcgtttggaattttagagggattgacgtggtttttttaagacggtatttcgaatagtcgtggtttattaaaagtttggttttgggtagtttttt

SEQ ID NO: 38710 - DNA, 738 bp, Artificial Sequence
  chemically treated genomic DNA (Homo sapiens) CpG-island No: 38710
aaaaaactacccaaaaccaaacttttaataaaccacgactattcgaaataccgtcttaaaaaaaccacgtcaatccctctaaaattccaaacgaccgacaacgaacacctcgaaaccacatccaaacctcgaaaacctatcaaaacgccatcgacgatcctaaaccaaatcccgcccgaaaaaaaaaaaatcgcgaccgaaccctaaaaacccacgactacctaacgatctaaacccaccccgacgctaccgtcccgcccccacttccgatcgatcgaaaatcacgtaccctaaccccgccccgcaaacgcgactcctccaactacgaacgtcccgactttcccttccgccgaaaataaaacgactttccttttccgactacgaatccccaaacgaaacgaaaaaccgaaccgaaaaaccgaacgacgacgtcgacgacgtcgacgacgacgacgacgacgacgaaaacgataataacgaaactaatacaaaaacaaaacgctcctataaaaataaaaaccgaaaacttcgtaaataccctacaccgaatccgacaaatacgaacgcaaccgactaacaaaaacacgaaatcccgaaacgaaacctaacgaacgaaaaaaaaaaattcgaacctaaaaaacgaaaaacaacctaaaccgacgtctcaaccgaaccgaaccgttccgtaaaattcctacaaccgaaaaaaaccgaaaaaataaaacgccactacgaaac

SEQ ID NO: 38711 - DNA, 738 bp, Artificial Sequence
  chemically treated genomic DNA (Homo sapiens) CpG-island No: 38711
gaggggttatttaggattaggtttttgatgaattacgattgttcggggtgtcgttttgggagagttacgttagtttttttgagattttaaacggtcgatagcggatatttcgggattatatttaagtttcggggatttgttaagacgttatcgacggttttggattaaatttcgttcgggaagggaagggtcgcgatcggattttggagatttacggttgtttggcgatttgagtttatttcggcgttgtcgtttcgtttttattttcgatcggtcgaaggttacgtgttttgatttcgtttcgtagacgcgatttttttagttgcgagcgtttcggttttttttttcgtcggaagtagggcgatttttttttttcggttacgggtttttaagcggagcgggaggtcggatcggggagtcgagcggcggcgtcggcggcgtcggcggcggcggcgacggcggcgggggcggtaatggcggagttggtgtaggggtagagcgtttttgtggggatgaaggtcgagggtttcgtggatgttttgtatcgggttcggtaggtacgggcgtagtcggttggtaggagtacgagatttcgaggcggggtttggcgggcggggaagaggggttcgggtttggggggcgggaggtagtttgaatcgacgttttagtcgggtcgggtcgtttcgtggagtttttatagtcgggaggagtcggggggataaggcgttattgcgaggt

SEQ ID NO: 38712 - DNA, 738 bp, Artificial Sequence
  chemically treated genomic DNA (Homo sapiens) CpG-island No: 38712
acctcgcaataacgccttatccccccgactcctcccgactataaaaactccacgaaacgacccgacccgactaaaacgtcgattcaaactacctcccgccccccaaacccgaacccctcttccccgcccgccaaaccccgcctcgaaatctcgtactcctaccaaccgactacgcccgtacctaccgaacccgatacaaaacatccacgaaaccctcgaccttcatccccacaaaaacgctctacccctacaccaactccgccattaccgcccccgccgccgtcgccgccgccgccgacgccgccgacgccgccgctcgactccccgatccgacctcccgctccgcttaaaaacccgtaaccgaaaaaaaaaaatcgccctacttccgacgaaaaaaaaaaccgaaacgctcgcaactaaaaaaatcgcgtctacgaaacgaaatcaaaacacgtaaccttcgaccgatcgaaaataaaaacgaaacgacaacgccgaaataaactcaaatcgccaaacaaccgtaaatctccaaaatccgatcgcgacccttcccttcccgaacgaaatttaatccaaaaccgtcgataacgtcttaacaaatccccgaaacttaaatataatcccgaaatatccgctatcgaccgtttaaaatctcaaaaaaactaacgtaactctcccaaaacgacaccccgaacaatcgtaattcatcaaaaacctaatcctaaataacccctc

SEQ ID NO: 38713 - DNA, 804 bp, Artificial Sequence
  chemically treated genomic DNA (Homo sapiens) CpG-island No: 38713
tttggggtcgcgacgtcgtaagagttgggacgataggattagtagaagtaggaggaataatataggaagcgcgttcggagaggcggttagtcgttgggtttcgttcgcggtgttttagggtttttttggttttttttttatttatttttttcgattttgtggtcggggagcgtttgtagttagtttcgtcgtcgttttttttggttcgcgtcgttttttagtcgtttttacgtcgtttttttatttagggtttttttttcgtattcgcgttatttttttagcgttttttacggtttttttatcgttcgcgttcgttcgaaaatgtttagagttatcgttttcgttacggttcgttttaggtttttattggttagtatacgttacgtgcggcgtgtggcggttgatattggcgggcgggcgcgttgagggtagcgtcggggacgcggttttagtaggggcgtttcgttacggggagtagtttaggcgttcgttttaggacgttgttcggcgggttgggttgggatttttttgtttttagggcgcgtcgggagtagtagggatcggtgtcgcgtcgtgagggtgcgtagaggttgttttcgggttcgttatttatagatttttcgcggggtagcgttttcgggtcggtcgcgttttggttcgtcgatcgtagacgatttgtgatacggacggcgcgttttgttgattttagtcggcgtcgagggtttggaatttcgagcgggaaaaggttcggaattcgtagttagtttagtcgtatatttagtatggtttttttagatttgtttt

SEQ ID NO: 38714 - DNA, 804 bp, Artificial Sequence
  chemically treated genomic DNA (Homo sapiens) CpG-island No: 38714
aaaacaaatctaaaaaaaccatactaaatatacgactaaactaactacgaattccgaaccttttcccgctcgaaattccaaaccctcgacgccgactaaaatcaacaaaacgcgccgtccgtatcacaaatcgtctacgatcgacgaaccaaaacgcgaccgacccgaaaacgctaccccgcgaaaaatctataaataacgaacccgaaaacaacctctacgcaccctcacgacgcgacaccgatccctactactcccgacgcgccctaaaaacaaaaaaatcccaacccaacccgccgaacaacgtcctaaaacgaacgcctaaactactccccgtaacgaaacgcccctactaaaaccgcgtccccgacgctaccctcaacgcgcccgcccgccaatatcaaccgccacacgccgcacgtaacgtatactaaccaataaaaacctaaaacgaaccgtaacgaaaacgataactctaaacattttcgaacgaacgcgaacgataaaaaaaccgtaaaaaacgctaaaaaaataacgcgaatacgaaaaaaaaaccctaaataaaaaaacgacgtaaaaacgactaaaaaacgacgcgaaccaaaaaaaacgacgacgaaactaactacaaacgctccccgaccacaaaatcgaaaaaaataaataaaaaaaaaaccaaaaaaaccctaaaacaccgcgaacgaaacccaacgactaaccgcctctccgaacgcgcttcctatattattcctcctacttctactaatcctatcgtcccaactcttacgacgtcgcgaccccaaa

SEQ ID NO: 38715 - DNA, 804 bp, Artificial Sequence
  chemically treated genomic DNA (Homo sapiens) CpG-island No: 38715
aaaataaatttgaaagaattatattgagtgtgcggttaaattagttgcgaatttcgaattttttttcgttcgagattttaagttttcggcgtcggttggggttagtaggacgcgtcgttcgtgttataagtcgtttgcggtcggcggattagggcgcggtcggttcggagacgttgtttcgcggagggtttgtgggtagcgggttcgagggtagtttttgcgtatttttacggcgcggtatcgatttttgttgttttcgacgcgttttggaggtagaggggttttagtttagttcgtcggataacgttttggggcgagcgtttgggttgtttttcgtggcggggcgtttttgttgaggtcgcgttttcggcgttgtttttagcgcgttcgttcgttaatgttagtcgttatacgtcgtacgtgacgtgtgttggttaatggaggtttgaagcggatcgtgacgagagcggtggttttgggtattttcgaacgggcgcgggcggtgagggaatcgtgagggacgttgaggggatggcgcgggtgcggaaaggggattttaagtaaggggacggcgtgaggacggttaggggacggcgcgagttaagaaggacggcggcggagttggttgtaagcgtttttcggttatagggtcgagaagagtgaatggaggaagagttaggagagttttggagtatcgcggacggaatttagcgattggtcgttttttcgggcgcgttttttgtgttgttttttttgtttttattggttttatcgttttaatttttacggcgtcgcggttttagg

SEQ ID NO: 38716 - DNA, 804 bp, Artificial Sequence
  chemically treated genomic DNA (Homo sapiens) CpG-island No: 38716
cctaaaaccgcgacgccgtaaaaattaaaacgataaaaccaataaaaacaaaaaaaacaacacaaaaaacgcgcccgaaaaaacgaccaatcgctaaattccgtccgcgatactccaaaactctcctaactcttcctccattcactcttctcgaccctataaccgaaaaacgcttacaaccaactccgccgccgtccttcttaactcgcgccgtcccctaaccgtcctcacgccgtccccttacttaaaatcccctttccgcacccgcgccatcccctcaacgtccctcacgattccctcaccgcccgcgcccgttcgaaaatacccaaaaccaccgctctcgtcacgatccgcttcaaacctccattaaccaacacacgtcacgtacgacgtataacgactaacattaacgaacgaacgcgctaaaaacaacgccgaaaacgcgacctcaacaaaaacgccccgccacgaaaaacaacccaaacgctcgccccaaaacgttatccgacgaactaaactaaaacccctctacctccaaaacgcgtcgaaaacaacaaaaatcgataccgcgccgtaaaaatacgcaaaaactaccctcgaacccgctacccacaaaccctccgcgaaacaacgtctccgaaccgaccgcgccctaatccgccgaccgcaaacgacttataacacgaacgacgcgtcctactaaccccaaccgacgccgaaaacttaaaatctcgaacgaaaaaaaattcgaaattcgcaactaatttaaccgcacactcaatataattctttcaaatttatttt

SEQ ID NO: 38717 - DNA, 593 bp, Artificial Sequence
  chemically treated genomic DNA (Homo sapiens) CpG-island No: 38717
  misc_feature (465)..(465): n is either a, c, g or t
  misc_feature (467)..(467): n is either a, c, g or t
ggacgcgttttttttttgggattattattcgcgggttagtatagacggttcgttttcgttcggcgtttaattgtacggttcgaggattttgtttttgcgcgttttattttcggtattcggaattttacggttatttattttgcgcgtaggattcggaagggttaggcgggggcgcggcggtgtagtttttttcgagcgcgttgggtcgtttttgttcggtttggggtttgttaggcgcgattttttcggtgtagtcgagttttttcgtagattttgcgtaggaaagcgaaattattcggtaggagaaaaggtagcgttggcgttcggttttttttcgtttttattaattatcgggcggtttcgcgtttagttaattagacgcggttgtttcgtgggcgttatcgtttttttttgcgggtcgttgtttcgtttacgcgttggggtattttcgtcggttttcggagngntcgtcgggttgggtgagttgtagtttagtttcgtgttgttacgttgggaattggcgttttgtttatatattttagagaacgattagaaggacgtgttgtgtttgtagaagtttaaatttggaggtt

SEQ ID NO: 38718 - DNA, 593 bp, Artificial Sequence
  chemically treated genomic DNA (Homo sapiens) CpG-island No: 38718
  misc_feature (127)..(127): n is either a, c, g or t
  misc_feature (129)..(129): n is either a, c, g or t
aacctccaaatttaaacttctacaaacacaacacgtccttctaatcgttctctaaaatatataaacaaaacgccaattcccaacgtaacaacacgaaactaaactacaactcacccaacccgacgancnctccgaaaaccgacgaaaataccccaacgcgtaaacgaaacaacgacccgcaaaaaaaaacgataacgcccacgaaacaaccgcgtctaattaactaaacgcgaaaccgcccgataattaataaaaacgaaaaaaaaccgaacgccaacgctaccttttctcctaccgaataatttcgctttcctacgcaaaatctacgaaaaaactcgactacaccgaaaaaatcgcgcctaacaaaccccaaaccgaacaaaaacgacccaacgcgctcgaaaaaaactacaccgccgcgcccccgcctaacccttccgaatcctacgcgcaaaataaataaccgtaaaattccgaataccgaaaataaaacgcgcaaaaacaaaatcctcgaaccgtacaattaaacgccgaacgaaaacgaaccgtctatactaacccgcgaataataatcccaaaaaaaaaacgcgtcc

SEQ ID NO: 38719 - DNA, 593 bp, Artificial Sequence
  chemically treated genomic DNA (Homo sapiens) CpG-island No: 38719
  misc_feature (127)..(127): n is either a, c, g or t
  misc_feature (129)..(129): n is either a, c, g or t
gatttttaagtttgggtttttgtaaatatagtacgtttttttgatcgttttttaagatatgtaaatagaacgttagtttttagcgtggtaatacgggattgggttgtagtttatttagttcggcggntntttcggaagtcggcggaaatattttagcgcgtgggcggagtagcggttcgtagagggaggcggtggcgtttacggaatagtcgcgtttaattggttgagcgcggagtcgttcggtgattggtgggggcggaagggggtcgggcgttagcgttgtttttttttttgtcgggtagtttcgtttttttgcgtagagtttgcggaggggttcggttgtatcggggggatcgcgtttggtagattttagatcgagtagaggcgatttagcgcgttcgggagaggttgtatcgtcgcgttttcgtttagttttttcggattttgcgcgtagagtgagtggtcgtgaggtttcgggtgtcgggggtgggacgcgtagggatagagttttcgggtcgtgtagttggacgtcgggcgaggacgggtcgtttgtgttgattcgcgaatagtgattttagaggaagaacgcgttt

SEQ ID NO: 38720 - DNA, 593 bp, Artificial Sequence
  chemically treated genomic DNA (Homo sapiens) CpG-island No: 38720
  misc_feature (465)..(465): n is either a, c, g or t
  misc_feature (467)..(467): n is either a, c, g or t
aaacgcgttcttcctctaaaatcactattcgcgaatcaacacaaacgacccgtcctcgcccgacgtccaactacacgacccgaaaactctatccctacgcgtcccacccccgacacccgaaacctcacgaccactcactctacgcgcaaaatccgaaaaaactaaacgaaaacgcgacgatacaacctctcccgaacgcgctaaatcgcctctactcgatctaaaatctaccaaacgcgatccccccgatacaaccgaacccctccgcaaactctacgcaaaaaaacgaaactacccgacaaaaaaaaaaacaacgctaacgcccgacccccttccgcccccaccaatcaccgaacgactccgcgctcaaccaattaaacgcgactattccgtaaacgccaccgcctccctctacgaaccgctactccgcccacgcgctaaaatatttccgccgacttccgaaananccgccgaactaaataaactacaacccaatcccgtattaccacgctaaaaactaacgttctatttacatatcttaaaaaacgatcaaaaaaacgtactatatttacaaaaacccaaacttaaaaatc

SEQ ID NO: 38721 - DNA, 577 bp, Artificial Sequence
  chemically treated genomic DNA (Homo sapiens) CpG-island No: 38721
tgcgtgtgttaggtggtgtcggttttttggagtgttcgtttcgtttattagggttgacggtcggcgtcgagttttttacggtttgtttagttcgaatcgatacgacgtgggtgacgttcgttttatttttttatttatatcggatcgtttaagttttcgttcggggattcgagttcgttcgacgcgaatttggatttttcgttttcgtgtcgacggggcgagtgttacgacggacggtcggtcgggagttcggggatcgatttatttttgataggttacgacgacgtcgtttcgtgaattcgtgggatcggttacgtcggggaggcgatcgattcgtgattaggtcgacggtcgaatcggttaaggttgcggggcgacgagggttaattattatcgtgattatagcgagggggtcgtagagtagagggattgagattaaagcgggaaatatttattattcgatcgaggacgagattagttcgatcgacgtggaggttttaggggattatataatgagttttttaaggacgtttttggttaatgtatttttttgttttagatgtttatatgtacgtaa

SEQ ID NO: 38722 - DNA, 577 bp, Artificial Sequence
  chemically treated genomic DNA (Homo sapiens) CpG-island No: 38722
ttacgtacatataaacatctaaaacaaaaaaatacattaaccaaaaacgtccttaaaaaactcattatataatcccctaaaacctccacgtcgatcgaactaatctcgtcctcgatcgaataataaatatttcccgctttaatctcaatccctctactctacgaccccctcgctataatcacgataataattaaccctcgtcgccccgcaaccttaaccgattcgaccgtcgacctaatcacgaatcgatcgcctccccgacgtaaccgatcccacgaattcacgaaacgacgtcgtcgtaacctatcaaaaataaatcgatccccgaactcccgaccgaccgtccgtcgtaacactcgccccgtcgacacgaaaacgaaaaatccaaattcgcgtcgaacgaactcgaatccccgaacgaaaacttaaacgatccgatataaataaaaaaataaaacgaacgtcacccacgtcgtatcgattcgaactaaacaaaccgtaaaaaactcgacgccgaccgtcaaccctaataaacgaaacgaacactccaaaaaaccgacaccacctaacacacgca

SEQ ID NO: 38723 - DNA, 577 bp, Artificial Sequence
  chemically treated genomic DNA (Homo sapiens) CpG-island No: 38723
ttacgtatatataaatatttggaataggggagtatattgattagggacgtttttgagggatttattgtatagttttttgagatttttacgtcggtcggattggtttcgttttcggtcgagtggtgagtgtttttcgttttaattttagtttttttgttttacgattttttcgttgtagttacgatggtagttgattttcgtcgtttcgtaattttgatcgattcgatcgtcgatttggttacgggtcggtcgttttttcgacgtaatcggttttacgaatttacgagacgacgtcgtcgtgatttgttaggggtgagtcggttttcggattttcggtcggtcgttcgtcgtggtattcgtttcgtcgatacgggagcgggaggtttaagttcgcgtcgagcgaattcggattttcggacggggatttgggcggttcggtgtgggtggagaggtggggcgaacgttatttacgtcgtgtcggttcggattggataaatcgtgggagattcgacgtcgatcgttaattttggtgaacgagacggatattttaaggaatcggtattatttggtatacgta

SEQ ID NO: 38724 - DNA, 577 bp, Artificial Sequence
  chemically treated genomic DNA (Homo sapiens) CpG-island No: 38724
tacgtataccaaataataccgattccttaaaatatccgtctcgttcaccaaaattaacgatcgacgtcgaatctcccacgatttatccaatccgaaccgacacgacgtaaataacgttcgccccacctctccacccacaccgaaccgcccaaatccccgtccgaaaatccgaattcgctcgacgcgaacttaaacctcccgctcccgtatcgacgaaacgaataccacgacgaacgaccgaccgaaaatccgaaaaccgactcacccctaacaaatcacgacgacgtcgtctcgtaaattcgtaaaaccgattacgtcgaaaaaacgaccgacccgtaaccaaatcgacgatcgaatcgatcaaaattacgaaacgacgaaaatcaactaccatcgtaactacaacgaaaaaatcgtaaaacaaaaaaactaaaattaaaacgaaaaacactcaccactcgaccgaaaacgaaaccaatccgaccgacgtaaaaatctcaaaaaactatacaataaatccctcaaaaacgtccctaatcaatatactcccctattccaaatatttatatatacgtaa

SEQ ID NO: 38725 - DNA, 583 bp, Artificial Sequence
  chemically treated genomic DNA (Homo sapiens) CpG-island No: 38725
  misc_feature (326)..(326): n is either a, c, g or t
atatcgcgtggggagatgtgatagtatttcgtcggttcgatatagcgtggtgagttggtatattttattcgtcgatttaatatttcgtggtgagttggtattttttattcgtcggttcgatatagcgttgtgagtttggatagtttcgacggatcgatatttcgtggtgagatgggatagtatatcgtcggatcgatatagcgtggtgagttgggatagtttttttaggatcgaatcgtgaatgtgtcgagttttttatcgaatcgatcgtcgttttatttttattttttacgtacgatatatgagcggagtcgagtggacggttntcgagatttacgagttatttaagtatagtggttgtcgaatgggtcgaggtgtttatcggtatcgttcgttatgagttcgttttatttcgtttataggtcggttcggaagagacgtaaaggggttgtggaggaaaaggattgatcgattcgtcgcgaagttcgaatgcgacgagtttcgatcgttattgattataatgatcgatttattttcgatttacgttatattcgacgattagattcgacgttgtcgtgaagat

SEQ ID NO: 38726 - DNA, 583 bp, Artificial Sequence
  chemically treated genomic DNA (Homo sapiens) CpG-island No: 38726
  misc_feature (258)..(258): n is either a, c, g or t
atcttcacgacaacgtcgaatctaatcgtcgaatataacgtaaatcgaaaataaatcgatcattataatcaataacgatcgaaactcgtcgcattcgaacttcgcgacgaatcgatcaatccttttcctccacaacccctttacgtctcttccgaaccgacctataaacgaaataaaacgaactcataacgaacgataccgataaacacctcgacccattcgacaaccactatacttaaataactcgtaaatctcganaaccgtccactcgactccgctcatatatcgtacgtaaaaaataaaaataaaacgacgatcgattcgataaaaaactcgacacattcacgattcgatcctaaaaaaactatcccaactcaccacgctatatcgatccgacgatatactatcccatctcaccacgaaatatcgatccgtcgaaactatccaaactcacaacgctatatcgaaccgacgaataaaaaataccaactcaccacgaaatattaaatcgacgaataaaatataccaactcaccacgctatatcgaaccgacgaaatactatcacatctccccacgcgatat

SEQ ID NO: 38727 - DNA, 583 bp, Artificial Sequence
  chemically treated genomic DNA (Homo sapiens) CpG-island No: 38727
  misc_feature (258)..(258): n is either a, c, g or t
atttttacggtaacgtcgagtttagtcgtcggatgtggcgtgagtcgaaggtgggtcggttattgtggttagtgacggtcgggattcgtcgtattcggatttcgcggcggatcggttagttttttttttttatagtttttttgcgtttttttcggatcggtttgtggacggggtaaggcgaatttatggcggacggtgtcggtgggtatttcggtttattcgatagttattgtgtttgagtgattcgtgaatttcggngatcgtttattcgatttcgtttatgtgtcgtgcgtagaaggtggaggtgggacggcggtcggttcggtgggaaattcggtatatttacggttcggttttggaggggttgttttaatttattacgttgtgtcggttcggcggtatgttgttttattttattacggggtgtcggttcgtcgggattgtttaagtttataacgttgtgtcgggtcggcggatgggaggtattaatttattacgaggtgttgggtcggcggatgagatgtattaatttattacgttgtgtcgggtcggcgggatgttgttatatttttttacgcggtgt

SEQ ID NO: 38728 - DNA, 583 bp, Artificial Sequence
  chemically treated genomic DNA (Homo sapiens) CpG-island No: 38728
  misc_feature (326)..(326): n is either a, c, g or t
acaccgcgtaaaaaaatataacaacatcccgccgacccgacacaacgtaataaattaatacatctcatccgccgacccaacacctcgtaataaattaatacctcccatccgccgacccgacacaacgttataaacttaaacaatcccgacgaaccgacaccccgtaataaaataaaacaacataccgccgaaccgacacaacgtaataaattaaaacaacccctccaaaaccgaaccgtaaatataccgaatttcccaccgaaccgaccgccgtcccacctccaccttctacgcacgacacataaacgaaatcgaataaacgatcnccgaaattcacgaatcactcaaacacaataactatcgaataaaccgaaatacccaccgacaccgtccgccataaattcgccttaccccgtccacaaaccgatccgaaaaaaacgcaaaaaaactataaaaaaaaaaaactaaccgatccgccgcgaaatccgaatacgacgaatcccgaccgtcactaaccacaataaccgacccaccttcgactcacgccacatccgacgactaaactcgacgttaccgtaaaaat

SEQ ID NO: 38729 - DNA, 2355 bp, Artificial Sequence
  chemically treated genomic DNA (Homo sapiens) CpG-island No: 38729
  misc_feature (1731)..(1731): n is either a, c, g or t
cgcggcgcgttcgtcggttcggcgtacgtttcgtgttttgtggcgtttggtataggttcggttttatatgatatttttttttttttcgagagttagttcgttttcgagttggaacgtcgggtaacgttttttgaaggtgtttaggtttttttatgtggcggacgtagtcgatttttttttttagtggattagaatttgacgaacgtttcgagttagtcgagaacgggtgacgcgttttggttcgggattaatggtatcgtggtggatagtaggtagtgtcggaggcgatggtggcgtagtttttacgaattttttgagtaggtttacgtggaatacgtcgtggagttttgcgcgaggcgggagttcgaggcggacggcgacggggttgattatttcgacgacgcggtagggttcgaagtagcggggtttgagtttgtttttggatatttggggtagcgatgtcggggcgcggtgacggaggcgtaggagaacgaggtcgtttatttcgtaggatatcgtacggtggtttttgtcgtagtattttttgtgcgtcgtttgggtttgttttagtcggtagcgtacgtcggttaagaattcgttacggttcgttatggagcgagcgacggtcgttacgcgcgtttcgtcgggttcgtaggatttgatgatcggcgggtcgcgttcgtatattattcggaacggcgtgtcgcggagagatgtttgataggcggtattgtagatgtatttcgtttacgggagttatcgaatttattgtcgaggtcggtcgtcggtgaagtatcgtaggtatatgacgatgattttgttggcggttttcgtttggttattagattgtgggtggatggtcgtcgttatgtgtatttttgtatcggttagtcgtattaattcgcgttaaaaggatgacgtgaatatcggatttcggttcgatattatggattggggtatgtcgtggaggcgtataatgttcgcgtagaacgtttgagttattgatttagttgtgtaggggtgagttaaagggatgaaatgatagtatttgttgaatcggtcgacgacggtgaggattattgtttttttatttatacggggtagagtttttacgaagtcgaggttaatgtcggtttatatcgtagttggaatcggtaggggaagaagtaggtcgttcgggtgtaaatgtttagatttgttgcgttggtatgtgtcgtacgttcggacgaatttttgaattattcggcgtatggcgggagagtggaaatcgcggcgtagtttgtgtagggtacgttgtacgtttttatgttcgtcggtgtggattgtcgttaagatttcgtggagtagtggtgacgatggcggaatgtatagtcgggagtcgaatattattatttcgtcgcgaagcgtttacggcgcgttgcgggtgtcggtttggatggcgtcgcggatggttacgagagtaggtttcgtggtttgggttgttcgtaatcgttcgatgtagtcgaatcgtggcgtcgatagtgttaagacggtattttcgttcgtgtcgcggcgcgagagggtatcggttattacgttggaggcgttcgatttgtattttatcgtgaagtcgaagtcgaggagtttgtttattaatggtgttggggatggtcgttaggcgttgatcgagtaggtatttgaggttgtagtggttcgttcgtattacgaacgtacgtttttatagatacgttngtttagtggcggatggcgaggacgaggtcgattaattttcgttcgtaggtagcgagcgtacggtggcgcggcgcgacggggcggttgaagaacgttagcgggtgtttgttttgtaggagtatcgcgtcgaatttatgcgtagaggcgttatattcgacgacgaatggtttgacgaagtcgggtagcgttagaatcggggtcgtggtgacggcgtgtttgagggcgtggaacgtagtcgttatttcgtcggattatcggaattttttttttttggttagcgcggtgaggggggcggcgatggtttcgtagtcgtggacgaatttgcggtagtagttcgcgagttttaggaagtttcggacggtgcgggtcgagcgcggttgcggttagtttacgatagtttgtattttggtcgggtttatggatacgttcgtcgcgtcgatgatgtggtttaggtaggagatggagttgacgtcgaaagcgtattttgaacgtttgacgaataggcgatgttgacgtagtaggaggagtatcgttcggatgtgttttagatggtttgtttaggtgttgttgtagatgagaatatcgttaaaaaatataaggataaaacggcgaagatatatgcgg

SEQ ID NO: 38730 - DNA, 2355 bp, Artificial Sequence
  chemically treated genomic DNA (Homo sapiens) CpG-island No: 38730
  misc_feature (625)..(625): n is either a, c, g or t
ccgcatatatcttcgccgttttatccttatattttttaacgatattctcatctacaacaacacctaaacaaaccatctaaaacacatccgaacgatactcctcctactacgtcaacatcgcctattcgtcaaacgttcaaaatacgctttcgacgtcaactccatctcctacctaaaccacatcatcgacgcgacgaacgtatccataaacccgaccaaaatacaaactatcgtaaactaaccgcaaccgcgctcgacccgcaccgtccgaaacttcctaaaactcgcgaactactaccgcaaattcgtccacgactacgaaaccatcgccgcccccctcaccgcgctaaccaaaaaaaaaaaattccgataatccgacgaaataacgactacgttccacgccctcaaacacgccgtcaccacgaccccgattctaacgctacccgacttcgtcaaaccattcgtcgtcgaatataacgcctctacgcataaattcgacgcgatactcctacaaaacaaacacccgctaacgttcttcaaccgccccgtcgcgccgcgccaccgtacgctcgctacctacgaacgaaaattaatcgacctcgtcctcgccatccgccactaaacnaacgtatctataaaaacgtacgttcgtaatacgaacgaaccactacaacctcaaatacctactcgatcaacgcctaacgaccatccccaacaccattaataaacaaactcctcgacttcgacttcacgataaaatacaaatcgaacgcctccaacgtaataaccgataccctctcgcgccgcgacacgaacgaaaataccgtcttaacactatcgacgccacgattcgactacatcgaacgattacgaacaacccaaaccacgaaacctactctcgtaaccatccgcgacgccatccaaaccgacacccgcaacgcgccgtaaacgcttcgcgacgaaataataatattcgactcccgactatacattccgccatcgtcaccactactccacgaaatcttaacgacaatccacaccgacgaacataaaaacgtacaacgtaccctacacaaactacgccgcgatttccactctcccgccatacgccgaataattcaaaaattcgtccgaacgtacgacacataccaacgcaacaaatctaaacatttacacccgaacgacctacttcttcccctaccgattccaactacgatataaaccgacattaacctcgacttcgtaaaaactctaccccgtataaataaaaaaacaataatcctcaccgtcgtcgaccgattcaacaaatactatcatttcatccctttaactcacccctacacaactaaatcaataactcaaacgttctacgcgaacattatacgcctccacgacataccccaatccataatatcgaaccgaaatccgatattcacgtcatccttttaacgcgaattaatacgactaaccgatacaaaaatacacataacgacgaccatccacccacaatctaataaccaaacgaaaaccgccaacaaaatcatcgtcatatacctacgatacttcaccgacgaccgacctcgacaataaattcgataactcccgtaaacgaaatacatctacaataccgcctatcaaacatctctccgcgacacgccgttccgaataatatacgaacgcgacccgccgatcatcaaatcctacgaacccgacgaaacgcgcgtaacgaccgtcgctcgctccataacgaaccgtaacgaattcttaaccgacgtacgctaccgactaaaacaaacccaaacgacgcacaaaaaatactacgacaaaaaccaccgtacgatatcctacgaaataaacgacctcgttctcctacgcctccgtcaccgcgccccgacatcgctaccccaaatatccaaaaacaaactcaaaccccgctacttcgaaccctaccgcgtcgtcgaaataatcaaccccgtcgccgtccgcctcgaactcccgcctcgcgcaaaactccacgacgtattccacgtaaacctactcaaaaaattcgtaaaaactacgccaccatcgcctccgacactacctactatccaccacgataccattaatcccgaaccaaaacgcgtcacccgttctcgactaactcgaaacgttcgtcaaattctaatccactaaaaaaaaaaatcgactacgtccgccacataaaaaaacctaaacaccttcaaaaaacgttacccgacgttccaactcgaaaacgaactaactctcgaaaaaaaaaaaaatatcatataaaaccgaacctataccaaacgccacaaaacacgaaacgtacgccgaaccgacgaacgcgccgcg

SEQ ID NO: 38731 - DNA, 2355 bp, Artificial Sequence
  chemically treated genomic DNA (Homo sapiens) CpG-island No: 38731
  misc_feature (625)..(625): n is either a, c, g or t
tcgtatatattttcgtcgttttgtttttgtgttttttgacgatatttttatttatagtaatatttgggtagattatttgaggtatattcgggcggtgttttttttgttgcgttagtatcgtttgttcgttaagcgtttaaagtgcgttttcggcgttagttttattttttatttgggttatattatcggcgcgacgggcgtgtttatggattcggttaaggtgtaggttgtcgtggattggtcgtaatcgcgttcggttcgtatcgttcggggttttttggggttcgcgggttattatcgtaagttcgtttacgattacgggattatcgtcgttttttttatcgcgttgattaagaaggaggggtttcggtggttcgacgaggtggcgattgcgttttacgtttttaagtacgtcgttattacggtttcggttttggcgttattcgatttcgttaagttattcgtcgtcgagtgtgacgtttttacgtatgggttcggcgcggtatttttgtaggataagtattcgttggcgttttttagtcgtttcgtcgcgtcgcgttatcgtgcgttcgttgtttacgagcgggagttgatcggtttcgttttcgttattcgttattgggtnggcgtatttgtgggggcgtgcgttcgtggtgcggacggattattatagttttaagtatttgttcgattaacgtttggcgattatttttaatattattggtgggtaagtttttcggtttcgattttacggtggagtataagtcgggcgtttttaacgtggtggtcgatgttttttcgcgtcgcgatacggacgagggtgtcgttttggtattgtcggcgttacggttcgattatatcgagcggttgcgggtagtttagattacggagtttgttttcgtggttattcgcgacgttatttaggtcggtattcgtagcgcgtcgtgggcgtttcgcgacgggatggtgatgttcgattttcggttgtatatttcgttatcgttattattgttttacgagattttggcggtaatttatatcgacggatatgaaggcgtgtagcgtattttgtataggttgcgtcgcgatttttattttttcgttatgcgtcgggtggtttaggagttcgttcgggcgtgcgatatatgttagcgtaataagtttgagtatttgtattcgggcggtttgtttttttttttgtcggttttaattacggtgtgggtcgatattggtttcgatttcgtggaagttttgtttcgtgtgggtgggaagatagtgatttttatcgtcgtcgatcggtttagtaagtattgttattttatttttttggtttatttttatatagttgaattagtagtttaggcgttttacgcggatattgtgcgtttttacggtatattttagtttatggtgtcggatcgggattcggtgtttacgttatttttttggcgcgagttgatgcggttgatcggtataaagatgtatatgacgacggttatttatttataatttgatggttagacggaggtcgttaataaggttatcgttatgtatttgcggtgttttatcggcgatcgatttcggtagtgggttcggtggttttcgtgggcggaatatatttataatatcgtttattagatattttttcgcgatacgtcgtttcgggtggtatacgggcgcgattcgtcgattattaggttttacgagttcggcgagacgcgcgtggcggtcgtcgttcgttttatggcggatcgtgacgagtttttggtcgacgtgcgttatcggttagagtaggtttaggcgacgtataagaagtattacgataaaggttatcgtgcggtgttttacgaggtgggcgatttcgtttttttgcgttttcgttatcgcgtttcggtatcgttgttttaagtgtttaagggtaagtttaagtttcgttatttcgggttttatcgcgtcgtcgaggtgattaatttcgtcgtcgttcgtttcgagttttcgtttcgcgtaaagttttacgacgtgttttacgtgggtttatttaagaagttcgtgggagttgcgttattatcgttttcggtattgtttgttgtttattacggtgttattgatttcgagttagagcgcgttattcgttttcggttagttcggggcgttcgttaagttttggtttattggaagggggaatcggttgcgttcgttatatgggaagatttggatatttttaaggagcgttattcggcgttttagttcgaggacgagttggttttcgaggaggggagagatgttatgtggggtcgaatttatgttaggcgttatagggtacgggacgtgcgtcgagtcggcgaacgcgtcgcg

SEQ ID NO: 38732 - DNA, 2355 bp, Artificial Sequence
  chemically treated genomic DNA (Homo sapiens) CpG-island No: 38732
  misc_feature (1731)..(1731): n is either a, c, g or t
cgcgacgcgttcgccgactcgacgcacgtcccgtaccctataacgcctaacataaattcgaccccacataacatctctcccctcctcgaaaaccaactcgtcctcgaactaaaacgccgaataacgctccttaaaaatatccaaatcttcccatataacgaacgcaaccgattcccccttccaataaaccaaaacttaacgaacgccccgaactaaccgaaaacgaataacgcgctctaactcgaaatcaataacaccgtaataaacaacaaacaataccgaaaacgataataacgcaactcccacgaacttcttaaataaacccacgtaaaacacgtcgtaaaactttacgcgaaacgaaaactcgaaacgaacgacgacgaaattaatcacctcgacgacgcgataaaacccgaaataacgaaacttaaacttacccttaaacacttaaaacaacgataccgaaacgcgataacgaaaacgcaaaaaaacgaaatcgcccacctcgtaaaacaccgcacgataacctttatcgtaatacttcttatacgtcgcctaaacctactctaaccgataacgcacgtcgaccaaaaactcgtcacgatccgccataaaacgaacgacgaccgccacgcgcgtctcgccgaactcgtaaaacctaataatcgacgaatcgcgcccgtataccacccgaaacgacgtatcgcgaaaaaatatctaataaacgatattataaatatattccgcccacgaaaaccaccgaacccactaccgaaatcgatcgccgataaaacaccgcaaatacataacgataaccttattaacgacctccgtctaaccatcaaattataaataaataaccgtcgtcatatacatctttataccgatcaaccgcatcaactcgcgccaaaaaaataacgtaaacaccgaatcccgatccgacaccataaactaaaatataccgtaaaaacgcacaatatccgcgtaaaacgcctaaactactaattcaactatataaaaataaaccaaaaaaataaaataacaatacttactaaaccgatcgacgacgataaaaatcactatcttcccacccacacgaaacaaaacttccacgaaatcgaaaccaatatcgacccacaccgtaattaaaaccgacaaaaaaaaaaacaaaccgcccgaatacaaatactcaaacttattacgctaacatatatcgcacgcccgaacgaactcctaaaccacccgacgcataacgaaaaaataaaaatcgcgacgcaacctatacaaaatacgctacacgccttcatatccgtcgatataaattaccgccaaaatctcgtaaaacaataataacgataacgaaatatacaaccgaaaatcgaacatcaccatcccgtcgcgaaacgcccacgacgcgctacgaataccgacctaaataacgtcgcgaataaccacgaaaacaaactccgtaatctaaactacccgcaaccgctcgatataatcgaaccgtaacgccgacaataccaaaacgacaccctcgtccgtatcgcgacgcgaaaaaacatcgaccaccacgttaaaaacgcccgacttatactccaccgtaaaatcgaaaccgaaaaacttacccaccaataatattaaaaataatcgccaaacgttaatcgaacaaatacttaaaactataataatccgtccgcaccacgaacgcacgcccccacaaatacgccnacccaataacgaataacgaaaacgaaaccgatcaactcccgctcgtaaacaacgaacgcacgataacgcgacgcgacgaaacgactaaaaaacgccaacgaatacttatcctacaaaaataccgcgccgaacccatacgtaaaaacgtcacactcgacgacgaataacttaacgaaatcgaataacgccaaaaccgaaaccgtaataacgacgtacttaaaaacgtaaaacgcaatcgccacctcgtcgaaccaccgaaacccctccttcttaatcaacgcgataaaaaaaacgacgataatcccgtaatcgtaaacgaacttacgataataacccgcgaaccccaaaaaaccccgaacgatacgaaccgaacgcgattacgaccaatccacgacaacctacaccttaaccgaatccataaacacgcccgtcgcgccgataatataacccaaataaaaaataaaactaacgccgaaaacgcactttaaacgcttaacgaacaaacgatactaacgcaacaaaaaaaacaccgcccgaatatacctcaaataatctacccaaatattactataaataaaaatatcgtcaaaaaacacaaaaacaaaacgacgaaaatatatacga

SEQ ID NO: 38733 - DNA, 702 bp, Artificial Sequence
  chemically treated genomic DNA (Homo sapiens) CpG-island No: 38733
tcgaatggtatgattaagaattcgtagaggttatcgtgcgttcggaacgtcgttttggcgacgtttttagttcgtattcggatttgatgatagttcgagcgtagatcgagtttggtgaagaatttggcgtcgtgtagttcgtttagtagttcgtttattatcgggatcgggtaggcgtttttgatggtgatggcgttgagggttttgtagtcgacgtagaaacgttacgagtcgtcggtttttttgattaataggacgggggacgagaacgtcgacgtgtttcggcgaatgaggttttgttttattatgacggtatattgtcgtttaagtttatttttgtgcgttatcgggtagcggtagggacgtacggcgacgggcggggcgtttggtaggaggtggatggcgtggtcgcggtttcgtggtggtggtaggtttcgtggttcggcgaagacgtcgtcgaaggagtttaggaggtcgtcgaggagggtaggtttcgtcgtgggcgtcggggtgttggaggaggatttcgtggtcgttaacgaggtttcgttttcggtgttgacggcgtggatatcggcgcgttggtgcgggggtaggttttgttacgagacggtgcgtttttgatgttggaaggatacggttttcgtggttacgttttaggcgatggtggtgtttaggtgggttatttattgagtgtttagt

SEQ ID NO: 38734 - DNA, 702 bp, Artificial Sequence
  chemically treated genomic DNA (Homo sapiens) CpG-island No: 38734
actaaacactcaataaataacccacctaaacaccaccatcgcctaaaacgtaaccacgaaaaccgtatccttccaacatcaaaaacgcaccgtctcgtaacaaaacctacccccgcaccaacgcgccgatatccacgccgtcaacaccgaaaacgaaacctcgttaacgaccacgaaatcctcctccaacaccccgacgcccacgacgaaacctaccctcctcgacgacctcctaaactccttcgacgacgtcttcgccgaaccacgaaacctaccaccaccacgaaaccgcgaccacgccatccacctcctaccaaacgccccgcccgtcgccgtacgtccctaccgctacccgataacgcacaaaaataaacttaaacgacaatataccgtcataataaaacaaaacctcattcgccgaaacacgtcgacgttctcgtcccccgtcctattaatcaaaaaaaccgacgactcgtaacgtttctacgtcgactacaaaaccctcaacgccatcaccatcaaaaacgcctacccgatcccgataataaacgaactactaaacgaactacacgacgccaaattcttcaccaaactcgatctacgctcgaactatcatcaaatccgaatacgaactaaaaacgtcgccaaaacgacgttccgaacgcacgataacctctacgaattcttaatcataccattcga

SEQ ID NO: 38735 - DNA, 702 bp, Artificial Sequence
  chemically treated genomic DNA (Homo sapiens) CpG-island No: 38735
gttgggtatttagtggatggtttatttgggtattattatcgtttgggacgtgattacggggatcgtgtttttttaatattaagggcgtatcgtttcgtggtagagtttattttcgtattagcgcgtcgatgtttacgtcgttagtatcggggacgaagtttcgttggcggttacggggtttttttttagtatttcggcgtttacgacggagtttgtttttttcgacggttttttgggttttttcgacgacgttttcgtcgagttacggggtttgttattattacggggtcgcgattacgttatttattttttgttaggcgtttcgttcgtcgtcgtgcgtttttatcgttattcggtggcgtataaggatgaatttgagcggtagtgtgtcgttatgatggagtagggttttattcgtcggagtacgtcggcgttttcgtttttcgttttgttggttaagaaagtcgacggttcgtggcgtttttgcgtcgattatagggtttttaacgttattattattaaggacgtttattcgatttcggtggtggacgagttgttggacgagttgtacggcgttaagttttttattaagttcgatttgcgttcgggttattattaagttcggatgcgggttgaagacgtcgttaagacggcgtttcggacgtacgatggtttttacgagtttttggttatgttattcgg

SEQ ID NO: 38736 - DNA, 702 bp, Artificial Sequence
  chemically treated genomic DNA (Homo sapiens) CpG-island No: 38736
ccgaataacataaccaaaaactcgtaaaaaccatcgtacgtccgaaacgccgtcttaacgacgtcttcaacccgcatccgaacttaataataacccgaacgcaaatcgaacttaataaaaaacttaacgccgtacaactcgtccaacaactcgtccaccaccgaaatcgaataaacgtccttaataataataacgttaaaaaccctataatcgacgcaaaaacgccacgaaccgtcgactttcttaaccaacaaaacgaaaaacgaaaacgccgacgtactccgacgaataaaaccctactccatcataacgacacactaccgctcaaattcatccttatacgccaccgaataacgataaaaacgcacgacgacgaacgaaacgcctaacaaaaaataaataacgtaatcgcgaccccgtaataataacaaaccccgtaactcgacgaaaacgtcgtcgaaaaaacccaaaaaaccgtcgaaaaaaacaaactccgtcgtaaacgccgaaatactaaaaaaaaaccccgtaaccgccaacgaaacttcgtccccgatactaacgacgtaaacatcgacgcgctaatacgaaaataaactctaccacgaaacgatacgcccttaatattaaaaaaacacgatccccgtaatcacgtcccaaacgataataatacccaaataaaccatccactaaatacccaac

SEQ ID NO: 38737 - DNA, 672 bp, Artificial Sequence
  chemically treated genomic DNA (Homo sapiens) CpG-island No: 38737
gtcggcgaggggtatgacgtaaaggtcgacgtcgaacgttatgttttggatggtgatcggtgttcgtcgtagtatattcggataggaaatttttttttcgttcgttatcgtcgtagtgagtcgtggacgcggttggacgggtaggtcggtgcggagcgcggcgtttttatcgatgaagttgtgggtggagttcgtgtttattagggtaacgagggaggcggtatcgagcgttatttggagtaggatcggtttgtttaacgggatgttagttatcgcgtgtaaggagaatacgggcgtttcgatagtcgttttttcggtgttattttttatcgtgtcgtcgtttttttcgattgtattattttttataaaaaataatcgtttgtatattttgttgtgggagcggttgtatttttcgttatagttgtagtatagttcgaggcgacggcgttttttttgttgggtttgggagagtcgtttgatcgggcgattttcgacggtgacggtgggcggtgtcggtttgacgacggggtcggtcgatggtcggggggtcggcgtcgggagtacgtcgcgcgcggatgtcgtggtcgggaataggtagggttttatgagttcgaattgtcgggcgagatttatggttttttttagggatgtcggtttttgttgttggatttg

SEQ ID NO: 38738 - DNA, 672 bp, Artificial Sequence
  chemically treated genomic DNA (Homo sapiens) CpG-island No: 38738
caaatccaacaacaaaaaccgacatccctaaaaaaaaccataaatctcgcccgacaattcgaactcataaaaccctacctattcccgaccacgacatccgcgcgcgacgtactcccgacgccgaccccccgaccatcgaccgaccccgtcgtcaaaccgacaccgcccaccgtcaccgtcgaaaatcgcccgatcaaacgactctcccaaacccaacaaaaaaaacgccgtcgcctcgaactatactacaactataacgaaaaatacaaccgctcccacaacaaaatatacaaacgattattttttataaaaaataatacaatcgaaaaaaacgacgacacgataaaaaataacaccgaaaaaacgactatcgaaacgcccgtattctccttacacgcgataactaacatcccgttaaacaaaccgatcctactccaaataacgctcgataccgcctccctcgttaccctaataaacacgaactccacccacaacttcatcgataaaaacgccgcgctccgcaccgacctacccgtccaaccgcgtccacgactcactacgacgataacgaacgaaaaaaaaatttcctatccgaatatactacgacgaacaccgatcaccatccaaaacataacgttcgacgtcgacctttacgtcatacccctcgccgac

SEQ ID NO: 38739 - DNA, 672 bp, Artificial Sequence
  chemically treated genomic DNA (Homo sapiens) CpG-island No: 38739
taggtttagtagtagaagtcggtatttttggaagaggttatgagtttcgttcgatagttcgagtttatggagttttatttgttttcggttacgatattcgcgcgcggcgtattttcgacgtcggtttttcggttatcgatcggtttcgtcgttaagtcggtatcgtttatcgttatcgtcgagggtcgttcggttaagcggtttttttaagtttagtaggaggagcgtcgtcgtttcgggttgtgttataattgtgacgagaaatatagtcgtttttataataaggtatgtaaacggttgttttttgtggagggtggtgtaatcgaagaaggcgacgatacggtggaggatgatatcgaagaggcgattgtcgaggcgttcgtgttttttttgtacgcggtggttggtatttcgttgggtaaatcgattttgttttaagtgacgttcggtgtcgtttttttcgttgttttggtggatacgggttttatttataattttatcggtgaggacgtcgcgtttcgtatcggtttgttcgtttagtcgcgtttacggtttattgcgacggtggcgaacggggagaaggttttttgttcgggtgtgttgcggcgggtatcgattattatttagggtatggcgttcgacgtcgatttttacgttatgtttttcgtcggt

SEQ ID NO: 38740 - DNA, 672 bp, Artificial Sequence
  chemically treated genomic DNA (Homo sapiens) CpG-island No: 38740
accgacgaaaaacataacgtaaaaatcgacgtcgaacgccataccctaaataataatcgatacccgccgcaacacacccgaacaaaaaaccttctccccgttcgccaccgtcgcaataaaccgtaaacgcgactaaacgaacaaaccgatacgaaacgcgacgtcctcaccgataaaattataaataaaacccgtatccaccaaaacaacgaaaaaaacgacaccgaacgtcacttaaaacaaaatcgatttacccaacgaaataccaaccaccgcgtacaaaaaaaacacgaacgcctcgacaatcgcctcttcgatatcatcctccaccgtatcgtcgccttcttcgattacaccaccctccacaaaaaacaaccgtttacataccttattataaaaacgactatatttctcgtcacaattataacacaacccgaaacgacgacgctcctcctactaaacttaaaaaaaccgcttaaccgaacgaccctcgacgataacgataaacgataccgacttaacgacgaaaccgatcgataaccgaaaaaccgacgtcgaaaatacgccgcgcgcgaatatcgtaaccgaaaacaaataaaactccataaactcgaactatcgaacgaaactcataacctcttccaaaaataccgacttctactactaaaccta

SEQ ID NO: 38741 - DNA, 536 bp, Artificial Sequence
  chemically treated genomic DNA (Homo sapiens) CpG-island No: 38741
gatcggcgcggggaagtagggtttggaatcgattttggtagttttttacggtgttcgtgcggcggtacgtcgagagttcgaatagcggtacggagcggagcgggggttcgtagcggaggttgaggagttttttgaaacgtttttacgtcggcgtattttcgttgttttggacgtgtatgtattatagttgcgcgtcgttttgtagattgtacgaagttatttacgtgcgtttcgtcgggatgacgtgttgttggatgaagaatgattcgtatcgattgatgaaggcgagcggatcggttttgttatcgtatttggggaatttcggacgttaatgtttcggcggtcgatttggtgtaggtgttttcgatgatttcgtggaagttttttcggtagttcgagtaacggatagggtcgcgatggtttgtgtgttgttttcgatcgttttggtcgtggtttcggatgaagattgtagggaggttagggttttggcgagggtttttagggtggatttgagatcgttttttatggtagcggtt

SEQ ID NO: 38742 - DNA, 536 bp, Artificial Sequence
  chemically treated genomic DNA (Homo sapiens) CpG-island No: 38742
aaccgctaccataaaaaacgatctcaaatccaccctaaaaaccctcgccaaaaccctaacctccctacaatcttcatccgaaaccacgaccaaaacgatcgaaaacaacacacaaaccatcgcgaccctatccgttactcgaactaccgaaaaaacttccacgaaatcatcgaaaacacctacaccaaatcgaccgccgaaacattaacgtccgaaattccccaaatacgataacaaaaccgatccgctcgccttcatcaatcgatacgaatcattcttcatccaacaacacgtcatcccgacgaaacgcacgtaaataacttcgtacaatctacaaaacgacgcgcaactataatacatacacgtccaaaacaacgaaaatacgccgacgtaaaaacgtttcaaaaaactcctcaacctccgctacgaacccccgctccgctccgtaccgctattcgaactctcgacgtaccgccgcacgaacaccgtaaaaaactaccaaaatcgattccaaaccctacttccccgcgccgatc

SEQ ID NO: 38743 - DNA, 536 bp, Artificial Sequence
  chemically treated genomic DNA (Homo sapiens) CpG-island No: 38743
agtcgttgttatgggggacgattttaagtttattttggagattttcgttaagattttggtttttttgtaatttttattcgaagttacgattaaggcgatcgaggataatatataggttatcgcggttttgttcgttgttcggattatcgagaaggtttttacggaattatcggggatatttgtattagatcggtcgtcgaagtattggcgttcggagttttttaagtacgatggtaagatcgattcgttcgtttttattaatcgatgcgagttattttttatttagtaatacgttatttcggcggaacgtacgtggatggtttcgtataatttgtaggacggcgcgtaattgtggtatatgtacgtttaggataacgagggtacgtcgacgtgggagcgttttaaggaattttttaattttcgttacgggttttcgtttcgtttcgtgtcgttattcgagttttcggcgtgtcgtcgtacgagtatcgtggaagattattaagatcggttttaggttttgttttttcgcgtcggtt

SEQ ID NO: 38744 - DNA, 536 bp, Artificial Sequence
  chemically treated genomic DNA (Homo sapiens) CpG-island No: 38744
aaccgacgcgaaaaaacaaaacctaaaaccgatcttaataatcttccacgatactcgtacgacgacacgccgaaaactcgaataacgacacgaaacgaaacgaaaacccgtaacgaaaattaaaaaattccttaaaacgctcccacgtcgacgtaccctcgttatcctaaacgtacatataccacaattacgcgccgtcctacaaattatacgaaaccatccacgtacgttccgccgaaataacgtattactaaataaaaaataactcgcatcgattaataaaaacgaacgaatcgatcttaccatcgtacttaaaaaactccgaacgccaatacttcgacgaccgatctaatacaaatatccccgataattccgtaaaaaccttctcgataatccgaacaacgaacaaaaccgcgataacctatatattatcctcgatcgccttaatcgtaacttcgaataaaaattacaaaaaaaccaaaatcttaacgaaaatctccaaaataaacttaaaatcgtcccccataacaacgact

SEQ ID NO: 38745 - DNA, 555 bp, Artificial Sequence
  chemically treated genomic DNA (Homo sapiens) CpG-island No: 38745
ggagcggcggcgtggcggcgcggtgtcggcgtggcgcggcggcggcgtggtggcgcggcggtagtatagcgtggcggtggcgtgtcgcggtggtggcgtggcgttacggcggcgtggcgcggttcggcggcgtgtcgaggcgggggcggcggcgtggttgtggcgttagcgtacgtcgtcggtagtgtcggcgttacgtcgtcggcggtggcggtcgtatcgaggtcggggtcggtatcggcgggaggcggagtcggggtcggtcgcgtcgacgtcggcggcggcgtcggtaacgaggcgggggcggtttggagagagagagagatcgaggtttagagagagagaggcggcggcggtttttattttagagatgtggcggcggcggaggcggcgacgacgacgttcgcgagacgatggtaagatacgacggcggcgtcggcgcggggatgttttaggtagtggcggcgaaggagaagtcgagatcgatcggggaaaaaatttttaagtgttggtagagaggacgagggtacgtatcggggatatatatatttttag

SEQ ID NO: 38746 - DNA, 555 bp, Artificial Sequence
  chemically treated genomic DNA (Homo sapiens) CpG-island No: 38746
ctaaaaatatatatatccccgatacgtaccctcgtcctctctaccaacacttaaaaattttttccccgatcgatctcgacttctccttcgccgccactacctaaaacatccccgcgccgacgccgccgtcgtatcttaccatcgtctcgcgaacgtcgtcgtcgccgcctccgccgccgccacatctctaaaataaaaaccgccgccgcctctctctctctaaacctcgatctctctctctctccaaaccgcccccgcctcgttaccgacgccgccgccgacgtcgacgcgaccgaccccgactccgcctcccgccgataccgaccccgacctcgatacgaccgccaccgccgacgacgtaacgccgacactaccgacgacgtacgctaacgccacaaccacgccgccgcccccgcctcgacacgccgccgaaccgcgccacgccgccgtaacgccacgccaccaccgcgacacgccaccgccacgctatactaccgccgcgccaccacgccgccgccgcgccacgccgacaccgcgccgccacgccgccgctcc

SEQ ID NO: 38747 - DNA, 555 bp, Artificial Sequence
  chemically treated genomic DNA (Homo sapiens) CpG-island No: 38747
ttagaggtatatatattttcgatgcgtgttttcgttttttttattaatatttagaaatttttttttcgatcgatttcggtttttttttcgtcgttattgtttagggtattttcgcgtcgacgtcgtcgtcgtattttgttatcgtttcgcgggcgtcgtcgtcgtcgttttcgtcgtcgttatatttttggggtgagagtcgtcgtcgtttttttttttttgaatttcgatttttttttttttttaaatcgttttcgtttcgttgtcgacgtcgtcgtcgacgtcgacgcggtcgatttcgatttcgtttttcgtcgatgtcgatttcgatttcgatgcggtcgttatcgtcgacgacgtagcgtcggtattgtcgacgacgtacgttgacgttatagttacgtcgtcgttttcgtttcggtacgtcgtcgggtcgcgttacgtcgtcgtgacgttacgttattatcgcggtacgttatcgttacgttatgttgtcgtcgcgttattacgtcgtcgtcgcgttacgtcgatatcgcgtcgttacgtcgtcgtttt

SEQ ID NO: 38748 - DNA, 555 bp, Artificial Sequence
  chemically treated genomic DNA (Homo sapiens) CpG-island No: 38748
aaaacgacgacgtaacgacgcgatatcgacgtaacgcgacgacgacgtaataacgcgacgacaacataacgtaacgataacgtaccgcgataataacgtaacgtcacgacgacgtaacgcgacccgacgacgtaccgaaacgaaaacgacgacgtaactataacgtcaacgtacgtcgtcgacaataccgacgctacgtcgtcgacgataacgaccgcatcgaaatcgaaatcgacatcgacgaaaaacgaaatcgaaatcgaccgcgtcgacgtcgacgacgacgtcgacaacgaaacgaaaacgatttaaaaaaaaaaaaaaatcgaaattcaaaaaaaaaaaaacgacgacgactctcaccccaaaaatataacgacgacgaaaacgacgacgacgacgcccgcgaaacgataacaaaatacgacgacgacgtcgacgcgaaaataccctaaacaataacgacgaaaaaaaaaccgaaatcgatcgaaaaaaaaatttctaaatattaataaaaaaaacgaaaacacgcatcgaaaatatatatacctctaa

SEQ ID NO: 38749 - DNA, 1185 bp, Artificial Sequence
  chemically treated genomic DNA (Homo sapiens) CpG-island No: 38749
taggtcgaggtttagttcggtagtttaggtcgtttcgttgttttttttttcggggtcgtcgataggtggggtttatttgtcggtttcgttttttttttttcgtttttttcgttcgcgtcgtcgtattcgtaatcgtcgtcgcgtttacgttttcgtttttttcgggttacgtcgattacgtttacgcgtgcgtcgcgtttttcgcgtttttttttttttttttttcgttcgcgttcgcgttcgagatggtcgggattcgaaaatcgaatttcgttttttttttttttttattttttcgcgtcggtcggcgattttcgtttttttcggttacgttcggttttttttttttttatttaagtatcgtcggtatttttttttattttttttttattgcgtcgatttttttcgagttttttatcgttttcgcgtcgtgtaattattcgtcgtcgtcgtttttgttatttcggtcgtcgttagtcgtcgttaggttcgtcgtcgttttgcgtcgtcgtcgtcgttagattcgcgcggtcgaggtttatttcgtttatttttttttcgttgaggttcgtcgtcggagatttattttcgtcgtgcgtcggtgagtgacgttatggtcgtcgttttcggtcggcgttttcgcgttttcgcgtttttttttttttttttaatttttttttttttgttcgttaggaggtttcggagttcgtttcgtcgtcgttatcgtttttcgtcgttcgtcgtcgtcgatcgttgtcggtgaggttttttttttcgttttttttttttcgtatcgtttagtcgtcgcgtcgtcgtttagttgcgtagtcgtcgttttttttttagtcgtcgtttttcgtcgttcgcgttcgtcgtcggtcgtcgttttgcgtcgttgtcgtatgcgcgtcgtcgtcgcgtgagcgttgcgtcgtcggcgttatggtcgtcggttcggtttgcgtcgtgttcgcgtgtttcggtcgcgagtttttatcgtcgttcgatttatttttgggtagatcggggtcgtcggttcggttgttacgtggcgtcgtcgtttttttttttttttttcgtgtcgttgatcggtgggtttcgtatgtcggcgtcgtatttttcgtgttgacgttagttttggaatttattgcgtaataaattgtttaaggttttttttttatagta

SEQ ID NO: 38750 - DNA, 1185 bp, Artificial Sequence
  chemically treated genomic DNA (Homo sapiens) CpG-island No: 38750
tactataaaaaaaaaaccttaaacaatttattacgcaataaattccaaaactaacgtcaacacgaaaaatacgacgccgacatacgaaacccaccgatcaacgacacgaaaaaaaaaaaaaaaaacgacgacgccacgtaacaaccgaaccgacgaccccgatctacccaaaaataaatcgaacgacgataaaaactcgcgaccgaaacacgcgaacacgacgcaaaccgaaccgacgaccataacgccgacgacgcaacgctcacgcgacgacgacgcgcatacgacaacgacgcaaaacgacgaccgacgacgaacgcgaacgacgaaaaacgacgactaaaaaaaaaacgacgactacgcaactaaacgacgacgcgacgactaaacgatacgaaaaaaaaaaaacgaaaaaaaaaacctcaccgacaacgatcgacgacgacgaacgacgaaaaacgataacgacgacgaaacgaactccgaaacctcctaacgaacaaaaaaaaaaaaattaaaaaaaaaaaaaaaaacgcgaaaacgcgaaaacgccgaccgaaaacgacgaccataacgtcactcaccgacgcacgacgaaaataaatctccgacgacgaacctcaacgaaaaaaaaataaacgaaataaacctcgaccgcgcgaatctaacgacgacgacgacgcaaaacgacgacgaacctaacgacgactaacgacgaccgaaataacaaaaacgacgacgacgaataattacacgacgcgaaaacgataaaaaactcgaaaaaaatcgacgcaataaaaaaaaaataaaaaaaaataccgacgatacttaaataaaaaaaaaaaaaaccgaacgtaaccgaaaaaaacgaaaatcgccgaccgacgcgaaaaaataaaaaaaaaaaaaaaacgaaattcgattttcgaatcccgaccatctcgaacgcgaacgcgaacgaaaaaaaaaaaaaaaaaaacgcgaaaaacgcgacgcacgcgtaaacgtaatcgacgtaacccgaaaaaaacgaaaacgtaaacgcgacgacgattacgaatacgacgacgcgaacgaaaaaaacgaaaaaaaaaaaacgaaaccgacaaataaaccccacctatcgacgaccccgaaaaaaaaaacaacgaaacgacctaaactaccgaactaaacctcgaccta

SEQ ID NO: 38751 - DNA, 1185 bp, Artificial Sequence
  chemically treated genomic DNA (Homo sapiens) CpG-island No: 38751
tattataaaagaaaaattttaaataatttattgcgtaataaattttagggttgacgttagtacggggggtgcggcgtcgatatgcggggtttatcggttagcggtacgggagagagagaaaggggcggcggcgttacgtggtagtcggatcgacggtttcgatttatttaagggtagatcggacggcggtgggagttcgcggtcggggtacgcgggtacggcgtaagtcgaatcggcgattatggcgtcggcggcgtagcgtttacgcggcggcggcgcgtatgcggtagcggcgtaaggcgacggtcgacggcgagcgcgggcggcggagagcggcggttagaggaggagcggcggttacgtagttaggcggcgacgcggcggttaaacggtgcgggagagagaaaacgaggaggagggttttatcgataacggtcgacgacggcgggcgacgaaggacgatggcgacggcggaacgagtttcggagttttttaacgaataaaaggagaggggttagagagagagggaagggcgcgaaagcgcgagggcgtcggtcgaaggcggcggttatggcgttatttatcggcgtacggcggggatgggttttcggcggcgaattttaacggaggaggggtggacgaggtggatttcggtcgcgcgaatttaacggcggcgacggcgtaagacggcggcgagtttagcggcggttagcggcggtcggagtagtaaaaacggcggcggcgggtggttgtacggcgcgggagcgatggggagttcgggagaggtcggcgtaatggggaaaaagtgagaaggagtgtcggcgatgtttaaatagggggagagggaatcggacgtggtcgggagaggcgggaatcgtcggtcgacgcgggagagtggggaggagagagaggcgggattcggttttcgaatttcggttatttcgggcgcgggcgcgagcgggagagagaggggaaaaggcgcggagagcgcggcgtacgcgtgggcgtggtcgacgtggttcggggaaggcggaggcgtgggcgcggcgacggttacgggtgcggcggcgcgagcgggagaggcgggaggagggagacgggatcgataggtgggttttatttgtcggcgatttcgagagaggaggtagcggggcggtttgggttgtcggattgggtttcggtttg

SEQ ID NO: 38752 - DNA, 1185 bp, Artificial Sequence
  chemically treated genomic DNA (Homo sapiens) CpG-island No: 38752
caaaccgaaacccaatccgacaacccaaaccgccccgctacctcctctctcgaaatcgccgacaaataaaacccacctatcgatcccgtctccctcctcccgcctctcccgctcgcgccgccgcacccgtaaccgtcgccgcgcccacgcctccgccttccccgaaccacgtcgaccacgcccacgcgtacgccgcgctctccgcgccttttcccctctctctcccgctcgcgcccgcgcccgaaataaccgaaattcgaaaaccgaatcccgcctctctctcctccccactctcccgcgtcgaccgacgattcccgcctctcccgaccacgtccgattccctctccccctatttaaacatcgccgacactccttctcactttttccccattacgccgacctctcccgaactccccatcgctcccgcgccgtacaaccacccgccgccgccgtttttactactccgaccgccgctaaccgccgctaaactcgccgccgtcttacgccgtcgccgccgttaaattcgcgcgaccgaaatccacctcgtccacccctcctccgttaaaattcgccgccgaaaacccatccccgccgtacgccgataaataacgccataaccgccgccttcgaccgacgccctcgcgctttcgcgcccttccctctctctctaacccctctccttttattcgttaaaaaactccgaaactcgttccgccgtcgccatcgtccttcgtcgcccgccgtcgtcgaccgttatcgataaaaccctcctcctcgttttctctctcccgcaccgtttaaccgccgcgtcgccgcctaactacgtaaccgccgctcctcctctaaccgccgctctccgccgcccgcgctcgccgtcgaccgtcgccttacgccgctaccgcatacgcgccgccgccgcgtaaacgctacgccgccgacgccataatcgccgattcgacttacgccgtacccgcgtaccccgaccgcgaactcccaccgccgtccgatctacccttaaataaatcgaaaccgtcgatccgactaccacgtaacgccgccgcccctttctctctctcccgtaccgctaaccgataaaccccgcatatcgacgccgcaccccccgtactaacgtcaaccctaaaatttattacgcaataaattatttaaaatttttcttttataata

SEQ ID NO: 38753 - DNA, 1142 bp, Artificial Sequence
  chemically treated genomic DNA (Homo sapiens) CpG-island No: 38753
aagaaattcgttatgattttgtcgttattttcggcggtttcgattttagtcgtgtagatttggagaaattcggcggggttgacgttttcgtcgtatttttcggtgatggtgggtcggaattttgggggttaacggacgtttcgaaggttcgttataaaggttcgatagtcggtatagttaatcggggatacggggggtcggttttcgtgttcggatcgaagtggcgtttcggacgaggaagcgtttttcgttgcgtgggtagtacgacgattattgcgttagcgttcgatattgagacgggtattcggttttttacgtatatttttttgggtcggaggcgttgacgagggaatggcggacgaacggcgggtaacggtcgtcgttcgtcgcgtttttcgtttcgacgatacggagtcggcggtagtagcgttagaggttttggtggcggaggatcgttcgtcggcgtttaggcgttgttgcgtcgttatgattaagtcggttacgttatttagttaacgtcgggttggagtttttggatcggggacgacgggcgggtgacgtaggagcgcgttcgtagtttggagcgcgttttggggcgtgttgttatcgtcgtagacgaggaggcgatatttttcgtttcgtcgtttttttttatcgttcgcgggcggcgaagtcgtggatttttcgattttttcgagcgttttttttcgtttaagatttcggcgagagggggacggtggagtacgagttcgacggcgcgggttttgtttttcgttattatcgttagttttcggagagaggttgtgcgttattgttcgttcggttattgggttgagtaggagaagtttggcgtatacgaaagaggacgagggtttagaaagatatacgcgttttttatttggcgcgttagatgacggagcgtggggttttttatcgggagatcgcgtaggtttttttttgtcggttcggtcgggggcgttgagtgaggttttttattttcgatttgtggaatgttcgcgagagagtaaatgtataagatacggacgatgtagataggttcgggtcgttgagaagcgtaatattttatttttgtgttttggtggatttgtgtgtgaaggaattatagagagttggagagttag

SEQ ID NO: 38754 - DNA, 1142 bp, Artificial Sequence
  chemically treated genomic DNA (Homo sapiens) CpG-island No: 38754
ctaactctccaactctctataattccttcacacacaaatccaccaaaacacaaaaataaaatattacgcttctcaacgacccgaacctatctacatcgtccgtatcttatacatttactctctcgcgaacattccacaaatcgaaaataaaaaacctcactcaacgcccccgaccgaaccgacaaaaaaaaacctacgcgatctcccgataaaaaaccccacgctccgtcatctaacgcgccaaataaaaaacgcgtatatctttctaaaccctcgtcctctttcgtatacgccaaacttctcctactcaacccaataaccgaacgaacaataacgcacaacctctctccgaaaactaacgataataacgaaaaacaaaacccgcgccgtcgaactcgtactccaccgtccccctctcgccgaaatcttaaacgaaaaaaaacgctcgaaaaaatcgaaaaatccacgacttcgccgcccgcgaacgataaaaaaaaacgacgaaacgaaaaatatcgcctcctcgtctacgacgataacaacacgccccaaaacgcgctccaaactacgaacgcgctcctacgtcacccgcccgtcgtccccgatccaaaaactccaacccgacgttaactaaataacgtaaccgacttaatcataacgacgcaacaacgcctaaacgccgacgaacgatcctccgccaccaaaacctctaacgctactaccgccgactccgtatcgtcgaaacgaaaaacgcgacgaacgacgaccgttacccgccgttcgtccgccattccctcgtcaacgcctccgacccaaaaaaatatacgtaaaaaaccgaatacccgtctcaatatcgaacgctaacgcaataatcgtcgtactacccacgcaacgaaaaacgcttcctcgtccgaaacgccacttcgatccgaacacgaaaaccgaccccccgtatccccgattaactataccgactatcgaacctttataacgaaccttcgaaacgtccgttaacccccaaaattccgacccaccatcaccgaaaaatacgacgaaaacgtcaaccccgccgaatttctccaaatctacacgactaaaatcgaaaccgccgaaaataacgacaaaatcataacgaatttctt

SEQ ID NO: 38755 - DNA, 1142 bp, Artificial Sequence
  chemically treated genomic DNA (Homo sapiens) CpG-island No: 38755
ttagttttttaattttttgtaatttttttatatatagatttattagaatataggagtagggtattacgttttttagcggttcgaatttgtttatatcgttcgtgttttgtgtatttgttttttcgcgaatattttatagatcgagggtgaagaattttatttagcgttttcgatcgaatcggtaaaggggggtttgcgcggtttttcggtgaggagttttacgtttcgttatttggcgcgttaggtagggggcgcgtgtgtttttttaagttttcgttttttttcgtgtgcgttaagttttttttgtttagtttaatggtcgaacgggtagtggcgtataattttttttcgagggttagcggtgatgacggggagtagaattcgcgtcgtcgagttcgtattttatcgtttttttttcgtcgaggttttgggcgggaggaggcgttcgagggggtcgaaagatttacgatttcgtcgttcgcgggcgatggagaaggacggcgagacggggagtgtcgttttttcgtttacggcgatggtagtacgttttagggcgcgttttaggttgcgggcgcgtttttgcgttattcgttcgtcgttttcgatttagagattttagttcgacgttggttggatgacgtggtcgatttggttatgacggcgtagtagcgtttaggcgtcggcgggcggtttttcgttattaagatttttggcgttgttatcgtcggtttcgtgtcgtcgaggcggagggcgcggcgagcggcggtcgttattcgtcgttcgttcgttattttttcgttaacgttttcgatttaagaagatgtgcgtggggggtcggatgttcgttttaatatcgagcgttggcgtaatggtcgtcgtgttgtttacgtaacggagggcgttttttcgttcggagcgttatttcggttcgggtacgggggtcggtttttcgtgttttcggttggttgtgtcggttgtcgagtttttgtggcgagttttcggaacgttcgttggtttttaaggtttcggtttattattatcgaaaaatacgacggaagcgttaatttcgtcgagtttttttagatttatacgattgggatcgaggtcgtcgggggtgacgatagggttatggcgaatttttt

SEQ ID NO: 38756 - DNA, 1142 bp, Artificial Sequence
  chemically treated genomic DNA (Homo sapiens) CpG-island No: 38756
aaaaaattcgccataaccctatcgtcacccccgacgacctcgatcccaatcgtataaatctaaaaaaactcgacgaaattaacgcttccgtcgtatttttcgataataataaaccgaaaccttaaaaaccaacgaacgttccgaaaactcgccacaaaaactcgacaaccgacacaaccaaccgaaaacacgaaaaaccgacccccgtacccgaaccgaaataacgctccgaacgaaaaaacgccctccgttacgtaaacaacacgacgaccattacgccaacgctcgatattaaaacgaacatccgaccccccacgcacatcttcttaaatcgaaaacgttaacgaaaaaataacgaacgaacgacgaataacgaccgccgctcgccgcgccctccgcctcgacgacacgaaaccgacgataacaacgccaaaaatcttaataacgaaaaaccgcccgccgacgcctaaacgctactacgccgtcataaccaaatcgaccacgtcatccaaccaacgtcgaactaaaatctctaaatcgaaaacgacgaacgaataacgcaaaaacgcgcccgcaacctaaaacgcgccctaaaacgtactaccatcgccgtaaacgaaaaaacgacactccccgtctcgccgtccttctccatcgcccgcgaacgacgaaatcgtaaatctttcgaccccctcgaacgcctcctcccgcccaaaacctcgacgaaaaaaaaacgataaaatacgaactcgacgacgcgaattctactccccgtcatcaccgctaaccctcgaaaaaaaattatacgccactacccgttcgaccattaaactaaacaaaaaaaacttaacgcacacgaaaaaaaacgaaaacttaaaaaaacacacgcgccccctacctaacgcgccaaataacgaaacgtaaaactcctcaccgaaaaaccgcgcaaacccccctttaccgattcgatcgaaaacgctaaataaaattcttcaccctcgatctataaaatattcgcgaaaaaacaaatacacaaaacacgaacgatataaacaaattcgaaccgctaaaaaacgtaataccctactcctatattctaataaatctatatataaaaaaattacaaaaaattaaaaaactaa

SEQ ID NO: 38757 - DNA, 1289 bp, Artificial Sequence
  chemically treated genomic DNA (Homo sapiens) CpG-island No: 38757
gtcggtttcggttagagacgagtgtttggaggtttttattatttcgacgggacggggcgaggcgtgtgataggtcgtttgttgttatttaattcgcgatttgatcggtttgtgatcggttatatattgcgatcggttacggatcggataagcgtgcgttgcgttgtattaaacgcggcgtggcgcgttcgttcgaatcgtaataaatgcggttaggtgagcgtcgttgtgtttatttaatttatatacgtggcgttaatattatagggggtcggggcgttttagttttcggggtcgaaacgggagcggttcgatttttcggggggatagagggaggggcggttacgttattttcgggttcgacgttttttgagggtgttaggttacgtgggcgattgtgtttgttttaaatttttagttatgatattttcgattttatgttatcgatagtagttttcggcgttatgttagggcgatcgtttttttcgagggaagcgttcgggcgtgacgttattttttaggtttggtgataggtggggtcggtttttataggcgggtagaaatttagcgatcgtaaatcgtgcgtatcggtaagggaaaatcgattgataataatgagcggttttttcgcgatcgttatattattcgagtagcggcgaatcgggacgagttgattcgtttcgtttggagatatgatgatggcgtttcggtcggcgagcgtagttaacgcgcgtacgatatgttttatttcgattgttacggtcgtatattcgtttcgtgcgtcgtaaacgggcgagcgggattagtggaggtgtgggtgcgagaaacgagggggcgagatagtgggtgtaggaagcgaggagtcgggtatagcgttggtaagggtataaagacgtcgaggaagagattcgttttttttttttcgttattattttttttgttttcgttatttgtattttaatttttcgttttttgtgttttatttacgtcgtatttattcgtttttaagtttttttttcgtcggcgttatggtacggggtttcgtatcgttcgatggtagcgtgttgtcgttttttcgtatcgtgagcgagaggtaggtcgggatgtcgcgtcgatttatgtcggaatttgttatcggtcgggaggtggtcgagttgggcgagggacgttcggcgttagattattcggggcggttcgtttttttttttttttttgtaatggtagggttggtttcgttatttttttttttttttatggatgttttggagttttacgatttttagatggcgt

SEQ ID NO: 38758 - DNA, 1289 bp, Artificial Sequence
  chemically treated genomic DNA (Homo sapiens) CpG-island No: 38758
acgccatctaaaaatcgtaaaactccaaaacatccataaaaaaaaaaaaaaataacgaaaccaaccctaccattacaaaaaaaaaaaaaaaaacgaaccgccccgaataatctaacgccgaacgtccctcgcccaactcgaccacctcccgaccgataacaaattccgacataaatcgacgcgacatcccgacctacctctcgctcacgatacgaaaaaacgacaacacgctaccatcgaacgatacgaaaccccgtaccataacgccgacgaaaaaaaaacttaaaaacgaataaatacgacgtaaataaaacacaaaaaacgaaaaattaaaatacaaataacgaaaacaaaaaaaataataacgaaaaaaaaaaaacgaatctcttcctcgacgtctttatacccttaccaacgctatacccgactcctcgcttcctacacccactatctcgccccctcgtttctcgcacccacacctccactaatcccgctcgcccgtttacgacgcacgaaacgaatatacgaccgtaacaatcgaaataaaacatatcgtacgcgcgttaactacgctcgccgaccgaaacgccatcatcatatctccaaacgaaacgaatcaactcgtcccgattcgccgctactcgaataatataacgatcgcgaaaaaaccgctcattattatcaatcgattttcccttaccgatacgcacgatttacgatcgctaaatttctacccgcctataaaaaccgaccccacctatcaccaaacctaaaaaataacgtcacgcccgaacgcttccctcgaaaaaaacgatcgccctaacataacgccgaaaactactatcgataacataaaatcgaaaatatcataactaaaaatttaaaacaaacacaatcgcccacgtaacctaacaccctcaaaaaacgtcgaacccgaaaataacgtaaccgcccctccctctatccccccgaaaaatcgaaccgctcccgtttcgaccccgaaaactaaaacgccccgaccccctataatattaacgccacgtatataaattaaataaacacaacgacgctcacctaaccgcatttattacgattcgaacgaacgcgccacgccgcgtttaatacaacgcaacgcacgcttatccgatccgtaaccgatcgcaatatataaccgatcacaaaccgatcaaatcgcgaattaaataacaacaaacgacctatcacacgcctcgccccgtcccgtcgaaataataaaaacctccaaacactcgtctctaaccgaaaccgac

SEQ ID NO: 38759 - DNA, 1289 bp, Artificial Sequence
  chemically treated genomic DNA (Homo sapiens) CpG-island No: 38759
gcgttatttggagatcgtagaattttagaatatttatgaagaaagaagaaaatggcggaattagttttgttattgtaaaggggagaaagaagacggatcgtttcgggtagtttggcgtcgggcgtttttcgtttagttcgattatttttcggtcggtggtagatttcggtatgaatcggcgcggtatttcggtttgtttttcgtttacgatgcgggaaggcggtagtacgttattatcgagcggtgcggagtttcgtgttatgacgtcggcggaggaggggtttgagagcgagtgagtgcggcgtgggtagggtataggaaacgaagagttagagtgtaagtggcgaaggtaaggggagtaatggcgagaggaaggaaacgaatttttttttcggcgtttttatatttttgttaacgttatgttcggtttttcgttttttgtatttattatttcgttttttcgtttttcgtatttatatttttattaatttcgttcgttcgtttgcggcgtacgaggcggatgtgcggtcgtggtagtcgagatgggatatatcgtgcgcgcgttaattacgttcgtcgatcgaagcgttattattatgtttttaggcgaaacgaattagttcgtttcgattcgtcgttgttcgagtaatgtagcgatcgcgaagaggtcgtttattattgttagtcggtttttttttatcgatgcgtacgatttgcgatcgttgggtttttgttcgtttgtagagatcggttttatttgttattaggtttaaggagtggcgttacgttcgagcgtttttttcgaggagagcgatcgttttggtataacgtcgggggttattgtcggtgatatgggatcgggagtattatgattagaggtttgaggtagatataatcgtttacgtggtttggtatttttaggggacgtcgggttcgagggtgacgtagtcgtttttttttttgttttttcgaggggtcgggtcgttttcgtttcggtttcgagggttggggcgtttcgattttttgtggtgttggcgttacgtgtgtgggttaggtgagtatagcggcgtttatttaatcgtatttattgcggttcggacgagcgcgttacgtcgcgtttaatgtagcgtagcgtacgtttattcggttcgtgatcggtcgtagtgtgtgatcgattatagatcggttagatcgcgggttaggtggtaataggcggtttgttatacgtttcgtttcgtttcgtcggaatgatgagagtttttaggtattcgtttttagtcggagtcggt

SEQ ID NO: 38760 - DNA, 1289 bp, Artificial Sequence
  chemically treated genomic DNA (Homo sapiens) CpG-island No: 38760
accgactccgactaaaaacgaatacctaaaaactctcatcattccgacgaaacgaaacgaaacgtataacaaaccgcctattaccacctaacccgcgatctaaccgatctataatcgatcacacactacgaccgatcacgaaccgaataaacgtacgctacgctacattaaacgcgacgtaacgcgctcgtccgaaccgcaataaatacgattaaataaacgccgctatactcacctaacccacacacgtaacgccaacaccacaaaaaatcgaaacgccccaaccctcgaaaccgaaacgaaaacgacccgacccctcgaaaaaacaaaaaaaaaaacgactacgtcaccctcgaacccgacgtcccctaaaaataccaaaccacgtaaacgattatatctacctcaaacctctaatcataatactcccgatcccatatcaccgacaataacccccgacgttataccaaaacgatcgctctcctcgaaaaaaacgctcgaacgtaacgccactccttaaacctaataacaaataaaaccgatctctacaaacgaacaaaaacccaacgatcgcaaatcgtacgcatcgataaaaaaaaaccgactaacaataataaacgacctcttcgcgatcgctacattactcgaacaacgacgaatcgaaacgaactaattcgtttcgcctaaaaacataataataacgcttcgatcgacgaacgtaattaacgcgcgcacgatatatcccatctcgactaccacgaccgcacatccgcctcgtacgccgcaaacgaacgaacgaaattaataaaaatataaatacgaaaaacgaaaaaacgaaataataaatacaaaaaacgaaaaaccgaacataacgttaacaaaaatataaaaacgccgaaaaaaaaattcgtttccttcctctcgccattactccccttaccttcgccacttacactctaactcttcgtttcctataccctacccacgccgcactcactcgctctcaaacccctcctccgccgacgtcataacacgaaactccgcaccgctcgataataacgtactaccgccttcccgcatcgtaaacgaaaaacaaaccgaaataccgcgccgattcataccgaaatctaccaccgaccgaaaaataatcgaactaaacgaaaaacgcccgacgccaaactacccgaaacgatccgtcttctttctcccctttacaataacaaaactaattccgccattttcttctttcttcataaatattctaaaattctacgatctccaaataacgc

SEQ ID NO: 38761 - DNA, 516 bp, Artificial Sequence
  chemically treated genomic DNA (Homo sapiens) CpG-island No: 38761
aacgcggtgatgatattggttattttcgcgtatttgtgcgagatgtttattggggtgcgtttattttttcggttgtttcggtggttttttatcgtgtagttagtgtcgtcgttatcggtagttggtggttgttatttttagttacgggggtcggtgtcgaatcgttatattttttgcgtttttcgtaagaagtgggacgattggaagagcgattggttttatattttttttgtcgacgaagcgcgttttcgattttcgagttagttttcggtttaggtttttagttggcgggcgtcggtagatttgggggatggttatgacgtcgttttcgatcgtttggcgggtttgcgattttaggggtttataggggttatggtgtacggcgattattttcgtcgtcggattgcgtcgttttagcggcgcgttcggggcgtttgggagtatatcgggttcgaagattttatgaggatttattagggagtgagatgggattgggtttttgaggattttaagata

SEQ ID NO: 38762 - DNA, 516 bp, Artificial Sequence
  chemically treated genomic DNA (Homo sapiens) CpG-island No: 38762
tatcttaaaatcctcaaaaacccaatcccatctcactccctaataaatcctcataaaatcttcgaacccgatatactcccaaacgccccgaacgcgccgctaaaacgacgcaatccgacgacgaaaataatcgccgtacaccataacccctataaacccctaaaatcgcaaacccgccaaacgatcgaaaacgacgtcataaccatcccccaaatctaccgacgcccgccaactaaaaacctaaaccgaaaactaactcgaaaatcgaaaacgcgcttcgtcgacaaaaaaaatataaaaccaatcgctcttccaatcgtcccacttcttacgaaaaacgcaaaaaatataacgattcgacaccgacccccgtaactaaaaataacaaccaccaactaccgataacgacgacactaactacacgataaaaaaccaccgaaacaaccgaaaaaataaacgcaccccaataaacatctcgcacaaatacgcgaaaataaccaatatcatcaccgcgtt

SEQ ID NO: 38763 - DNA, 516 bp, Artificial Sequence
  chemically treated genomic DNA (Homo sapiens) CpG-island No: 38763
tattttgaagtttttaggggtttagttttattttattttttggtgagtttttatgaagttttcggattcggtgtatttttaggcgtttcgagcgcgtcgttggagcggcgtaattcgacgacggaggtagtcgtcgtatattatggtttttgtgagtttttgggatcgtaggttcgttaggcggtcgaggacggcgttatagttattttttagatttatcggcgttcgttagttggaggtttgagtcgggggttggttcggaagtcggaggcgcgtttcgtcggtaaggggggtgtagaattagtcgtttttttagtcgttttattttttgcggagggcgtaggggatgtagcggttcggtatcggttttcgtggttggaagtagtagttattaattatcgatggcggcgatattgattgtacggtgaagaattatcggaatagtcggagagatgggcgtattttaatgaatatttcgtatagatgcgcgaagatggttaatgttattatcgcgtt

SEQ ID NO: 38764 - DNA, 516 bp, Artificial Sequence
  chemically treated genomic DNA (Homo sapiens) CpG-island No: 38764
aacgcgataataacattaaccatcttcgcgcatctatacgaaatattcattaaaatacgcccatctctccgactattccgataattcttcaccgtacaatcaatatcgccgccatcgataattaataactactacttccaaccacgaaaaccgataccgaaccgctacatcccctacgccctccgcaaaaaataaaacgactaaaaaaacgactaattctacaccccccttaccgacgaaacgcgcctccgacttccgaaccaacccccgactcaaacctccaactaacgaacgccgataaatctaaaaaataactataacgccgtcctcgaccgcctaacgaacctacgatcccaaaaactcacaaaaaccataatatacgacgactacctccgtcgtcgaattacgccgctccaacgacgcgctcgaaacgcctaaaaatacaccgaatccgaaaacttcataaaaactcaccaaaaaataaaataaaactaaacccctaaaaacttcaaaata

SEQ ID NO: 38765 - DNA, 691 bp, Artificial Sequence
  chemically treated genomic DNA (Homo sapiens) CpG-island No: 38765
tcgttattttaagttcggtcggtttgaggtcgaggattcggcggtcgtagaggttcggaggcgggaatttgattagcgagaggtcgcggatcgtttacgggaagtcgaggaagttgtttaggaggtcgttcgggttttttaggtcgaggaaatcgttcgggagggagtcgttcgggttcgttaggtcgaggaagttgttcgggaggaggtcgttcgagtttattaggtcgaggaagtcgttcgggaggaggttgttcgagtttataaggtcgaggaagtcgttcgggaggaggttgttcgagtttataaggtcgaggaagtcgttcggtaggaagtcggatttcgttaggacgaggcgatggcgattttcgaggtagttcgcgacgaggtcgcgggcgcgtcgttcgggtttattttttcgtacgacgtttaggcgataattttcggggtagttggcgacgaggttgcgggcgcgtcgtttgggtttatttttttaggcgacgtttaggtttaattaggttcggaggatattttcgcgtttggtacgtttatcggtgggtcgagtcgcgtggtatttttttcgaggcggtttttttttacgttttttattgttttattgagcgtagagttttttttgtaagttttggtcgtcgtaaatattacggtgttggacgggttaagtgtttaggtg

SEQ ID NO: 38766 - DNA, 691 bp, Artificial Sequence
  chemically treated genomic DNA (Homo sapiens) CpG-island No: 38766
cacctaaacacttaacccgtccaacaccgtaatatttacgacgaccaaaacttacaaaaaaaactctacgctcaataaaacaataaaaaacgtaaaaaaaaaccgcctcgaaaaaaataccacgcgactcgacccaccgataaacgtaccaaacgcgaaaatatcctccgaacctaattaaacctaaacgtcgcctaaaaaaataaacccaaacgacgcgcccgcaacctcgtcgccaactaccccgaaaattatcgcctaaacgtcgtacgaaaaaataaacccgaacgacgcgcccgcgacctcgtcgcgaactacctcgaaaatcgccatcgcctcgtcctaacgaaatccgacttcctaccgaacgacttcctcgaccttataaactcgaacaacctcctcccgaacgacttcctcgaccttataaactcgaacaacctcctcccgaacgacttcctcgacctaataaactcgaacgacctcctcccgaacaacttcctcgacctaacgaacccgaacgactccctcccgaacgatttcctcgacctaaaaaacccgaacgacctcctaaacaacttcctcgacttcccgtaaacgatccgcgacctctcgctaatcaaattcccgcctccgaacctctacgaccgccgaatcctcgacctcaaaccgaccgaacttaaaataacga

SEQ ID NO: 38767 - DNA, 691 bp, Artificial Sequence
  chemically treated genomic DNA (Homo sapiens) CpG-island No: 38767
tatttgggtatttaattcgtttaatatcgtggtgtttgcggcggttaaggtttgtagaaggggttttgcgtttagtagggtagtagaaggcgtggggaaaagtcgtttcggagaagatgttacgcggttcggtttatcgatggacgtgttagacgcggggatgtttttcggatttggttgggtttgagcgtcgtttgagggagtgggtttaagcgacgcgttcgtagtttcgtcgttagttatttcggaagttgtcgtttgagcgtcgtgcgagggagtgggttcgagcgacgcgttcgcggtttcgtcgcgagttgtttcggaagtcgttatcgtttcgttttggcgaaattcggttttttatcgagcggttttttcggttttgtgggttcggatagttttttttcgagcggttttttcggttttgtgggttcggatagttttttttcgagcggttttttcggtttggtgggttcgggcggttttttttcgagtagttttttcggtttggcgggttcgggcggttttttttcgagcggttttttcggtttggagaattcggacggttttttgggtagttttttcggtttttcgtaggcgattcgcggtttttcgttggttagattttcgttttcgggtttttgcggtcgtcggattttcggttttagatcggtcggatttggaatggcgg

SEQ ID NO: 38768 - DNA, 691 bp, Artificial Sequence
  chemically treated genomic DNA (Homo sapiens) CpG-island No: 38768
ccgccattccaaatccgaccgatctaaaaccgaaaatccgacgaccgcaaaaacccgaaaacgaaaatctaaccaacgaaaaaccgcgaatcgcctacgaaaaaccgaaaaaactacccaaaaaaccgtccgaattctccaaaccgaaaaaaccgctcgaaaaaaaaccgcccgaacccgccaaaccgaaaaaactactcgaaaaaaaaccgcccgaacccaccaaaccgaaaaaaccgctcgaaaaaaaactatccgaacccacaaaaccgaaaaaaccgctcgaaaaaaaactatccgaacccacaaaaccgaaaaaaccgctcgataaaaaaccgaatttcgccaaaacgaaacgataacgacttccgaaacaactcgcgacgaaaccgcgaacgcgtcgctcgaacccactccctcgcacgacgctcaaacgacaacttccgaaataactaacgacgaaactacgaacgcgtcgcttaaacccactccctcaaacgacgctcaaacccaaccaaatccgaaaaacatccccgcgtctaacacgtccatcgataaaccgaaccgcgtaacatcttctccgaaacgacttttccccacgccttctactaccctactaaacgcaaaaccccttctacaaaccttaaccgccgcaaacaccacgatattaaacgaattaaatacccaaata

SEQ ID NO: 38769 - DNA, 1113 bp, Artificial Sequence
  chemically treated genomic DNA (Homo sapiens) CpG-island No: 38769
ggcggagttcgacgtcgcgtgggcgcgtgtcgaagaggggcgacgttcggtggaggttatggtggaggtgggtcgtaaggtttatcgtcggtacgtttcggagtttgaaattcgtaagaaggtgttggcggagatcgttaaggaagtggaagaggagcggggggttgtttttattgttattatcgtgatgaacgaggcgtaggatatttttcgtttttaatacgggagttgggaggcggagttaaggaagaagttcgacgtcgtttagggagtgtttgacgttgtcgttgttcgagaatagcgggcggcggagatcgaagcggcgtttcggtagttgaagaggtttttgaggcgcgcgttatggtattggaagagcgcgtttgcgtcgtggagagggatttggcggatcgcgaggtcgtcgttattattcgggaagtaacgttggcggcgtacgaggttgtttgcgtcgaagaagagttcgcgttttcgttttcgcgaggacgcgtttatcgagcgggagcgagttttcgagggggtcgagtcgcggtttaatagttggcggatagtttgttttttcgcgaggtagcgtaggaggagtaagcgcgtcgtaatttggaaggtgttcgcgtcgagagggtcgtattgaattaacgggtcgttgagttcgaggcgcgggcgaaggagttggacgcgagggtgcgtagcggcggggcggtcgcgggcgaaagcgatttagtcgttcgtttcgtagttgtcgaatatattatcgtcgatttgtagggcgcgttggattcgttcgtcggggaggtcgaagtttttcgtttggtaggcgaggttgggttcggtatgttttgggacgtcgtttttcgtttagattgcgtcggtcggtaagtgggtttttggagagggcggatcgtaaagtacgtcgttaattagggaggtttcgtttagcgtttttcgaagatggtcggggttttttaacggtttttcgaggagttcgagaagataattaagttattttcgagggatttcgtttaaggagcggtggagttcgttttggcgagttattaggttagggattttaatttttttttatggatggcgttggaagag

SEQ ID NO: 38770 - DNA, 1113 bp, Artificial Sequence
  chemically treated genomic DNA (Homo sapiens) CpG-island No: 38770
ctcttccaacgccatccataaaaaaaaattaaaatccctaacctaataactcgccaaaacgaactccaccgctccttaaacgaaatccctcgaaaataacttaattatcttctcgaactcctcgaaaaaccgttaaaaaaccccgaccatcttcgaaaaacgctaaacgaaacctccctaattaacgacgtactttacgatccgccctctccaaaaacccacttaccgaccgacgcaatctaaacgaaaaacgacgtcccaaaacataccgaacccaacctcgcctaccaaacgaaaaacttcgacctccccgacgaacgaatccaacgcgccctacaaatcgacgataatatattcgacaactacgaaacgaacgactaaatcgctttcgcccgcgaccgccccgccgctacgcaccctcgcgtccaactccttcgcccgcgcctcgaactcaacgacccgttaattcaatacgaccctctcgacgcgaacaccttccaaattacgacgcgcttactcctcctacgctacctcgcgaaaaaacaaactatccgccaactattaaaccgcgactcgaccccctcgaaaactcgctcccgctcgataaacgcgtcctcgcgaaaacgaaaacgcgaactcttcttcgacgcaaacaacctcgtacgccgccaacgttacttcccgaataataacgacgacctcgcgatccgccaaatccctctccacgacgcaaacgcgctcttccaataccataacgcgcgcctcaaaaacctcttcaactaccgaaacgccgcttcgatctccgccgcccgctattctcgaacaacgacaacgtcaaacactccctaaacgacgtcgaacttcttccttaactccgcctcccaactcccgtattaaaaacgaaaaatatcctacgcctcgttcatcacgataataacaataaaaacaaccccccgctcctcttccacttccttaacgatctccgccaacaccttcttacgaatttcaaactccgaaacgtaccgacgataaaccttacgacccacctccaccataacctccaccgaacgtcgcccctcttcgacacgcgcccacgcgacgtcgaactccgcc

SEQ ID NO: 38771 - DNA, 1113 bp, Artificial Sequence
  chemically treated genomic DNA (Homo sapiens) CpG-island No: 38771
tttttttagcgttatttatggagagaaattggggtttttggtttggtaattcgttaggacgagttttatcgttttttgggcgaggtttttcgaggatgatttaattgttttttcgagtttttcggggagtcgttggagagtttcggttattttcgagaggcgttgggcgagatttttttggttggcggcgtattttacggttcgttttttttagaggtttatttgtcgatcggcgtaatttaggcgggagacggcgttttaaagtatgtcgggtttaatttcgtttgttaagcggagggtttcgattttttcggcggacgagtttagcgcgttttgtagatcggcgatggtgtgttcggtagttgcgaggcgggcggttaggtcgttttcgttcgcggtcgtttcgtcgttgcgtattttcgcgtttagttttttcgttcgcgtttcgagtttagcggttcgttggtttagtgcggttttttcgacgcgggtattttttagattacggcgcgtttgttttttttgcgttgtttcgcggagggataggttgttcgttagttgttgggtcgcggttcggttttttcgagagttcgttttcgttcggtgagcgcgttttcgcggaggcgggagcgcgagttttttttcggcgtaggtagtttcgtgcgtcgttagcgttgtttttcggatggtgacggcggtttcgcggttcgttagatttttttttacgacgtaggcgcgtttttttagtgttatggcgcgcgttttaagggtttttttagttgtcgggacgtcgtttcggttttcgtcgttcgttgttttcgggtagcggtagcgttaagtattttttgggcggcgtcgagttttttttttagtttcgttttttagttttcgtattgaaggcggagggtgttttacgtttcgtttattacggtggtggtaatgagggtagtttttcgttttttttttatttttttggcgattttcgttagtatttttttacgggttttaagtttcgagacgtgtcggcggtgagttttacggtttatttttattatggtttttatcgagcgtcgttttttttcgatacgcgtttacgcggcgtcgagtttcgtt

SEQ ID NO: 38772 - DNA, 1113 bp, Artificial Sequence
  chemically treated genomic DNA (Homo sapiens) CpG-island No: 38772
aacgaaactcgacgccgcgtaaacgcgtatcgaaaaaaaacgacgctcgataaaaaccataataaaaataaaccgtaaaactcaccgccgacacgtctcgaaacttaaaacccgtaaaaaaatactaacgaaaatcgccaaaaaaataaaaaaaaaacgaaaaactaccctcattaccaccaccgtaataaacgaaacgtaaaacaccctccgccttcaatacgaaaactaaaaaacgaaactaaaaaaaaaactcgacgccgcccaaaaaatacttaacgctaccgctacccgaaaacaacgaacgacgaaaaccgaaacgacgtcccgacaactaaaaaaacccttaaaacgcgcgccataacactaaaaaaacgcgcctacgtcgtaaaaaaaaatctaacgaaccgcgaaaccgccgtcaccatccgaaaaacaacgctaacgacgcacgaaactacctacgccgaaaaaaaactcgcgctcccgcctccgcgaaaacgcgctcaccgaacgaaaacgaactctcgaaaaaaccgaaccgcgacccaacaactaacgaacaacctatccctccgcgaaacaacgcaaaaaaaacaaacgcgccgtaatctaaaaaatacccgcgtcgaaaaaaccgcactaaaccaacgaaccgctaaactcgaaacgcgaacgaaaaaactaaacgcgaaaatacgcaacgacgaaacgaccgcgaacgaaaacgacctaaccgcccgcctcgcaactaccgaacacaccatcgccgatctacaaaacgcgctaaactcgtccgccgaaaaaatcgaaaccctccgcttaacaaacgaaattaaacccgacatactttaaaacgccgtctcccgcctaaattacgccgatcgacaaataaacctctaaaaaaaacgaaccgtaaaatacgccgccaaccaaaaaaatctcgcccaacgcctctcgaaaataaccgaaactctccaacgactccccgaaaaactcgaaaaaacaattaaatcatcctcgaaaaacctcgcccaaaaaacgataaaactcgtcctaacgaattaccaaaccaaaaaccccaatttctctccataaataacgctaaaaaaa

SEQ ID NO: 38773 - DNA, 589 bp, Artificial Sequence
  chemically treated genomic DNA (Homo sapiens) CpG-island No: 38773
cgacgaaggtgttcgatgttttacgggttaggtagttttgtgtcgtcgttcgtggttagtcgaacggagttcggttgggggacgttgattattcgatacggatttttttatattggtgagagtttgtttagtttagtacgcgtttggacgcggcgtaggacgaggtcgtcgacgtagagtgatcgggttcggacgtggcgttgatggtagcgtcgtaggttttgttggtagcgcgcggttcggagggtcgcgcgtcgcgttcgtttttttaagtagtcgaggtcgtttttgcgaagttgattttgattagtttcgtaatatatggtggttcgaggggattttagggtgagtttagatgggaggatcgttttcgcgtcgtagacgaagaagaaaggcgttttttcggttgttcggtttggcgtggttcggttcgtttagagtatcgttggtagtttttcgatttacgagtcgtcgtgttttttgaggatgttgaaggttttggttttgaggtttttgaggatttttgcgttggcgcgttttatttggttattgtttttggggtgggcgggggaggcgaagtagagtttga

SEQ ID NO: 38774 - DNA, 589 bp, Artificial Sequence
  chemically treated genomic DNA (Homo sapiens) CpG-island No: 38774
tcaaactctacttcgcctcccccgcccaccccaaaaacaataaccaaataaaacgcgccaacgcaaaaatcctcaaaaacctcaaaaccaaaaccttcaacatcctcaaaaaacacgacgactcgtaaatcgaaaaactaccaacgatactctaaacgaaccgaaccacgccaaaccgaacaaccgaaaaaacgcctttcttcttcgtctacgacgcgaaaacgatcctcccatctaaactcaccctaaaatcccctcgaaccaccatatattacgaaactaatcaaaatcaacttcgcaaaaacgacctcgactacttaaaaaaacgaacgcgacgcgcgaccctccgaaccgcgcgctaccaacaaaacctacgacgctaccatcaacgccacgtccgaacccgatcactctacgtcgacgacctcgtcctacgccgcgtccaaacgcgtactaaactaaacaaactctcaccaatataaaaaaatccgtatcgaataatcaacgtcccccaaccgaactccgttcgactaaccacgaacgacgacacaaaactacctaacccgtaaaacatcgaacaccttcgtcg

SEQ ID NO: 38775 - DNA, 589 bp, Artificial Sequence
  chemically treated genomic DNA (Homo sapiens) CpG-island No: 38775
ttaagttttgtttcgtttttttcgtttattttagaagtaatggttaagtggagcgcgttaacgtagaaatttttaagggttttaaaattaagatttttaatatttttaagaagtacggcgattcgtggatcgagaagttgttagcggtgttttgggcgaatcggattacgttaagtcgagtaatcggggaaacgtttttttttttcgtttacggcgcggaggcggtttttttatttgagtttattttggggttttttcgggttattatgtattgcgagattgattaagattagtttcgtagagacgatttcgattatttggaagagcgaacgcggcgcgcggtttttcgagtcgcgcgttattagtagagtttgcggcgttattattagcgttacgttcgggttcgattattttacgtcgacgatttcgttttacgtcgcgtttaaacgcgtgttggattgagtaagtttttattaatgtgggagggttcgtatcgagtgattagcgttttttagtcgggtttcgttcggttggttacgggcgacggtatagagttgtttaattcgtggaatatcgaatattttcgtcg

SEQ ID NO: 38776 - DNA, 589 bp, Artificial Sequence
  chemically treated genomic DNA (Homo sapiens) CpG-island No: 38776
cgacgaaaatattcgatattccacgaattaaacaactctataccgtcgcccgtaaccaaccgaacgaaacccgactaaaaaacgctaatcactcgatacgaaccctcccacattaataaaaacttactcaatccaacacgcgtttaaacgcgacgtaaaacgaaatcgtcgacgtaaaataatcgaacccgaacgtaacgctaataataacgccgcaaactctactaataacgcgcgactcgaaaaaccgcgcgccgcgttcgctcttccaaataatcgaaatcgtctctacgaaactaatcttaatcaatctcgcaatacataataacccgaaaaaaccccaaaataaactcaaataaaaaaaccgcctccgcgccgtaaacgaaaaaaaaaaacgtttccccgattactcgacttaacgtaatccgattcgcccaaaacaccgctaacaacttctcgatccacgaatcgccgtacttcttaaaaatattaaaaatcttaattttaaaacccttaaaaatttctacgttaacgcgctccacttaaccattacttctaaaataaacgaaaaaaacgaaacaaaacttaa

SEQ ID NO: 38777 - DNA, 678 bp, Artificial Sequence
  chemically treated genomic DNA (Homo sapiens) CpG-island No: 38777
atcgtcggattaggttaatcgtatcgttgagagtcgttggttaatagaaattttggcgaaaggttttgttaattaaggtgcgtgaggcggagtgggtttcgtatttttttttatggatatcggtaagaagttcgacgttttgttttcgaggaatgtattttaggaggatttcgttagtcgcgcgtcgatagagggttttttttattagtacgtagcgtttggagatgcgttggacgcgtttatttttttcgcggttttcgggtagagttttatttgcgaggtacgtttggattttagcgatttaagtaattaatttaagggagttgggagcgtttttttcgggtttcgaggtttggatttcgacgggtttcgggggtcgtttaggcgcgttcgttttttttagggggtcgggtcgcgtcgacggttgggtaagtttttttttaaaggcgttcggtggggtttgggttcgcgaggaagcgagttttgagagttcgtcggcgatcgcgttatttcgtttgggtacgtgtcgaagttttatttcgtcgaaatgacgttttatacgtcgtatttggcgtacgtaagcgtttatttgcgggttagagtatttgtattttttatagatttggttaacgattagttgggagtcgtttaatattaggaggcggcggatttttagtt

SEQ ID NO: 38778 - DNA, 678 bp, Artificial Sequence
  chemically treated genomic DNA (Homo sapiens) CpG-island No: 38778
aactaaaaatccgccgcctcctaatattaaacgactcccaactaatcgttaaccaaatctataaaaaatacaaatactctaacccgcaaataaacgcttacgtacgccaaatacgacgtataaaacgtcatttcgacgaaataaaacttcgacacgtacccaaacgaaataacgcgatcgccgacgaactctcaaaactcgcttcctcgcgaacccaaaccccaccgaacgcctttaaaaaaaaacttacccaaccgtcgacgcgacccgaccccctaaaaaaaacgaacgcgcctaaacgacccccgaaacccgtcgaaatccaaacctcgaaacccgaaaaaaacgctcccaactcccttaaattaattacttaaatcgctaaaatccaaacgtacctcgcaaataaaactctacccgaaaaccgcgaaaaaaataaacgcgtccaacgcatctccaaacgctacgtactaataaaaaaaaccctctatcgacgcgcgactaacgaaatcctcctaaaatacattcctcgaaaacaaaacgtcgaacttcttaccgatatccataaaaaaaaatacgaaacccactccgcctcacgcaccttaattaacaaaacctttcgccaaaatttctattaaccaacgactctcaacgatacgattaacctaatccgacgat

SEQ ID NO: 38779 - DNA, 678 bp, Artificial Sequence
  chemically treated genomic DNA (Homo sapiens) CpG-island No: 38779
gattggggattcgtcgttttttggtgttaggcgatttttagttggtcgttaattaggtttgtaaggagtataggtgttttgattcgtagatggacgtttacgtgcgttaagtgcggcgtatggagcgttatttcgacgggatagagtttcggtacgtgtttagacgggataacgcggtcgtcgacgagtttttaaggttcgttttttcgcgagtttagattttatcgggcgtttttgaagaaaggtttgtttagtcgtcggcgcgattcgattttttaggggagacggacgcgtttgaacggttttcgaggttcgtcggagtttaggtttcgggattcgaggggagcgtttttagtttttttagattgattgtttggatcgttgagatttaggcgtatttcgtagataagattttattcgaggatcgcgaagggagtgaacgcgtttagcgtatttttaagcgttacgtgttagtggaagggattttttatcggcgcgcggttaacggagtttttttgaagtgtatttttcgggaataaggcgtcgagttttttgtcgatatttatgaaggagagtgcggagtttatttcgttttacgtattttggttggtaaggtttttcgttagggtttttattggttaacggtttttaacgatgcggttgatttggttcggcggt

SEQ ID NO: 38780 - DNA, 678 bp, Artificial Sequence
  chemically treated genomic DNA (Homo sapiens) CpG-island No: 38780
accgccgaaccaaatcaaccgcatcgttaaaaaccgttaaccaataaaaaccctaacgaaaaaccttaccaaccaaaatacgtaaaacgaaataaactccgcactctccttcataaatatcgacaaaaaactcgacgccttattcccgaaaaatacacttcaaaaaaactccgttaaccgcgcgccgataaaaaatcccttccactaacacgtaacgcttaaaaatacgctaaacgcgttcactcccttcgcgatcctcgaataaaatcttatctacgaaatacgcctaaatctcaacgatccaaacaatcaatctaaaaaaactaaaaacgctcccctcgaatcccgaaacctaaactccgacgaacctcgaaaaccgttcaaacgcgtccgtctcccctaaaaaatcgaatcgcgccgacgactaaacaaacctttcttcaaaaacgcccgataaaatctaaactcgcgaaaaaacgaaccttaaaaactcgtcgacgaccgcgttatcccgtctaaacacgtaccgaaactctatcccgtcgaaataacgctccatacgccgcacttaacgcacgtaaacgtccatctacgaatcaaaacacctatactccttacaaacctaattaacgaccaactaaaaatcgcctaacaccaaaaaacgacgaatccccaatc

SEQ ID NO: 38781 - DNA, 565 bp, Artificial Sequence
  chemically treated genomic DNA (Homo sapiens) CpG-island No: 38781
attcgatgcgtttggaaataatggcgtaattttttcgaggttattagaatagcgtaaagtattttttgggtttgagggtatcgggttttggcgtttcggagggtttcgttaacgaagtagacgggtcgttgtatttttcggcggggtcgatttttttcgttaggggtcgtatttttagggcgtttttcgttcgagaggttgcgcggggtgtattcggtttttgtgttatcgatttcggggttcgagggcgataaacgcggttttttcgtagtggtttcggggttattttgggggtcgggggcgtttggtatcgtcggataagcgggcggagggttattttcggtcgtcgggggttttggatcgtcgttcggttcgggggttttttttttttgttttttttcgggtcgagtcggtatagggtggggacgcgtggagtgggggttgttttcgtcgcgttttacgattaacgtcgcgttgattatttgcggggttgttattaggtagagtagtaacggtttatttggtttcggggcgattatgattgggggagaattgaggtatgttt

SEQ ID NO: 38782 - DNA, 565 bp, Artificial Sequence
  chemically treated genomic DNA (Homo sapiens) CpG-island No: 38782
aaacatacctcaattctcccccaatcataatcgccccgaaaccaaataaaccgttactactctacctaataacaaccccgcaaataatcaacgcgacgttaatcgtaaaacgcgacgaaaacaacccccactccacgcgtccccaccctataccgactcgacccgaaaaaaaacaaaaaaaaaaaacccccgaaccgaacgacgatccaaaacccccgacgaccgaaaataaccctccgcccgcttatccgacgataccaaacgcccccgacccccaaaataaccccgaaaccactacgaaaaaaccgcgtttatcgccctcgaaccccgaaatcgataacacaaaaaccgaatacaccccgcgcaacctctcgaacgaaaaacgccctaaaaatacgacccctaacgaaaaaaatcgaccccgccgaaaaatacaacgacccgtctacttcgttaacgaaaccctccgaaacgccaaaacccgataccctcaaacccaaaaaatactttacgctattctaataacctcgaaaaaattacgccattatttccaaacgcatcgaat

SEQ ID NO: 38783 - DNA, 565 bp, Artificial Sequence
  chemically treated genomic DNA (Homo sapiens) CpG-island No: 38783
aggtatattttagtttttttttagttatggtcgtttcggagttagatgagtcgttgttattttatttggtggtaatttcgtaggtggttagcgcggcgttggtcgtggagcgcgacgaggataatttttattttacgcgtttttattttgtgtcgattcgattcgggagagagtagggaggagaggttttcgagtcgaacggcggtttaaggttttcgacggtcggagatggtttttcgttcgtttgttcgacggtgttaggcgttttcgatttttaggatggtttcggggttattgcgggaaggtcgcgtttgtcgttttcggatttcgaggtcggtgatatagaagtcgagtgtatttcgcgtagtttttcggacgaagagcgttttggagatgcggtttttagcgaagaggatcggtttcgtcgaaaggtgtagcggttcgtttatttcgttagcgaggtttttcgggacgttaaaattcgatatttttaggtttagaagatgttttacgttattttgatggtttcgaggaagttgcgttattatttttaggcgtatcgggt

SEQ ID NO: 38784 - DNA, 565 bp, Artificial Sequence
  chemically treated genomic DNA (Homo sapiens) CpG-island No: 38784
acccgatacgcctaaaaataataacgcaacttcctcgaaaccatcaaaataacgtaaaacatcttctaaacctaaaaatatcgaattttaacgtcccgaaaaacctcgctaacgaaataaacgaaccgctacacctttcgacgaaaccgatcctcttcgctaaaaaccgcatctccaaaacgctcttcgtccgaaaaactacgcgaaatacactcgacttctatatcaccgacctcgaaatccgaaaacgacaaacgcgaccttcccgcaataaccccgaaaccatcctaaaaatcgaaaacgcctaacaccgtcgaacaaacgaacgaaaaaccatctccgaccgtcgaaaaccttaaaccgccgttcgactcgaaaacctctcctccctactctctcccgaatcgaatcgacacaaaataaaaacgcgtaaaataaaaattatcctcgtcgcgctccacgaccaacgccgcgctaaccacctacgaaattaccaccaaataaaataacaacgactcatctaactccgaaacgaccataactaaaaaaaaactaaaatatacct

SEQ ID NO: 38785 - DNA, 908 bp, Artificial Sequence
  chemically treated genomic DNA (Homo sapiens) CpG-island No: 38785
ttatgcgtggtagggggtaagggtttttaggatatgttttgttaaggtcggtgtagtcgatgtatattcgaagtttgtcgttcgttttgggaacgatgatcgggttcgttagttatttcggatggatgattttacggatgaatttagtttttagaagtcgcgttattttttcgcggatgaaggtttgacgtttcggggtttgtcgtcgtattttttgtcggatcggttttgcgttcggtcgtacggcgagacggtgtttaattatttttttggggatttcgggtatgttcgtcggtttttaggcgaagacgtcggtttttgttcgtaggaaggagacgagcgcgtttttttatttgtcgtttagaagattatcgattcgtgtggttttggacgggtcgtcgtttagggtaatttttttgatcgggatttcgtcgtaagtgattattcgttgtttcggggcggttgggacgggggggttgagtttttcgtcgttattcgcggttttggacgtcgcggcgaggtggttcgcgcgttgttttatataagtaagtgcgattttaaggtcgttatggacggtgatgtggttatcggggttcggtatttttatttggagataggcgtagtggatcgtcgttatgaattttattaacgcgggtttttttaggatcgcgttgtagggtagattgaggttcgttatatcgaagtttattagtttcgtgcggaagttggcggaattatcgaaggtgatcgggaggtcgatatgatttagcggttaagtgtgttttagcgttatatcgatgatcggttgggacggtcggagtattattttcggggttttgatggcgttaaaggttgcgggggaaaggatgttgagggttgtattttcgtttatgaggatacgttttaat

SEQ ID NO: 38786 - DNA, 908 bp, Artificial Sequence
  chemically treated genomic DNA (Homo sapiens) CpG-island No: 38786
attaaaacgtatcctcataaacgaaaatacaaccctcaacatcctttcccccgcaacctttaacgccatcaaaaccccgaaaataatactccgaccgtcccaaccgatcatcgatataacgctaaaacacacttaaccgctaaatcatatcgacctcccgatcaccttcgataattccgccaacttccgcacgaaactaataaacttcgatataacgaacctcaatctaccctacaacgcgatcctaaaaaaacccgcgttaataaaattcataacgacgatccactacgcctatctccaaataaaaataccgaaccccgataaccacatcaccgtccataacgaccttaaaatcgcacttacttatataaaacaacgcgcgaaccacctcgccgcgacgtccaaaaccgcgaataacgacgaaaaactcaacccccccgtcccaaccgccccgaaacaacgaataatcacttacgacgaaatcccgatcaaaaaaattaccctaaacgacgacccgtccaaaaccacacgaatcgataatcttctaaacgacaaataaaaaaacgcgctcgtctccttcctacgaacaaaaaccgacgtcttcgcctaaaaaccgacgaacatacccgaaatccccaaaaaaataattaaacaccgtctcgccgtacgaccgaacgcaaaaccgatccgacaaaaaatacgacgacaaaccccgaaacgtcaaaccttcatccgcgaaaaaataacgcgacttctaaaaactaaattcatccgtaaaatcatccatccgaaataactaacgaacccgatcatcgttcccaaaacgaacgacaaacttcgaatatacatcgactacaccgaccttaacaaaacatatcctaaaaacccttaccccctaccacgcataa

SEQ ID NO: 38787 - DNA, 908 bp, Artificial Sequence
  chemically treated genomic DNA (Homo sapiens) CpG-island No: 38787
gttggggcgtgtttttatagacgggggtgtagtttttaatattttttttttcgtagtttttgacgttattaaggtttcggggatggtgtttcggtcgttttagtcgattatcggtgtgacgttggggtatatttggtcgttaggttatatcgatttttcggttattttcggtggtttcgttaattttcgtacggagttggtgaatttcgatgtggcgggttttagtttgttttataacgcggttttggggaggttcgcgttggtgaagtttatggcggcggtttattacgtttatttttagatgaagatgtcgggtttcggtggttatattatcgtttatggcgattttaaagtcgtatttgtttgtatggagtagcgcgcggattatttcgtcgcggcgtttaaggtcgcgggtggcgacgagaggtttagttttttcgttttagtcgtttcgaggtagcggatgattatttgcgacgaggtttcggttaaggaggttgttttgggcgacggttcgtttaagattatacgaatcggtggttttttggacgataaataggaagacgcgttcgttttttttttgcgggtaaaagtcgacgttttcgtttggagatcggcggatatgttcggggtttttagggagatgattgagtatcgtttcgtcgtgcggtcgggcgtaaggtcggttcggtagaaagtgcggcggtaagtttcggaacgttaagtttttattcgcgaggaggtggcgcgatttttggaggttggatttattcgtgaggttatttattcggagtggttggcgaattcggttatcgtttttaaggcgaacggtaagtttcggatgtgtatcgattatatcgattttaataaggtatgttttaaggatttttattttttgttacgtatag

SEQ ID NO: 38788 - DNA, 908 bp, Artificial Sequence
  chemically treated genomic DNA (Homo sapiens) CpG-island No: 38788
ctatacgtaacaaaaaataaaaatccttaaaacataccttattaaaatcgatataatcgatacacatccgaaacttaccgttcgccttaaaaacgataaccgaattcgccaaccactccgaataaataacctcacgaataaatccaacctccaaaaatcgcgccacctcctcgcgaataaaaacttaacgttccgaaacttaccgccgcactttctaccgaaccgaccttacgcccgaccgcacgacgaaacgatactcaatcatctccctaaaaaccccgaacatatccgccgatctccaaacgaaaacgtcgacttttacccgcaaaaaaaaaacgaacgcgtcttcctatttatcgtccaaaaaaccaccgattcgtataatcttaaacgaaccgtcgcccaaaacaacctccttaaccgaaacctcgtcgcaaataatcatccgctacctcgaaacgactaaaacgaaaaaactaaacctctcgtcgccacccgcgaccttaaacgccgcgacgaaataatccgcgcgctactccatacaaacaaatacgactttaaaatcgccataaacgataatataaccaccgaaacccgacatcttcatctaaaaataaacgtaataaaccgccgccataaacttcaccaacgcgaacctccccaaaaccgcgttataaaacaaactaaaacccgccacatcgaaattcaccaactccgtacgaaaattaacgaaaccaccgaaaataaccgaaaaatcgatataacctaacgaccaaatataccccaacgtcacaccgataatcgactaaaacgaccgaaacaccatccccgaaaccttaataacgtcaaaaactacgaaaaaaaaaatattaaaaactacacccccgtctataaaaacacgccccaac

SEQ ID NO: 38789 - DNA, 637 bp, Artificial Sequence
  chemically treated genomic DNA (Homo sapiens) CpG-island No: 38789
ttattatcgcgatttgtttttttcgggtaacgtacggcgggtggtcggtttggtcgaaggtgagggtaattttcgattatcgcgttcgtcgcgtcgttttatgggtaggggttacggttagaagttttcgttttatggttttgaggtttcggcgagaaacgtgagcgtacgtttttttatcgatagtggcgacggtggtttcgggtttttggaattttaggttatcgtcgttatcgtcgacgttttcggcggtggttttttgtttggttttatttcgtcggttgtcggcgggagtcgtcggggttttgtttttacggcgtttttgtttttttttttttttttattttttcgttcgtttagttaaatttttgatcgcgcggtagttcgcgaggtcgtggagggaggtgttgtgtacggaatattatttgtcggtcgggcgttttttgttgggagcgcgggtttttttttttttgtcgttcgtaggttttttttttcgggtggttcgtgaagcgttttcgacggggaggacgtgattttcgtcgtcggaatgggtcgattttttttttttttttttgtttcgtcgttttgatcgagcggcggattcgggggcggtcgaagttgttatatcggaatcgga

SEQ ID NO: 38790 - DNA, 637 bp, Artificial Sequence
  chemically treated genomic DNA (Homo sapiens) CpG-island No: 38790
tccgattccgatataacaacttcgaccgcccccgaatccgccgctcgatcaaaacgacgaaacaaaaaaaaaaaaaaaaaatcgacccattccgacgacgaaaatcacgtcctccccgtcgaaaacgcttcacgaaccacccgaaaaaaaaaacctacgaacgacaaaaaaaaaaaaacccgcgctcccaacaaaaaacgcccgaccgacaaataatattccgtacacaacacctccctccacgacctcgcgaactaccgcgcgatcaaaaatttaactaaacgaacgaaaaaataaaaaaaaaaaaaaaaacaaaaacgccgtaaaaacaaaaccccgacgactcccgccgacaaccgacgaaataaaaccaaacaaaaaaccaccgccgaaaacgtcgacgataacgacgataacctaaaattccaaaaacccgaaaccaccgtcgccactatcgataaaaaaacgtacgctcacgtttctcgccgaaacctcaaaaccataaaacgaaaacttctaaccgtaacccctacccataaaacgacgcgacgaacgcgataatcgaaaattaccctcaccttcgaccaaaccgaccacccgccgtacgttacccgaaaaaaacaaatcgcgataataa

SEQ ID NO: 38791 - DNA, 637 bp, Artificial Sequence
  chemically treated genomic DNA (Homo sapiens) CpG-island No: 38791
ttcggtttcggtgtggtagtttcggtcgttttcgggttcgtcgttcggttagggcggcgggataggaggaggaagaagaggtcggtttatttcgacgacgagggttacgtttttttcgtcgagggcgttttacgggttattcgaaaggggaggtttgcgagcgataaaaagaaggaggttcgcgtttttagtagggagcgttcggtcggtaagtggtgtttcgtgtataatatttttttttacgatttcgcggattgtcgcgcggttaaaagtttggttgagcggacgaggaagtgggaggaggagaggaggtaggagcgtcgtgagggtaaggtttcggcggttttcgtcggtaatcggcgaggtgaggttaagtagaaggttatcgtcgaggacgtcgacgatggcgacgatgatttggggttttaggagttcggggttatcgtcgttattgtcgatgggggagcgtgcgtttacgtttttcgtcggagttttaaggttatgaagcgagagtttttggtcgtggtttttatttatgaggcgacgcggcgggcgcggtggtcggaggttgtttttattttcgattagatcgattattcgtcgtgcgttgttcggggaggatagatcgcgatggtgg

SEQ ID NO: 38792 - DNA, 637 bp, Artificial Sequence
  chemically treated genomic DNA (Homo sapiens) CpG-island No: 38792
ccaccatcgcgatctatcctccccgaacaacgcacgacgaataatcgatctaatcgaaaataaaaacaacctccgaccaccgcgcccgccgcgtcgcctcataaataaaaaccacgaccaaaaactctcgcttcataaccttaaaactccgacgaaaaacgtaaacgcacgctcccccatcgacaataacgacgataaccccgaactcctaaaaccccaaatcatcgtcgccatcgtcgacgtcctcgacgataaccttctacttaacctcacctcgccgattaccgacgaaaaccgccgaaaccttaccctcacgacgctcctacctcctctcctcctcccacttcctcgtccgctcaaccaaacttttaaccgcgcgacaatccgcgaaatcgtaaaaaaaaatattatacacgaaacaccacttaccgaccgaacgctccctactaaaaacgcgaacctccttctttttatcgctcgcaaacctcccctttcgaataacccgtaaaacgccctcgacgaaaaaaacgtaaccctcgtcgtcgaaataaaccgacctcttcttcctcctcctatcccgccgccctaaccgaacgacgaacccgaaaacgaccgaaactaccacaccgaaaccgaa

SEQ ID NO: 38793 - DNA, 1034 bp, Artificial Sequence
  chemically treated genomic DNA (Homo sapiens) CpG-island No: 38793
gtttacgtggtagttttacggtttacggtggatcgggtgtacgcgggtttatatcggtcggtgtcgtgggttttacgcgttagtcgtattcgaggacgcgggcggttgacggtcgggttttacgcggtagtcgttcggtgcgttcgaaggcggttacggcggtacggtcggcgggaggcggtgcgttcgtatttttatggtcgtcggcggcggttataggtacggcggagcggcggttaagagaagggagggaaagggggaaacgaaatgggtggtttacggtttattttaggtcgacggcgacgacgaaaacggcggtcggagcggaggaaggcggcggcgcggttcgggtcgacggggacggcggcgtttcggcgatcgacgagcgaaacggagtggtggacgaggtcggcgaggatgcggcgaagtcgaagtaggcggcgtcgaggtgggaggtggttcggggcgacgacgacggcggattagagttcggcggcgacggcggagagagagagcgacggcgcgagttcgatttcggcgaggaggaagggcggcgagaggcggaaacggacggaggaggtgcggggagggtttatatagggttggaagggggagagagcggtcggcggggaaggaataggtacgggaggttcggtcgttataatggcgtcggcgagatttgcggggtaaatttattcgtttgaacgcgagggagagagggaaaaatggggggaaagggagagggaattacggggaataatttttttttattgattgtacgcggggaggacggggacggtgggattcgcggcggcggcggcgttagggtacgggcgaggcggcgggtgcggcgcgaggtaggggatgacgggtgggttttattcgttagcgagggtggcgggcgggttcgttcgttagcggcgcgcgcgtgggggaaggcggatgggttgcgggggagaggagagagagggagggagttgggtcgagtcggtttaagagggagagggagggaaaggggattttttagagttttt

SEQ ID NO: 38794 - DNA, 1034 bp, Artificial Sequence
  chemically treated genomic DNA (Homo sapiens) CpG-island No: 38794
aaaaactctaaaaaatcccctttccctccctctccctcttaaaccgactcgacccaactccctccctctctctcctctcccccgcaacccatccgccttcccccacgcgcgcgccgctaacgaacgaacccgcccgccaccctcgctaacgaataaaacccacccgtcatcccctacctcgcgccgcacccgccgcctcgcccgtaccctaacgccgccgccgccgcgaatcccaccgtccccgtcctccccgcgtacaatcaataaaaaaaaattattccccgtaattccctctccctttccccccatttttccctctctccctcgcgttcaaacgaataaatttaccccgcaaatctcgccgacgccattataacgaccgaacctcccgtacctattccttccccgccgaccgctctctcccccttccaaccctatataaaccctccccgcacctcctccgtccgtttccgcctctcgccgcccttcctcctcgccgaaatcgaactcgcgccgtcgctctctctctccgccgtcgccgccgaactctaatccgccgtcgtcgtcgccccgaaccacctcccacctcgacgccgcctacttcgacttcgccgcatcctcgccgacctcgtccaccactccgtttcgctcgtcgatcgccgaaacgccgccgtccccgtcgacccgaaccgcgccgccgccttcctccgctccgaccgccgttttcgtcgtcgccgtcgacctaaaataaaccgtaaaccacccatttcgtttccccctttccctcccttctcttaaccgccgctccgccgtacctataaccgccgccgacgaccataaaaatacgaacgcaccgcctcccgccgaccgtaccgccgtaaccgccttcgaacgcaccgaacgactaccgcgtaaaacccgaccgtcaaccgcccgcgtcctcgaatacgactaacgcgtaaaacccacgacaccgaccgatataaacccgcgtacacccgatccaccgtaaaccgtaaaactaccacgtaaac

SEQ ID NO: 38795 - DNA, 1034 bp, Artificial Sequence
  chemically treated genomic DNA (Homo sapiens) CpG-island No: 38795
aaaaattttaaaaagtttttttttttttttttttttttttgggtcggttcggtttagtttttttttttttttttttttttttcgtagtttattcgtttttttttacgcgcgcgtcgttgacgggcgggttcgttcgttattttcgttgacgggtggggtttattcgttattttttatttcgcgtcgtattcgtcgtttcgttcgtgttttagcgtcgtcgtcgtcgcgaattttatcgttttcgtttttttcgcgtgtaattaataggggagaattatttttcgtgattttttttttttttttttttatttttttttttttttttcgcgtttaaacgggtggatttgtttcgtaaatttcgtcggcgttattatggcggtcggatttttcgtgtttatttttttttcgtcggtcgtttttttttttttttaattttatataaatttttttcgtatttttttcgttcgttttcgtttttcgtcgtttttttttttcgtcggaatcgagttcgcgtcgtcgtttttttttttcgtcgtcgtcgtcgagttttggttcgtcgtcgtcgtcgtttcggattattttttatttcggcgtcgtttgtttcggtttcgtcgtattttcgtcgatttcgtttattatttcgtttcgttcgtcgatcgtcggagcgtcgtcgttttcgtcgattcgaatcgcgtcgtcgttttttttcgtttcggtcgtcgttttcgtcgtcgtcgtcgatttagggtgagtcgtggattatttatttcgtttttttttttttttttttttttttggtcgtcgtttcgtcgtgtttatggtcgtcgtcggcgattataggggtgcgggcgtatcgtttttcgtcggtcgtgtcgtcgtggtcgttttcgggcgtatcgagcggttgtcgcgtggggttcggtcgttagtcgttcgcgttttcgggtgcggttgacgcgtggggtttacggtatcggtcggtgtgagttcgcgtgtattcggtttatcgtggatcgtgaggttgttacgtgggt

SEQ ID NO: 38796 - DNA, 1034 bp, Artificial Sequence
  chemically treated genomic DNA (Homo sapiens) CpG-island No: 38796
acccacgtaacaacctcacgatccacgataaaccgaatacacgcgaactcacaccgaccgataccgtaaaccccacgcgtcaaccgcacccgaaaacgcgaacgactaacgaccgaaccccacgcgacaaccgctcgatacgcccgaaaacgaccacgacgacacgaccgacgaaaaacgatacgcccgcacccctataatcgccgacgacgaccataaacacgacgaaacgacgaccaaaaaaaaaaaaaaaaaaaaaaaaacgaaataaataatccacgactcaccctaaatcgacgacgacgacgaaaacgacgaccgaaacgaaaaaaaacgacgacgcgattcgaatcgacgaaaacgacgacgctccgacgatcgacgaacgaaacgaaataataaacgaaatcgacgaaaatacgacgaaaccgaaacaaacgacgccgaaataaaaaataatccgaaacgacgacgacgacgaaccaaaactcgacgacgacgacgaaaaaaaaaaacgacgacgcgaactcgattccgacgaaaaaaaaaaacgacgaaaaacgaaaacgaacgaaaaaaatacgaaaaaaatttatataaaattaaaaaaaaaaaaaaacgaccgacgaaaaaaaaataaacacgaaaaatccgaccgccataataacgccgacgaaatttacgaaacaaatccacccgtttaaacgcgaaaaaaaaaaaaaaaaataaaaaaaaaaaaaaaaaaaatcacgaaaaataattctcccctattaattacacgcgaaaaaaacgaaaacgataaaattcgcgacgacgacgacgctaaaacacgaacgaaacgacgaatacgacgcgaaataaaaaataacgaataaaccccacccgtcaacgaaaataacgaacgaacccgcccgtcaacgacgcgcgcgtaaaaaaaaacgaataaactacgaaaaaaaaaaaaaaaaaaaaaaaaactaaaccgaaccgacccaaaaaaaaaaaaaaaaaaaaaaaaactttttaaaattttt

SEQ ID NO: 38797 - DNA, 1485 bp, Artificial Sequence
  chemically treated genomic DNA (Homo sapiens) CpG-island No: 38797
cgagatcgtagacggtgagttaagatttagggttggtggtatcgttatatttttcgattttagtcggtttaaagtcggttagttaatttattcgacgtaggtcgtttgtgaaggtagtaattttatttatgtcgtcgtcgtagcgatttggtgaatgatggggagtatggttttttgtcgtacggcgttggttgatggtatcgcgaagatcgacggggcgtttgcgatgtggggagtgcggtcgtttaattcgacgttttttgtgtcgtttagtaggcgaacggatagattattcgtcgtgatttttgtttttgcgattggatttcgcgtcggcgacgttgaggtttggttggtgatagttttgagatcgaagaagaggaattcggttgttagtcggcgtgcgggtgttcgttgagttaatcgggatcgaggcggcgattatggttttcgtttggtttaagatgttgacgacgtgattagtttgattgagagcgttttttttgaggagggtgtcgaggagggtgatcgttgtaatcgcgttttgttggggggtgcggaaaatcgttgtttcgtcgacgttttgttgtttaatgaggttttttgttcgtcgttcggattttaaggcgcgttgtcgtcgatttttagttttttttgtagttttttcgcgattttgttgtttacgttgtagtcgttttcgtttttgtcgttgttattttttttttaggtggcgacgtttagttttttgtcgcgtcgtttttttttcgtttttcgggttcggcgttgttttgtcgtttcgttgtcggttatgaatacgtcgaaaaagaaaggcgtgtagttattttcgtagttgttgtcgaagtcgtcgaagttgttatagtcgtagcgatagtcgaagttgtcgtattcgaggattttcgttggtcgagaattgatgtcgggggatttgaggtgttatttaattttttcgtcgagattgtttcgagaggttggagtataacgtcgatttttttggagttagattggatcggggttaaagtcggatttcgtttaggttttcgggtgggagacgttttggtcgtgaagatagtagttaaattatcgggaagttttattaggatttaatattttggtttggtcgtgtcgatgtagattggatttcgtttaagtggtttggagtcgattcgatcgagatgagtttggggtagattttagtcgagttcggaatatcgaacggggtaaggatttggttttttttcgattggtttgaattcgagttaaggagagaaattttgtcgaagtcgttggtgatgaagtcgagattgtcgaatcggaacgtttgtttaggagggaaggtgaagtcgtcgatgtcggagacgaaatttatcgtattagtcggcgaaaaatttgacgttatttttgtttggtgcgttaattgtcgaaataagatttcggtaatattaaaagggggtggttattaagttagaa

SEQ ID NO: 38798 - DNA, 1485 bp, Artificial Sequence
  chemically treated genomic DNA (Homo sapiens) CpG-island No: 38798
ttctaacttaataaccacccccttttaatattaccgaaatcttatttcgacaattaacgcaccaaacaaaaataacgtcaaatttttcgccgactaatacgataaatttcgtctccgacatcgacgacttcaccttccctcctaaacaaacgttccgattcgacaatctcgacttcatcaccaacgacttcgacaaaatttctctccttaactcgaattcaaaccaatcgaaaaaaaaccaaatccttaccccgttcgatattccgaactcgactaaaatctaccccaaactcatctcgatcgaatcgactccaaaccacttaaacgaaatccaatctacatcgacacgaccaaaccaaaatattaaatcctaataaaacttcccgataatttaactactatcttcacgaccaaaacgtctcccacccgaaaacctaaacgaaatccgactttaaccccgatccaatctaactccaaaaaaatcgacgttatactccaacctctcgaaacaatctcgacgaaaaaattaaataacacctcaaatcccccgacatcaattctcgaccaacgaaaatcctcgaatacgacaacttcgactatcgctacgactataacaacttcgacgacttcgacaacaactacgaaaataactacacgcctttctttttcgacgtattcataaccgacaacgaaacgacaaaacaacgccgaacccgaaaaacgaaaaaaaaacgacgcgacaaaaaactaaacgtcgccacctaaaaaaaaaataacaacgacaaaaacgaaaacgactacaacgtaaacaacaaaatcgcgaaaaaactacaaaaaaaactaaaaatcgacgacaacgcgccttaaaatccgaacgacgaacaaaaaacctcattaaacaacaaaacgtcgacgaaacaacgattttccgcaccccccaacaaaacgcgattacaacgatcaccctcctcgacaccctcctcaaaaaaaacgctctcaatcaaactaatcacgtcgtcaacatcttaaaccaaacgaaaaccataatcgccgcctcgatcccgattaactcaacgaacacccgcacgccgactaacaaccgaattcctcttcttcgatctcaaaactatcaccaaccaaacctcaacgtcgccgacgcgaaatccaatcgcaaaaacaaaaatcacgacgaataatctatccgttcgcctactaaacgacacaaaaaacgtcgaattaaacgaccgcactccccacatcgcaaacgccccgtcgatcttcgcgataccatcaaccaacgccgtacgacaaaaaaccatactccccatcattcaccaaatcgctacgacgacgacataaataaaattactaccttcacaaacgacctacgtcgaataaattaactaaccgactttaaaccgactaaaatcgaaaaatataacgataccaccaaccctaaatcttaactcaccgtctacgatctcg

SEQ ID NO: 38799 - DNA, 1485 bp, Artificial Sequence
  chemically treated genomic DNA (Homo sapiens) CpG-island No: 38799
ttttagtttgatagttatttttttttagtattgtcgaaattttgtttcgatagttggcgtattaggtaggggtagcgttaagtttttcgtcgattagtgcgatgggtttcgttttcggtatcgacgattttatttttttttttgggtaggcgtttcggttcggtaatttcgattttattattaacgatttcggtaagatttttttttttgattcggatttaaattagtcggggagagattaggtttttgtttcgttcggtatttcgaattcggttgagatttattttaagtttatttcgatcgagtcggttttaaattatttggacgagatttaatttatatcgatacgattagattaagatgttgggttttgatgagatttttcgatgatttggttgttgtttttacgattaaggcgttttttattcgaagatttagacgagattcggttttggtttcgatttaatttagttttagggaggtcggcgttatattttaatttttcgggatagtttcgacggaagaattggatggtattttaagtttttcggtattagttttcgattaacggagattttcgagtacgataatttcggttatcgttacgattatggtaatttcgacgatttcgataatagttacgaggatgattatacgtttttttttttcggcgtgtttatggtcgataacgaaacggtagaatagcgtcgaattcgagaagcggaagaagaacgacgcgataagaagttaaacgtcgttatttggagggagaatgataacgataagagcgagaacgattatagcgtgaataataagatcgcgaaagggttgtaaaagaggttgaggatcgacggtaacgcgttttggaattcgggcgacgagtaagagattttattgggtaataagacgtcgacgggatagcggtttttcgtattttttaatagaacgcggttgtagcgattatttttttcgatattttttttaaggaagacgtttttaattaggttgattacgtcgttaatattttgaattagacgaagattatgatcgtcgtttcggtttcggttaatttagcgagtattcgtacgtcgattggtagtcgagtttttttttttcgattttaagattattattaattaagttttagcgtcgtcggcgcgggatttagtcgtaggagtaggggttacgacgagtgatttgttcgttcgtttattgaacgatatagggagcgtcgagttgaacgatcgtattttttatatcgtaggcgtttcgtcgattttcgcgatattattaattagcgtcgtgcggtaagaggttatgttttttattatttattagatcgttacgacgacgatatggatggagttgttgtttttataaacgatttgcgtcgagtggattggttagtcggttttaagtcgattggaatcgagaagtatgacggtattattaattttgagttttggtttatcgtttacggtttcg

SEQ ID NO: 38800 - DNA, 1485 bp, Artificial Sequence
  chemically treated genomic DNA (Homo sapiens) CpG-island No: 38800
cgaaaccgtaaacgataaaccaaaactcaaaattaataataccgtcatacttctcgattccaatcgacttaaaaccgactaaccaatccactcgacgcaaatcgtttataaaaacaacaactccatccatatcgtcgtcgtaacgatctaataaataataaaaaacataacctcttaccgcacgacgctaattaataatatcgcgaaaatcgacgaaacgcctacgatataaaaaatacgatcgttcaactcgacgctccctatatcgttcaataaacgaacgaacaaatcactcgtcgtaacccctactcctacgactaaatcccgcgccgacgacgctaaaacttaattaataataatcttaaaatcgaaaaaaaaaaactcgactaccaatcgacgtacgaatactcgctaaattaaccgaaaccgaaacgacgatcataatcttcgtctaattcaaaatattaacgacgtaatcaacctaattaaaaacgtcttccttaaaaaaaatatcgaaaaaaataatcgctacaaccgcgttctattaaaaaatacgaaaaaccgctatcccgtcgacgtcttattacccaataaaatctcttactcgtcgcccgaattccaaaacgcgttaccgtcgatcctcaacctcttttacaaccctttcgcgatcttattattcacgctataatcgttctcgctcttatcgttatcattctccctccaaataacgacgtttaacttcttatcgcgtcgttcttcttccgcttctcgaattcgacgctattctaccgtttcgttatcgaccataaacacgccgaaaaaaaaaaacgtataatcatcctcgtaactattatcgaaatcgtcgaaattaccataatcgtaacgataaccgaaattatcgtactcgaaaatctccgttaatcgaaaactaataccgaaaaacttaaaataccatccaattcttccgtcgaaactatcccgaaaaattaaaatataacgccgacctccctaaaactaaattaaatcgaaaccaaaaccgaatctcgtctaaatcttcgaataaaaaacgccttaatcgtaaaaacaacaaccaaatcatcgaaaaatctcatcaaaacccaacatcttaatctaatcgtatcgatataaattaaatctcgtccaaataatttaaaaccgactcgatcgaaataaacttaaaataaatctcaaccgaattcgaaataccgaacgaaacaaaaacctaatctctccccgactaatttaaatccgaatcaaaaaaaaaaatcttaccgaaatcgttaataataaaatcgaaattaccgaaccgaaacgcctacccaaaaaaaaaaataaaatcgtcgataccgaaaacgaaacccatcgcactaatcgacgaaaaacttaacgctacccctacctaatacgccaactatcgaaacaaaatttcgacaatactaaaaaaaaataactatcaaactaaaa

SEQ ID NO: 38801 - DNA, 503 bp, Artificial Sequence
  chemically treated genomic DNA (Homo sapiens) CpG-island No: 38801
ttgtttagggtattttcgcgtcgacgtcgtcgtcgtttttcgtcgtcgtgtcgtagttttcgtcgttttcgtcgtcgacgtcgtcgtcgtatttttggggtgagagtcgtcgttgtttttttttttcgatttttttttttttttttttttttttaaatcgtcgttagttagttcgttgtcgacgtcgtcgtcgacgttaacgcgcgcggtcgattttgatttcgtttttcgtcgatgtcgatttcgatttcgacgcggtcgttatcgtcgataacgtaacgtttaagcggtcgttacggcgacgacgtcgacgttttcgtttcgagttcgtatgttatcgcgttacgtcgttgttgcgtcgttacgtcgtcgtcgtattacgtcgttgtttcgttgtcgttattatcgtttcgttattgttaaacgtgaacgaacgtgattgaaatgtgaacgaacgggaacgaacgtgaacgaaacgtgaacgaacgggaacgaatgcgaat

SEQ ID NO: 38802 - DNA, 503 bp, Artificial Sequence
  chemically treated genomic DNA (Homo sapiens) CpG-island No: 38802
attcgcattcgttcccgttcgttcacgtttcgttcacgttcgttcccgttcgttcacatttcaatcacgttcgttcacgtttaacaataacgaaacgataataacgacaacgaaacaacgacgtaatacgacgacgacgtaacgacgcaacaacgacgtaacgcgataacatacgaactcgaaacgaaaacgtcgacgtcgtcgccgtaacgaccgcttaaacgttacgttatcgacgataacgaccgcgtcgaaatcgaaatcgacatcgacgaaaaacgaaatcaaaatcgaccgcgcgcgttaacgtcgacgacgacgtcgacaacgaactaactaacgacgatttaaaaaaaaaaaaaaaaaaaaaaaaatcgaaaaaaaaaaacaacgacgactctcaccccaaaaatacgacgacgacgtcgacgacgaaaacgacgaaaactacgacacgacgacgaaaaacgacgacgacgtcgacgcgaaaataccctaaacaa

SEQ ID NO: 38803 - DNA, 503 bp, Artificial Sequence
  chemically treated genomic DNA (Homo sapiens) CpG-island No: 38803
gttcgtattcgttttcgttcgtttacgtttcgtttacgttcgttttcgttcgtttatattttaattacgttcgtttacgtttggtaatgacggggcggtagtggcggtagcggagtagcggcgtggtacggcggcggcgtggcggcgtagtagcggcgtggcgcggtggtatgcgagttcgaggcgggggcgtcggcgtcgtcgtcgtggcggtcgtttggacgttacgttgtcggcggtggcggtcgcgtcgaagtcggggtcggtatcggcgggaggcggagttagggtcggtcgcgcgcgttgacgtcggcggcggcgtcggtaacgagttagttagcggcggtttggagagagagagagagagagagagatcgagagagagaggtagcggcggtttttattttagagatgcggcggcggcgtcggcggcggaggcggcgaggattgcgatacgacggcgagagacgacggcggcgtcggcgcggggatgttttaggtag

SEQ ID NO: 38804 - DNA, 503 bp, Artificial Sequence
  chemically treated genomic DNA (Homo sapiens) CpG-island No: 38804
ctacctaaaacatccccgcgccgacgccgccgtcgtctctcgccgtcgtatcgcaatcctcgccgcctccgccgccgacgccgccgccgcatctctaaaataaaaaccgccgctacctctctctctcgatctctctctctctctctctctctccaaaccgccgctaactaactcgttaccgacgccgccgccgacgtcaacgcgcgcgaccgaccctaactccgcctcccgccgataccgaccccgacttcgacgcgaccgccaccgccgacaacgtaacgtccaaacgaccgccacgacgacgacgccgacgcccccgcctcgaactcgcataccaccgcgccacgccgctactacgccgccacgccgccgccgtaccacgccgctactccgctaccgccactaccgccccgtcattaccaaacgtaaacgaacgtaattaaaatataaacgaacgaaaacgaacgtaaacgaaacgtaaacgaacgaaaacgaatacgaac

SEQ ID NO: 38805 - DNA, 625 bp, Artificial Sequence
  chemically treated genomic DNA (Homo sapiens) CpG-island No: 38805
  misc_feature (572)..(572): n is either a, c, g or t
gtcgcgtttttttcggttattaattatggtcgtcggtcgtgtttttcgtcgtcgtttcgtttttttcgtgttcggtttttttttttatttaataaaatggaattatttcggtacgttttttagttttagttttttttcgcgttttttcgtggtcgtttcgttttttttcgtcgtcgttttttttttttcgtgttatcggtcgtttttagtcgttttttttttttcgtcggagcgtcgttcggtcgcgtcgtcgtcgttagtagcgtcgtagttgttttttttttatcggcgtcgttttcgttttacgcggagattatcggagacgcgttttcgtcggtaattagtggtattggtgttattgtattttttttagtcggttgttgtttttcgtcggagcgtcggtcgacgtcgtcgtttttttcgtcgacgtcgtggtatcgttttttttttcggttatatttcggtttcgtcggaatatcgtcgtgtcgttattaatttttttattcgtttcgtcggagtttttcggtcgttcgttttttttcgtttgtttatcggttagtcgcggtattatntatttcggtatcgtagcggtaaggttttttcggtttcgtttttttttcgatcg

SEQ ID NO: 38806 - DNA, 625 bp, Artificial Sequence
  chemically treated genomic DNA (Homo sapiens) CpG-island No: 38806
  misc_feature (54)..(54): n is either a, c, g or t
cgatcgaaaaaaaaacgaaaccgaaaaaaccttaccgctacgataccgaaatanataataccgcgactaaccgataaacaaacgaaaaaaaacgaacgaccgaaaaactccgacgaaacgaataaaaaaattaataacgacacgacgatattccgacgaaaccgaaatataaccgaaaaaaaaaacgataccacgacgtcgacgaaaaaaacgacgacgtcgaccgacgctccgacgaaaaacaacaaccgactaaaaaaaatacaataacaccaataccactaattaccgacgaaaacgcgtctccgataatctccgcgtaaaacgaaaacgacgccgataaaaaaaaaacaactacgacgctactaacgacgacgacgcgaccgaacgacgctccgacgaaaaaaaaaaaacgactaaaaacgaccgataacacgaaaaaaaaaaaacgacgacgaaaaaaaacgaaacgaccacgaaaaaacgcgaaaaaaaactaaaactaaaaaacgtaccgaaataattccattttattaaataaaaaaaaaaaccgaacacgaaaaaaacgaaacgacgacgaaaaacacgaccgacgaccataattaataaccgaaaaaaacgcgac

SEQ ID NO: 38807 - DNA, 625 bp, Artificial Sequence
  chemically treated genomic DNA (Homo sapiens) CpG-island No: 38807
  misc_feature (54)..(54): n is either a, c, g or t
cggtcgaaggggaggcgaggtcgaggggattttgtcgttgcgatgtcggagtgngtggtgtcgcggttgatcggtaaataagcgaggaggaacgggcggtcggaggatttcggcgaggcgggtggaggggttggtggcgatacggcggtgtttcggcgaaatcgaggtgtggtcggggaaggagacgatgttacggcgtcgacgaaggagacggcgacgtcggtcgacgtttcgacgagggatagtagtcggttggagggagtatagtggtattaatgttattggttgtcggcggggacgcgttttcggtggttttcgcgtgaaacggaggcgacgtcggtggaggggaagtagttgcgacgttgttggcggcgacggcgcgatcggacgacgtttcggcgaggagggagaggcggttggaggcggtcggtggtacgggagagagaggacgacggcggggagaggcggggcggttacgagagggcgcgggagggggttaaaattggagaacgtatcgaggtggttttattttattggatgggagagggagtcgggtacggggagggcggaacggcgacgggaaatacggtcggcggttatggttggtggtcgggaaaggcgcggt

SEQ ID NO: 38808 - DNA, 625 bp, Artificial Sequence
  chemically treated genomic DNA (Homo sapiens) CpG-island No: 38808
  misc_feature (572)..(572): n is either a, c, g or t
accgcgcctttcccgaccaccaaccataaccgccgaccgtatttcccgtcgccgttccgccctccccgtacccgactccctctcccatccaataaaataaaaccacctcgatacgttctccaattttaaccccctcccgcgccctctcgtaaccgccccgcctctccccgccgtcgtcctctctctcccgtaccaccgaccgcctccaaccgcctctccctcctcgccgaaacgtcgtccgatcgcgccgtcgccgccaacaacgtcgcaactacttcccctccaccgacgtcgcctccgtttcacgcgaaaaccaccgaaaacgcgtccccgccgacaaccaataacattaataccactatactccctccaaccgactactatccctcgtcgaaacgtcgaccgacgtcgccgtctccttcgtcgacgccgtaacatcgtctccttccccgaccacacctcgatttcgccgaaacaccgccgtatcgccaccaacccctccacccgcctcgccgaaatcctccgaccgcccgttcctcctcgcttatttaccgatcaaccgcgacaccacncactccgacatcgcaacgacaaaatcccctcgacctcgcctccccttcgaccg

SEQ ID NO: 38809 - DNA, 582 bp, Artificial Sequence
  chemically treated genomic DNA (Homo sapiens) CpG-island No: 38809
aggcgggatttgcgtgtcgacgtatagcgagtacgttgacgttttggcgtatcgttttacggtatcgtttatcggtttgaatttcggcgttttagaggattatgaggcgggcgttaattgtttgggtcgtagggcgggaggtagcgcgggagtggggcgttgaggggtcggtttagtttggggttttggttttgcgtttttcgatcgaattatcgtttttgagttcggtgcggggttgtcgttatcgtttggtcgtgggtgtcggagcggtcgggttgcgatttagcgtttttgggtgggcgcgggcggcgttttcgcggcgggtatttttcgaggtcgttttcgggttatgatcgatttcgtgaagttgcgtcgcgatagcgcggcggatttttttttttattacgagtatttgtgcgcgttgtagaattcggtgtcgttgttcgtcgtgcgcgtttgttttcgggagggcgtgttggattttaacgtcgatcgttttcgcggggtggattgggcgtttttgttgagtatttttaagattaataaagatttgtttttggtttttattaagagtttttttta

SEQ ID NO: 38810 - DNA, 582 bp, Artificial Sequence
  chemically treated genomic DNA (Homo sapiens) CpG-island No: 38810
taaaaaaaactcttaataaaaaccaaaaacaaatctttattaatcttaaaaatactcaacaaaaacgcccaatccaccccgcgaaaacgatcgacgttaaaatccaacacgccctcccgaaaacaaacgcgcacgacgaacaacgacaccgaattctacaacgcgcacaaatactcgtaataaaaaaaaaaatccgccgcgctatcgcgacgcaacttcacgaaatcgatcataacccgaaaacgacctcgaaaaatacccgccgcgaaaacgccgcccgcgcccacccaaaaacgctaaatcgcaacccgaccgctccgacacccacgaccaaacgataacgacaaccccgcaccgaactcaaaaacgataattcgatcgaaaaacgcaaaaccaaaaccccaaactaaaccgacccctcaacgccccactcccgcgctacctcccgccctacgacccaaacaattaacgcccgcctcataatcctctaaaacgccgaaattcaaaccgataaacgataccgtaaaacgatacgccaaaacgtcaacgtactcgctatacgtcgacacgcaaatcccgcct

SEQ ID NO: 38811 - DNA, 582 bp, Artificial Sequence
  chemically treated genomic DNA (Homo sapiens) CpG-island No: 38811
tggaagaagtttttgatggagattaagggtaggtttttattgattttgagggtgtttagtagaggcgtttagtttatttcgcggaggcggtcggcgttgaaatttagtacgttttttcggagataggcgcgtacggcgggtagcggtatcgagttttgtagcgcgtataggtattcgtagtgggagaagaagttcgtcgcgttgtcgcggcgtagttttacggagtcgattatggttcgagggcggtttcgggggatgttcgtcgcggagacgtcgttcgcgtttatttaagaacgttgagtcgtaattcggtcgtttcggtatttacggttaggcgatagcggtagtttcgtatcgggtttaggagcggtgattcggtcggaagacgtaaggttagagttttaagttaggtcggttttttaacgttttattttcgcgttgtttttcgttttgcggtttaagtagttggcgttcgttttatagttttttgaggcgtcgggatttaagtcggtgggcggtgtcgtggaacggtgcgttaagacgttaacgtgttcgttgtgcgtcggtacgtaggtttcgttt

SEQ ID NO: 38812 - DNA, 582 bp, Artificial Sequence
  chemically treated genomic DNA (Homo sapiens) CpG-island No: 38812
aaacgaaacctacgtaccgacgcacaacgaacacgttaacgtcttaacgcaccgttccacgacaccgcccaccgacttaaatcccgacgcctcaaaaaactataaaacgaacgccaactacttaaaccgcaaaacgaaaaacaacgcgaaaataaaacgttaaaaaaccgacctaacttaaaactctaaccttacgtcttccgaccgaatcaccgctcctaaacccgatacgaaactaccgctatcgcctaaccgtaaataccgaaacgaccgaattacgactcaacgttcttaaataaacgcgaacgacgtctccgcgacgaacatcccccgaaaccgccctcgaaccataatcgactccgtaaaactacgccgcgacaacgcgacgaacttcttctcccactacgaatacctatacgcgctacaaaactcgataccgctacccgccgtacgcgcctatctccgaaaaaacgtactaaatttcaacgccgaccgcctccgcgaaataaactaaacgcctctactaaacaccctcaaaatcaataaaaacctacccttaatctccatcaaaaacttcttcca

SEQ ID NO: 38813 - DNA, 571 bp, Artificial Sequence
  chemically treated genomic DNA (Homo sapiens) CpG-island No: 38813
gtcgcgttcgggagagtcgagtaaggttcgtcggtcggttagttagggttagcggagtcgagtcgggtaatgagagacgagtcggttcggagcgtgcggagcgtagacgagtataagagagagtcgggtagaggaagggaagtcggcgtgataggcggcgtgcgggaagcgggggcggtgttgtagatcggtagtatagatatttcgtcggtttcgtttttttagcgggagcgagcgagcgttatttttatttttttttttttcgttttcgttttcgagtttcgtgcgttaaggttttagcgtcgtagggttaacgagatcgttttcggtcgtagttacggcggggcgttgcgaagtcggttagtttttttcggttgttcgtttttttttttgtcgtttttagttgtttcgttttcggcgcggcgttagcgttcggcggtcggggagcgacgttttaggttgttagttcggtggtttttagtttttttcgatcgtagggttggggcgattagaaaagttagattaattaggacgagttcgggcgtggaattgggtttgaagtttttatgtt

SEQ ID NO: 38814 - DNA, 571 bp, Artificial Sequence
  chemically treated genomic DNA (Homo sapiens) CpG-island No: 38814
aacataaaaacttcaaacccaattccacgcccgaactcgtcctaattaatctaacttttctaatcgccccaaccctacgatcgaaaaaaactaaaaaccaccgaactaacaacctaaaacgtcgctccccgaccgccgaacgctaacgccgcgccgaaaacgaaacaactaaaaacgacaaaaaaaaaaacgaacaaccgaaaaaaactaaccgacttcgcaacgccccgccgtaactacgaccgaaaacgatctcgttaaccctacgacgctaaaaccttaacgcacgaaactcgaaaacgaaaacgaaaaaaaaaaaaataaaaataacgctcgctcgctcccgctaaaaaaacgaaaccgacgaaatatctatactaccgatctacaacaccgcccccgcttcccgcacgccgcctatcacgccgacttcccttcctctacccgactctctcttatactcgtctacgctccgcacgctccgaaccgactcgtctctcattacccgactcgactccgctaaccctaactaaccgaccgacgaaccttactcgactctcccgaacgcgac

SEQ ID NO: 38815 - DNA, 571 bp, Artificial Sequence
  chemically treated genomic DNA (Homo sapiens) CpG-island No: 38815
ggtatgagggttttaggtttaattttacgttcgaattcgttttgattagtttggtttttttggtcgttttagttttgcggtcggggagagttggaaattatcgagttgatagtttagagcgtcgtttttcggtcgtcgagcgttgacgtcgcgtcgggggcggggtagttggaggcggtagggagaggagcgagtagtcgggaagggttggtcggtttcgtagcgtttcgtcgtggttgcggtcggaagcggtttcgttggttttgcggcgttggagttttgacgtacggagttcgagagcgagaacgggagagaaaggggtagaaatggcgttcgttcgttttcgttgaggaggcgaagtcggcggagtgtttgtgttgtcggtttgtagtatcgttttcgtttttcgtacgtcgtttgttacgtcgatttttttttttttgttcggtttttttttgtgttcgtttgcgtttcgtacgtttcgggtcggttcgttttttattgttcggttcggtttcgttggttttgattgatcggtcggcgggttttgttcggttttttcgggcgcggt

SEQ ID NO: 38816 - DNA, 571 bp, Artificial Sequence
  chemically treated genomic DNA (Homo sapiens) CpG-island No: 38816
accgcgcccgaaaaaaccgaacaaaacccgccgaccgatcaatcaaaaccaacgaaaccgaaccgaacaataaaaaacgaaccgacccgaaacgtacgaaacgcaaacgaacacaaaaaaaaaccgaacaaaaaaaaaaaaatcgacgtaacaaacgacgtacgaaaaacgaaaacgatactacaaaccgacaacacaaacactccgccgacttcgcctcctcaacgaaaacgaacgaacgccatttctacccctttctctcccgttctcgctctcgaactccgtacgtcaaaactccaacgccgcaaaaccaacgaaaccgcttccgaccgcaaccacgacgaaacgctacgaaaccgaccaacccttcccgactactcgctcctctccctaccgcctccaactaccccgcccccgacgcgacgtcaacgctcgacgaccgaaaaacgacgctctaaactatcaactcgataatttccaactctccccgaccgcaaaactaaaacgaccaaaaaaaccaaactaatcaaaacgaattcgaacgtaaaattaaacctaaaaccctcatacc

SEQ ID NO: 38817 - DNA, 645 bp, Artificial Sequence
  chemically treated genomic DNA (Homo sapiens) CpG-island No: 38817
gagtcgtcgttaaacgtttagggaaagttattaggtgggtcggcgaacgttttcgggttagtaggtaggttttttcgtatagtagttttcgtattcggttcgtaagttcgttgttttttttgcgtcgggtatggttttaggttaggaggttttatattatgatagttaacgcgtttattttgcgttttttcgtaggttttgtttttcgttcggtttttttcggtcgcggcgttgtcggaagtgcgtgtcggcgcgggggcggatttcggtggcggcgaggggcggatttcgcggataaggttaggtttagttttgagtttcgtcgggtagggtcgtcgggattggtgttcggtagagcgtgagtttagcgggttggagtcggcgagcgggagtgaaagaagaaaagttagagagcgaaggtaaagttcgaggagagagggtcgcggtcggcggaggaatttgattgtacggttgcgtgcgtttattttcggagggtttttttaggcgggcggtttcgttagtggttaaaggtaaagtatttcggggcgcggcgtatgaagttgagtttcgtttttgttagtcgtcgttttttttttaaaaatatattttagttttaatgtttatgtttttattgttttagttttt

SEQ ID NO: 38818 - DNA, 645 bp, Artificial Sequence
  chemically treated genomic DNA (Homo sapiens) CpG-island No: 38818
aaaaactaaaacaataaaaacataaacattaaaactaaaatatatttttaaaaaaaaaacgacgactaacaaaaacgaaactcaacttcatacgccgcgccccgaaatactttacctttaaccactaacgaaaccgcccgcctaaaaaaaccctccgaaaataaacgcacgcaaccgtacaatcaaattcctccgccgaccgcgaccctctctcctcgaactttaccttcgctctctaacttttcttctttcactcccgctcgccgactccaacccgctaaactcacgctctaccgaacaccaatcccgacgaccctacccgacgaaactcaaaactaaacctaaccttatccgcgaaatccgcccctcgccgccaccgaaatccgcccccgcgccgacacgcacttccgacaacgccgcgaccgaaaaaaaccgaacgaaaaacaaaacctacgaaaaaacgcaaaataaacgcgttaactatcataatataaaacctcctaacctaaaaccatacccgacgcaaaaaaaacaacgaacttacgaaccgaatacgaaaactactatacgaaaaaacctacctactaacccgaaaacgttcgccgacccacctaataactttccctaaacgtttaacgacgactc

SEQ ID NO: 38819 - DNA, 645 bp, Artificial Sequence
  chemically treated genomic DNA (Homo sapiens) CpG-island No: 38819
aagaattggggtaatggaggtataaatattaaggttaggatgtatttttggggagaaagcggcggttagtagggacgaagtttaattttatgcgtcgcgtttcggaatgttttgtttttagttattagcggagtcgttcgtttgagggagtttttcggaagtgagcgtacgtaatcgtgtagttagattttttcgtcgatcgcggtttttttttttcgggttttgttttcgttttttagtttttttttttttattttcgttcgtcgattttagttcgttgggtttacgttttgtcggatattaatttcggcggttttgttcgacggagtttaaggttaggtttggttttgttcgcggagttcgtttttcgtcgttatcgggattcgttttcgcgtcgatacgtattttcggtagcgtcgcggtcgggagggatcgagcggggagtaaggtttgcggggaggcgtaggatggacgcgttggttgttatgatgtaggattttttgatttagaattatgttcggcgtagggagaataacgagtttacggatcgggtgcgggggttgttgtgcgagaaagtttatttgttggttcgggagcgttcgtcggtttatttggtggttttttttggacgtttaacggcgattt

SEQ ID NO: 38820 - DNA, 645 bp, Artificial Sequence
  chemically treated genomic DNA (Homo sapiens) CpG-island No: 38820
aaatcgccgttaaacgtccaaaaaaaaccaccaaataaaccgacgaacgctcccgaaccaacaaataaactttctcgcacaacaacccccgcacccgatccgtaaactcgttattctccctacgccgaacataattctaaatcaaaaaatcctacatcataacaaccaacgcgtccatcctacgcctccccgcaaaccttactccccgctcgatccctcccgaccgcgacgctaccgaaaatacgtatcgacgcgaaaacgaatcccgataacgacgaaaaacgaactccgcgaacaaaaccaaacctaaccttaaactccgtcgaacaaaaccgccgaaattaatatccgacaaaacgtaaacccaacgaactaaaatcgacgaacgaaaataaaaaaaaaaaaactaaaaaacgaaaacaaaacccgaaaaaaaaaaaccgcgatcgacgaaaaaatctaactacacgattacgtacgctcacttccgaaaaactccctcaaacgaacgactccgctaataactaaaaacaaaacattccgaaacgcgacgcataaaattaaacttcgtccctactaaccgccgctttctccccaaaaatacatcctaaccttaatatttatacctccattaccccaattctt

SEQ ID NO: 38821 - DNA, 1026 bp, Artificial Sequence
  chemically treated genomic DNA (Homo sapiens) CpG-island No: 38821
gttgcgttttttcgcgtttcgtcggtttagtttataggcgatggtagttgtcgtgggtttattgatgattcgtaatacgttgagtttcgcgatggttttcgcgtttttggtggtttggcgttgcgagttattgaaataggcgggtacggtgattattgcgtgttttacgggttggtttaggtacgtttcggtcgttttttttattttgtttagtattatggacgagattttttcggggtagaacgttttgtttttttcgcggtagtatacgcgtattttgggtttgtcgttttcgtttattattcggaagggttagtgttttatgttcgattgtatcgtggtgttcgcgaatttgcgttcgattagtcgtttggtatcgaatacggtgttgtgggggtttagggtcgtttggtttttggtcgcgttttcgattagtcgttcggtgtcggtgaaggttacgtagttgggcgtggtgcggttgttttggtcgttggttaggatttttacgcggttttgttgaaatacgtttacgtacgagtaggtggtgtttaggtcgatgtttatcgcgagttttcgtggggtttgtatggttgaagttttttgtcggatgttggaggttacggaggttgttgtcgtttcgtcgtcgaggggcgtttagtagtgaggttttttttgcggtttttttgtagttagttcggttcggatttgtttagtttcgtttttatcggttttttatttttttgcgttttattcgattttcgtcgtcgcgaattttcgcgaattttttcgtattttttcgtattttttcgtttagttgagagtttttcgttcgttcgggttgatttagtcgggtggcgcggcgcggcgttgatttcgggagaaggttcgggtagatcggggtatgagtcgcgaggttgggcggttacgttaggttagttcgtttttgatttaggttgttgaaagaaatgcggggaaggttttagttttttcgggttggttttgaggacgcgcggttgtggtagaggt

SEQ ID NO: 38822 - DNA, 1026 bp, Artificial Sequence
  chemically treated genomic DNA (Homo sapiens) CpG-island No: 38822
acctctaccacaaccgcgcgtcctcaaaaccaacccgaaaaaactaaaaccttccccgcatttctttcaacaacctaaatcaaaaacgaactaacctaacgtaaccgcccaacctcgcgactcataccccgatctacccgaaccttctcccgaaatcaacgccgcgccgcgccacccgactaaatcaacccgaacgaacgaaaaactctcaactaaacgaaaaaatacgaaaaaatacgaaaaaattcgcgaaaattcgcgacgacgaaaatcgaataaaacgcaaaaaaataaaaaaccgataaaaacgaaactaaacaaatccgaaccgaactaactacaaaaaaaccgcaaaaaaaacctcactactaaacgcccctcgacgacgaaacgacaacaacctccgtaacctccaacatccgacaaaaaacttcaaccatacaaaccccacgaaaactcgcgataaacatcgacctaaacaccacctactcgtacgtaaacgtatttcaacaaaaccgcgtaaaaatcctaaccaacgaccaaaacaaccgcaccacgcccaactacgtaaccttcaccgacaccgaacgactaatcgaaaacgcgaccaaaaaccaaacgaccctaaacccccacaacaccgtattcgataccaaacgactaatcgaacgcaaattcgcgaacaccacgatacaatcgaacataaaacactaacccttccgaataataaacgaaaacgacaaacccaaaatacgcgtatactaccgcgaaaaaaacaaaacgttctaccccgaaaaaatctcgtccataatactaaacaaaataaaaaaaacgaccgaaacgtacctaaaccaacccgtaaaacacgcaataatcaccgtacccgcctatttcaataactcgcaacgccaaaccaccaaaaacgcgaaaaccatcgcgaaactcaacgtattacgaatcatcaataaacccacgacaactaccatcgcctataaactaaaccgacgaaacgcgaaaaaacgcaac

SEQ ID NO: 38823 - DNA, 1026 bp, Artificial Sequence
  chemically treated genomic DNA (Homo sapiens) CpG-island No: 38823
gtttttgttataatcgcgcgtttttagagttagttcggaggagttagaatttttttcgtattttttttagtagtttgagttagaggcgggttggtttggcgtagtcgtttagtttcgcggtttatgtttcgatttgttcgaattttttttcggggttagcgtcgcgtcgcgttattcggttgagttagttcgggcgggcgagaggtttttaattgggcgggaaggtgcgggaaggtgcggaaaggttcgcgaaagttcgcggcggcgggggtcgggtgaggcgtaaaaggataaaaagtcggtggaagcggagttgagtagattcgagtcgggttggttgtagagaaatcgtagggagagttttattgttgagcgtttttcgacggcggagcggtagtagttttcgtggtttttagtattcgataagaagttttagttatgtaggttttacgggagttcgcggtgggtatcgatttgggtattatttattcgtgcgtgggcgtgttttagtagggtcgcgtggagattttggttaacgattagggtaatcgtattacgtttagttacgtggtttttatcgatatcgagcggttggtcggggacgcggttaagagttaggcggttttgaatttttataatatcgtgttcgatgttaagcggttgatcgggcgtaagttcgcggatattacggtgtagtcggatatgaagtattggttttttcgggtggtgagcgagggcggtaagtttaaggtgcgcgtatgttatcgcggggaggataagacgttttatttcgaggagatttcgtttatggtgttgagtaagatgaaggagacggtcgaggcgtatttgggttagttcgtgaagtacgtagtgattatcgtgttcgtttattttaatgattcgtagcgttaggttattaaggacgcgggggttatcgcggggtttaacgtgttgcggattattaatgagtttacggtagttgttatcgtttatgggttggatcggcggggcgcgggagagcgtaat

SEQ ID NO: 38824 - DNA, 1026 bp, Artificial Sequence
  chemically treated genomic DNA (Homo sapiens) CpG-island No: 38824
attacgctctcccgcgccccgccgatccaacccataaacgataacaactaccgtaaactcattaataatccgcaacacgttaaaccccgcgataacccccgcgtccttaataacctaacgctacgaatcattaaaataaacgaacacgataatcactacgtacttcacgaactaacccaaatacgcctcgaccgtctccttcatcttactcaacaccataaacgaaatctcctcgaaataaaacgtcttatcctccccgcgataacatacgcgcaccttaaacttaccgccctcgctcaccacccgaaaaaaccaatacttcatatccgactacaccgtaatatccgcgaacttacgcccgatcaaccgcttaacatcgaacacgatattataaaaattcaaaaccgcctaactcttaaccgcgtccccgaccaaccgctcgatatcgataaaaaccacgtaactaaacgtaatacgattaccctaatcgttaaccaaaatctccacgcgaccctactaaaacacgcccacgcacgaataaataatacccaaatcgatacccaccgcgaactcccgtaaaacctacataactaaaacttcttatcgaatactaaaaaccacgaaaactactaccgctccgccgtcgaaaaacgctcaacaataaaactctccctacgatttctctacaaccaacccgactcgaatctactcaactccgcttccaccgactttttatccttttacgcctcacccgacccccgccgccgcgaactttcgcgaacctttccgcaccttcccgcaccttcccgcccaattaaaaacctctcgcccgcccgaactaactcaaccgaataacgcgacgcgacgctaaccccgaaaaaaaattcgaacaaatcgaaacataaaccgcgaaactaaacgactacgccaaaccaacccgcctctaactcaaactactaaaaaaaatacgaaaaaaattctaactcctccgaactaactctaaaaacgcgcgattataacaaaaac

SEQ ID NO: 38825 - DNA, 623 bp, Artificial Sequence
  chemically treated genomic DNA (Homo sapiens) CpG-island No: 38825
gaggtgggatcggcgatttggttagggtgtcggtagaatggaatgcgcggtcggggttcgaggggtcggaggaaaggataggatgttggatggcgtgtttttggtgggagacgtgtgtgcggttttacgagcgagtcgttcgttgttgtttagcggttagaagttggagggtgaaatcgggcgggttgtttaggttagtacgtttttgggtagcgtagcggcgatttaaggcggtgggcggtgggcgtacgtcggtgggaggaaggagggaaaaggaggaataggggaagaatttgggttgtgtttgtttgggcgagtgaggagaaggcgggcggaggagataggtaggaaagagcgtggaaggtggtcgcggtcgttcgttgtgtgtggggttaggaaagagggcgtgtgaggtggtggagagggcgtttgtttaaagggtaattgagtagagggtcgcgggcgttggcgtatggttttgggttgtttttgcgatagtcggcgggtgggtagaaagaacgtacgtgtttgaaaagcggcggcgttttggaggtttgttttaagggggttggagtttggagagcgggtaagggtttaaggtagaaagcggttaaaggtgtttt

SEQ ID NO: 38826 - DNA, 623 bp, Artificial Sequence
  chemically treated genomic DNA (Homo sapiens) CpG-island No: 38826
aaaacacctttaaccgctttctaccttaaacccttacccgctctccaaactccaacccccttaaaacaaacctccaaaacgccgccgcttttcaaacacgtacgttctttctacccacccgccgactatcgcaaaaacaacccaaaaccatacgccaacgcccgcgaccctctactcaattaccctttaaacaaacgccctctccaccacctcacacgccctctttcctaaccccacacacaacgaacgaccgcgaccaccttccacgctctttcctacctatctcctccgcccgccttctcctcactcgcccaaacaaacacaacccaaattcttcccctattcctccttttccctccttcctcccaccgacgtacgcccaccgcccaccgccttaaatcgccgctacgctacccaaaaacgtactaacctaaacaacccgcccgatttcaccctccaacttctaaccgctaaacaacaacgaacgactcgctcgtaaaaccgcacacacgtctcccaccaaaaacacgccatccaacatcctatcctttcctccgacccctcgaaccccgaccgcgcattccattctaccgacaccctaaccaaatcgccgatcccacctc

SEQ ID NO: 38827 - DNA, 623 bp, Artificial Sequence
  chemically treated genomic DNA (Homo sapiens) CpG-island No: 38827
ggagtatttttggtcgttttttgttttgagtttttgttcgttttttagattttagtttttttgaagtaagtttttaaaacgtcgtcgttttttaggtacgtgcgttttttttgtttattcgtcggttgtcgtagaaatagtttaggattatgcgttagcgttcgcgattttttatttaattgttttttggatagacgttttttttattattttatacgtttttttttttggttttatatatagcgagcgatcgcgattattttttacgtttttttttgtttatttttttcgttcgttttttttttattcgtttaaatagatatagtttagattttttttttatttttttttttttttttttttttttatcggcgtgcgtttatcgtttatcgttttgaatcgtcgttgcgttgtttagaggcgtgttggtttgaatagttcgttcggttttattttttaatttttgatcgttgagtagtagcgagcgattcgttcgtggagtcgtatatacgttttttattagaggtacgttatttaatattttgttttttttttcgatttttcggatttcggtcgcgtattttattttgtcgatattttagttaggtcgtcgattttatttt

SEQ ID NO: 38828 - DNA, 623 bp, Artificial Sequence
  chemically treated genomic DNA (Homo sapiens) CpG-island No: 38828
aaaataaaatcgacgacctaactaaaatatcgacaaaataaaatacgcgaccgaaatccgaaaaatcgaaaaaaaaaacaaaatattaaataacgtacctctaataaaaaacgtatatacgactccacgaacgaatcgctcgctactactcaacgatcaaaaattaaaaaataaaaccgaacgaactattcaaaccaacacgcctctaaacaacgcaacgacgattcaaaacgataaacgataaacgcacgccgataaaaaaaaaaaaaaaaaaaaaaaaataaaaaaaaaatctaaactatatctatttaaacgaataaaaaaaaaacgaacgaaaaaaataaacaaaaaaaaacgtaaaaaataatcgcgatcgctcgctatatataaaaccaaaaaaaaaaacgtataaaataataaaaaaaacgtctatccaaaaaacaattaaataaaaaatcgcgaacgctaacgcataatcctaaactatttctacgacaaccgacgaataaacaaaaaaaacgcacgtacctaaaaaacgacgacgttttaaaaacttacttcaaaaaaactaaaatctaaaaaacgaacaaaaactcaaaacaaaaaacgaccaaaaatactcc

SEQ ID NO: 38829 - DNA, 608 bp, Artificial Sequence
  chemically treated genomic DNA (Homo sapiens) CpG-island No: 38829
ttttggtcggcgtttgtttgggttcggtgcgtaatcgacggatcgcgcgggcggagcgggcgttaagtgaacggagtcggttggcgttggcgtggacgttttcgcgtttttatttcggatttaaagggttcgcgtcgggtcggtcgtcgtcggcgtacgttttagttttcgcgttttcgttcgtcgaatttcgtagggcgtgcgtttatcgcgttttaggagtagcggtttgattgtttcgttcgcgtttttttttgtttcggcgcgattttcgcgttggagatagtaggtagggcgcgcggggaggttttacgtcgtttcggtatttgtcggggttcggtttcggtttcgggttttagcgggatcgtagggtgttttgttgggtgtcggggtaggtcgtgttaacggtggcggggggcgggtggtaggtgacgggtggcgtgtggcgggtggcgggcggcgggcggcgggtggaaggcgagtacgcgttcggtttttgtcgtcgggggaggggattaaggtagggttaggcgttcgcggtcggagtggggtttggcgtttcggcgatcgtcgtcgtcgttttcgttagtatagtggtgagtattttt

SEQ ID NO: 38830 - DNA, 608 bp, Artificial Sequence
  chemically treated genomic DNA (Homo sapiens) CpG-island No: 38830
aaaaatactcaccactatactaacgaaaacgacgacgacgatcgccgaaacgccaaaccccactccgaccgcgaacgcctaaccctaccttaatcccctcccccgacgacaaaaaccgaacgcgtactcgccttccacccgccgcccgccgcccgccacccgccacacgccacccgtcacctaccacccgccccccgccaccgttaacacgacctaccccgacacccaacaaaacaccctacgatcccgctaaaacccgaaaccgaaaccgaaccccgacaaataccgaaacgacgtaaaacctccccgcgcgccctacctactatctccaacgcgaaaatcgcgccgaaacaaaaaaaaacgcgaacgaaacaatcaaaccgctactcctaaaacgcgataaacgcacgccctacgaaattcgacgaacgaaaacgcgaaaactaaaacgtacgccgacgacgaccgacccgacgcgaaccctttaaatccgaaataaaaacgcgaaaacgtccacgccaacgccaaccgactccgttcacttaacgcccgctccgcccgcgcgatccgtcgattacgcaccgaacccaaacaaacgccgaccaaaa

SEQ ID NO: 38831 - DNA, 608 bp, Artificial Sequence
  chemically treated genomic DNA (Homo sapiens) CpG-island No: 38831
ggggatatttattattatattaacgaggacgacggcgacggtcgtcgggacgttagattttatttcgatcgcggacgtttagttttgttttgattttttttttcgacggtaggggtcgggcgcgtgttcgttttttattcgtcgttcgtcgttcgttattcgttatacgttattcgttatttgttattcgtttttcgttatcgttggtacgatttatttcgatatttaataaagtattttgcgatttcgttgggattcggagtcggagtcggatttcgataggtatcggagcggcgtggaattttttcgcgcgttttgtttgttgtttttaacgcggggatcgcgtcggggtaggaggaggcgcgggcgaaatagttaggtcgttgtttttaggacgcggtgggcgtacgttttgcggggttcggcgagcggaggcgcgggggttggggcgtgcgtcggcggcggtcggttcgacgcggattttttgggttcggggtggggacgcgggggcgtttacgttaacgttagtcggtttcgtttatttggcgttcgtttcgttcgcgcggttcgtcggttgcgtatcgaatttagataggcgtcggttaagg

SEQ ID NO: 38832 - DNA, 608 bp, Artificial Sequence
  chemically treated genomic DNA (Homo sapiens) CpG-island No: 38832
ccttaaccgacgcctatctaaattcgatacgcaaccgacgaaccgcgcgaacgaaacgaacgccaaataaacgaaaccgactaacgttaacgtaaacgcccccgcgtccccaccccgaacccaaaaaatccgcgtcgaaccgaccgccgccgacgcacgccccaacccccgcgcctccgctcgccgaaccccgcaaaacgtacgcccaccgcgtcctaaaaacaacgacctaactatttcgcccgcgcctcctcctaccccgacgcgatccccgcgttaaaaacaacaaacaaaacgcgcgaaaaaattccacgccgctccgatacctatcgaaatccgactccgactccgaatcccaacgaaatcgcaaaatactttattaaatatcgaaataaatcgtaccaacgataacgaaaaacgaataacaaataacgaataacgtataacgaataacgaacgacgaacgacgaataaaaaacgaacacgcgcccgacccctaccgtcgaaaaaaaaaatcaaaacaaaactaaacgtccgcgatcgaaataaaatctaacgtcccgacgaccgtcgccgtcgtcctcgttaatataataataaatatcccc

SEQ ID NO: 38833 - DNA, 627 bp, Artificial Sequence
  chemically treated genomic DNA (Homo sapiens) CpG-island No: 38833
aggtacgttcgttttttttgtttattcgtcggttgtcgtagaaatagtttaggattatgcgttagcgttcgcgattttttattaattgtttttcggatagacgttttttttattattttatacgtttttttttttggttttatatatagcgagcgatcgcgattattttttacgtttttttttgtttatttttttcgttcgttttttttttattcgtttaaatagatatagtttagattttttttttatttttttttttttttttttttttttatcggtttgcgtttatcgtttatcgttttgaatcgtcgttgcgttgtttagaggcgttttggtttgaatagttcgttcggttttattttttaatttttgatcgttgagtagtagcgagcgattcgttcgtggagtcgtatatacgttttttattagaggtacgttatttagtattttgttttttttttcgatttttcggatttcggtcgcgtattttattttgtcgatattttagttaggtcgtcgattttatttcgttatttgtgtttttttttcgttaatatttgtttgtcggtttatttgtagttcggacgtttgtcggttagaggtagcgggaattttgtatatagtcgg

SEQ ID NO: 38834 - DNA, 627 bp, Artificial Sequence
  chemically treated genomic DNA (Homo sapiens) CpG-island No: 38834
ccgactatatacaaaattcccgctacctctaaccgacaaacgtccgaactacaaataaaccgacaaacaaatattaacgaaaaaaaaacacaaataacgaaataaaatcgacgacctaactaaaatatcgacaaaataaaatacgcgaccgaaatccgaaaaatcgaaaaaaaaaacaaaatactaaataacgtacctctaataaaaaacgtatatacgactccacgaacgaatcgctcgctactactcaacgatcaaaaattaaaaaataaaaccgaacgaactattcaaaccaaaacgcctctaaacaacgcaacgacgattcaaaacgataaacgataaacgcaaaccgataaaaaaaaaaaaaaaaaaaaaaaaataaaaaaaaaatctaaactatatctatttaaacgaataaaaaaaaaacgaacgaaaaaaataaacaaaaaaaaacgtaaaaaataatcgcgatcgctcgctatatataaaaccaaaaaaaaaaacgtataaaataataaaaaaaacgtctatccgaaaaacaattaataaaaaatcgcgaacgctaacgcataatcctaaactatttctacgacaaccgacgaataaacaaaaaaaacgaacgtacct

SEQ ID NO: 38835 - DNA, 627 bp, Artificial Sequence
  chemically treated genomic DNA (Homo sapiens) CpG-island No: 38835
tcggttgtgtgtagggttttcgttgtttttggtcggtaggcgttcgggttgtaggtgggtcggtaggtaggtgttagcgggaagggagtataggtagcgaggtgggatcggcgatttggttagggtgtcggtagaatggaatgcgcggtcggggttcgaggggtcggaggaaaggataggatgttggatggcgtgtttttggtgggagacgtgtgtgcggttttacgagcgagtcgttcgttgttgtttagcggttagaagttggagggtgaaatcgggcgggttgtttaggttaggacgtttttgggtagcgtagcggcgatttaaggcggtgggcggtgggcgtaggtcggtgggaggaaggagggaaaaggaggaataggggaagaatttgggttgtgtttgtttgggcgagtgaggagaaggcgggcggaggagataggtagggaagagcgtggaaggtggtcgcggtcgttcgttgtgtgtggggttagggaagagggcgtgtgaggtggtggggagggcgtttgttcgaagggtaattggtagagggtcgcgggcgttggcgtatggttttgggttgtttttgcgatagtcggcgggtgggtaggaagaacggacgtgttt

SEQ ID NO: 38836 - DNA, 627 bp, Artificial Sequence
  chemically treated genomic DNA (Homo sapiens) CpG-island No: 38836
aaacacgtccgttcttcctacccacccgccgactatcgcaaaaacaacccaaaaccatacgccaacgcccgcgaccctctaccaattacccttcgaacaaacgccctccccaccacctcacacgccctcttccctaaccccacacacaacgaacgaccgcgaccaccttccacgctcttccctacctatctcctccgcccgccttctcctcactcgcccaaacaaacacaacccaaattcttcccctattcctccttttccctccttcctcccaccgacctacgcccaccgcccaccgccttaaatcgccgctacgctacccaaaaacgtcctaacctaaacaacccgcccgatttcaccctccaacttctaaccgctaaacaacaacgaacgactcgctcgtaaaaccgcacacacgtctcccaccaaaaacacgccatccaacatcctatcctttcctccgacccctcgaaccccgaccgcgcattccattctaccgacaccctaaccaaatcgccgatcccacctcgctacctatactcccttcccgctaacacctacctaccgacccacctacaacccgaacgcctaccgaccaaaaacaacgaaaaccctacacacaaccga

SEQ ID NO: 38837 - DNA, 551 bp, Artificial Sequence
  chemically treated genomic DNA (Homo sapiens) CpG-island No: 38837
gtcggggttttttttttcggtcgtggtggtcgggtttcgtggcggcgtggcgcgtgggggtcgttttttcgcggtcggtcgtttttcgttggcgttttttcgtttcgcgtggcgttttcgcggggggtcgtttttcgtttttttcggtttcgcgttcgcgtcggggggtcgtttttttcgtttcggcgggttttggggtgggcgtggggttttttttcgtgggttcgtcgttgggttcgttttttttcgttcggggcgtttcggtttgggcggttttttcgggggtgttgtcgttcggggtcgttttttttcgtttggggcgcgttgcggcgttcgttgtgttcgcggggcgggtttgtcggtgtgtcggttgcgtcgcgtcggggttcgttttcgtttttttcggtgttttcgtttgttcggtcgtgcgcggcgttggggtcgtgtcgtcgcggcgggggcgtttcgggggcgcgcgcggacggtcgtttcgtttttagtttaggtcgtgttcgatcgcgcgggggttaatacggtaggcgcgttatcgg

SEQ ID NO: 38838 - DNA, 551 bp, Artificial Sequence
  chemically treated genomic DNA (Homo sapiens) CpG-island No: 38838
ccgataacgcgcctaccgtattaacccccgcgcgatcgaacacgacctaaactaaaaacgaaacgaccgtccgcgcgcgcccccgaaacgcccccgccgcgacgacacgaccccaacgccgcgcacgaccgaacaaacgaaaacaccgaaaaaaacgaaaacgaaccccgacgcgacgcaaccgacacaccgacaaacccgccccgcgaacacaacgaacgccgcaacgcgccccaaacgaaaaaaaacgaccccgaacgacaacacccccgaaaaaaccgcccaaaccgaaacgccccgaacgaaaaaaaacgaacccaacgacgaacccacgaaaaaaaaccccacgcccaccccaaaacccgccgaaacgaaaaaaacgaccccccgacgcgaacgcgaaaccgaaaaaaacgaaaaacgaccccccgcgaaaacgccacgcgaaacgaaaaaacgccaacgaaaaacgaccgaccgcgaaaaaacgacccccacgcgccacgccgccacgaaacccgaccaccacgaccgaaaaaaaaaaccccgac

SEQ ID NO: 38839 - DNA, 551 bp, Artificial Sequence
  chemically treated genomic DNA (Homo sapiens) CpG-island No: 38839
tcggtggcgcgtttgtcgtgttggttttcgcgcggtcggatacgatttggattagggacggggcggtcgttcgcgcgcgttttcggggcgttttcgtcgcggcggtacggttttagcgtcgcgtacggtcggatagacgggggtatcggggggggcgggggcgggtttcgacgcggcgtagtcgatatatcggtaggttcgtttcgcggatataacgaacgtcgtagcgcgttttaggcgggggggggcggtttcgggcgatagtattttcgagggagtcgtttaggtcgaggcgtttcgggcggaggggggcggatttagcgacgggtttacggaggagagttttacgtttattttaggattcgtcggaacggagggggcggtttttcggcgcgggcgcgaaatcgaggagagcgagagacggtttttcgcgagggcgttacgcggagcgaagaagcgttagcggagggcgatcggtcgcggagagacgatttttacgcgttacgtcgttacgaggttcggttattacggtcgggaggagaggtttcgat

SEQ ID NO: 38840 - DNA, 551 bp, Artificial Sequence
  chemically treated genomic DNA (Homo sapiens) CpG-island No: 38840
atcgaaacctctcctcccgaccgtaataaccgaacctcgtaacgacgtaacgcgtaaaaatcgtctctccgcgaccgatcgccctccgctaacgcttcttcgctccgcgtaacgccctcgcgaaaaaccgtctctcgctctcctcgatttcgcgcccgcgccgaaaaaccgccccctccgttccgacgaatcctaaaataaacgtaaaactctcctccgtaaacccgtcgctaaatccgcccccctccgcccgaaacgcctcgacctaaacgactccctcgaaaatactatcgcccgaaaccgcccccccccgcctaaaacgcgctacgacgttcgttatatccgcgaaacgaacctaccgatatatcgactacgccgcgtcgaaacccgcccccgccccccccgatacccccgtctatccgaccgtacgcgacgctaaaaccgtaccgccgcgacgaaaacgccccgaaaacgcgcgcgaacgaccgccccgtccctaatccaaatcgtatccgaccgcgcgaaaaccaacacgacaaacgcgccaccga

SEQ ID NO: 38841 - DNA, 664 bp, Artificial Sequence
  chemically treated genomic DNA (Homo sapiens) CpG-island No: 38841
ggtcggtcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtgttgttggggtcgaatcgtgaaacgttgttgtgcggtgtgaaagcgttgtttgttcggtatgaggttttttggtttggtgatcggatttgtgggggtttggcggttgtatcgttttttggttcgtttttcgttcgtttacgtttttttattggttattttgtttatttgt

SEQ ID NO: 38842 - DNA, 664 bp, Artificial Sequence
  chemically treated genomic DNA (Homo sapiens) CpG-island No: 38842
acaaataaacaaaataaccaataaaaaaacgtaaacgaacgaaaaacgaaccaaaaaacgatacaaccgccaaacccccacaaatccgatcaccaaaccaaaaaacctcataccgaacaaacaacgctttcacaccgcacaacaacgtttcacgattcgaccccaacaacaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacgaccgacc

SEQ ID NO: 38843 - DNA, 664 bp, Artificial Sequence
  chemically treated genomic DNA (Homo sapiens) CpG-island No: 38843
atagataagtaaagtgattaatgaaggaacgtgagcgagcggagagcggattagagaacgatatagtcgttaggtttttatagattcggttattaaattaagaagttttatgtcgggtagatagcgtttttatatcgtataataacgttttacggttcgattttagtaatatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacggtcggtt

SEQ ID NO: 38844 - DNA, 664 bp, Artificial Sequence
  chemically treated genomic DNA (Homo sapiens) CpG-island No: 38844
aaccgaccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgatattactaaaatcgaaccgtaaaacgttattatacgatataaaaacgctatctacccgacataaaacttcttaatttaataaccgaatctataaaaacctaacgactatatcgttctctaatccgctctccgctcgctcacgttccttcattaatcactttacttatctat

SEQ ID NO: 38845 - DNA, 726 bp, Artificial Sequence
  chemically treated genomic DNA (Homo sapiens) CpG-island No: 38845
tttatgtcgtcgttttttttttttttttcggttttttttgtttttttgtggttttttttatttgtgcgggattatttatcgttcgttttttttttagtacgtttatttagtatgtttagtattgtatgcgatgttaatagtgttaacggtatagtatttattttttgcgttttggtttcgttttcgtcgttatttattattttttttttgcgcggtttcgtatttttcggcgttcgttcgcgttgttttcgtttcggtcggttttcgttgtttcgttcgcgttttttttcgtcgtcggttagtcgttttgtatttgtcgtttcgttttcggtcgcgttcgcgtgtcgttttcgcgttcgttcgtttcgggtgcggtttttcgttcgcgggttgttcggcggggtcgtcggttcgtttgtcgttgtcgatggtcgcgttttgttttgttcgcgggtttttttcgcgggtcgcgtttcggtgtgttcgtgttttggcgttttgtgcggcgtttttttgtcgcgtttgttttatcgttacgtcgttattttcgttgtttttgtttggtcgcgtttgtttgcgtatcgtgcgcgcgatgtcggtttcgtttcgtggtttttgcgcgttttatgtcgtcgagtcgttttcgttttttgtcgttattatcgtttttcgatcgtttgtttgttcgtttcgttgtttttgtttttgtttgcgtcggtttttttt

SEQ ID NO: 38846 - DNA, 726 bp, Artificial Sequence
  chemically treated genomic DNA (Homo sapiens) CpG-island No: 38846
aaaaaaaaccgacgcaaacaaaaacaaaaacaacgaaacgaacaaacaaacgatcgaaaaacgataataacgacaaaaaacgaaaacgactcgacgacataaaacgcgcaaaaaccacgaaacgaaaccgacatcgcgcgcacgatacgcaaacaaacgcgaccaaacaaaaacaacgaaaataacgacgtaacgataaaacaaacgcgacaaaaaaacgccgcacaaaacgccaaaacacgaacacaccgaaacgcgacccgcgaaaaaaacccgcgaacaaaacaaaacgcgaccatcgacaacgacaaacgaaccgacgaccccgccgaacaacccgcgaacgaaaaaccgcacccgaaacgaacgaacgcgaaaacgacacgcgaacgcgaccgaaaacgaaacgacaaatacaaaacgactaaccgacgacgaaaaaaaacgcgaacgaaacaacgaaaaccgaccgaaacgaaaacaacgcgaacgaacgccgaaaaatacgaaaccgcgcaaaaaaaaaataataaataacgacgaaaacgaaaccaaaacgcaaaaaataaatactataccgttaacactattaacatcgcatacaatactaaacatactaaataaacgtactaaaaaaaaaacgaacgataaataatcccgcacaaataaaaaaaaccacaaaaaaacaaaaaaaaccgaaaaaaaaaaaaaaaacgacgacataaa

SEQ ID NO: 38847 - DNA, 726 bp, Artificial Sequence
  chemically treated genomic DNA (Homo sapiens) CpG-island No: 38847
aagggggatcgacgtagataagagtaggaatagcggagcgagtaggtaggcggtcgggaggcgatgatggcgatagggagcggaggcggttcgacggtatggggcgcgtagaagttacgagacgaggtcggtatcgcgcgtacggtgcgtaggtaagcgcgattaggtaggagtaacggaagtagcggcgtggcggtggagtaggcgcgataaggaggcgtcgtatagaacgttaggatacggatatatcgaagcgcggttcgcggggggggttcgcgggtagggtaggacgcgattatcgatagcgataagcgagtcggcggtttcgtcggatagttcgcgagcggagagtcgtattcgagacgggcgggcgcgagagcggtacgcgggcgcggtcgggggcgaggcggtaggtgtagggcggttgatcgacggcggagaggaacgcgagcgagatagcgagagtcggtcggggcgggggtagcgcgagcgggcgtcgggaagtacgagatcgcgtagagaggaggtggtgagtggcgacgaggacgggattagagcgtaagaagtaggtgttatgtcgttggtattgttagtatcgtatgtagtattgaatatattgagtaaacgtgttgagggagaggcggacggtgagtggtttcgtatagatggagagagttataggagggtaggaggagtcgagagagaaaggaggaacgacgatataga

SEQ ID NO: 38848 - DNA, 726 bp, Artificial Sequence
  chemically treated genomic DNA (Homo sapiens) CpG-island No: 38848
tctatatcgtcgttcctcctttctctctcgactcctcctaccctcctataactctctccatctatacgaaaccactcaccgtccgcctctccctcaacacgtttactcaatatattcaatactacatacgatactaacaataccaacgacataacacctacttcttacgctctaatcccgtcctcgtcgccactcaccacctcctctctacgcgatctcgtacttcccgacgcccgctcgcgctacccccgccccgaccgactctcgctatctcgctcgcgttcctctccgccgtcgatcaaccgccctacacctaccgcctcgcccccgaccgcgcccgcgtaccgctctcgcgcccgcccgtctcgaatacgactctccgctcgcgaactatccgacgaaaccgccgactcgcttatcgctatcgataatcgcgtcctaccctacccgcgaaccccccccgcgaaccgcgcttcgatatatccgtatcctaacgttctatacgacgcctccttatcgcgcctactccaccgccacgccgctacttccgttactcctacctaatcgcgcttacctacgcaccgtacgcgcgataccgacctcgtctcgtaacttctacgcgccccataccgtcgaaccgcctccgctccctatcgccatcatcgcctcccgaccgcctacctactcgctccgctattcctactcttatctacgtcgatccccctt

SEQ ID NO: 38849 - DNA, 904 bp, Artificial Sequence
  chemically treated genomic DNA (Homo sapiens) CpG-island No: 38849
cgttagcgtttttcgcgcggcgtcgggggcggtttcgggattgggggtggtgttttgggagttgtgtggtcgcgtgcgcgtttcgtcggggttttggaggtttttgggcgcgtgcgcgggcggtcgttatttgcggtcgagttagggagttagagggcgtagagggtagcgggtttgagtagtatgaggttcggaggggagcggttcgtggaagggggcgcgtgtaatggtcgtttcgagttggagttattgaagttgcgttcggcggagtgtatcgacgaggcggtcgagcggttgggggttttgagtcgcgcgatttggagttagttcgagttggtttacgaggagtattatgtttatcgcgtgttgacgtattttttcgagcgggagtcgttcgcggttttttgggtagtgtagtcgtattattagttgtttacggtttttcgcgtcgagtgggagtcgtcggaggttcgggtatcgagcgttacgttacgttcgttgtatttgggttttttttgcgagtacgacgcgttgttcggtatcggttacgtttgcggttataattttatcgttgaggtcggggcggcggtcgcgttgggcgtgaggggggttttagagggtttttttaggtcgttttcgttcgtgaaggtgaggtggggttcgggtgcgggattttattcgattgttcgggtcgggggcgattcgggaagggcgggattttcgtgcgtttcgcgcgtttcggtgttttttcgttcggggtaggtgtgtgtgggatcgcgttaaatttgcggttttcgtttcggcgtaggagtagagttgaatttttagttaaagttagttcgcgttgtcgatttggcgatattttgtagattattgtttttttttttttagttataaatagttt

SEQ ID NO: 38850 - DNA, 904 bp, Artificial Sequence
  chemically treated genomic DNA (Homo sapiens) CpG-island No: 38850
aaactatttataactaaaaaaaaaaaaacaataatctacaaaatatcgccaaatcgacaacgcgaactaactttaactaaaaattcaactctactcctacgccgaaacgaaaaccgcaaatttaacgcgatcccacacacacctaccccgaacgaaaaaacaccgaaacgcgcgaaacgcacgaaaatcccgcccttcccgaatcgcccccgacccgaacaatcgaataaaatcccgcacccgaaccccacctcaccttcacgaacgaaaacgacctaaaaaaaccctctaaaacccccctcacgcccaacgcgaccgccgccccgacctcaacgataaaattataaccgcaaacgtaaccgataccgaacaacgcgtcgtactcgcaaaaaaaacccaaatacaacgaacgtaacgtaacgctcgatacccgaacctccgacgactcccactcgacgcgaaaaaccgtaaacaactaataatacgactacactacccaaaaaaccgcgaacgactcccgctcgaaaaaatacgtcaacacgcgataaacataatactcctcgtaaaccaactcgaactaactccaaatcgcgcgactcaaaacccccaaccgctcgaccgcctcgtcgatacactccgccgaacgcaacttcaataactccaactcgaaacgaccattacacgcgcccccttccacgaaccgctcccctccgaacctcatactactcaaacccgctaccctctacgccctctaactccctaactcgaccgcaaataacgaccgcccgcgcacgcgcccaaaaacctccaaaaccccgacgaaacgcgcacgcgaccacacaactcccaaaacaccacccccaatcccgaaaccgcccccgacgccgcgcgaaaaacgctaacg

SEQ ID NO: 38851 - DNA, 904 bp, Artificial Sequence
  chemically treated genomic DNA (Homo sapiens) CpG-island No: 38851
gagttgtttataattagagaggaggaaataataatttgtaagatgtcgttaggtcggtaacgcgaattgattttgattgggggtttagttttgtttttgcgtcgaggcgaggatcgtaggtttagcgcggttttatatatatttgtttcgggcgggagggtatcgaggcgcgcgggacgtacgagagtttcgtttttttcgggtcgttttcgattcgggtagtcggatagggtttcgtattcgggttttattttatttttacgggcggaggcggtttggggaggttttttaaggttttttttacgtttagcgcggtcgtcgtttcgattttagcgatgaggttgtggtcgtaggcgtggtcgatgtcgggtagcgcgtcgtattcgtagaggaagtttaggtgtagcgggcgtggcgtggcgttcggtgttcgggttttcggcggtttttattcggcgcggaaggtcgtgggtagttggtagtgcggttgtattgtttaggaggtcgcgggcggttttcgttcgaagaagtgcgttagtacgcggtgggtatggtgtttttcgtaggttagttcgggttggttttagatcgcgcggtttagggtttttagtcgttcggtcgtttcgtcgatgtatttcgtcgagcgtagttttagtagttttagttcggagcggttattgtacgcgtttttttttacgggtcgttttttttcgggttttatgttgtttaagttcgttgttttttgcgttttttggttttttggttcggtcgtaggtagcgatcgttcgcgtacgcgtttagaggtttttaggatttcggcggagcgcgtacgcggttatatagtttttagggtattatttttagtttcggggtcgttttcggcgtcgcgcgggaaacgttggcg

SEQ ID NO: 38852 - DNA, 904 bp, Artificial Sequence
  chemically treated genomic DNA (Homo sapiens) CpG-island No: 38852
cgccaacgtttcccgcgcgacgccgaaaacgaccccgaaactaaaaataataccctaaaaactatataaccgcgtacgcgctccgccgaaatcctaaaaacctctaaacgcgtacgcgaacgatcgctacctacgaccgaaccaaaaaaccaaaaaacgcaaaaaacaacgaacttaaacaacataaaacccgaaaaaaaacgacccgtaaaaaaaaacgcgtacaataaccgctccgaactaaaactactaaaactacgctcgacgaaatacatcgacgaaacgaccgaacgactaaaaaccctaaaccgcgcgatctaaaaccaacccgaactaacctacgaaaaacaccatacccaccgcgtactaacgcacttcttcgaacgaaaaccgcccgcgacctcctaaacaatacaaccgcactaccaactacccacgaccttccgcgccgaataaaaaccgccgaaaacccgaacaccgaacgccacgccacgcccgctacacctaaacttcctctacgaatacgacgcgctacccgacatcgaccacgcctacgaccacaacctcatcgctaaaatcgaaacgacgaccgcgctaaacgtaaaaaaaaccttaaaaaacctccccaaaccgcctccgcccgtaaaaataaaataaaacccgaatacgaaaccctatccgactacccgaatcgaaaacgacccgaaaaaaacgaaactctcgtacgtcccgcgcgcctcgataccctcccgcccgaaacaaatatatataaaaccgcgctaaacctacgatcctcgcctcgacgcaaaaacaaaactaaacccccaatcaaaatcaattcgcgttaccgacctaacgacatcttacaaattattatttcctcctctctaattataaacaactc

SEQ ID NO: 38853 - DNA, 1061 bp, Artificial Sequence
  chemically treated genomic DNA (Homo sapiens) CpG-island No: 38853
ggtcgcggaggttgagcgggggcgcggttgaaagcggtttttattgattttattttcgtttagtcgtagtttcgttattatttttgggttttttaattttcggcgttttcgtcgcggttttaagtttttttttggttttcgtttttttgatatatattggttttcgtcgttttttttttaaatttcgtcgtattttaggattttttatattcggattttatagggtttgggaacggtcgcgtttttgttttcggaattttcgcggtttttgggtcgggtcggcgtcgttttcgttttcggttcgtgcgtttaggttggcgtcgcgttgcgttttttttgcgtcggtttttgcggttgcgcgttggcggggttgaggtcgaggggtgggggtcgcgtcgggggtcggcggagtttttgtggtggtagtagcggtagcgggagacggagcgagtttagcggtcgcgggtagattcggagggaacggaggaagcggttatgtttcgttatacgaggttttttaatatttttttgtttattaggaacgtcgcggacgttattaggtgaacggtcgcggttgtaggttgggggcgcggaggaggggcggggtaatagtcgcgtcgcggagtacggtcgaggttcggcggaggttcgggggagttgcgcggagttttttcgcgggtttaggttgcgttatttggggaggtgtgagttttcggattatttcgcggtttagggcggaattcgcgttttcgttttttcggttagtttttagtttcggcgtcgcgtatatcgtgtttcgggttcgcgtcgtttttcgcggtttagtatcgtagtcggcgggtcgtgggatacggggcgtttttttttcgagtttaggtcgtttttcgtcgggagtcgggagggtttgcgttttagcgagtgttcgcgttttagtttttttgtcgtcgtgtttcgataaaatcgcgcgtatttaatttttttagatggagaggaattggggttggtgagaacgttttgtattataatgcgtattcgggttttatagttttttttttttagtt

SEQ ID NO: 38854 - DNA, 1061 bp, Artificial Sequence
  chemically treated genomic DNA (Homo sapiens) CpG-island No: 38854
aactaaaaaaaaaaaactataaaacccgaatacgcattataatacaaaacgttctcaccaaccccaattcctctccatctaaaaaaattaaatacgcgcgattttatcgaaacacgacgacaaaaaaactaaaacgcgaacactcgctaaaacgcaaaccctcccgactcccgacgaaaaacgacctaaactcgaaaaaaaaacgccccgtatcccacgacccgccgactacgatactaaaccgcgaaaaacgacgcgaacccgaaacacgatatacgcgacgccgaaactaaaaactaaccgaaaaaacgaaaacgcgaattccgccctaaaccgcgaaataatccgaaaactcacacctccccaaataacgcaacctaaacccgcgaaaaaactccgcgcaactcccccgaacctccgccgaacctcgaccgtactccgcgacgcgactattaccccgcccctcctccgcgcccccaacctacaaccgcgaccgttcacctaataacgtccgcgacgttcctaataaacaaaaaaatattaaaaaacctcgtataacgaaacataaccgcttcctccgttccctccgaatctacccgcgaccgctaaactcgctccgtctcccgctaccgctactaccaccacaaaaactccgccgacccccgacgcgacccccacccctcgacctcaaccccgccaacgcgcaaccgcaaaaaccgacgcaaaaaaaacgcaacgcgacgccaacctaaacgcacgaaccgaaaacgaaaacgacgccgacccgacccaaaaaccgcgaaaattccgaaaacaaaaacgcgaccgttcccaaaccctataaaatccgaatataaaaaatcctaaaatacgacgaaatttaaaaaaaaaacgacgaaaaccaatatatatcaaaaaaacgaaaaccaaaaaaaaacttaaaaccgcgacgaaaacgccgaaaattaaaaaacccaaaaataataacgaaactacgactaaacgaaaataaaatcaataaaaaccgctttcaaccgcgcccccgctcaacctccgcgacc

SEQ ID NO: 38855 - DNA, 1061 bp, Artificial Sequence
  chemically treated genomic DNA (Homo sapiens) CpG-island No: 38855
aattgggggaaagaaattgtaaggttcgagtacgtattatggtataaaacgtttttattagttttaatttttttttatttaggagggttggatgcgcgcgattttatcggggtacggcgataaaggagttgaaacgcgggtattcgttggagcgtaaattttttcgattttcggcggggagcgatttgagttcgggagaggggcgtttcgtgttttacggttcgtcggttgcggtgttgaatcgcggaaagcgacgcgggttcgggatacgatgtgcgcggcgtcggggttgaaagttggtcgggagggcggaggcgcgagtttcgttttgggtcgcggagtagttcgagggtttatatttttttaagtggcgtagtttgggttcgcggggaggtttcgcgtagttttttcgagttttcgtcgggtttcggtcgtgtttcgcggcgcggttgttatttcgtttttttttcgcgtttttaatttgtagtcgcggtcgtttatttggtggcgttcgcgacgtttttgatgaatagggaggtgttggggggtttcgtgtagcgagatatgatcgtttttttcgtttttttcgggtttgttcgcggtcgttggattcgtttcgtttttcgttatcgttgttattattataggagtttcgtcggttttcggcgcgatttttatttttcggttttagtttcgttagcgcgtagtcgtagaggtcggcgtagagggggcgtagcgcggcgttagtttggacgtacgggtcgggggcgggggcggcgtcggttcgatttaggggtcgcgggaatttcgaagataggagcgcggtcgtttttaggttttatgggattcgggtatggggggttttggagtgcgacgggatttggggagggggcggcgagggttagtgtatgttaggagggcggaggttaagagggggtttgaggtcgcggcggggacgtcgggggttagaggatttagaggtggtggcggggttgcggttgggcggaggtggggttagtgagagtcgtttttaatcgcgttttcgtttagttttcgcggtt

SEQ ID NO: 38856 - DNA, 1061 bp, Artificial Sequence
  chemically treated genomic DNA (Homo sapiens) CpG-island No: 38856
aaccgcgaaaactaaacgaaaacgcgattaaaaacgactctcactaaccccacctccgcccaaccgcaaccccgccaccacctctaaatcctctaacccccgacgtccccgccgcgacctcaaaccccctcttaacctccgccctcctaacatacactaaccctcgccgccccctccccaaatcccgtcgcactccaaaaccccccatacccgaatcccataaaacctaaaaacgaccgcgctcctatcttcgaaattcccgcgacccctaaatcgaaccgacgccgcccccgcccccgacccgtacgtccaaactaacgccgcgctacgccccctctacgccgacctctacgactacgcgctaacgaaactaaaaccgaaaaataaaaatcgcgccgaaaaccgacgaaactcctataataataacaacgataacgaaaaacgaaacgaatccaacgaccgcgaacaaacccgaaaaaaacgaaaaaaacgatcatatctcgctacacgaaaccccccaacacctccctattcatcaaaaacgtcgcgaacgccaccaaataaacgaccgcgactacaaattaaaaacgcgaaaaaaaaacgaaataacaaccgcgccgcgaaacacgaccgaaacccgacgaaaactcgaaaaaactacgcgaaacctccccgcgaacccaaactacgccacttaaaaaaatataaaccctcgaactactccgcgacccaaaacgaaactcgcgcctccgccctcccgaccaactttcaaccccgacgccgcgcacatcgtatcccgaacccgcgtcgctttccgcgattcaacaccgcaaccgacgaaccgtaaaacacgaaacgcccctctcccgaactcaaatcgctccccgccgaaaatcgaaaaaatttacgctccaacgaatacccgcgtttcaactcctttatcgccgtaccccgataaaatcgcgcgcatccaaccctcctaaataaaaaaaaattaaaactaataaaaacgttttataccataatacgtactcgaaccttacaatttctttcccccaatt

SEQ ID NO: 38857 - DNA, 1413 bp, Artificial Sequence
  chemically treated genomic DNA (Homo sapiens) CpG-island No: 38857
ttcggtcgcgtagttgtttttggcggtcgaggaggcggcgggcgcgttttcgttcggtgggttttcgtcgttggcggcggtttcgttttcgtttttgaggttttgaaagatttgcgtgaagaagtgggggtcggcgttgagtcgtagtatttgcgggttgagtcgttggatgaggcgtaggtagcgttgttagaagcgttttttgtcgggttttacgaggaagggtttgagtgggtaggagatttcgttgtttatgtaggagtaggcgaggtagaggtaggtgaggaaggcggtttgtagttcggcggtcgacgttagttcgtttttacgtagcgattcgcggtatagtaggtatacgaatattaggtttgtaggcgtaatgaaggtttggttttgttagttttgtagtagtagcgagcggtttatatcgcggaattagtttattagttcgttcgggtttagttttttgaggcgatagtagcgtcggtatacgaagtcgtttagatagcgtagtagttcgtcggtggacgtttgtacgatgattcgtcgcggcgagtcgttaggtatcggcggcgttatttgcggggttgggggaggcggcggcggaggttttttttcgttcgagttcggcggttgagcggtcgcgttgtttttcgacggtggttcgtaggtggcggtagtcgcgggtacggtgggtattggtatcgttaggggtttggcggtgtcgtcgtcgtcggggggatttcggtttttgcggagaaggttttcgcggttgcgttgttggattagggggtcggggttcgtggatgtcggtttgggtgttatttttttgttgttttttttttttttggcggacgcggttattaggcgtttttaggtgagcgtcgagatgagtacggacggtcgtttgagtcggttttcgtttttgtcgtttttgtttattggcggcgtttcgtagttttttagcgtttcgtttttcgcgggcggcgtttttttttttttttcgggtagttcgtcgggttttcggtttttggtcgaggaggtaggcgaaagagatagtattgtgtttattttgtagagcggggtcggcgtttaggttttagcgggagtcgcgggcggcgtcgttgttattgtagtttcgggggattcggcggtggggggtttagtttcggttcgggcgcgcggattggcgggggaaggtggttgttaggcggtttcgttgttttaattttgagttgcgttagttgtagcgttagttttattttttgggttttttttttcgtcgcgtcgtgtttcgttttacgcggttaattcgttttcgagttgtatttttgatgggtagttttaatgattaatagattttcgtattttaattttaagtttcgttttaatttttatttttcgttttgagtt

SEQ ID NO: 38858 - DNA, 1413 bp, Artificial Sequence
  chemically treated genomic DNA (Homo sapiens) CpG-island No: 38858
aactcaaaacgaaaaataaaaattaaaacgaaacttaaaattaaaatacgaaaatctattaatcattaaaactacccatcaaaaatacaactcgaaaacgaattaaccgcgtaaaacgaaacacgacgcgacgaaaaaaaaaacccaaaaaataaaactaacgctacaactaacgcaactcaaaattaaaacaacgaaaccgcctaacaaccaccttcccccgccaatccgcgcgcccgaaccgaaactaaaccccccaccgccgaatcccccgaaactacaataacaacgacgccgcccgcgactcccgctaaaacctaaacgccgaccccgctctacaaaataaacacaatactatctctttcgcctacctcctcgaccaaaaaccgaaaacccgacgaactacccgaaaaaaaaaaaaaaacgccgcccgcgaaaaacgaaacgctaaaaaactacgaaacgccgccaataaacaaaaacgacaaaaacgaaaaccgactcaaacgaccgtccgtactcatctcgacgctcacctaaaaacgcctaataaccgcgtccgccaaaaaaaaaaaaaacaacaaaaaaataacacccaaaccgacatccacgaaccccgaccccctaatccaacaacgcaaccgcgaaaaccttctccgcaaaaaccgaaatccccccgacgacgacgacaccgccaaacccctaacgataccaatacccaccgtacccgcgactaccgccacctacgaaccaccgtcgaaaaacaacgcgaccgctcaaccgccgaactcgaacgaaaaaaaacctccgccgccgcctcccccaaccccgcaaataacgccgccgatacctaacgactcgccgcgacgaatcatcgtacaaacgtccaccgacgaactactacgctatctaaacgacttcgtataccgacgctactatcgcctcaaaaaactaaacccgaacgaactaataaactaattccgcgatataaaccgctcgctactactacaaaactaacaaaaccaaaccttcattacgcctacaaacctaatattcgtatacctactataccgcgaatcgctacgtaaaaacgaactaacgtcgaccgccgaactacaaaccgccttcctcacctacctctacctcgcctactcctacataaacaacgaaatctcctacccactcaaacccttcctcgtaaaacccgacaaaaaacgcttctaacaacgctacctacgcctcatccaacgactcaacccgcaaatactacgactcaacgccgacccccacttcttcacgcaaatctttcaaaacctcaaaaacgaaaacgaaaccgccgccaacgacgaaaacccaccgaacgaaaacgcgcccgccgcctcctcgaccgccaaaaacaactacgcgaccgaa

SEQ ID NO: 38859 - DNA, 1413 bp, Artificial Sequence
  chemically treated genomic DNA (Homo sapiens) CpG-island No: 38859
gatttagggcggagggtggggattggggcgggatttgaaattgaagtgcgagagtttattggttattggagttgtttattaggagtgtaattcgggagcggattggtcgcgtgaggcggggtacggcgcgacgaaaaaaggggtttaaggggtggggttgacgttgtagttggcgtagtttaggattagagtagcggagtcgtttagtagttattttttttcgttagttcgcgcgttcgggtcggggttaggttttttatcgtcgggtttttcggggttgtagtagtagcggcgtcgttcgcggttttcgttggggtttgggcgtcggtttcgttttgtaggatgggtatagtgttgtttttttcgtttgttttttcggttaagggtcggaggttcggcgggttgttcgaggagaagaagaaggcgtcgttcgcgggggacgaggcgttggggggttacggggcgtcgttagtgggtaagggcggtaaaggcgagagtcgatttaagcggtcgttcgtgtttatttcggcgtttatttggaagcgtttggtggtcgcgttcgttaagaagaagaaaggtagtaagaaggtgatatttaagtcggtatttacgggtttcgattttttggtttagtaacgtaatcgcgagaatttttttcgtaagggtcgggattttttcgacggcggcggtatcgttaagtttttggcggtgttagtgtttatcgtgttcgcggttgtcgttatttgcgagttatcgtcggggggtagcgcggtcgtttagtcgtcgggttcgggcgggggaaagttttcgtcgtcgttttttttagtttcgtaggtggcgtcgtcggtgtttggcggttcgtcgcggcgggttatcgtgtaggcgtttatcggcgagttgttgcgttgtttgggcgatttcgtgtgtcgacgttgttatcgttttaaggagttgagttcgggcgagttggtgggttggtttcgcggtgtggatcgttcgttgttgttgtagggttggtaagattaggtttttattacgtttgtaaatttggtgttcgtgtatttgttgtgtcgcgagtcgttgcgtggggacgagttggcgtcggtcgtcgagttgtaggtcgttttttttatttgtttttatttcgtttatttttatatgggtaacgagattttttatttatttaagttttttttcgtggagttcgataaggagcgtttttggtagcgttgtttgcgttttatttagcggtttagttcgtagatgttgcggtttaacgtcgatttttatttttttacgtaggttttttaagattttaagaacgagggcgaggtcgtcgttagcggcgggggtttatcgagcgggggcgcgttcgtcgttttttcggtcgttagggatagttgcgcggtcgga

SEQ ID NO: 38860 - DNA, 1413 bp, Artificial Sequence
  chemically treated genomic DNA (Homo sapiens) CpG-island No: 38860
tccgaccgcgcaactatccctaacgaccgaaaaaacgacgaacgcgcccccgctcgataaacccccgccgctaacgacgacctcgccctcgttcttaaaatcttaaaaaacctacgtaaaaaaataaaaatcgacgttaaaccgcaacatctacgaactaaaccgctaaataaaacgcaaacaacgctaccaaaaacgctccttatcgaactccacgaaaaaaaacttaaataaataaaaaatctcgttacccatataaaaataaacgaaataaaaacaaataaaaaaaacgacctacaactcgacgaccgacgccaactcgtccccacgcaacgactcgcgacacaacaaatacacgaacaccaaatttacaaacgtaataaaaacctaatcttaccaaccctacaacaacaacgaacgatccacaccgcgaaaccaacccaccaactcgcccgaactcaactccttaaaacgataacaacgtcgacacacgaaatcgcccaaacaacgcaacaactcgccgataaacgcctacacgataacccgccgcgacgaaccgccaaacaccgacgacgccacctacgaaactaaaaaaaacgacgacgaaaactttcccccgcccgaacccgacgactaaacgaccgcgctaccccccgacgataactcgcaaataacgacaaccgcgaacacgataaacactaacaccgccaaaaacttaacgataccgccgccgtcgaaaaaatcccgacccttacgaaaaaaattctcgcgattacgttactaaaccaaaaaatcgaaacccgtaaataccgacttaaatatcaccttcttactacctttcttcttcttaacgaacgcgaccaccaaacgcttccaaataaacgccgaaataaacacgaacgaccgcttaaatcgactctcgcctttaccgcccttacccactaacgacgccccgtaaccccccaacgcctcgtcccccgcgaacgacgccttcttcttctcctcgaacaacccgccgaacctccgacccttaaccgaaaaaacaaacgaaaaaaacaacactatacccatcctacaaaacgaaaccgacgcccaaaccccaacgaaaaccgcgaacgacgccgctactactacaaccccgaaaaacccgacgataaaaaacctaaccccgacccgaacgcgcgaactaacgaaaaaaaataactactaaacgactccgctactctaatcctaaactacgccaactacaacgtcaaccccaccccttaaaccccttttttcgtcgcgccgtaccccgcctcacgcgaccaatccgctcccgaattacactcctaataaacaactccaataaccaataaactctcgcacttcaatttcaaatcccgccccaatccccaccctccgccctaaatc

SEQ ID NO: 38861 - DNA, 585 bp, Artificial Sequence
  chemically treated genomic DNA (Homo sapiens) CpG-island No: 38861
cgggggagcggcgggcgaggttttttggtgggttgatgggtaggcgcgtcgacgggagcgttgcgggggtttaggcgttcgggtggtttcggggggttttaggcgggggcgttatgggcggcgtggtgcggttagggtcggcgggatttaagtgcggggcgggggtttagggttcgagttggtggcggcgcgttgtttttttcggcgtttcgattttgagttgtcgggttcgtcggtcgttaataaataggtcggttcgtttgttttggtaacgcggcggcggcggggggcggcgggcggcggggttgcgggtcgtcgggttgggttgggttggtcgggtcggcgggttgtagggtttcgcggttagtatttcggttcggcggttaggcggttcgggcggagcgggagttgttgtcgtttgcggcgtagttcggggtcgagtgagaggggaaatggaagagattcgggttcgggtttcgcgtagatcgtattttatttatgtttttgttttttgtgcgttcgatagcgaatttgtagtaagggtagtatagttttttttttttcgggcgggcggtttcggtatta

SEQ ID NO: 38862 - DNA, 585 bp, Artificial Sequence
  chemically treated genomic DNA (Homo sapiens) CpG-island No: 38862
taataccgaaaccgcccgcccgaaaaaaaaaaaactatactacccttactacaaattcgctatcgaacgcacaaaaaacaaaaacataaataaaatacgatctacgcgaaacccgaacccgaatctcttccatttcccctctcactcgaccccgaactacgccgcaaacgacaacaactcccgctccgcccgaaccgcctaaccgccgaaccgaaatactaaccgcgaaaccctacaacccgccgacccgaccaacccaacccaacccgacgacccgcaaccccgccgcccgccgccccccgccgccgccgcgttaccaaaacaaacgaaccgacctatttattaacgaccgacgaacccgacaactcaaaatcgaaacgccgaaaaaaacaacgcgccgccaccaactcgaaccctaaacccccgccccgcacttaaatcccgccgaccctaaccgcaccacgccgcccataacgcccccgcctaaaaccccccgaaaccacccgaacgcctaaacccccgcaacgctcccgtcgacgcgcctacccatcaacccaccaaaaaacctcgcccgccgctcccccg

SEQ ID NO: 38863 - DNA, 585 bp, Artificial Sequence
  chemically treated genomic DNA (Homo sapiens) CpG-island No: 38863
tagtgtcggggtcgttcgttcgagggggaggaggttgtgttgtttttgttgtaggttcgttgtcgagcgtataggaggtagggatatgggtagggtgcggtttgcgcggggttcgagttcggattttttttatttttttttttattcggtttcgggttgcgtcgtagacggtagtagttttcgtttcgttcgagtcgtttgatcgtcgggtcggggtgttaatcgcggggttttgtagttcgtcggttcggttagtttagtttagttcggcggttcgtagtttcgtcgttcgtcgtttttcgtcgtcgtcgcgttgttaaaataaacgggtcggtttatttattggcggtcggcgagttcggtagtttagagtcgaggcgtcgagggggatagcgcgtcgttattagttcgggttttgggttttcgtttcgtatttgagtttcgtcggttttggtcgtattacgtcgtttatggcgttttcgtttggagtttttcggagttattcggacgtttgagttttcgtagcgttttcgtcgacgcgtttgtttattagtttattaggagatttcgttcgtcgttttttcg

SEQ ID NO: 38864 - DNA, 585 bp, Artificial Sequence
  chemically treated genomic DNA (Homo sapiens) CpG-island No: 38864
cgaaaaaacgacgaacgaaatctcctaataaactaataaacaaacgcgtcgacgaaaacgctacgaaaactcaaacgtccgaataactccgaaaaactccaaacgaaaacgccataaacgacgtaatacgaccaaaaccgacgaaactcaaatacgaaacgaaaacccaaaacccgaactaataacgacgcgctatccccctcgacgcctcgactctaaactaccgaactcgccgaccgccaataaataaaccgacccgtttattttaacaacgcgacgacgacgaaaaacgacgaacgacgaaactacgaaccgccgaactaaactaaactaaccgaaccgacgaactacaaaaccccgcgattaacaccccgacccgacgatcaaacgactcgaacgaaacgaaaactactaccgtctacgacgcaacccgaaaccgaataaaaaaaaaaataaaaaaaatccgaactcgaaccccgcgcaaaccgcaccctacccatatccctacctcctatacgctcgacaacgaacctacaacaaaaacaacacaacctcctccccctcgaacgaacgaccccgacacta

SEQ ID NO: 38865 - DNA, 723 bp, Artificial Sequence
  chemically treated genomic DNA (Homo sapiens) CpG-island No: 38865
gttgacggaggttttcgggtttttttcgggatgtcgatgggatcgggcgagattttaggcgtgcgggcgaggtcgtaggtattcgatcgtttcgtttagtggtaatggttttttaagtgcgaggttgcggttacggtttcgaagggttcgggcgggggttgtaagttgggattggggtagagcgcggcggtggcggcggtagcggtggcggcggggttcgggttcggttagtaggagaagtcggcgggcgcgatttcggtcgaggcggttatgaggttgagtttggagaggtcggggaagggtagcggggcgaggtcggcgggtagtttgtagagcgcgtcgttttgggcggtcgcggcggcggtagtagttgcggcggcggtatgagcgtgcgcgggcggcggttggtaggtttgcgttaggttttggaagtcgaagcggtaggcgtagcgtttgttatgtattttgtttatgatgtttttgtcgtagtagtagcgtagggcgcggtttagtttgtcgtagtttatgttgggtttgtttttgcgttcgttttatcgtcgcgttatttcgttcgggttcgtgagtttgaattcgtcgtgatcgtttttttacgcgatgtagtcggcgttcgcgcggttagttagtagttttagtagaaattgttatagttggatttgttcgttgtttgtggggaggggggcggttagttataggcgggagcgg

SEQ ID NO: 38866 - DNA, 723 bp, Artificial Sequence
  chemically treated genomic DNA (Homo sapiens) CpG-island No: 38866
ccgctcccgcctataactaaccgcccccctccccacaaacaacgaacaaatccaactataacaatttctactaaaactactaactaaccgcgcgaacgccgactacatcgcgtaaaaaaacgatcacgacgaattcaaactcacgaacccgaacgaaataacgcgacgataaaacgaacgcaaaaacaaacccaacataaactacgacaaactaaaccgcgccctacgctactactacgacaaaaacatcataaacaaaatacataacaaacgctacgcctaccgcttcgacttccaaaacctaacgcaaacctaccaaccgccgcccgcgcacgctcataccgccgccgcaactactaccgccgccgcgaccgcccaaaacgacgcgctctacaaactacccgccgacctcgccccgctacccttccccgacctctccaaactcaacctcataaccgcctcgaccgaaatcgcgcccgccgacttctcctactaaccgaacccgaaccccgccgccaccgctaccgccgccaccgccgcgctctaccccaatcccaacttacaacccccgcccgaacccttcgaaaccgtaaccgcaacctcgcacttaaaaaaccattaccactaaacgaaacgatcgaatacctacgacctcgcccgcacgcctaaaatctcgcccgatcccatcgacatcccgaaaaaaacccgaaaacctccgtcaac

SEQ ID NO: 38867 - DNA, 723 bp, Artificial Sequence
  chemically treated genomic DNA (Homo sapiens) CpG-island No: 38867
tcgttttcgtttgtggttgatcgtttttttttttataggtagcggatagatttagttgtggtagtttttgttggagttgttggttgatcgcgcgaacgtcggttgtatcgcgtgggagggcggttacggcgagtttaagtttacggattcggacgaggtggcgcggcggtggggcgagcgtaagagtaagtttaatatgaattacgataagttgagtcgcgttttgcgttattattacgataagaatattatgagtaaggtgtatggtaagcgttacgtttatcgtttcgatttttagggtttggcgtaggtttgttagtcgtcgttcgcgtacgtttatgtcgtcgtcgtagttgttgtcgtcgtcgcggtcgtttaggacggcgcgttttataagttgttcgtcggtttcgtttcgttgttttttttcggtttttttaaatttaattttatggtcgtttcggtcggggtcgcgttcgtcggttttttttattggtcgggttcgggtttcgtcgttatcgttgtcgtcgttatcgtcgcgttttattttagttttagtttgtagttttcgttcgggtttttcggggtcgtggtcgtagtttcgtatttggggggttattattattagacggggcggtcgggtgtttgcggtttcgttcgtacgtttagagtttcgttcgattttatcggtatttcggggagggttcgggagttttcgttaat

SEQ ID NO: 38868 - DNA, 723 bp, Artificial Sequence
  chemically treated genomic DNA (Homo sapiens) CpG-island No: 38868
attaacgaaaactcccgaaccctccccgaaataccgataaaatcgaacgaaactctaaacgtacgaacgaaaccgcaaacacccgaccgccccgtctaataataataaccccccaaatacgaaactacgaccacgaccccgaaaaacccgaacgaaaactacaaactaaaactaaaataaaacgcgacgataacgacgacaacgataacgacgaaacccgaacccgaccaataaaaaaaaccgacgaacgcgaccccgaccgaaacgaccataaaattaaatttaaaaaaaccgaaaaaaaacaacgaaacgaaaccgacgaacaacttataaaacgcgccgtcctaaacgaccgcgacgacgacaacaactacgacgacgacataaacgtacgcgaacgacgactaacaaacctacgccaaaccctaaaaatcgaaacgataaacgtaacgcttaccatacaccttactcataatattcttatcgtaataataacgcaaaacgcgactcaacttatcgtaattcatattaaacttactcttacgctcgccccaccgccgcgccacctcgtccgaatccgtaaacttaaactcgccgtaaccgccctcccacgcgatacaaccgacgttcgcgcgatcaaccaacaactccaacaaaaactaccacaactaaatctatccgctacctataaaaaaaaaaacgatcaaccacaaacgaaaacga

SEQ ID NO: 38869 - DNA, 557 bp, Artificial Sequence
  chemically treated genomic DNA (Homo sapiens) CpG-island No: 38869
gttttcgagtcgtaattttcgcgtacgtttcgtgatttttatttttttataagcgtagttgttgttatatgagtttcgtaggtatgtcggttgcgttggttgttcgttgttaagcgcgcgggaaatggatttttgttgttgttagttgagtggttattttcgagtttcgtcgtacgtattttaattatttaggtttatatagtttaacgtattcgggatgagcgagttttaaggtattttgtagtattacgtttttagaggtcgtatgtattattggtgagcgattgggggaggttttgtgttgattgcgttgcgtattcggcgtaacgagtgcgagagtgcgttacgacgttttttagagcgggcgaggatagaagttggaataggtttgtagggtgtgtagttatgttttagcgtaagggtagatgtagaagtcgcgaagtgtaagagatgaggcgtcgatcgtcgttacggcgtatgaagagacggattgttcgttagttatttgtggtgcgagcgtttcgtatcgattgagcgtacgttgagcggttgtatgt

SEQ ID NO: 38870 - DNA, 557 bp, Artificial Sequence
  chemically treated genomic DNA (Homo sapiens) CpG-island No: 38870
acatacaaccgctcaacgtacgctcaatcgatacgaaacgctcgcaccacaaataactaacgaacaatccgtctcttcatacgccgtaacgacgatcgacgcctcatctcttacacttcgcgacttctacatctacccttacgctaaaacataactacacaccctacaaacctattccaacttctatcctcgcccgctctaaaaaacgtcgtaacgcactctcgcactcgttacgccgaatacgcaacgcaatcaacacaaaacctcccccaatcgctcaccaataatacatacgacctctaaaaacgtaatactacaaaataccttaaaactcgctcatcccgaatacgttaaactatataaacctaaataattaaaatacgtacgacgaaactcgaaaataaccactcaactaacaacaacaaaaatccatttcccgcgcgcttaacaacgaacaaccaacgcaaccgacatacctacgaaactcatataacaacaactacgcttataaaaaaataaaaatcacgaaacgtacgcgaaaattacgactcgaaaac

SEQ ID NO: 38871 - DNA, 557 bp, Artificial Sequence
  chemically treated genomic DNA (Homo sapiens) CpG-island No: 38871
gtatatagtcgtttagcgtgcgtttagtcggtgcgggacgttcgtattataggtggttagcgggtaattcgtttttttatacgtcgtaacggcgatcgacgttttattttttgtatttcgcgatttttatatttatttttgcgttgaagtatagttatatattttgtaaatttgttttagtttttgttttcgttcgttttggggggcgtcgtggcgtattttcgtattcgttgcgtcgggtgcgtagcgtagttagtataaggttttttttagtcgtttattaatagtatatacggtttttgaaagcgtgatattgtagagtattttagagttcgtttatttcgagtacgttggattgtatgggtttggataattggggtgcgtgcggcggggttcgggggtaattatttagttgataataatagggatttatttttcgcgcgtttaataacggataattaacgtagtcgatatatttacggaatttatatggtaataattacgtttgtggaggagtaggaattacgggacgtgcgcgggagttgcggttcgggggt

SEQ ID NO: 38872 - DNA, 557 bp, Artificial Sequence
  chemically treated genomic DNA (Homo sapiens) CpG-island No: 38872
acccccgaaccgcaactcccgcgcacgtcccgtaattcctactcctccacaaacgtaattattaccatataaattccgtaaatatatcgactacgttaattatccgttattaaacgcgcgaaaaataaatccctattattatcaactaaataattacccccgaaccccgccgcacgcaccccaattatccaaacccatacaatccaacgtactcgaaataaacgaactctaaaatactctacaatatcacgctttcaaaaaccgtatatactattaataaacgactaaaaaaaaccttatactaactacgctacgcacccgacgcaacgaatacgaaaatacgccacgacgccccccaaaacgaacgaaaacaaaaactaaaacaaatttacaaaatatataactatacttcaacgcaaaaataaatataaaaatcgcgaaatacaaaaaataaaacgtcgatcgccgttacgacgtataaaaaaacgaattacccgctaaccacctataatacgaacgtcccgcaccgactaaacgcacgctaaacgactatatac

SEQ ID NO: 38873 - DNA, 526 bp, Artificial Sequence
  chemically treated genomic DNA (Homo sapiens) CpG-island No: 38873
gaatttttacgttttatttttaagtaggttttgtagtttagttttcgcggttttttatagttagtcgatgttgcgtaagcgtcgtatttacgttttagtatatgcgtatttaggtgcgtcggtaggggacgcgtcggtatagtaaaaatggcggcggtattacgggtggcggcggtcggggtaaggtttagcgttttggcgagcggttttcgcgtcgcggttcgtagtttttgtagttaggttatttttgttaacgaacgtatcgaaaataagcgtcggatcgcgttgttgggagggggttaacgtcgtattgacgcgtagtataagcgagtgagttttgaggggtttaagtgagtttcgtttttggcgttcgcgatttattattgcgtgttcggtttgcggcgttcgaggtttttttgttaattcgtacggtgtttggaggggtcggagtaagggtgtttattttgaaaatttgtagcgtttttcgtggaggcgggtataattagtagaagtatttgtgtgtttt

SEQ ID NO: 38874 - DNA, 526 bp, Artificial Sequence
  chemically treated genomic DNA (Homo sapiens) CpG-island No: 38874
aaaacacacaaatacttctactaattatacccgcctccacgaaaaacgctacaaattttcaaaataaacacccttactccgacccctccaaacaccgtacgaattaacaaaaaaacctcgaacgccgcaaaccgaacacgcaataataaatcgcgaacgccaaaaacgaaactcacttaaacccctcaaaactcactcgcttatactacgcgtcaatacgacgttaaccccctcccaacaacgcgatccgacgcttattttcgatacgttcgttaacaaaaataacctaactacaaaaactacgaaccgcgacgcgaaaaccgctcgccaaaacgctaaaccttaccccgaccgccgccacccgtaataccgccgccatttttactataccgacgcgtcccctaccgacgcacctaaatacgcatatactaaaacgtaaatacgacgcttacgcaacatcgactaactataaaaaaccgcgaaaactaaactacaaaacctacttaaaaataaaacgtaaaaattc

SEQ ID NO: 38875 - DNA, 526 bp, Artificial Sequence
  chemically treated genomic DNA (Homo sapiens) CpG-island No: 38875
aaagtatataggtgtttttgttggttatattcgtttttacgagaaacgttataggtttttaaggtgaatatttttgtttcggtttttttaggtatcgtgcggattggtagggaggtttcggacgtcgtaagtcgggtacgtagtgataggtcgcggacgttaggggcgggatttatttaggttttttaggatttattcgtttgtgttgcgcgttaatacggcgttggtttttttttagtagcgcggttcggcgtttgttttcgatgcgttcgttaatagaggtggtttggttgtaaaggttgcggatcgcggcgcggagatcgttcgttagaacgttgagttttgtttcgatcgtcgttattcgtaatgtcgtcgttatttttgttgtgtcggcgcgttttttatcggcgtatttgagtacgtatgtgttaaagcgtgggtacggcgtttgcgtagtatcggttggttgtagggagtcgcgggggttggattatagaatttgtttgggagtaaggcgtgagagttt

SEQ ID NO: 38876 - DNA, 526 bp, Artificial Sequence
  chemically treated genomic DNA (Homo sapiens) CpG-island No: 38876
aaactctcacgccttactcccaaacaaattctataatccaacccccgcgactccctacaaccaaccgatactacgcaaacgccgtacccacgctttaacacatacgtactcaaatacgccgataaaaaacgcgccgacacaacaaaaataacgacgacattacgaataacgacgatcgaaacaaaactcaacgttctaacgaacgatctccgcgccgcgatccgcaacctttacaaccaaaccacctctattaacgaacgcatcgaaaacaaacgccgaaccgcgctactaaaaaaaaaccaacgccgtattaacgcgcaacacaaacgaataaatcctaaaaaacctaaataaatcccgcccctaacgtccgcgacctatcactacgtacccgacttacgacgtccgaaacctccctaccaatccgcacgatacctaaaaaaaccgaaacaaaaatattcaccttaaaaacctataacgtttctcgtaaaaacgaatataaccaacaaaaacacctatatacttt

SEQ ID NO: 38877 - DNA, 1062 bp, Artificial Sequence
  chemically treated genomic DNA (Homo sapiens) CpG-island No: 38877
gagttcgttcggagcgattatagagcgtagaacgcggcggtttgggcgttcggggcgggattcggagtttagtttagtttcgcggttcggtaggcggtttgtattcgagttttattttcggatacggaggcgtttttttaagtcgagttggtaggcgcgggagtaggtttcggtttcgtttgaggcgcggtacgtttttttcgggttgtagggttttttattttattttagtatagggcgcggaggcggcggcgacggtaaggacgacggtcgggtagcggtttttcggatttagtgtaagacgtcgcggcggcgacgaaggttgatgttgcggttggcggacgtcgtcgtcgcgttttttatatcggacgcggggtttagattgcgttttggtttttcgtttcgtgggttgtagttcgtagtttttcgaggtggcgaggcgggcgggagtttttaattcggaggggaaggtcggggaggaagtgcgcgggtcgtcgtcggcgggcgggagggggcggggggtaagttcggtcgggtcgcggcggcgtttttcgcgttttagtcgtatatttcggggttattagatttaagcgtcgtttttttattgttcggttattttttcggcgttatatatatagacgattttttcgtcgagtacgacggtcgtcgtcgtttttagtatttttcggtcgcggaaggtaagcgtttatatcgttaggtttcgtcgtcgtttagcgtatatagtaaggtttcgtcgtaggtttttttttcgtgtttcgtcgtttttatttcgattttacgcgttattttagttcggtagggttcgggttgttgcggttttaatggatttcgcgggttgtgtggcgttttaggtttttgttggcggcgacgacgatcgttattttaacgggtaaagttattgttattttcgagattttttcgtcgtcgtcgtcgttagcgttcgtacgtatgcgtagagtatatttttattttttttttttttttttttttttcgtttttttttttttttgttttttttttaataattttttttatagtttt

SEQ ID NO: 38878 - DNA, 1062 bp, Artificial Sequence
  chemically treated genomic DNA (Homo sapiens) CpG-island No: 38878
aaaactataaaaaaaattattaaaaaaaaaacaaaaaaaaaaaaaaacgaaaaaaaaaaaaaaaaaaaaaaaataaaaatatactctacgcatacgtacgaacgctaacgacgacgacgacgaaaaaatctcgaaaataacaataactttacccgttaaaataacgatcgtcgtcgccgccaacaaaaacctaaaacgccacacaacccgcgaaatccattaaaaccgcaacaacccgaaccctaccgaactaaaataacgcgtaaaatcgaaataaaaacgacgaaacacgaaaaaaaaacctacgacgaaaccttactatatacgctaaacgacgacgaaacctaacgatataaacgcttaccttccgcgaccgaaaaatactaaaaacgacgacgaccgtcgtactcgacgaaaaaatcgtctatatatataacgccgaaaaaataaccgaacaataaaaaaacgacgcttaaatctaataaccccgaaatatacgactaaaacgcgaaaaacgccgccgcgacccgaccgaacttaccccccgccccctcccgcccgccgacgacgacccgcgcacttcctccccgaccttcccctccgaattaaaaactcccgcccgcctcgccacctcgaaaaactacgaactacaacccacgaaacgaaaaaccaaaacgcaatctaaaccccgcgtccgatataaaaaacgcgacgacgacgtccgccaaccgcaacatcaaccttcgtcgccgccgcgacgtcttacactaaatccgaaaaaccgctacccgaccgtcgtccttaccgtcgccgccgcctccgcgccctatactaaaataaaataaaaaaccctacaacccgaaaaaaacgtaccgcgcctcaaacgaaaccgaaacctactcccgcgcctaccaactcgacttaaaaaaacgcctccgtatccgaaaataaaactcgaatacaaaccgcctaccgaaccgcgaaactaaactaaactccgaatcccgccccgaacgcccaaaccgccgcgttctacgctctataatcgctccgaacgaactc

SEQ ID NO: 38879 - DNA, 1062 bp, Artificial Sequence
  chemically treated genomic DNA (Homo sapiens) CpG-island No: 38879
gaggttgtggagggggttgttagaggagaagtaagggaaaagggaagcgaagggagaggaaaggggggaggggtgagagtgtgttttgcgtatgcgtgcgagcgttagcgacgacggcggcgggggagtttcggggatgatagtggttttgttcgttggggtaacggtcgtcgtcgtcgttagtagaggtttgaggcgttatatagttcgcgggatttattaaggtcgtagtagttcgggttttatcgagttggagtggcgcgtggagtcggggtgagggcggcgaggtacgggggaggggtttgcggcggggttttgttgtgtgcgttgggcggcggcggggtttggcggtgtgagcgtttgtttttcgcggtcggggagtgttgagggcggcggcggtcgtcgtgttcggcggaggagtcgtttgtgtgtgtggcgtcgaaaaaatggtcgggtagtgagggggcggcgtttgagtttggtgatttcggagtgtgcgattgaggcgcgaggggcgtcgtcgcggttcggtcgggtttgtttttcgttttttttcgttcgtcggcggcggttcgcgtatttttttttcggttttttttttcgggttgaggattttcgttcgtttcgttatttcggggaattgcgggttgtaatttacggggcggagagttagggcgtagtttgggtttcgcgttcgatatggagagcgcggcggcggcgttcgttagtcgtaatattaattttcgtcgtcgtcgcggcgttttgtattagattcgggaagtcgttgttcgatcgtcgtttttgtcgtcgtcgtcgttttcgcgttttgtattgggatggagtaagaggttttgtagttcgggagaagcgtgtcgcgttttagacggggtcggggtttgttttcgcgtttgttagttcgatttgaggaggcgttttcgtgttcggagatggagttcgagtgtaggtcgtttgtcgagtcgcggggttagattgagtttcgagtttcgtttcgagcgtttaagtcgtcgcgttttgcgttttgtggtcgtttcggacgaattt

SEQ ID NO: 38880 - DNA, 1062 bp, Artificial Sequence
  chemically treated genomic DNA (Homo sapiens) CpG-island No: 38880
aaattcgtccgaaacgaccacaaaacgcaaaacgcgacgacttaaacgctcgaaacgaaactcgaaactcaatctaaccccgcgactcgacaaacgacctacactcgaactccatctccgaacacgaaaacgcctcctcaaatcgaactaacaaacgcgaaaacaaaccccgaccccgtctaaaacgcgacacgcttctcccgaactacaaaacctcttactccatcccaatacaaaacgcgaaaacgacgacgacgacaaaaacgacgatcgaacaacgacttcccgaatctaatacaaaacgccgcgacgacgacgaaaattaatattacgactaacgaacgccgccgccgcgctctccatatcgaacgcgaaacccaaactacgccctaactctccgccccgtaaattacaacccgcaattccccgaaataacgaaacgaacgaaaatcctcaacccgaaaaaaaaaaccgaaaaaaaaatacgcgaaccgccgccgacgaacgaaaaaaaacgaaaaacaaacccgaccgaaccgcgacgacgcccctcgcgcctcaatcgcacactccgaaatcaccaaactcaaacgccgccccctcactacccgaccattttttcgacgccacacacacaaacgactcctccgccgaacacgacgaccgccgccgccctcaacactccccgaccgcgaaaaacaaacgctcacaccgccaaaccccgccgccgcccaacgcacacaacaaaaccccgccgcaaacccctcccccgtacctcgccgccctcaccccgactccacgcgccactccaactcgataaaacccgaactactacgaccttaataaatcccgcgaactatataacgcctcaaacctctactaacgacgacgacgaccgttaccccaacgaacaaaaccactatcatccccgaaactcccccgccgccgtcgtcgctaacgctcgcacgcatacgcaaaacacactctcacccctcccccctttcctctcccttcgcttcccttttcccttacttctcctctaacaaccccctccacaacctc

SEQ ID NO: 38881 - DNA, 548 bp, Artificial Sequence
  chemically treated genomic DNA (Homo sapiens) CpG-island No: 38881
  misc_feature (29)..(29): n is either a, c, g or t
  misc_feature (59)..(59): n is either a, c, g or t
  misc_feature (86)..(86): n is either a, c, g or t
  misc_feature (102)..(102): n is either a, c, g or t
  misc_feature (147)..(147): n is either a, c, g or t
  misc_feature (290)..(290): n is either a, c, g or t
  misc_feature (298)..(298): n is either a, c, g or t
  misc_feature (381)..(381): n is either a, c, g or t
  misc_feature (400)..(400): n is either a, c, g or t
  misc_feature (427)..(427): n is either a, c, g or t
  misc_feature (541)..(541): n is either a, c, g or t
gggtggtggtttttgtgggttggtggggnggggttttcggggcgtgttggggggcgcgnttggggtggtcgcggggttgcgttggngttttgtttggggggngggggggtggggggtttttgtggcggtcgcgcgtggtgcgtgggnggtggtgcggtgggtggcggggtcggggggttgggcggcgggggcgtcgtggttcgcgtcggtgtgggtcgttttgggggcggtcggcgtttgggttcgggttgttgttggtgggtgttgggtcggtcgcgtttcgcgttttngcgtttgncgtttttgttcgtcggtttgcgtgtgtttggggtcgttcggggcgcggcgtcgttcgcgggtcggtcgcgcgtcgttttgcgntggcgcgtgggcgtttcgnttttgggtcggcgcggtttgcgtcgtncgtgcgtgtcggggtcgttgcgtcgtggtcgttgtcgtttcggtcgggtcgttcggtggtggcggggttcgggtggcgtcgttggcgcgggttgtgttcgttttgtcggtgggntcgttcg

SEQ ID NO: 38882 - DNA, 548 bp, Artificial Sequence
  chemically treated genomic DNA (Homo sapiens) CpG-island No: 38882
  misc_feature (8)..(8): n is either a, c, g or t
  misc_feature (122)..(122): n is either a, c, g or t
  misc_feature (149)..(149): n is either a, c, g or t
  misc_feature (168)..(168): n is either a, c, g or t
  misc_feature (251)..(251): n is either a, c, g or t
  misc_feature (259)..(259): n is either a, c, g or t
  misc_feature (402)..(402): n is either a, c, g or t
  misc_feature (447)..(447): n is either a, c, g or t
  misc_feature (463)..(463): n is either a, c, g or t
  misc_feature (490)..(490): n is either a, c, g or t
  misc_feature (520)..(520): n is either a, c, g or t
cgaacgancccaccgacaaaacgaacacaacccgcgccaacgacgccacccgaaccccgccaccaccgaacgacccgaccgaaacgacaacgaccacgacgcaacgaccccgacacgcacgnacgacgcaaaccgcgccgacccaaaancgaaacgcccacgcgccancgcaaaacgacgcgcgaccgacccgcgaacgacgccgcgccccgaacgaccccaaacacacgcaaaccgacgaacaaaaacgncaaacgcnaaaacgcgaaacgcgaccgacccaacacccaccaacaacaacccgaacccaaacgccgaccgcccccaaaacgacccacaccgacgcgaaccacgacgcccccgccgcccaaccccccgaccccgccacccaccgcaccaccncccacgcaccacgcgcgaccgccacaaaaaccccccacccccccnccccccaaacaaaacnccaacgcaaccccgcgaccaccccaancgcgccccccaacacgccccgaaaaccccnccccaccaacccacaaaaaccaccaccc

SEQ ID NO: 38883 - DNA, 548 bp, Artificial Sequence
  chemically treated genomic DNA (Homo sapiens) CpG-island No: 38883
  misc_feature (8)..(8): n is either a, c, g or t
  misc_feature (122)..(122): n is either a, c, g or t
  misc_feature (149)..(149): n is either a, c, g or t
  misc_feature (168)..(168): n is either a, c, g or t
  misc_feature (251)..(251): n is either a, c, g or t
  misc_feature (259)..(259): n is either a, c, g or t
  misc_feature (402)..(402): n is either a, c, g or t
  misc_feature (447)..(447): n is either a, c, g or t
  misc_feature (463)..(463): n is either a, c, g or t
  misc_feature (490)..(490): n is either a, c, g or t
  misc_feature (520)..(520): n is either a, c, g or t
cgagcgantttatcgataaaacgggtatagttcgcgttaacggcgttattcgaatttcgttattatcgagcggttcggtcgaggcggtagcgattacggcgtaacggtttcgatacgtacgngcggcgtaggtcgcgtcggtttagagncggggcgtttacgcgttancgtagagcggcgcgcggtcgattcgcgggcgacgtcgcgtttcgggcgattttagatatacgtaagtcggcgagtaaagacgntaaacgtnagggcgcgaggcgcgatcgatttaatatttattaatagtaattcgagtttaggcgtcgatcgtttttaaaacgatttatatcggcgcgagttacggcgttttcgtcgtttagtttttcggtttcgttatttatcgtattattntttacgtattacgcgcggtcgttataggaattttttatttttttnttttttaggtaaagtnttagcgtagtttcgcggttattttaancgcgttttttaatacgtttcgggaattttnttttattagtttatagagattattattt

SEQ ID NO: 38884 - DNA, 548 bp, Artificial Sequence
  chemically treated genomic DNA (Homo sapiens) CpG-island No: 38884
  misc_feature (29)..(29): n is either a, c, g or t
  misc_feature (59)..(59): n is either a, c, g or t
  misc_feature (86)..(86): n is either a, c, g or t
  misc_feature (102)..(102): n is either a, c, g or t
  misc_feature (147)..(147): n is either a, c, g or t
  misc_feature (290)..(290): n is either a, c, g or t
  misc_feature (298)..(298): n is either a, c, g or t
  misc_feature (381)..(381): n is either a, c, g or t
  misc_feature (400)..(400): n is either a, c, g or t
  misc_feature (427)..(427): n is either a, c, g or t
  misc_feature (541)..(541): n is either a, c, g or t
aaataataatctctataaactaataaaanaaaattcccgaaacgtattaaaaaacgcgnttaaaataaccgcgaaactacgctaanactttacctaaaaaanaaaaaaataaaaaattcctataacgaccgcgcgtaatacgtaaanaataatacgataaataacgaaaccgaaaaactaaacgacgaaaacgccgtaactcgcgccgatataaatcgttttaaaaacgatcgacgcctaaactcgaattactattaataaatattaaatcgatcgcgcctcgcgccctnacgtttancgtctttactcgccgacttacgtatatctaaaatcgcccgaaacgcgacgtcgcccgcgaatcgaccgcgcgccgctctacgntaacgcgtaaacgccccgnctctaaaccgacgcgacctacgccgcncgtacgtatcgaaaccgttacgccgtaatcgctaccgcctcgaccgaaccgctcgataataacgaaattcgaataacgccgttaacgcgaactatacccgttttatcgataaantcgctcg

SEQ ID NO: 38885 - DNA, 530 bp, Artificial Sequence
  chemically treated genomic DNA (Homo sapiens) CpG-island No: 38885
ttcgtgtgtttttgtgttttcgttttttcgtttttcgttttcgtttgcgtttttcgttttttttcgttttttttttggtttttttgtttttcgcggcgtttcggttttttcggttcgcgcggttgttttttttttttttttcggtcgtttttttttcgtttttttttttttttttttttttttgtttttttttttttttcgtttttttttttttcgtttttttttttttttttttttttcgttttgttcgtcgtcgttttcgttgtttcgcgtttcgtcgtcgttttttttttttttttcgttgcgtttttttttcgtcgtcgttttcggcgtgcgttcggtgtgttttggtttttttcggttcgcgttttcgtcgttcggcgggttcgtcgtcgcgcgggttcgtcgttgtttttttttcgtttttcgttttttttttttttttttttttttttttcgttttttcgttttgttttcgttttttgtttttttttttttttttgtttttttttttcgtttttttcgttttt

SEQ ID NO: 38886 - DNA, 530 bp, Artificial Sequence
  chemically treated genomic DNA (Homo sapiens) CpG-island No: 38886
aaaaacgaaaaaaacgaaaaaaaaaaacaaaaaaaaaaaaaaaaacaaaaaacgaaaacaaaacgaaaaaacgaaaaaaaaaaaaaaaaaaaaaaaaaaaacgaaaaacgaaaaaaaaacaacgacgaacccgcgcgacgacgaacccgccgaacgacgaaaacgcgaaccgaaaaaaaccaaaacacaccgaacgcacgccgaaaacgacgacgaaaaaaaaacgcaacgaaaaaaaaaaaaaaaacgacgacgaaacgcgaaacaacgaaaacgacgacgaacaaaacgaaaaaaaaaaaaaaaaaaaaaaacgaaaaaaaaaaaaacgaaaaaaaaaaaaaaacaaaaaaaaaaaaaaaaaaaaaaaaacgaaaaaaaaacgaccgaaaaaaaaaaaaaaaacaaccgcgcgaaccgaaaaaaccgaaacgccgcgaaaaacaaaaaaaccaaaaaaaaaacgaaaaaaaacgaaaaacgcaaacgaaaacgaaaaacgaaaaaacgaaaacacaaaaacacacgaa

SEQ ID NO: 38887 - DNA, 530 bp, Artificial Sequence
  chemically treated genomic DNA (Homo sapiens) CpG-island No: 38887
ggaagcgggggggacgggggggggagatagggaggggggggggaataaagggcgagaataggacgggaggacggggaaaggggaaaaaaggaagagggaaacgggggacggggagggggtaacgacgggttcgcgcggcggcgaattcgtcgggcgacgagggcgcgaatcgggggggattaaaatatatcgaacgtacgtcgggagcgacgacgggagggagacgtaacggaggggagaggggaggcggcggcggggcgcggaatagcgggggcggcggcgagtaaagcgggaaagagggagggagagaaagacgaaaggggggaaagcgggggaaagggggaagtaaggggggggggagagaagaaggggcgggagaggggcggtcggggggaagaaaaaaaataatcgcgcgggtcggggggatcggggcgtcgcgaaagatagaaggattaggggggaaacgggggggaacggaaggcgtaaacggaaacggggggcgggggagcgggggtatagaggtatacgag

SEQ ID NO: 38888 - DNA, 530 bp, Artificial Sequence
  chemically treated genomic DNA (Homo sapiens) CpG-island No: 38888
ctcgtatacctctatacccccgctcccccgccccccgtttccgtttacgccttccgttcccccccgtttcccccctaatccttctatctttcgcgacgccccgatccccccgacccgcgcgattattttttttcttccccccgaccgcccctctcccgccccttcttctctccccccccccttacttccccctttcccccgctttcccccctttcgtctttctctccctccctctttcccgctttactcgccgccgcccccgctattccgcgccccgccgccgcctcccctctcccctccgttacgtctccctcccgtcgtcgctcccgacgtacgttcgatatattttaatcccccccgattcgcgccctcgtcgcccgacgaattcgccgccgcgcgaacccgtcgttaccccctccccgtcccccgtttccctcttccttttttcccctttccccgtcctcccgtcctattctcgccctttattcccccccccctccctatctcccccccccgtcccccccgcttcc

SEQ ID NO: 38889 - DNA, 651 bp, Artificial Sequence
  chemically treated genomic DNA (Homo sapiens) CpG-island No: 38889
agtcggggtttcggttttcgtcgttcgttcgtcgtagcgttatagtcggttttggtgtgttagcgtgtatatttatatatatttatttaaatttatacgttttacgcggggatagcgcggggatagttcgggattcgtagagttgcgcgtacgtatttttttcgggtgtagtatatttcgtattcgtttcgcgtagcgtttgatttcgcgtttgatcggtcgcgcggcgtcgtttatttttttagacggcgaagatgcggggttcgttttttaggtggttttgggcggaggcggcggtcgtttagagtagtagtagtagtcgtagtcgtagcggaagttttaatcgagtcggcgggttagggacgcgggcgcgcggtgcgttgggggcggtacgttcgggcggaggaggcgttatttcgtggtttcgggagcgatagcggtaattagtcgagattgagttagcgttcggtcgtaggtagatttaagcgttaggaggcggagttagcgttgattttatttcgttttttttttcgtttttcgtagttttttttcgttttattggtttttttgagcgagagcggaattgttgggggaattttcgttattttttttcgggtaattttacggggaaagtttagttgcggataagtt

SEQ ID NO: 38890 - DNA, 651 bp, Artificial Sequence
  chemically treated genomic DNA (Homo sapiens) CpG-island No: 38890
aacttatccgcaactaaactttccccgtaaaattacccgaaaaaaaataacgaaaattcccccaacaattccgctctcgctcaaaaaaaccaataaaacgaaaaaaaactacgaaaaacgaaaaaaaaaacgaaataaaatcaacgctaactccgcctcctaacgcttaaatctacctacgaccgaacgctaactcaatctcgactaattaccgctatcgctcccgaaaccacgaaataacgcctcctccgcccgaacgtaccgcccccaacgcaccgcgcgcccgcgtccctaacccgccgactcgattaaaacttccgctacgactacgactactactactactctaaacgaccgccgcctccgcccaaaaccacctaaaaaacgaaccccgcatcttcgccgtctaaaaaaataaacgacgccgcgcgaccgatcaaacgcgaaatcaaacgctacgcgaaacgaatacgaaatatactacacccgaaaaaaatacgtacgcgcaactctacgaatcccgaactatccccgcgctatccccgcgtaaaacgtataaatttaaataaatatatataaatatacacgctaacacaccaaaaccgactataacgctacgacgaacgaacgacgaaaaccgaaaccccgact

SEQ ID NO: 38891 - DNA, 651 bp, Artificial Sequence
  chemically treated genomic DNA (Homo sapiens) CpG-island No: 38891
ggtttgttcgtagttgggtttttttcgtagagttgttcgggagagggtggcgaaggtttttttagtagtttcgttttcgtttaggaaagttagtgaggcgagaaaaggttgcgaggggcggggggaggggcggggtggggttagcgttggtttcgttttttggcgtttgggtttgtttgcggtcgggcgttggtttagtttcggttgattgtcgttgtcgttttcggggttacgggatgacgtttttttcgttcggacgtgtcgtttttagcgtatcgcgcgttcgcgtttttggttcgtcggttcggttggggttttcgttgcggttgcggttgttgttgttgttttgggcggtcgtcgttttcgtttagggttatttaaggagcggatttcgtattttcgtcgtttggaaaggtaggcggcgtcgcgcggtcggttaggcgcgggattagacgttgcgcggggcgggtgcggagtgtgttgtattcggagggagtgcgtgcgcgtagttttgcgggtttcgggttgttttcgcgttgttttcgcgtggagcgtgtgggtttgggtgagtgtgtgtgagtgtatacgttggtatattagagtcggttgtaacgttgcggcgagcgagcggcgggggtcggagtttcggtt

SEQ ID NO: 38892 - DNA, 651 bp, Artificial Sequence
  chemically treated genomic DNA (Homo sapiens) CpG-island No: 38892
aaccgaaactccgacccccgccgctcgctcgccgcaacgttacaaccgactctaatataccaacgtatacactcacacacactcacccaaacccacacgctccacgcgaaaacaacgcgaaaacaacccgaaacccgcaaaactacgcgcacgcactccctccgaatacaacacactccgcacccgccccgcgcaacgtctaatcccgcgcctaaccgaccgcgcgacgccgcctacctttccaaacgacgaaaatacgaaatccgctccttaaataaccctaaacgaaaacgacgaccgcccaaaacaacaacaacaaccgcaaccgcaacgaaaaccccaaccgaaccgacgaaccaaaaacgcgaacgcgcgatacgctaaaaacgacacgtccgaacgaaaaaaacgtcatcccgtaaccccgaaaacgacaacgacaatcaaccgaaactaaaccaacgcccgaccgcaaacaaacccaaacgccaaaaaacgaaaccaacgctaaccccaccccgcccctccccccgcccctcgcaaccttttctcgcctcactaactttcctaaacgaaaacgaaactactaaaaaaaccttcgccaccctctcccgaacaactctacgaaaaaaacccaactacgaacaaacc

SEQ ID NO: 38893 - DNA, 506 bp, Artificial Sequence
  chemically treated genomic DNA (Homo sapiens) CpG-island No: 38893
tttcgtaatagaaaacgttcggagaatacgatttttcgtttagttttttttaatttttcgcggaagtgtttatatcggaatttttttgtgttcgtattttgttattggtcgaggttttcgttcgtttttattcgtttttttttataatttagtcgggttgcgcggttcgtaggagttattttcgtttcgttttatttcggtttttcggtttttttttagtagttttcggtttcggtttcgtttcgttttttgtggtttcgtttcgttttcgttttcgtttttggttggcggtttagtttcgcggcgtcgttttcggtgcgggtttcgtttcggttgtggttttcggttgcggaggagttcgagacgtagttgtcgcgtcggggtttgagttgtcgtttttttcgtcgttcgaaaattcggagtgtttcgtataggtaagtggttcgggttcgggtttttttaggtatggcgggagaggaggttgcgataggtggaggggtcgaggt

SEQ ID NO: 38894 - DNA, 506 bp, Artificial Sequence
  chemically treated genomic DNA (Homo sapiens) CpG-island No: 38894
acctcgacccctccacctatcgcaacctcctctcccgccatacctaaaaaaacccgaacccgaaccacttacctatacgaaacactccgaattttcgaacgacgaaaaaaacgacaactcaaaccccgacgcgacaactacgtctcgaactcctccgcaaccgaaaaccacaaccgaaacgaaacccgcaccgaaaacgacgccgcgaaactaaaccgccaaccaaaaacgaaaacgaaaacgaaacgaaaccacaaaaaacgaaacgaaaccgaaaccgaaaactactaaaaaaaaaccgaaaaaccgaaataaaacgaaacgaaaataactcctacgaaccgcgcaacccgactaaattataaaaaaaaacgaataaaaacgaacgaaaacctcgaccaataacaaaatacgaacacaaaaaaattccgatataaacacttccgcgaaaaattaaaaaaaactaaacgaaaaatcgtattctccgaacgttttctattacgaaa

SEQ ID NO: 38895 - DNA, 506 bp, Artificial Sequence
  chemically treated genomic DNA (Homo sapiens) CpG-island No: 38895
gtttcggtttttttatttgtcgtagttttttttttcgttatgtttgagggagttcggattcgggttatttatttgtgcggggtatttcgggttttcgggcggcggaggaggcggtagtttaggtttcggcgcggtagttgcgtttcggattttttcgtagtcgggggttatagtcggggcggggttcgtatcggaagcggcgtcgcggggttggatcgttagttaggggcgggggcgggggcggggcggggttatagggggcggggcgggatcgaagtcggaagttgttagaaagggatcggggggtcggggtgggacgaggcggaagtgatttttacggatcgcgtagttcgattgagttgtgggaggaagcgaatggaagcgggcggaagtttcggttaatggtaaagtgcggatatagaggggtttcggtgtgagtattttcgcggggagttgaaaagagttgggcgggagatcgtgtttttcgagcgttttttattgcggag

SEQ ID NO: 38896 - DNA, 506 bp, Artificial Sequence
  chemically treated genomic DNA (Homo sapiens) CpG-island No: 38896
ctccgcaataaaaaacgctcgaaaaacacgatctcccgcccaactcttttcaactccccgcgaaaatactcacaccgaaacccctctatatccgcactttaccattaaccgaaacttccgcccgcttccattcgcttcctcccacaactcaatcgaactacgcgatccgtaaaaatcacttccgcctcgtcccaccccgaccccccgatccctttctaacaacttccgacttcgatcccgccccgccccctataaccccgccccgcccccgcccccgcccctaactaacgatccaaccccgcgacgccgcttccgatacgaaccccgccccgactataacccccgactacgaaaaaatccgaaacgcaactaccgcgccgaaacctaaactaccgcctcctccgccgcccgaaaacccgaaataccccgcacaaataaataacccgaatccgaactccctcaaacataacgaaaaaaaaaactacgacaaataaaaaaaccgaaac

SEQ ID NO: 38897 - DNA, 796 bp, Artificial Sequence
  chemically treated genomic DNA (Homo sapiens) CpG-island No: 38897
cgagcggtgttttttggggttttaatgtagcgagttgtgttcgaggggttcggaaggcgtaagttgggtagcgatatggggaacgcggagcgggtttcggggtttcggagttttgggttcgtatttacgttgttgttgttcgtcgcggcgttattggtcgtgtcggacgtattcgggcgttttttcgaggaggacgaggagttagtggtgtcggagttggagcgcgtttcgggatacgggattacgcgttttcgtttgtacgtttttgattagtagttggatttggagttgcggttcgatagtagttttttggcgttcggttttacgttttagaacgtggggcgtaaattcgggttcgagacgtcgttttcggaaatcgatttggcgtattgtttttatttcggtatcgtgaatggcgattttagttcggttgtcgtttttagtttttgcgagggcgtgcgcggcgttttttatttgttgggggaggcgtattttatttagtcgttgttcgtcgttagcgagcgtttcgttatcgtcgttttaggggagaagtcgtcggtattattatagttttattttttgcggcggaatcggtagggcgacgtaggcggtacgtgcggggtggtggacgacgagtttcggtcgattgggaaagcggagatcgaagacgaggacgaagggattgagggcgaggacgaagggttttagtggtcgtcgtaggattcggtattgtaaggcgtaggatagtttataggtagaagaattgttttcgtttgtttgtttatttatttttttt

SEQ ID NO: 38898 - DNA, 796 bp, Artificial Sequence
  chemically treated genomic DNA (Homo sapiens) CpG-island No: 38898
aaaaaaaataaataaacaaacaaacgaaaacaattcttctacctataaactatcctacgccttacaataccgaatcctacgacgaccactaaaacccttcgtcctcgccctcaatcccttcgtcctcgtcttcgatctccgctttcccaatcgaccgaaactcgtcgtccaccaccccgcacgtaccgcctacgtcgccctaccgattccgccgcaaaaaataaaactataataataccgacgacttctcccctaaaacgacgataacgaaacgctcgctaacgacgaacaacgactaaataaaatacgcctcccccaacaaataaaaaacgccgcgcacgccctcgcaaaaactaaaaacgacaaccgaactaaaatcgccattcacgataccgaaataaaaacaatacgccaaatcgatttccgaaaacgacgtctcgaacccgaatttacgccccacgttctaaaacgtaaaaccgaacgccaaaaaactactatcgaaccgcaactccaaatccaactactaatcaaaaacgtacaaacgaaaacgcgtaatcccgtatcccgaaacgcgctccaactccgacaccactaactcctcgtcctcctcgaaaaaacgcccgaatacgtccgacacgaccaataacgccgcgacgaacaacaacaacgtaaatacgaacccaaaactccgaaaccccgaaacccgctccgcgttccccatatcgctacccaacttacgccttccgaacccctcgaacacaactcgctacattaaaaccccaaaaaacaccgctcg

SEQ ID NO: 38899 - DNA, 796 bp, Artificial Sequence
  chemically treated genomic DNA (Homo sapiens) CpG-island No: 38899
gaggaggatgaatggatagataaacgagagtaatttttttatttgtgggttgttttacgttttgtagtgtcgggttttgcggcgattattgaggtttttcgttttcgtttttagttttttcgttttcgttttcggttttcgtttttttagtcggtcggggttcgtcgtttattatttcgtacgtgtcgtttacgtcgttttgtcgatttcgtcgtaggaggtggaattgtagtggtgtcggcggttttttttttggggcggcggtggcgaggcgttcgttggcggcgggtagcggttggatgaaatacgttttttttagtaggtagaaggcgtcgcgtacgttttcgtagaggttgagggcggtagtcgagttgggatcgttatttacggtgtcggagtagaagtagtgcgttaggtcggttttcggaagcggcgtttcggattcggatttgcgttttacgttttggagcgtgaagtcgggcgttaaaaagttgttgtcgggtcgtagttttagatttagttgttggttaaaggcgtgtaggcggaggcgcgtggtttcgtgtttcggggcgcgttttagtttcggtattattagtttttcgtttttttcggaggggcgttcgagtgcgttcgatacggttagtagcgtcgcggcgagtagtagtagcgtgggtacgggtttaaagtttcgagatttcggagttcgtttcgcgttttttatgtcgttgtttagtttgcgtttttcgaatttttcgggtatagttcgttgtattggagttttaggagatatcgttcg

SEQ ID NO: 38900 - DNA, 796 bp, Artificial Sequence
  chemically treated genomic DNA (Homo sapiens) CpG-island No: 38900
cgaacgatatctcctaaaactccaatacaacgaactatacccgaaaaattcgaaaaacgcaaactaaacaacgacataaaaaacgcgaaacgaactccgaaatctcgaaactttaaacccgtacccacgctactactactcgccgcgacgctactaaccgtatcgaacgcactcgaacgcccctccgaaaaaaacgaaaaactaataataccgaaactaaaacgcgccccgaaacacgaaaccacgcgcctccgcctacacgcctttaaccaacaactaaatctaaaactacgacccgacaacaactttttaacgcccgacttcacgctccaaaacgtaaaacgcaaatccgaatccgaaacgccgcttccgaaaaccgacctaacgcactacttctactccgacaccgtaaataacgatcccaactcgactaccgccctcaacctctacgaaaacgtacgcgacgccttctacctactaaaaaaaacgtatttcatccaaccgctacccgccgccaacgaacgcctcgccaccgccgccccaaaaaaaaaaccgccgacaccactacaattccacctcctacgacgaaatcgacaaaacgacgtaaacgacacgtacgaaataataaacgacgaaccccgaccgactaaaaaaacgaaaaccgaaaacgaaaacgaaaaaactaaaaacgaaaacgaaaaacctcaataatcgccgcaaaacccgacactacaaaacgtaaaacaacccacaaataaaaaaattactctcgtttatctatccattcatcctcctc

SEQ ID NO: 38901 - DNA, 601 bp, Artificial Sequence
  chemically treated genomic DNA (Homo sapiens) CpG-island No: 38901
tgatcgcgtttttttttgtcgtagttttggttcggtttagatcgtatagcgacgattatagtattatgaagaagattttttttcgaaagtttaagcgtagttttaatattaagtttagcggtttttacgaggagatatcggggtttcggttcggggacgcgaggttcgcgggcgtttcgggggtagtagcgcgcgttttgattttcgggatttcgtagtgcgcgttgttttcggcggcgttttcgggtgacgaggacgatagcgagtttgtgtatatcgagatgttggggtacgcggttaggttcgatagttcggatttcggggagttcgtgtacgaggagatgaagtgttgtttgttcgacgacggcggttcgggcgcgggtttttttttgttttacggcgtatcgtcgtttttgttttatcgcgcgtcggaggacgaggcggcggggtttttaggggacgcgtgcgatatttcgtcgtttttttttaatttgttgtcgtatcggtcgtttttgttggtgtttttttcgattttcgttatttgttttttcgttttcgacgagtcgtttttgatatttttggaggtgaagaagttgttagt

SEQ ID NO: 38902 - DNA, 601 bp, Artificial Sequence
  chemically treated genomic DNA (Homo sapiens) CpG-island No: 38902
actaacaacttcttcacctccaaaaatatcaaaaacgactcgtcgaaaacgaaaaaacaaataacgaaaatcgaaaaaaacaccaacaaaaacgaccgatacgacaacaaattaaaaaaaaacgacgaaatatcgcacgcgtcccctaaaaaccccgccgcctcgtcctccgacgcgcgataaaacaaaaacgacgatacgccgtaaaacaaaaaaaaacccgcgcccgaaccgccgtcgtcgaacaaacaacacttcatctcctcgtacacgaactccccgaaatccgaactatcgaacctaaccgcgtaccccaacatctcgatatacacaaactcgctatcgtcctcgtcacccgaaaacgccgccgaaaacaacgcgcactacgaaatcccgaaaatcaaaacgcgcgctactacccccgaaacgcccgcgaacctcgcgtccccgaaccgaaaccccgatatctcctcgtaaaaaccgctaaacttaatattaaaactacgcttaaactttcgaaaaaaaatcttcttcataatactataatcgtcgctatacgatctaaaccgaaccaaaactacgacaaaaaaaaacgcgatca

SEQ ID NO: 38903 - DNA, 601 bp, Artificial Sequence
  chemically treated genomic DNA (Homo sapiens) CpG-island No: 38903
attggtagtttttttatttttaggggtgttaggggcgattcgtcggaggcgggggagtaggtgacgggggtcggggggaatattagtaggggcggtcggtgcggtagtaggttggggaagggcggcgggatgtcgtacgcgttttttgggggtttcgtcgtttcgtttttcggcgcgcggtggagtaggggcggcgatgcgtcgtggagtaggaaggagttcgcgttcgggtcgtcgtcgtcgggtaggtaatattttattttttcgtatacggatttttcggggttcgggttatcgggtttggtcgcgtgttttagtatttcgatgtatataggttcgttgtcgttttcgttattcggaggcgtcgtcgggggtagcgcgtattgcggagtttcgggggttagaacgcgcgttgttgttttcggggcgttcgcgggtttcgcgttttcgggtcgggatttcgatattttttcgtaggagtcgttgagtttggtgttggggttgcgtttgggttttcgaggaggaattttttttatggtgttgtagtcgtcgttgtgcggtttgggtcgggttagagttgcggtaggaaaggacgcggtta

SEQ ID NO: 38904 - DNA, 601 bp, Artificial Sequence
  chemically treated genomic DNA (Homo sapiens) CpG-island No: 38904
taaccgcgtcctttcctaccgcaactctaacccgacccaaaccgcacaacgacgactacaacaccataaaaaaaattcctcctcgaaaacccaaacgcaaccccaacaccaaactcaacgactcctacgaaaaaatatcgaaatcccgacccgaaaacgcgaaacccgcgaacgccccgaaaacaacaacgcgcgttctaacccccgaaactccgcaatacgcgctacccccgacgacgcctccgaataacgaaaacgacaacgaacctatatacatcgaaatactaaaacacgcgaccaaacccgataacccgaaccccgaaaaatccgtatacgaaaaaataaaatattacctacccgacgacgacgacccgaacgcgaactccttcctactccacgacgcatcgccgcccctactccaccgcgcgccgaaaaacgaaacgacgaaacccccaaaaaacgcgtacgacatcccgccgcccttccccaacctactaccgcaccgaccgcccctactaatattccccccgacccccgtcacctactcccccgcctccgacgaatcgcccctaacacccctaaaaataaaaaaactaccaat

SEQ ID NO: 38905 - DNA, 1546 bp, Artificial Sequence
  chemically treated genomic DNA (Homo sapiens) CpG-island No: 38905
cgacgttttatgtcgagtcgatcgttgagtcgtacgtttttttacggcgggggcgagatggtgcgtagatttagcggtgcgaggggcggcggcgattttgggcggtcgggagttcgggtttttagcgtagttttttgttaggcgggtcgtttttggcgttgcggggcggcgggcgggcgggcggcggcggtattttggagagcgggtagtatttgatggtgtgcgcgttgtcgtcgttggcgtcgtataggggatacgtgtagcggcgtagtacgggatatagtattcgttcgtcggggtttttgaggatatgggtggtgtagagcgttatcgtttttttgttgtttcggtagaatacgtatatttgtagttcgggttttagtagtcgggcggtcgtcgtttcggaggtcgcgtgtagtcggggttcggtcgtttacgtcggggttcgtttttcgcgcggcgtcgtttcgttggtggtggtggcggcggcggcggcggcgggcgcgtagtttagtagtacggcggcggtacgattcgcgaacgggtttagttcggcgaagcgtttttttagtagttcggtttcggcggggttcgcgtatagttttagcgcgcgtaattttagcgcgttttttaggtagcggtttcgggatttcggttcgtcgttgtcgtcgtcgtcgttttcgtcgtagtcgggcggttttagcgtcggttttagcgttttaggttcggttttcgtgtggggggagtagtaggacgacgaggaggaggagggcggggagtcgtcgtcgtcgtttttatcgcgggcgtagtcgaagcgcggttcgtcgtttatcgttttggtgatgagcgtggcgagttttaggtagtcgttttaggagttgaagggttgcgggtgcgtcgggttcggggcgtttacgtagcgggcgttgggtacgagcgttatgggcgggggggcgcggtcgcggcggggcgagcggggcgtttaggggaaagtttttatgggcgggttgcgggtcgcgcgtcgttttttcgtcgtcggcgcgggtcggacggaagggatacgtcgagtttgttcgtcggtttgtcgcggggtggggtcgtcgcgtcgttttttatcgggtttattttttttcgtttttcggtttcgtcgtcgcggttttgttttttgcgttttttcgtttcggttatttcgttcgcgtttcggacggaggcggagcggaggcgggttggttgtgtgcgcgtttcgttttagttcgcgcggttttcgcgtttcgcgcgttgcgttagtttcgttagttgtcgggcggtttttatttcgggagggggcgggcgaggcgtcgtttcgagtcgtggcgtttattggttgtagattagagtttttcggcgtttcgggcgtcgtttcggacgttgattggtgggaatacggggagggggcgtgtttttcgcgtagttgggaggtgaggagaaagtaggggagagaagggtcgggaagggagggtcgttggggttcgtattcgagcgtcgggtttgggtttggagtaggtga

SEQ ID NO: 38906 - DNA, 1546 bp, Artificial Sequence
  chemically treated genomic DNA (Homo sapiens) CpG-island No: 38906
tcacctactccaaacccaaacccgacgctcgaatacgaaccccaacgaccctcccttcccgacccttctctcccctactttctcctcacctcccaactacgcgaaaaacacgccccctccccgtattcccaccaatcaacgtccgaaacgacgcccgaaacgccgaaaaactctaatctacaaccaataaacgccacgactcgaaacgacgcctcgcccgccccctcccgaaataaaaaccgcccgacaactaacgaaactaacgcaacgcgcgaaacgcgaaaaccgcgcgaactaaaacgaaacgcgcacacaaccaacccgcctccgctccgcctccgtccgaaacgcgaacgaaataaccgaaacgaaaaaacgcaaaaaacaaaaccgcgacgacgaaaccgaaaaacgaaaaaaaataaacccgataaaaaacgacgcgacgaccccaccccgcgacaaaccgacgaacaaactcgacgtatcccttccgtccgacccgcgccgacgacgaaaaaacgacgcgcgacccgcaacccgcccataaaaactttcccctaaacgccccgctcgccccgccgcgaccgcgcccccccgcccataacgctcgtacccaacgcccgctacgtaaacgccccgaacccgacgcacccgcaacccttcaactcctaaaacgactacctaaaactcgccacgctcatcaccaaaacgataaacgacgaaccgcgcttcgactacgcccgcgataaaaacgacgacgacgactccccgccctcctcctcctcgtcgtcctactactccccccacacgaaaaccgaacctaaaacgctaaaaccgacgctaaaaccgcccgactacgacgaaaacgacgacgacgacaacgacgaaccgaaatcccgaaaccgctacctaaaaaacgcgctaaaattacgcgcgctaaaactatacgcgaaccccgccgaaaccgaactactaaaaaaacgcttcgccgaactaaacccgttcgcgaatcgtaccgccgccgtactactaaactacgcgcccgccgccgccgccgccgccaccaccaccaacgaaacgacgccgcgcgaaaaacgaaccccgacgtaaacgaccgaaccccgactacacgcgacctccgaaacgacgaccgcccgactactaaaacccgaactacaaatatacgtattctaccgaaacaacaaaaaaacgataacgctctacaccacccatatcctcaaaaaccccgacgaacgaatactatatcccgtactacgccgctacacgtatcccctatacgacgccaacgacgacaacgcgcacaccatcaaatactacccgctctccaaaataccgccgccgcccgcccgcccgccgccccgcaacgccaaaaacgacccgcctaacaaaaaactacgctaaaaacccgaactcccgaccgcccaaaatcgccgccgcccctcgcaccgctaaatctacgcaccatctcgcccccgccgtaaaaaaacgtacgactcaacgatcgactcgacataaaacgtcg

SEQ ID NO: 38907 - DNA, 1546 bp, Artificial Sequence
  chemically treated genomic DNA (Homo sapiens) CpG-island No: 38907
ttatttgttttaagtttaggttcggcgttcgaatgcgggttttagcggtttttttttttcggttttttttttttttattttttttttattttttagttgcgcggagaatacgtttttttttcgtgtttttattaattagcgttcggagcggcgttcgaggcgtcggggggttttggtttgtagttaatgagcgttacggttcgaggcggcgtttcgttcgttttttttcggaatgaaggtcgttcgatagttggcgaggttggcgtagcgcgcggggcgcgggagtcgcgcgggttggagcggagcgcgtatatagttagttcgttttcgtttcgttttcgttcggggcgcgggcgaggtggtcggggcgggggaacgtagggggtagggtcgcggcggcgaggtcggggggcggggaggagtgggttcgataaaaggcggcgcggcggttttatttcgcggtaggtcggcgggtaggttcggcgtgtttttttcgttcggttcgcgtcggcggcggggaggcggcgcgcggttcgtagttcgtttatggaggtttttttttgggcgtttcgttcgtttcgtcgcggtcgcgttttttcgtttatggcgttcgtgtttagcgttcgttacgtgagcgtttcgggttcggcgtattcgtagttttttagtttttggaacgattatttggggttcgttacgtttattattaaagcggtggacggcgagtcgcgtttcggttgcgttcgcggtgggaacggcggcggcggtttttcgtttttttttttttcgtcgttttgttgttttttttatacgggggtcgggtttggggcgttggggtcggcgttggggtcgttcgattacgacgaggacgacgacgacgatagcgacgagtcggggtttcggggtcgttatttggggagcgcgttggaattgcgcgcgttggagttgtgcgcgggtttcgtcgaggtcgggttgttggaggagcgtttcgtcgagttgagttcgttcgcgggtcgtgtcgtcgtcgtgttgttgggttgcgcgttcgtcgtcgtcgtcgtcgttattattattagcgaggcgacgtcgcgcgaggagcgggtttcggcgtgggcggtcgagtttcggttgtacgcggttttcggggcggcggtcgttcggttgttgaagttcgagttgtaggtgtgcgtgttttgtcggaataataaggaggcgatggcgttttatattatttatatttttaagggtttcgacgggcgagtgttgtgtttcgtgttgcgtcgttatacgtgttttttgtgcggcgttagcggcgataacgcgtatattattaagtattgttcgttttttaaagtgtcgtcgtcgttcgttcgttcgtcgtttcgtagcgttagggacggttcgtttggtaagaagttgcgttgaaggttcgggttttcggtcgtttagggtcgtcgtcgtttttcgtatcgttaggtttgcgtattatttcgttttcgtcgtggggaggcgtgcggtttagcggtcggttcgatatgggacgtcg

SEQ ID NO: 38908 - DNA, 1546 bp, Artificial Sequence
  chemically treated genomic DNA (Homo sapiens) CpG-island No: 38908
cgacgtcccatatcgaaccgaccgctaaaccgcacgcctccccacgacgaaaacgaaataatacgcaaacctaacgatacgaaaaacgacgacgaccctaaacgaccgaaaacccgaaccttcaacgcaacttcttaccaaacgaaccgtccctaacgctacgaaacgacgaacgaacgaacgacgacgacactttaaaaaacgaacaatacttaataatatacgcgttatcgccgctaacgccgcacaaaaaacacgtataacgacgcaacacgaaacacaacactcgcccgtcgaaacccttaaaaatataaataatataaaacgccatcgcctccttattattccgacaaaacacgcacacctacaactcgaacttcaacaaccgaacgaccgccgccccgaaaaccgcgtacaaccgaaactcgaccgcccacgccgaaacccgctcctcgcgcgacgtcgcctcgctaataataataacgacgacgacgacgacgaacgcgcaacccaacaacacgacgacgacacgacccgcgaacgaactcaactcgacgaaacgctcctccaacaacccgacctcgacgaaacccgcgcacaactccaacgcgcgcaattccaacgcgctccccaaataacgaccccgaaaccccgactcgtcgctatcgtcgtcgtcgtcctcgtcgtaatcgaacgaccccaacgccgaccccaacgccccaaacccgacccccgtataaaaaaaacaacaaaacgacgaaaaaaaaaaaaacgaaaaaccgccgccgccgttcccaccgcgaacgcaaccgaaacgcgactcgccgtccaccgctttaataataaacgtaacgaaccccaaataatcgttccaaaaactaaaaaactacgaatacgccgaacccgaaacgctcacgtaacgaacgctaaacacgaacgccataaacgaaaaaacgcgaccgcgacgaaacgaacgaaacgcccaaaaaaaaacctccataaacgaactacgaaccgcgcgccgcctccccgccgccgacgcgaaccgaacgaaaaaaacacgccgaacctacccgccgacctaccgcgaaataaaaccgccgcgccgccttttatcgaacccactcctccccgccccccgacctcgccgccgcgaccctaccccctacgttcccccgccccgaccacctcgcccgcgccccgaacgaaaacgaaacgaaaacgaactaactatatacgcgctccgctccaacccgcgcgactcccgcgccccgcgcgctacgccaacctcgccaactatcgaacgaccttcattccgaaaaaaaacgaacgaaacgccgcctcgaaccgtaacgctcattaactacaaaccaaaaccccccgacgcctcgaacgccgctccgaacgctaattaataaaaacacgaaaaaaaaacgtattctccgcgcaactaaaaaataaaaaaaaaataaaaaaaaaaaaaaccgaaaaaaaaaaaccgctaaaacccgcattcgaacgccgaacctaaacttaaaacaaataa

SEQ ID NO: 38909 - DNA, 672 bp, Artificial Sequence
  chemically treated genomic DNA (Homo sapiens) CpG-island No: 38909
attttgcgcgtttaggatttcggcgtcgttacgtttgtcggcgtgcgtgacgttagcgcgtttgcgcgtacggagattcgttttttatattcggggtttgggcggtagtagggtcgtcgcggggaggttacgtggttttttttttttcgtttttggtcggttgggcgcgggcgattgttggcgaggcgcgtgggattttacgttggttttttttcgttttttttttcggttcgggttattagagagttcgttgacgtcgggtgagttgagtttgtcgttaagatgtcggtttatttttagaggtcggaaaatgtttttaaacgcgttaacggtgagtagttgatcggggcgcgtcgggttggggcggttcgaggttttcgaggtcgagaggcgcggggtttgttttttattgtttcgtcgttcggttcgcgcggggagaggagatcgatgcggtttgttcgtcgttgttttagtcggtggttgggtatgggttttttttttattttatcgattggggtttgggaggcgcgtagttcggaatcgtcgttttaggggtttttttttttttttgtcgttttcgggtgcgtcgcggggatcgtagttcgggagatagtttttattcggattggagttttttttttgttgtttgcgttttttggttttttaggtttt

SEQ ID NO: 38910 - DNA, 672 bp, Artificial Sequence
  chemically treated genomic DNA (Homo sapiens) CpG-island No: 38910
aaaacctaaaaaaccaaaaaacgcaaacaacaaaaaaaaaactccaatccgaataaaaactatctcccgaactacgatccccgcgacgcacccgaaaacgacaaaaaaaaaaaaaaacccctaaaacgacgattccgaactacgcgcctcccaaaccccaatcgataaaataaaaaaaaaacccatacccaaccaccgactaaaacaacgacgaacaaaccgcatcgatctcctctccccgcgcgaaccgaacgacgaaacaataaaaaacaaaccccgcgcctctcgacctcgaaaacctcgaaccgccccaacccgacgcgccccgatcaactactcaccgttaacgcgtttaaaaacattttccgacctctaaaaataaaccgacatcttaacgacaaactcaactcacccgacgtcaacgaactctctaataacccgaaccgaaaaaaaaaacgaaaaaaaaccaacgtaaaatcccacgcgcctcgccaacaatcgcccgcgcccaaccgaccaaaaacgaaaaaaaaaaaaccacgtaacctccccgcgacgaccctactaccgcccaaaccccgaatataaaaaacgaatctccgtacgcgcaaacgcgctaacgtcacgcacgccgacaaacgtaacgacgccgaaatcctaaacgcgcaaaat

SEQ ID NO: 38911 - DNA, 672 bp, Artificial Sequence
  chemically treated genomic DNA (Homo sapiens) CpG-island No: 38911
gggatttggagagttagaggacgtaggtagtaaggagggagttttagttcgggtaggggttgtttttcgggttgcggttttcgcgacgtattcggaggcggtagggggaaggaaaggtttttggggcgacggtttcgggttacgcgttttttagattttagtcgatagagtgagaaggaaatttatgtttaattatcggttgggatagcggcgggtaggtcgtatcggtttttttttttcgcgcgggtcgggcggcggagtagtgggaagtaggtttcgcgtttttcgatttcggaggtttcgggtcgttttagttcggcgcgtttcgattagttatttatcgttggcgcgtttgagggtatttttcggtttttgaaaataggtcggtattttggcggtaggtttagtttattcggcgttagcgaattttttagtggttcgggtcgggagaggagacgaaggggaattagcgtaaggttttacgcgtttcgttagtagtcgttcgcgtttagtcggttagagacggaaaggaaggagttacgtgattttttcgcggcggttttgttgtcgtttaggtttcggatgtagggggcgggttttcgtgcgcgtaagcgcgttggcgttacgtacgtcgatagacgtggcggcgtcggagttttaggcgcgtaaggt

SEQ ID NO: 38912 - DNA, 672 bp, Artificial Sequence
  chemically treated genomic DNA (Homo sapiens) CpG-island No: 38912
accttacgcgcctaaaactccgacgccgccacgtctatcgacgtacgtaacgccaacgcgcttacgcgcacgaaaacccgccccctacatccgaaacctaaacgacaacaaaaccgccgcgaaaaaatcacgtaactccttcctttccgtctctaaccgactaaacgcgaacgactactaacgaaacgcgtaaaaccttacgctaattccccttcgtctcctctcccgacccgaaccactaaaaaattcgctaacgccgaataaactaaacctaccgccaaaataccgacctattttcaaaaaccgaaaaataccctcaaacgcgccaacgataaataactaatcgaaacgcgccgaactaaaacgacccgaaacctccgaaatcgaaaaacgcgaaacctacttcccactactccgccgcccgacccgcgcgaaaaaaaaaaaccgatacgacctacccgccgctatcccaaccgataattaaacataaatttccttctcactctatcgactaaaatctaaaaaacgcgtaacccgaaaccgtcgccccaaaaacctttccttccccctaccgcctccgaatacgtcgcgaaaaccgcaacccgaaaaacaacccctacccgaactaaaactccctccttactacctacgtcctctaactctccaaatccc

SEQ ID NO: 38913 - DNA, 800 bp, Artificial Sequence
  chemically treated genomic DNA (Homo sapiens) CpG-island No: 38913
gcgggagggaggcgggttttatagcgggaggcggggtttgtgatggttcggggagggaggcggggtttatgatgggtcggggagggaggcggggtttgtgatgggggcgggttttacggcgggcggggcggggttcgggtgcgaggtcggttttgtaggcggtagttagagttgcgcgtcgcggcggcggaagatggttgcggtcgaggtggcggatatttagttgatgtttggagtcgggttgatcggtgaggacgtaggcgttttgtttggaagttcgtattttggttttgtttttgttttatttcggttcggggtagttcgggttttcgcggttttcggcgtcgatcgtatgaggagggcgcggttttttttttgttgggtttggattggggattgcggagttcggtttttttggtgtaggggattcggttcgtcgttttcgttcgttcgttcgcggtcgtttgtggggtttgttcggttcgagggagttcggggatttttaagatttcggggtggagttttttttgtacgtttcgggttgttcggcggagtcgggacgtcgagcgtttttaggttgggtagttgcgaggggcgttgcgcgggcggggtcgggtcgggcgggagtagtcggttggcggcgcggcgcggcgcggcggggaggaggtagggttcggttttttcgagtcgggggcgggcggttgtttcggagttacgggtgattgttcgttcgggcggtttttatcgtgggatcgggtagttggagattgttgggtcgggtgttgcgcgttgtatatata

SEQ ID NO: 38914 - DNA, 800 bp, Artificial Sequence
  chemically treated genomic DNA (Homo sapiens) CpG-island No: 38914
tatatatacaacgcgcaacacccgacccaacaatctccaactacccgatcccacgataaaaaccgcccgaacgaacaatcacccgtaactccgaaacaaccgcccgcccccgactcgaaaaaaccgaaccctacctcctccccgccgcgccgcgccgcgccgccaaccgactactcccgcccgacccgaccccgcccgcgcaacgcccctcgcaactacccaacctaaaaacgctcgacgtcccgactccgccgaacaacccgaaacgtacaaaaaaaactccaccccgaaatcttaaaaatccccgaactccctcgaaccgaacaaaccccacaaacgaccgcgaacgaacgaacgaaaacgacgaaccgaatcccctacaccaaaaaaaccgaactccgcaatccccaatccaaacccaacaaaaaaaaaaccgcgccctcctcatacgatcgacgccgaaaaccgcgaaaacccgaactaccccgaaccgaaataaaacaaaaacaaaaccaaaatacgaacttccaaacaaaacgcctacgtcctcaccgatcaacccgactccaaacatcaactaaatatccgccacctcgaccgcaaccatcttccgccgccgcgacgcgcaactctaactaccgcctacaaaaccgacctcgcacccgaaccccgccccgcccgccgtaaaacccgcccccatcacaaaccccgcctccctccccgacccatcataaaccccgcctccctccccgaaccatcacaaaccccgcctcccgctataaaacccgcctccctcccgc

SEQ ID NO: 38915 - DNA, 800 bp, Artificial Sequence
  chemically treated genomic DNA (Homo sapiens) CpG-island No: 38915
tgtgtgtataacgcgtagtattcggtttagtagtttttagttgttcggttttacgatgggggtcgttcgggcgggtagttattcgtggtttcgaggtagtcgttcgttttcggttcgggggaatcggattttgtttttttttcgtcgcgtcgcgtcgcgtcgttagtcggttgttttcgttcggttcggtttcgttcgcgtagcgtttttcgtagttgtttagtttgggagcgttcgacgtttcggtttcgtcgggtaattcggggcgtgtagggggagttttatttcggaattttggaggttttcgggttttttcgggtcgggtaggttttataggcggtcgcgggcgggcgggcgagggcggcgggtcgggttttttgtattaaggaggtcgggtttcgtagtttttagtttaggtttaatagggagggggtcgcgttttttttatgcggtcggcgtcgggggtcgcgggagttcgggttgtttcgggtcgaggtggagtagaggtagaattagggtgcgggtttttaggtagggcgtttacgtttttatcgattagttcgattttaagtattagttgagtgttcgttatttcggtcgtagttatttttcgtcgtcgcggcgcgtagttttggttgtcgtttgtaggatcggtttcgtattcgaatttcgtttcgttcgtcgtagggttcgtttttattataggtttcgttttttttttcggtttattataagtttcgttttttttttcggattattataggtttcgtttttcgttgtaggattcgtttttttttcgt

SEQ ID NO: 38916 - DNA, 800 bp, Artificial Sequence
  chemically treated genomic DNA (Homo sapiens) CpG-island No: 38916
acgaaaaaaaaacgaatcctacaacgaaaaacgaaacctataataatccgaaaaaaaaaacgaaacttataataaaccgaaaaaaaaaacgaaacctataataaaaacgaaccctacgacgaacgaaacgaaattcgaatacgaaaccgatcctacaaacgacaaccaaaactacgcgccgcgacgacgaaaaataactacgaccgaaataacgaacactcaactaatacttaaaatcgaactaatcgataaaaacgtaaacgccctacctaaaaacccgcaccctaattctacctctactccacctcgacccgaaacaacccgaactcccgcgacccccgacgccgaccgcataaaaaaaacgcgaccccctccctattaaacctaaactaaaaactacgaaacccgacctccttaatacaaaaaacccgacccgccgccctcgcccgcccgcccgcgaccgcctataaaacctacccgacccgaaaaaacccgaaaacctccaaaattccgaaataaaactccccctacacgccccgaattacccgacgaaaccgaaacgtcgaacgctcccaaactaaacaactacgaaaaacgctacgcgaacgaaaccgaaccgaacgaaaacaaccgactaacgacgcgacgcgacgcgacgaaaaaaaaacaaaatccgattcccccgaaccgaaaacgaacgactacctcgaaaccacgaataactacccgcccgaacgacccccatcgtaaaaccgaacaactaaaaactactaaaccgaatactacgcgttatacacaca

SEQ ID NO: 38917 - DNA, 562 bp, Artificial Sequence
  chemically treated genomic DNA (Homo sapiens) CpG-island No: 38917
ttttttgcgttttttgtcgcgttttaaggggtgaaggtcggtggtgcgcgttttcggtataatttcgagaggaggaaacggagatagggggcgtttacgtggtttggttaaggttattcgggttagttcgattttacgcgggtcggttcgttttttttttgtttttagtcgcgtcgggttcgggtcgtatttggcgttcggtgatttagaagcgtacgttgggtttaatgaagtcggggacggcgtttttgcgttttaggagtcgtttaggttgcgttttttttttttgttttagggatattttgcgttggttagagtggtcgtcgtcgttaggtcgcgcgtggaggaggagtcgggcggcgagtttcgtttcgggtcgcgcgtattcgtagttttcgttttaggttcgcgcgttcgacgtttcgtgttatagcgtttcggggtttttgcgcgtttattgtttcggcgagcgtagtttttttacgggttacgtttttttaattttgtttgttttgtttcgtatttttggggagtcgggtcgtttttaggttttaaggggtta

SEQ ID NO: 38918 - DNA, 562 bp, Artificial Sequence
  chemically treated genomic DNA (Homo sapiens) CpG-island No: 38918
taaccccttaaaacctaaaaacgacccgactccccaaaaatacgaaacaaaacaaacaaaattaaaaaaacgtaacccgtaaaaaaactacgctcgccgaaacaataaacgcgcaaaaaccccgaaacgctataacacgaaacgtcgaacgcgcgaacctaaaacgaaaactacgaatacgcgcgacccgaaacgaaactcgccgcccgactcctcctccacgcgcgacctaacgacgacgaccactctaaccaacgcaaaatatccctaaaacaaaaaaaaaaaacgcaacctaaacgactcctaaaacgcaaaaacgccgtccccgacttcattaaacccaacgtacgcttctaaatcaccgaacgccaaatacgacccgaacccgacgcgactaaaaacaaaaaaaaaacgaaccgacccgcgtaaaatcgaactaacccgaataaccttaaccaaaccacgtaaacgccccctatctccgtttcctcctctcgaaattataccgaaaacgcgcaccaccgaccttcaccccttaaaacgcgacaaaaaacgcaaaaaa

SEQ ID NO: 38919 - DNA, 562 bp, Artificial Sequence
  chemically treated genomic DNA (Homo sapiens) CpG-island No: 38919
tgattttttggggtttggagacggttcggttttttaaaggtgcggagtagggtaagtagggttgggaggacgtggttcgtgggagagttgcgttcgtcggaatagtgggcgcgtaagggtttcgaggcgttgtgatacgggacgtcgggcgcgcgggtttggggcgggaattgcgggtgcgcgcggttcggggcggggttcgtcgttcggttttttttttacgcgcggtttggcggcggcggttattttaattagcgtaaaatgtttttggaataggaggaggaaacgtaatttgggcggtttttaggacgtagagacgtcgttttcggttttattgagtttaacgtgcgtttttggattatcgagcgttaagtacggttcgggttcggcgcgattaggggtagggagggggcgggtcggttcgcgtggagtcgggttgattcgggtgattttggttaggttacgtgggcgttttttgttttcgtttttttttttcggagttgtgtcgggaacgcgtattatcggtttttattttttagggcgcggtaggggacgtagggga

SEQ ID NO: 38920 - DNA, 562 bp, Artificial Sequence
  chemically treated genomic DNA (Homo sapiens) CpG-island No: 38920
tcccctacgtcccctaccgcgccctaaaaaataaaaaccgataatacgcgttcccgacacaactccgaaaaaaaaaaacgaaaacaaaaaacgcccacgtaacctaaccaaaatcacccgaatcaacccgactccacgcgaaccgacccgccccctccctacccctaatcgcgccgaacccgaaccgtacttaacgctcgataatccaaaaacgcacgttaaactcaataaaaccgaaaacgacgtctctacgtcctaaaaaccgcccaaattacgtttcctcctcctattccaaaaacattttacgctaattaaaataaccgccgccgccaaaccgcgcgtaaaaaaaaaaccgaacgacgaaccccgccccgaaccgcgcgcacccgcaattcccgccccaaacccgcgcgcccgacgtcccgtatcacaacgcctcgaaacccttacgcgcccactattccgacgaacgcaactctcccacgaaccacgtcctcccaaccctacttaccctactccgcacctttaaaaaaccgaaccgtctccaaaccccaaaaaatca

SEQ ID NO: 38921 - DNA, 703 bp, Artificial Sequence
  chemically treated genomic DNA (Homo sapiens) CpG-island No: 38921
  misc_feature (144)..(146): n is either a, c, g or t
  misc_feature (213)..(213): n is either a, c, g or t
  misc_feature (220)..(221): n is either a, c, g or t
aagttcgggtagaggtcggagaagaaggcggtgttagggcgttttgcggaagggtcgggggcggggttcgtgacgttgtcgggatagttaattacgtttggttttattagtggtttcgtttttttatcgtatattttttttttnnnagtttatttcgtacgacgtagcggttgggaatatagatattttcggagttggagtcgttattgtcgncgtattnngtgtttgtggagaaagaagtttttgtggcggttggaagtggacggagattattcgcgagacggcggcgttttatattcgaggttttttttgtgtcgttttttatttttttttcgcggttagtatgtggtgaagtcggagtcgcgagagagtcggggggaggaagaggagtcggaagggaggcggggtatttagagcggttttagttttagttgtagcggatttcggaggggggtcgcggcgtaatgttagagtagacgtcggtcgaggtcggtgttgcgggggttcgggaggacgtttgtcgggattattagttatcgttcgaagatttgatttttaatagtaagtcgtatattaatatgttgattattttagtcgaggagaatttgtttttcgttaaggagatcgttttttttatcgaggtttaaatcgttaaggtttttatatatttcgtagttttttattatttttaatattttttgat

SEQ ID NO: 38922 - DNA, 703 bp, Artificial Sequence
  chemically treated genomic DNA (Homo sapiens) CpG-island No: 38922
  misc_feature (483)..(484): n is either a, c, g or t
  misc_feature (491)..(491): n is either a, c, g or t
  misc_feature (558)..(560): n is either a, c, g or t
atcaaaaaatattaaaaataataaaaaactacgaaatatataaaaaccttaacgatttaaacctcgataaaaaaaacgatctccttaacgaaaaacaaattctcctcgactaaaataatcaacatattaatatacgacttactattaaaaatcaaatcttcgaacgataactaataatcccgacaaacgtcctcccgaacccccgcaacaccgacctcgaccgacgtctactctaacattacgccgcgacccccctccgaaatccgctacaactaaaactaaaaccgctctaaataccccgcctcccttccgactcctcttcctccccccgactctctcgcgactccgacttcaccacatactaaccgcgaaaaaaaaataaaaaacgacacaaaaaaaacctcgaatataaaacgccgccgtctcgcgaataatctccgtccacttccaaccgccacaaaaacttctttctccacaaacacnnaatacgncgacaataacgactccaactccgaaaatatctatattcccaaccgctacgtcgtacgaaataaactnnnaaaaaaaaaatatacgataaaaaaacgaaaccactaataaaaccaaacgtaattaactatcccgacaacgtcacgaaccccgcccccgacccttccgcaaaacgccctaacaccgccttcttctccgacctctacccgaactt

SEQ ID NO: 38923 - DNA, 703 bp, Artificial Sequence
  chemically treated genomic DNA (Homo sapiens) CpG-island No: 38923
  misc_feature (483)..(484): n is either a, c, g or t
  misc_feature (491)..(491): n is either a, c, g or t
  misc_feature (558)..(560): n is either a, c, g or t
attagggagtattagaagtaataggaggttgcggggtgtataaaaattttggcggtttgggtttcgatgagagagacgatttttttggcgaagggtaggtttttttcggttagaatggttagtatattgatgtgcggtttgttattgaaggttaggttttcgagcgatgattgataatttcgataggcgttttttcgggttttcgtagtatcggtttcggtcggcgtttgttttgatattgcgtcgcggttttttttcgaggttcgttgtagttgaagttgaagtcgttttggatatttcgtttttttttcgattttttttttttttttcggttttttcgcggtttcggttttattatatgttgatcgcggaggggggatgggggacgatatagggggaatttcgggtatgaaacgtcgtcgtttcgcgggtgattttcgtttatttttagtcgttatagaagtttttttttttatagatatnnaatgcgncggtagtggcggttttagtttcgaaaatgtttgtgtttttaatcgttgcgtcgtgcgaaatgaattnnnggaggggaaatgtgcggtaaaagggcggggttattgataaaattaggcgtgattggttgtttcggtaacgttacgagtttcgttttcggttttttcgtaggacgttttggtatcgttttttttttcggtttttattcggattt

SEQ ID NO: 38924 - DNA, 703 bp, Artificial Sequence
  chemically treated genomic DNA (Homo sapiens) CpG-island No: 38924
  misc_feature (144)..(146): n is either a, c, g or t
  misc_feature (213)..(213): n is either a, c, g or t
  misc_feature (220)..(221): n is either a, c, g or t
aaatccgaataaaaaccgaaaaaaaaaacgataccaaaacgtcctacgaaaaaaccgaaaacgaaactcgtaacgttaccgaaacaaccaatcacgcctaattttatcaataaccccgcccttttaccgcacatttcccctccnnnaattcatttcgcacgacgcaacgattaaaaacacaaacattttcgaaactaaaaccgccactaccgncgcattnnatatctataaaaaaaaaaacttctataacgactaaaaataaacgaaaatcacccgcgaaacgacgacgtttcatacccgaaattccccctatatcgtcccccatcccccctccgcgatcaacatataataaaaccgaaaccgcgaaaaaaccgaaaaaaaaaaaaaaaatcgaaaaaaaaacgaaatatccaaaacgacttcaacttcaactacaacgaacctcgaaaaaaaaccgcgacgcaatatcaaaacaaacgccgaccgaaaccgatactacgaaaacccgaaaaaacgcctatcgaaattatcaatcatcgctcgaaaacctaaccttcaataacaaaccgcacatcaatatactaaccattctaaccgaaaaaaacctacccttcgccaaaaaaatcgtctctctcatcgaaacccaaaccgccaaaatttttatacaccccgcaacctcctattacttctaatactccctaat

SEQ ID NO: 38925 - DNA, 662 bp, Artificial Sequence
  chemically treated genomic DNA (Homo sapiens) CpG-island No: 38925
gtttcgaacgttagtaagtataatgataggtggcgtttgcgggggagtcggtttataaatatttacgagtagattagattgtttcgtttttatcggaaataagttggtttcggggtttttattcgttttcgtcgtcgtcgtcgtcgtttattgagttcgtatattcgtacgcgttcgcgcggtcgatttatgtattgagttgcgattttttttcgtttttcgtcgtagttcggagagatgtttaagtttcgattgtatttttatttttaaaaagtggttggttttgcggttgagtatttcgtcgttttttcgtgtcgcgaggcgtttcgggttttcgtcgtttaggttttaggatagttagcgttcggtcggcggttattaaggtcgggttcgttcgtttcgtttcggttaatttacgcgcggagaggcgcggcggggcgaattcgtgggggcgttttttttcgttttaacggcgacggttgttaagggggtttgtgagggaaggaaggcggaaagcgtaggtttacgttagtgggagcgaagagaacgcgtagatacgtgagaagttgcgagtgtttatttgggcgtttttttttttaggttgttaatacgagggtcggtgttgttttttaggttgggaagtgggagcgcggtgttagtta

SEQ ID NO: 38926 - DNA, 662 bp, Artificial Sequence
  chemically treated genomic DNA (Homo sapiens) CpG-island No: 38926
taactaacaccgcgctcccacttcccaacctaaaaaacaacaccgaccctcgtattaacaacctaaaaaaaaaaacgcccaaataaacactcgcaacttctcacgtatctacgcgttctcttcgctcccactaacgtaaacctacgctttccgccttccttccctcacaaacccccttaacaaccgtcgccgttaaaacgaaaaaaaacgcccccacgaattcgccccgccgcgcctctccgcgcgtaaattaaccgaaacgaaacgaacgaacccgaccttaataaccgccgaccgaacgctaactatcctaaaacctaaacgacgaaaacccgaaacgcctcgcgacacgaaaaaacgacgaaatactcaaccgcaaaaccaaccactttttaaaaataaaaatacaatcgaaacttaaacatctctccgaactacgacgaaaaacgaaaaaaaatcgcaactcaatacataaatcgaccgcgcgaacgcgtacgaatatacgaactcaataaacgacgacgacgacgacgaaaacgaataaaaaccccgaaaccaacttatttccgataaaaacgaaacaatctaatctactcgtaaatatttataaaccgactcccccgcaaacgccacctatcattatacttactaacgttcgaaac

SEQ ID NO: 38927 - DNA, 662 bp, Artificial Sequence
  chemically treated genomic DNA (Homo sapiens) CpG-island No: 38927
taattgatatcgcgtttttattttttagtttggaggatagtatcggttttcgtattagtaatttggaagagagggcgtttaggtgggtattcgtaattttttacgtatttgcgcgtttttttcgtttttattggcgtgagtttgcgtttttcgtttttttttttttataagtttttttggtaatcgtcgtcgttgagacggagggagacgtttttacggattcgtttcgtcgcgttttttcgcgcgtagattggtcggagcgaggcgaacgggttcggttttggtagtcgtcgatcgagcgttggttgttttggaatttaggcggcgggagttcggggcgtttcgcggtacggaagagcggcgagatgtttaatcgtaagattagttattttttgggaatgagggtgtagtcggagtttgaatattttttcgagttgcggcgggaagcggggaaggatcgtagtttagtgtatgggtcggtcgcgcggacgcgtgcgagtgtgcggatttagtggacgacggcggcggcggcgaaagcggatgaagatttcggagttaatttgttttcggtgagggcgggatagtttggtttgttcgtgaatatttataaatcggttttttcgtaggcgttatttgttattatgtttattaacgttcgggat

SEQ ID NO: 38928 - DNA, 662 bp, Artificial Sequence
  chemically treated genomic DNA (Homo sapiens) CpG-island No: 38928
atcccgaacgttaataaacataataacaaataacgcctacgaaaaaaccgatttataaatattcacgaacaaaccaaactatcccgccctcaccgaaaacaaattaactccgaaatcttcatccgctttcgccgccgccgccgtcgtccactaaatccgcacactcgcacgcgtccgcgcgaccgacccatacactaaactacgatccttccccgcttcccgccgcaactcgaaaaaatattcaaactccgactacaccctcattcccaaaaaataactaatcttacgattaaacatctcgccgctcttccgtaccgcgaaacgccccgaactcccgccgcctaaattccaaaacaaccaacgctcgatcgacgactaccaaaaccgaacccgttcgcctcgctccgaccaatctacgcgcgaaaaaacgcgacgaaacgaatccgtaaaaacgtctccctccgtctcaacgacgacgattaccaaaaaaacttataaaaaaaaaaaaacgaaaaacgcaaactcacgccaataaaaacgaaaaaaacgcgcaaatacgtaaaaaattacgaatacccacctaaacgccctctcttccaaattactaatacgaaaaccgatactatcctccaaactaaaaaataaaaacgcgatatcaatta

SEQ ID NO: 38929 - DNA, 749 bp, Artificial Sequence
  chemically treated genomic DNA (Homo sapiens) CpG-island No: 38929
tggtatttatttaagagtttaggcgaaggttatttttggaaggggatcgcgtttacggaggtttggttgatttttattcgtgatcggtgcggcgtttttgagattggcgttttttaggggcgaaggtggtcgcgtttttatgatgtaatattttgcgttttttttattttcgtatcgttgttttaggttatcggtattttttttgcggttcgatgtttttttttgtcgcggttcgcgtttttattagcgtgttcgtcgtcgtcggttttacgttcgaggttatcgtggcggttcgcgtttttttttttagttcgttttggtttagtagcggcggtttcgtttaagtttcgggcgttaatagggttcgaaggcgttatcgttgagacgtacgcggtttttgtcgtggttatagtattgtcgttagcgtttgaattaatatcgtttcgtatcggttttggcgttagttttagttttgtttcggtgaaggattcgttcggggcgtttgtagcgcgttgagtttaggggcgtcgttcggtatacgtcgtatcgttttcgaggtcgattgtaacgagggaagttatttagttgaggtgtttcgatttgtgtattcgagtggtgtgggggtgaagtcgttgagaagcggttcgtaggatttagtttaggtcggtttttggttagcgtaatcgggaaattagtttttttttcgagaattttttaattatgtgcggattaggaattatattttttag

SEQ ID NO: 38930 - DNA, 749 bp, Artificial Sequence
  chemically treated genomic DNA (Homo sapiens) CpG-island No: 38930
ctaaaaaatataattcctaatccgcacataattaaaaaattctcgaaaaaaaaactaatttcccgattacgctaaccaaaaaccgacctaaactaaatcctacgaaccgcttctcaacgacttcacccccacaccactcgaatacacaaatcgaaacacctcaactaaataacttccctcgttacaatcgacctcgaaaacgatacgacgtataccgaacgacgcccctaaactcaacgcgctacaaacgccccgaacgaatccttcaccgaaacaaaactaaaactaacgccaaaaccgatacgaaacgatattaattcaaacgctaacgacaatactataaccacgacaaaaaccgcgtacgtctcaacgataacgccttcgaaccctattaacgcccgaaacttaaacgaaaccgccgctactaaaccaaaacgaactaaaaaaaaaaacgcgaaccgccacgataacctcgaacgtaaaaccgacgacgacgaacacgctaataaaaacgcgaaccgcgacaaaaaaaaacatcgaaccgcaaaaaaaataccgataacctaaaacaacgatacgaaaataaaaaaaacgcaaaatattacatcataaaaacgcgaccaccttcgcccctaaaaaacgccaatctcaaaaacgccgcaccgatcacgaataaaaatcaaccaaacctccgtaaacgcgatccccttccaaaaataaccttcgcctaaactcttaaataaatacca

SEQ ID NO: 38931 - DNA, 749 bp, Artificial Sequence
  chemically treated genomic DNA (Homo sapiens) CpG-island No: 38931
ttgggaagtgtagtttttggttcgtatatggttaggaggttttcggagagagagttagtttttcggttgcgttggttaaaggtcggtttgaattggattttgcggatcgttttttagcggttttatttttatattattcgaatgtatagatcgggatattttagttgggtgatttttttcgttgtaatcggtttcgggagcggtgcggcgtgtatcgagcggcgtttttgggtttagcgcgttgtaggcgtttcgggcggattttttatcgaggtaggattggggttggcgttagagtcggtgcggagcggtgttggtttaggcgttggcgatagtgttatggttacggtaggggtcgcgtgcgttttagcggtggcgttttcggattttattggcgttcgggatttaagcggggtcgtcgttgttggattaggacgaattggagaaggagacgcgggtcgttacggtgatttcgggcgtagggtcggcggcggcgggtacgttggtggaagcgcgggtcgcggtaggggaggatatcgggtcgtagagaaagtgtcgatggtttggggtagcggtgcgagggtgggaaaaacgtaggatattgtattatagagacgcggttattttcgtttttggagagcgttagttttaggagcgtcgtatcggttacgggtggaggttagttaggttttcgtaagcgcggtttttttttaggagtagttttcgtttgggtttttgagtagatgtta

SEQ ID NO: 38932 - DNA, 749 bp, Artificial Sequence
  chemically treated genomic DNA (Homo sapiens) CpG-island No: 38932
taacatctactcaaaaacccaaacgaaaactactcctaaaaaaaaaccgcgcttacgaaaacctaactaacctccacccgtaaccgatacgacgctcctaaaactaacgctctccaaaaacgaaaataaccgcgtctctataatacaatatcctacgtttttcccaccctcgcaccgctaccccaaaccatcgacactttctctacgacccgatatcctcccctaccgcgacccgcgcttccaccaacgtacccgccgccgccgaccctacgcccgaaatcaccgtaacgacccgcgtctccttctccaattcgtcctaatccaacaacgacgaccccgcttaaatcccgaacgccaataaaatccgaaaacgccaccgctaaaacgcacgcgacccctaccgtaaccataacactatcgccaacgcctaaaccaacaccgctccgcaccgactctaacgccaaccccaatcctacctcgataaaaaatccgcccgaaacgcctacaacgcgctaaacccaaaaacgccgctcgatacacgccgcaccgctcccgaaaccgattacaacgaaaaaaatcacccaactaaaatatcccgatctatacattcgaataatataaaaataaaaccgctaaaaaacgatccgcaaaatccaattcaaaccgacctttaaccaacgcaaccgaaaaactaactctctctccgaaaacctcctaaccatatacgaaccaaaaactacacttcccaa

SEQ ID NO: 38933 - DNA, 774 bp, Artificial Sequence
  chemically treated genomic DNA (Homo sapiens) CpG-island No: 38933
cgggtcgttttaaaggggtcgggagttggataatttggggtttcgttttaaagggacggtcgtttcgttttcgtcgtcgcggtttcgtcgagttcgtagggggggttttcgggtttgtcgtttcgggggcggcgtcggtttttcgggtcgtggttttggggtaagttcggggttagtagattcggttttaaaggagaagtcgtggttttttcgttattgtgtagtcgttagcgtcgcgtttgcgatttcgggtttgcggataggtcgtttcgggtttcgtcgttttcggatgcggcgttgagggcggtcgttatggagacggtagcggtcgcggtttcgggttcgggttgggtagtagaaggggagcgtcgacggcggcgttgttcgcgtcgagatcgagatcgggagtagcggcgtcgtcgaggtttaggcggcgacgcgtttcgggttttgttggtcgtttcgcgcggtttttcgttttcgtcgtcgtcgtcgtcgttcgttaggttttggtcgttagtttcgtttggagagcggtttgggggttcgagacgtcggcggtttcgttcgagatttcgattttcgcgatttcgagttcggaagcggtttgtcggttcgggtagtcgcggggaggaagaggaggaggaggaggaggaggggggcgtagacgacggcgaagtcgaggaggagtttgaggaggaggaagaggaggaggaggatttgatcgatggtttcgttatcgttagtttcgttattttcgaggttttgtaggtg

SEQ ID NO: 38934 - DNA, 774 bp, Artificial Sequence
  chemically treated genomic DNA (Homo sapiens) CpG-island No: 38934
cacctacaaaacctcgaaaataacgaaactaacgataacgaaaccatcgatcaaatcctcctcctcctcttcctcctcctcaaactcctcctcgacttcgccgtcgtctacgcccccctcctcctcctcctcctcctcttcctccccgcgactacccgaaccgacaaaccgcttccgaactcgaaatcgcgaaaatcgaaatctcgaacgaaaccgccgacgtctcgaacccccaaaccgctctccaaacgaaactaacgaccaaaacctaacgaacgacgacgacgacgacgaaaacgaaaaaccgcgcgaaacgaccaacaaaacccgaaacgcgtcgccgcctaaacctcgacgacgccgctactcccgatctcgatctcgacgcgaacaacgccgccgtcgacgctccccttctactacccaacccgaacccgaaaccgcgaccgctaccgtctccataacgaccgccctcaacgccgcatccgaaaacgacgaaacccgaaacgacctatccgcaaacccgaaatcgcaaacgcgacgctaacgactacacaataacgaaaaaaccacgacttctcctttaaaaccgaatctactaaccccgaacttaccccaaaaccacgacccgaaaaaccgacgccgcccccgaaacgacaaacccgaaaaccccccctacgaactcgacgaaaccgcgacgacgaaaacgaaacgaccgtccctttaaaacgaaaccccaaattatccaactcccgacccctttaaaacgacccg

SEQ ID NO: 38935 - DNA, 774 bp, Artificial Sequence
  chemically treated genomic DNA (Homo sapiens) CpG-island No: 38935
tatttgtaaggtttcgagggtggcgaagttggcgatggcgaagttatcgattaagttttttttttttttttttttttttttaggttttttttcggtttcgtcgtcgtttgcgttttttttttttttttttttttttttttttttttcgcggttgttcgagtcggtaggtcgttttcgagttcggggtcgcgggggtcgaggtttcggacggggtcgtcggcgtttcgggtttttaggtcgttttttagacgaagttgacgattaaggtttggcgggcggcggcggcgacgacgaggacgaggagtcgcgcggggcggttaatagggttcggggcgcgtcgtcgtttggatttcggcggcgtcgttgttttcggtttcggtttcggcgcgagtagcgtcgtcgtcggcgttttttttttgttgtttagttcggattcggggtcgcggtcgttgtcgtttttatggcgatcgtttttagcgtcgtattcggaggcggcggggttcgaagcggtttgttcgtaggttcggggtcgtaggcgcggcgttggcggttgtatagtgacgagagggttacggttttttttttaaagtcggatttgttggtttcgagtttgttttaaggttacggttcggggagtcggcgtcgttttcggggcgataagttcgagggttttttttgcgggttcggcggggtcgcgacggcgaaaacggggcggtcgtttttttaaggcgaggttttaagttgtttagttttcggtttttttaagacgattcg

SEQ ID NO: 38936 - DNA, 774 bp, Artificial Sequence
  chemically treated genomic DNA (Homo sapiens) CpG-island No: 38936
cgaatcgtcttaaaaaaaccgaaaactaaacaacttaaaacctcgccttaaaaaaacgaccgccccgttttcgccgtcgcgaccccgccgaacccgcaaaaaaaaccctcgaacttatcgccccgaaaacgacgccgactccccgaaccgtaaccttaaaacaaactcgaaaccaacaaatccgactttaaaaaaaaaaccgtaaccctctcgtcactatacaaccgccaacgccgcgcctacgaccccgaacctacgaacaaaccgcttcgaaccccgccgcctccgaatacgacgctaaaaacgatcgccataaaaacgacaacgaccgcgaccccgaatccgaactaaacaacaaaaaaaaaacgccgacgacgacgctactcgcgccgaaaccgaaaccgaaaacaacgacgccgccgaaatccaaacgacgacgcgccccgaaccctattaaccgccccgcgcgactcctcgtcctcgtcgtcgccgccgccgcccgccaaaccttaatcgtcaacttcgtctaaaaaacgacctaaaaacccgaaacgccgacgaccccgtccgaaacctcgacccccgcgaccccgaactcgaaaacgacctaccgactcgaacaaccgcgaaaaaaaaaaaaaaaaaaaaaaaaaaaaaaaaaacgcaaacgacgacgaaaccgaaaaaaaacctaaaaaaaaaaaaaaaaaaaaaaaaaacttaatcgataacttcgccatcgccaacttcgccaccctcgaaaccttacaaata

SEQ ID NO: 38937 - DNA, 708 bp, Artificial Sequence
  chemically treated genomic DNA (Homo sapiens) CpG-island No: 38937
atacgaataggttttcgtttatgtgcgtgcggacgtgggtaataaggttggagttttggttgaagtttttgtcgtattcggggtatttgtagggtttttcgtcggtgtgcgtgcggcggtgttggataaggtgggagttgcggatgaagtttttgtcgtagtcggaatatttgtagggttttttatcggtgtggatgcgttggtggcggataagggtggagtttatgatgaagtttttgtcgtagtcggcgtagatgtagggtcgttcgtcgcggtggatgcgttggtggttgatgaggttggagttgacgttgaagtttttgtcgtattttgggtatttgtagggtcgttcgttcgtgtgcgtgcgttggtgtcgtagtaacgtggcgtttagggtgaaggttttgtcgtatattgggtatttgaacgggttttcgcgtaggtgagttcgttggtgtttgatgagggtggagttgtggtcgaagtttttgtcgtattttaggtattcgtagggtttttcgtttgtgtgcgtgcgttggtgttgggttagtttcgagttttggatgaagtttttttcgtattcggtgtagcggtatggtttttcgttcgcgtggattttttggtgtttgaggaggttgtggttttggtcgaagcgtttttcgtattcggggtatttgtagggtttttcgtttgtgtgggtggtttggt

SEQ ID NO: 38938 - DNA, 708 bp, Artificial Sequence
  chemically treated genomic DNA (Homo sapiens) CpG-island No: 38938
accaaaccacccacacaaacgaaaaaccctacaaataccccgaatacgaaaaacgcttcgaccaaaaccacaacctcctcaaacaccaaaaaatccacgcgaacgaaaaaccataccgctacaccgaatacgaaaaaaacttcatccaaaactcgaaactaacccaacaccaacgcacgcacacaaacgaaaaaccctacgaatacctaaaatacgacaaaaacttcgaccacaactccaccctcatcaaacaccaacgaactcacctacgcgaaaacccgttcaaatacccaatatacgacaaaaccttcaccctaaacgccacgttactacgacaccaacgcacgcacacgaacgaacgaccctacaaatacccaaaatacgacaaaaacttcaacgtcaactccaacctcatcaaccaccaacgcatccaccgcgacgaacgaccctacatctacgccgactacgacaaaaacttcatcataaactccacccttatccgccaccaacgcatccacaccgataaaaaaccctacaaatattccgactacgacaaaaacttcatccgcaactcccaccttatccaacaccgccgcacgcacaccgacgaaaaaccctacaaataccccgaatacgacaaaaacttcaaccaaaactccaaccttattacccacgtccgcacgcacataaacgaaaacctattcgtat

SEQ ID NO: 38939 - DNA, 708 bp, Artificial Sequence
  chemically treated genomic DNA (Homo sapiens) CpG-island No: 38939
attaggttatttatataggcgagaaattttataagtgtttcgagtgcgggaagcgtttcggttagaattataatttttttaagtattagaagatttacgcgggcgagaagttatatcgttgtatcgagtgcgggaagagttttatttagagttcggagttgatttagtattagcgtacgtatataggcgagaagttttacgagtgtttagagtgcggtaagagtttcggttatagttttatttttattaagtattagcggatttatttgcgcgaggattcgtttaagtgtttagtgtgcggtaagatttttattttgagcgttacgttgttgcggtattagcgtacgtatacgggcgagcggttttataagtgtttagagtgcggtaagagttttagcgttagttttaattttattaattattagcgtatttatcgcggcgagcggttttatatttgcgtcgattgcggtaagagttttattatgagttttatttttattcgttattagcgtatttatatcggtgagaagttttataagtgtttcgattgcggtaagagttttattcgtagtttttattttatttagtatcgtcgtacgtatatcggcgagaagttttataagtgtttcgagtgcggtaagagttttagttagagttttaattttattatttacgttcgtacgtatatggacgagaatttgttcgtgt

SEQ ID NO: 38940 - DNA, 708 bp, Artificial Sequence
  chemically treated genomic DNA (Homo sapiens) CpG-island No: 38940
acacgaacaaattctcgtccatatacgtacgaacgtaaataataaaattaaaactctaactaaaactcttaccgcactcgaaacacttataaaacttctcgccgatatacgtacgacgatactaaataaaataaaaactacgaataaaactcttaccgcaatcgaaacacttataaaacttctcaccgatataaatacgctaataacgaataaaaataaaactcataataaaactcttaccgcaatcgacgcaaatataaaaccgctcgccgcgataaatacgctaataattaataaaattaaaactaacgctaaaactcttaccgcactctaaacacttataaaaccgctcgcccgtatacgtacgctaataccgcaacaacgtaacgctcaaaataaaaatcttaccgcacactaaacacttaaacgaatcctcgcgcaaataaatccgctaatacttaataaaaataaaactataaccgaaactcttaccgcactctaaacactcgtaaaacttctcgcctatatacgtacgctaatactaaatcaactccgaactctaaataaaactcttcccgcactcgatacaacgatataacttctcgcccgcgtaaatcttctaatacttaaaaaaattataattctaaccgaaacgcttcccgcactcgaaacacttataaaatttctcgcctatataaataacctaat

SEQ ID NO: 38941 - DNA, 586 bp, Artificial Sequence
  chemically treated genomic DNA (Homo sapiens) CpG-island No: 38941
  misc_feature (283)..(283): n is either a, c, g or t
cggtttcggcgtcgttgggcggttcgtttttttcgtcgcgcgcgtcgttgcgcgttttttttcgtcggtcgtcgtttttcgttcgttcgtttcgggtcggttttcgtcgcgcgggcgcgttcgggtgtcgcgtttcgcgttttcgcgcgtcgtttcggtcggttcggtgcggcggcgcggtcgtttcgcgtttggggtcgttgtttttgttcgcggcgcgggtcggggggttgcggtttcggggggcggtcggtggggcggcgcgggttcggggggcgggggngtgcggcggtttcgttgtttggtttcgtgcggtttgtgggttcgcgcggtcgcggttcgggtcggcggcgtcgggttcgttcgttgcgcggcgttggtcggttttttttcgtgggtttcgcggcgcggttttgtcgcgttcgtcgcgttgttgcgttcgggcgcgcgtttcgttttcggcggcgcgggggtcggtgcgattgttcgtttcgttttttttttttagtcgcgtcgcgttttcgtcgcgcgggcggtgggtcgattgcggcggcgggttcgggcgtgttcgtgtcgttttggtcgt

SEQ ID NO: 38942 - DNA, 586 bp, Artificial Sequence
  chemically treated genomic DNA (Homo sapiens) CpG-island No: 38942
  misc_feature (304)..(304): n is either a, c, g or t
acgaccaaaacgacacgaacacgcccgaacccgccgccgcaatcgacccaccgcccgcgcgacgaaaacgcgacgcgactaaaaaaaaaaaacgaaacgaacaatcgcaccgacccccgcgccgccgaaaacgaaacgcgcgcccgaacgcaacaacgcgacgaacgcgacaaaaccgcgccgcgaaacccacgaaaaaaaaccgaccaacgccgcgcaacgaacgaacccgacgccgccgacccgaaccgcgaccgcgcgaacccacaaaccgcacgaaaccaaacaacgaaaccgccgcacncccccgccccccgaacccgcgccgccccaccgaccgccccccgaaaccgcaaccccccgacccgcgccgcgaacaaaaacaacgaccccaaacgcgaaacgaccgcgccgccgcaccgaaccgaccgaaacgacgcgcgaaaacgcgaaacgcgacacccgaacgcgcccgcgcgacgaaaaccgacccgaaacgaacgaacgaaaaacgacgaccgacgaaaaaaaacgcgcaacgacgcgcgcgacgaaaaaaacgaaccgcccaacgacgccgaaaccg

SEQ ID NO: 38943 - DNA, 586 bp, Artificial Sequence
  chemically treated genomic DNA (Homo sapiens) CpG-island No: 38943
  misc_feature (304)..(304): n is either a, c, g or t
acgattaggacggtacgaatacgttcgggttcgtcgtcgtagtcggtttatcgttcgcgcgacggaggcgcggcgcgattgggggaggggagcgggacgaatagtcgtatcgattttcgcgtcgtcggaggcggggcgcgcgttcgggcgtaatagcgcggcgggcgcggtaaagtcgcgtcgcggaatttacgggggggggtcgattagcgtcgcgtagcgaacggattcggcgtcgtcggttcgggtcgcgatcgcgcgaatttataggtcgtacgaggttaggtagcggggtcgtcgtatnttttcgtttttcgggttcgcgtcgttttatcggtcgtttttcgggatcgtagtttttcggttcgcgtcgcgggtaggagtagcggttttaggcgcggggcggtcgcgtcgtcgtatcgggtcgatcggggcggcgcgcgggagcgcggggcgcggtattcgggcgcgttcgcgcggcgggggtcggttcggggcgggcgggcggggggcggcggtcggcgggggggggcgcgtagcggcgcgcgcgacggggggggcgggtcgtttagcggcgtcggggtcg

SEQ ID NO: 38944 - DNA, 586 bp, Artificial Sequence
  chemically treated genomic DNA (Homo sapiens) CpG-island No: 38944
  misc_feature (283)..(283): n is either a, c, g or t
cgaccccgacgccgctaaacgacccgccccccccgtcgcgcgcgccgctacgcgcccccccccgccgaccgccgccccccgcccgcccgccccgaaccgacccccgccgcgcgaacgcgcccgaataccgcgccccgcgctcccgcgcgccgccccgatcgacccgatacgacgacgcgaccgccccgcgcctaaaaccgctactcctacccgcgacgcgaaccgaaaaactacgatcccgaaaaacgaccgataaaacgacgcgaacccgaaaaacgaaaanatacgacgaccccgctacctaacctcgtacgacctataaattcgcgcgatcgcgacccgaaccgacgacgccgaatccgttcgctacgcgacgctaatcgacccccccccgtaaattccgcgacgcgactttaccgcgcccgccgcgctattacgcccgaacgcgcgccccgcctccgacgacgcgaaaatcgatacgactattcgtcccgctcccctcccccaatcgcgccgcgcctccgtcgcgcgaacgataaaccgactacgacgacgaacccgaacgtattcgtaccgtcctaatcgt

SEQ ID NO: 38945 - DNA, 616 bp, Artificial Sequence
  chemically treated genomic DNA (Homo sapiens) CpG-island No: 38945
gtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggttgtgttggggtcggatcgtgaaacgttgttgtgcggtgtgaaagcgttgtttggcggttatgaggtttttgggtttgttatcggattttttgggtttgtggggcgtatcgggtttgtatttttcgggtaaggtggttaatgg

SEQ ID NO: 38946 - DNA, 616 bp, Artificial Sequence
  chemically treated genomic DNA (Homo sapiens) CpG-island No: 38946
ccattaaccaccttacccgaaaaatacaaacccgatacgccccacaaacccaaaaaatccgataacaaacccaaaaacctcataaccgccaaacaacgctttcacaccgcacaacaacgtttcacgatccgaccccaacacaaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgac

SEQ ID NO: 38947 - DNA, 616 bp, Artificial Sequence
  chemically treated genomic DNA (Homo sapiens) CpG-island No: 38947
ttattgattattttgttcggaaaatataaattcgatgcgttttataggtttaagagattcggtaataaatttagaagttttatgatcgttagatagcgtttttatatcgtataataacgttttacggttcgattttagtataatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgat

SEQ ID NO: 38948 - DNA, 616 bp, Artificial Sequence
  chemically treated genomic DNA (Homo sapiens) CpG-island No: 38948
atcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgattatactaaaatcgaaccgtaaaacgttattatacgatataaaaacgctatctaacgatcataaaacttctaaatttattaccgaatctcttaaacctataaaacgcatcgaatttatattttccgaacaaaataatcaataa

SEQ ID NO: 38949 - DNA, 589 bp, Artificial Sequence
  chemically treated genomic DNA (Homo sapiens) CpG-island No: 38949
ggatcggaggcggggttatgaatagatcggattgggttaaaaggaataaggcgaggattgggcggggttagagggaaataggggcggggttaggcgtcgggagtttttatatgcgtttcgagttcgttagaagttgttaggttgaggttgttgtttcggcgggagttgtggcgcggagcggtttttttgttgcgtttgttttcgttttgttttacgatttatatttagtgttttattttttaagagttcgcgtttttcgcgcggcggtcgagaggcggttgttcgcggtttcgcgcgggcgcggggcgatggcggcgcgggggttagggtttcgcgcgtttcgtttgttgtttttggtttagttggtcgcggggcgttgcggtttagcgggcgcggcgggcggcgcgtagagaggtaagttcgggttgtagaggggcggggcgggagttggttcggattttatatcgcggtgtttaggaagtcgttaggcgacggtcgtcggaaaatttggttgcgaggggaggtgggttttttttttttgggggtttggagtgaggttttagtttaaatgtttagatttgtttattta

SEQ ID NO: 38950 - DNA, 589 bp, Artificial Sequence
  chemically treated genomic DNA (Homo sapiens) CpG-island No: 38950
taaataaacaaatctaaacatttaaactaaaacctcactccaaacccccaaaaaaaaaaaacccacctcccctcgcaaccaaattttccgacgaccgtcgcctaacgacttcctaaacaccgcgatataaaatccgaaccaactcccgccccgcccctctacaacccgaacttacctctctacgcgccgcccgccgcgcccgctaaaccgcaacgccccgcgaccaactaaaccaaaaacaacaaacgaaacgcgcgaaaccctaacccccgcgccgccatcgccccgcgcccgcgcgaaaccgcgaacaaccgcctctcgaccgccgcgcgaaaaacgcgaactcttaaaaaataaaacactaaatataaatcgtaaaacaaaacgaaaacaaacgcaacaaaaaaaccgctccgcgccacaactcccgccgaaacaacaacctcaacctaacaacttctaacgaactcgaaacgcatataaaaactcccgacgcctaaccccgcccctatttccctctaaccccgcccaatcctcgccttattccttttaacccaatccgatctattcataaccccgcctccgatcc

SEQ ID NO: 38951 - DNA, 589 bp, Artificial Sequence
  chemically treated genomic DNA (Homo sapiens) CpG-island No: 38951
taaatgagtaaatttggatatttaaattgaaattttattttaagtttttaggagaaaaaaatttattttttttcgtaattaggtttttcggcggtcgtcgtttggcggttttttgggtatcgcgatgtggagttcgggttagttttcgtttcgtttttttgtagttcgggtttatttttttgcgcgtcgttcgtcgcgttcgttagatcgtagcgtttcgcgattagttggattaagagtagtaggcggagcgcgcggggttttgattttcgcgtcgttatcgtttcgcgttcgcgcgggatcgcgggtagtcgtttttcgatcgtcgcgcggggaacgcgaatttttggggaatggagtattgagtgtgagtcgtgagataaaacgagggtagacgtagtagaggggtcgtttcgcgttatagttttcgtcgggatagtagttttagtttagtagtttttggcgggttcgggacgtatgtggaagttttcggcgtttagtttcgtttttatttttttttggtttcgtttaattttcgttttgttttttttggtttagttcggtttatttatagtttcgttttcgattt

SEQ ID NO: 38952 - DNA, 589 bp, Artificial Sequence
  chemically treated genomic DNA (Homo sapiens) CpG-island No: 38952
aaatcgaaaacgaaactataaataaaccgaactaaaccaaaaaaaacaaaacgaaaattaaacgaaaccaaaaaaaaataaaaacgaaactaaacgccgaaaacttccacatacgtcccgaacccgccaaaaactactaaactaaaactactatcccgacgaaaactataacgcgaaacgacccctctactacgtctaccctcgttttatctcacgactcacactcaatactccattccccaaaaattcgcgttccccgcgcgacgatcgaaaaacgactacccgcgatcccgcgcgaacgcgaaacgataacgacgcgaaaatcaaaaccccgcgcgctccgcctactactcttaatccaactaatcgcgaaacgctacgatctaacgaacgcgacgaacgacgcgcaaaaaaataaacccgaactacaaaaaaacgaaacgaaaactaacccgaactccacatcgcgatacccaaaaaaccgccaaacgacgaccgccgaaaaacctaattacgaaaaaaaataaatttttttctcctaaaaacttaaaataaaatttcaatttaaatatccaaatttactcattta

SEQ ID NO: 38953 - DNA, 695 bp, Artificial Sequence
  chemically treated genomic DNA (Homo sapiens) CpG-island No: 38953
acgcggtcgcggatttcgaatagggatagttggagacgggtttgggtagcgcgcggtttgtattcgcggttatttattttgtagttcggttcggttaggttatttcgggtaagggttgggggaattcgttgtttttagcgtcgttacggtcgggcgatattttgcgttttgggaagggggataggggtgcggcgcggtttcggttttcggttcgttcggattttcggttttattttgacgtggaagcggatgagcgttaggcggatgtagtgggttatgtagacgggcggtaggaattagatttttggcggcggggtgtttttgttttggatatggttgacgatttgttgtgtcgtttggcgttcgttgttttgtcgtttgatttattcgtgtagtcgggttttttcgagcgcgtcgttgaagaagacgaagagttcgatgttgtcgtcgaagtaggttttggttagcgtcgttaggtagttaagtatgtggttttattggtcgtcgttgatttagtcggtgtagaagtcgtcgtagaggcggtgtaggtagttgtcggcgtttattagtaggcgtagcggggtttgcgggggtcgttgtcgttcgtcgtttattaggttgtttcgggttagtttttgtagttttatcggtattacggcgttcgggtagtgtttttcgatgtagttttggaagtt

SEQ ID NO: 38954 - DNA, 695 bp, Artificial Sequence
  chemically treated genomic DNA (Homo sapiens) CpG-island No: 38954
aacttccaaaactacatcgaaaaacactacccgaacgccgtaataccgataaaactacaaaaactaacccgaaacaacctaataaacgacgaacgacaacgacccccgcaaaccccgctacgcctactaataaacgccgacaactacctacaccgcctctacgacgacttctacaccgactaaatcaacgacgaccaataaaaccacatacttaactacctaacgacgctaaccaaaacctacttcgacgacaacatcgaactcttcgtcttcttcaacgacgcgctcgaaaaaacccgactacacgaataaatcaaacgacaaaacaacgaacgccaaacgacacaacaaatcgtcaaccatatccaaaacaaaaacaccccgccgccaaaaatctaattcctaccgcccgtctacataacccactacatccgcctaacgctcatccgcttccacgtcaaaataaaaccgaaaatccgaacgaaccgaaaaccgaaaccgcgccgcacccctatcccccttcccaaaacgcaaaatatcgcccgaccgtaacgacgctaaaaacaacgaattcccccaacccttacccgaaataacctaaccgaaccgaactacaaaataaataaccgcgaatacaaaccgcgcgctacccaaacccgtctccaactatccctattcgaaatccgcgaccgcgt

SEQ ID NO: 38955 - DNA, 695 bp, Artificial Sequence
  chemically treated genomic DNA (Homo sapiens) CpG-island No: 38955
ggtttttaggattatatcgagaagtattgttcgagcgtcgtggtgtcggtggagttgtagaagttggttcggggtagtttggtgggcggcgggcggtagcggttttcgtagatttcgttgcgtttgttggtggacgtcgataattgtttgtatcgtttttacggcggtttttatatcgattgggttagcggcggttagtggaattatatgtttggttatttggcggcgttggttaaggtttgtttcggcggtaatatcgagtttttcgttttttttaacggcgcgttcgagaaggttcggttgtacgagtgggttaagcggtagggtaacgagcgttagacggtatagtagatcgttagttatgtttagaataagggtatttcgtcgttaaaggtttggtttttgtcgttcgtttgtatggtttattgtattcgtttggcgtttattcgtttttacgttaaggtgaggtcggggattcgggcgggtcggggatcggggtcgcgtcgtatttttatttttttttttagggcgtagaatgtcgttcggtcgtggcggcgttgggggtagcgagtttttttagtttttgttcgggatagtttggtcgggtcgggttgtaagatggatggtcgcgggtgtaggtcgcgcgttgtttaagttcgtttttagttgtttttgttcggggttcgcggtcgcgt

SEQ ID NO: 38956 - DNA, 695 bp, Artificial Sequence
  chemically treated genomic DNA (Homo sapiens) CpG-island No: 38956
acgcgaccgcgaaccccgaacaaaaacaactaaaaacgaacttaaacaacgcgcgacctacacccgcgaccatccatcttacaacccgacccgaccaaactatcccgaacaaaaactaaaaaaactcgctacccccaacgccgccacgaccgaacgacattctacgccctaaaaaaaaaaataaaaatacgacgcgaccccgatccccgacccgcccgaatccccgacctcaccttaacgtaaaaacgaataaacgccaaacgaatacaataaaccatacaaacgaacgacaaaaaccaaacctttaacgacgaaatacccttattctaaacataactaacgatctactataccgtctaacgctcgttaccctaccgcttaacccactcgtacaaccgaaccttctcgaacgcgccgttaaaaaaaacgaaaaactcgatattaccgccgaaacaaaccttaaccaacgccgccaaataaccaaacatataattccactaaccgccgctaacccaatcgatataaaaaccgccgtaaaaacgatacaaacaattatcgacgtccaccaacaaacgcaacgaaatctacgaaaaccgctaccgcccgccgcccaccaaactaccccgaaccaacttctacaactccaccgacaccacgacgctcgaacaatacttctcgatataatcctaaaaacc

SEQ ID NO: 38957 - DNA, 577 bp, Artificial Sequence
  chemically treated genomic DNA (Homo sapiens) CpG-island No: 38957
gtgtcgaggacgttcgaggatggtaaattattttttcgcgaaattatagtttcgttttcgagttaggtgtcggtaaagggtaataacgaaggaggtttaattttcgcgcgttttttagggtttcgggtttttcgtttttgtgttcgacgacggtatttttatcgcgatttttttttaggaattttttttaaaggcgattaagttataggaattttttttaacggcgattaagttataagagttttttacgcgaggtttgtacgtcgtgtttttttttttttttattcgtcggggcgtttcgttagggttacgcgtttttcgtttattatgatggttgggttttaatttatcgcggtagataggggtcgttggcgcgggggtttcgagtgggcgaagcggggagcgggttgtaggtcgagtagggttaagcggcggtagtggcggcgggtaggatagcgtttacgtaggagaggtatatcgcgttaggtgagataaagttaggcgtggatagtataggtgaggtgaggttaagtaacgtaagttttagtgttcgtgaggtagttggtttgcgtaggcg

SEQ ID NO: 38958 - DNA, 577 bp, Artificial Sequence
  chemically treated genomic DNA (Homo sapiens) CpG-island No: 38958
cgcctacgcaaaccaactacctcacgaacactaaaacttacgttacttaacctcacctcacctatactatccacgcctaactttatctcacctaacgcgatatacctctcctacgtaaacgctatcctacccgccgccactaccgccgcttaaccctactcgacctacaacccgctccccgcttcgcccactcgaaacccccgcgccaacgacccctatctaccgcgataaattaaaacccaaccatcataataaacgaaaaacgcgtaaccctaacgaaacgccccgacgaataaaaaaaaaaaaaaacacgacgtacaaacctcgcgtaaaaaactcttataacttaatcgccgttaaaaaaaattcctataacttaatcgcctttaaaaaaaattcctaaaaaaaaatcgcgataaaaataccgtcgtcgaacacaaaaacgaaaaacccgaaaccctaaaaaacgcgcgaaaattaaacctccttcgttattaccctttaccgacacctaactcgaaaacgaaactataatttcgcgaaaaaataatttaccatcctcgaacgtcctcgacac

SEQ ID NO: 38959 - DNA, 577 bp, Artificial Sequence
  chemically treated genomic DNA (Homo sapiens) CpG-island No: 38959
cgtttgcgtaaattagttgttttacgagtattggagtttgcgttatttggttttattttatttgtgttgtttacgtttggttttgttttatttgacgcgatatgttttttttgcgtgggcgttgttttgttcgtcgttattatcgtcgtttggttttgttcggtttgtagttcgtttttcgtttcgtttattcggggttttcgcgttagcggtttttgtttgtcgcggtgagttgaggtttagttattatggtgggcgggaagcgcgtggttttggcggggcgtttcgacgggtggggagaagggaggatacggcgtgtaggtttcgcgtgggaggtttttgtggtttggtcgtcgttgggggaggtttttgtggtttggtcgtttttgggggaggtttttgggagagggtcgcggtgaggatgtcgtcgtcgggtataggggcggaaagttcgggattttgaggaacgcgcggggattgggtttttttcgttgttattttttatcggtatttggttcgggggcggggttgtggtttcgcggaggaatgatttattattttcggacgttttcggtat

SEQ ID NO: 38960 - DNA, 577 bp, Artificial Sequence
  chemically treated genomic DNA (Homo sapiens) CpG-island No: 38960
ataccgaaaacgtccgaaaataataaatcattcctccgcgaaaccacaaccccgcccccgaaccaaataccgataaaaaataacaacgaaaaaaacccaatccccgcgcgttcctcaaaatcccgaactttccgcccctatacccgacgacgacatcctcaccgcgaccctctcccaaaaacctcccccaaaaacgaccaaaccacaaaaacctcccccaacgacgaccaaaccacaaaaacctcccacgcgaaacctacacgccgtatcctcccttctccccacccgtcgaaacgccccgccaaaaccacgcgcttcccgcccaccataataactaaacctcaactcaccgcgacaaacaaaaaccgctaacgcgaaaaccccgaataaacgaaacgaaaaacgaactacaaaccgaacaaaaccaaacgacgataataacgacgaacaaaacaacgcccacgcaaaaaaaacatatcgcgtcaaataaaacaaaaccaaacgtaaacaacacaaataaaataaaaccaaataacgcaaactccaatactcgtaaaacaactaatttacgcaaacg

SEQ ID NO: 38961 - DNA, 1091 bp, Artificial Sequence
  chemically treated genomic DNA (Homo sapiens) CpG-island No: 38961
agggcgcggtgggaggggaaattgaggttcggttaggtattttcgtcgcgtttagttcgtcgagaggtttaggtttcgggaggtatttggagtttgcgtttcgttcgcgtcgttttttgtttcgcgcgttgcgtttacgtgattcgggtttgggaggagtcggggcgggcgggggttatttgaataagggagttacgtgagcggggggcgggggtgggggggcggtgtcgggcggttgttacgtgacgcggtttcggggtcgtcgttgtcgttgtcgttgtcgtcgagtttagtcgagtcgcgtttatttcgggttttcgtttcgtttttattttcgtttttgttttggcggcgcgatttcgtttcgggcgcggtttttagtagtcgcgcgtcgttcgtttaagcgttcgtcgcgtagttaaaataaagagcgatggggttcgttgtcggtcggagtttttatttggggttcgcgttcgttcgtcgttcgtagcgttttttgtttttgttgtagttgttgttgttcgtcgttgtttcggggtttacgtaggtttaggtcgtttcgtttttcgaattgtgtaggtgggtggttcgttcggacgtaggtttcgttcgcggtgttcggggtgagcggtcggcgtggggggcggggagcgttcgaggagtttttggggtttttaagtcgttttcgtttcgcgtcggggttcgtttcgttttcgagggaaagttgtttgcgtggtgttcgcgagtttcgtcgggtttcgtgcgtaggcggggggcgcgggggtatacgcggtcgtggcggttttggagtttcgcgttcggttatttgtggttgtcgttgagtcgggggtggttttgtgcggagcggtcgtttcggtttttggggtcggcgtttgttttcgcgcggtcgggcgttcgggaaagttggaggtagaaattttagtttgttttgttttcgttgcgcgtttgtattagagtttcgttagcggggtatcggtgaggtttttcggtgtggagaggtttatcggggcgttggagttcgtaggaatggttttggagttgagtgtttgtggttttatttgttgatt

SEQ ID NO: 38962 - DNA, 1091 bp, Artificial Sequence
  chemically treated genomic DNA (Homo sapiens) CpG-island No: 38962
aatcaacaaataaaaccacaaacactcaactccaaaaccattcctacgaactccaacgccccgataaacctctccacaccgaaaaacctcaccgataccccgctaacgaaactctaatacaaacgcgcaacgaaaacaaaacaaactaaaatttctacctccaactttcccgaacgcccgaccgcgcgaaaacaaacgccgaccccaaaaaccgaaacgaccgctccgcacaaaaccacccccgactcaacgacaaccacaaataaccgaacgcgaaactccaaaaccgccacgaccgcgtatacccccgcgccccccgcctacgcacgaaacccgacgaaactcgcgaacaccacgcaaacaactttccctcgaaaacgaaacgaaccccgacgcgaaacgaaaacgacttaaaaaccccaaaaactcctcgaacgctccccgccccccacgccgaccgctcaccccgaacaccgcgaacgaaacctacgtccgaacgaaccacccacctacacaattcgaaaaacgaaacgacctaaacctacgtaaaccccgaaacaacgacgaacaacaacaactacaacaaaaacaaaaaacgctacgaacgacgaacgaacgcgaaccccaaataaaaactccgaccgacaacgaaccccatcgctctttattttaactacgcgacgaacgcttaaacgaacgacgcgcgactactaaaaaccgcgcccgaaacgaaatcgcgccgccaaaacaaaaacgaaaataaaaacgaaacgaaaacccgaaataaacgcgactcgactaaactcgacgacaacgacaacgacaacgacgaccccgaaaccgcgtcacgtaacaaccgcccgacaccgcccccccacccccgccccccgctcacgtaactcccttattcaaataacccccgcccgccccgactcctcccaaacccgaatcacgtaaacgcaacgcgcgaaacaaaaaacgacgcgaacgaaacgcaaactccaaatacctcccgaaacctaaacctctcgacgaactaaacgcgacgaaaatacctaaccgaacctcaatttcccctcccaccgcgccct

SEQ ID NO: 38963 - DNA, 1091 bp, Artificial Sequence
  chemically treated genomic DNA (Homo sapiens) CpG-island No: 38963
aattagtaaatgaaattataaatatttaattttaggattatttttgcgggttttaacgtttcggtgagtttttttatatcgaggggttttatcggtgtttcgttggcgaaattttgatgtaaacgcgtagcgggaataaagtaaattggagtttttgtttttaattttttcggacgttcggtcgcgcgagggtaggcgtcgattttaagggtcggggcgatcgtttcgtataaagttattttcgatttagcgatagttataagtggtcggacgcggggttttaggatcgttacgatcgcgtgtgttttcgcgtttttcgtttgcgtacgggattcggcgggattcgcggatattacgtaggtaattttttttcgggaacggggcggatttcggcgcggaacggaggcgatttggagattttaggagtttttcgagcgtttttcgttttttacgtcggtcgtttatttcgggtatcgcgagcggagtttgcgttcgggcgggttatttatttgtatagttcggggaacggggcggtttgggtttgcgtggatttcggggtagcgacgagtagtagtagttgtagtaggagtagagagcgttgcgggcggcgggcgggcgcgggttttaggtgggggtttcggtcggtagcggattttatcgttttttgttttgattgcgcggcgggcgtttaggcgaacggcgcgcgattgttgggggtcgcgttcgggacggggtcgcgtcgttagggtaaaggcggaggtggagacggagcgggagttcgaggtgagcgcggttcgattgggttcggcgatagcgatagcggtagcggcggtttcggaatcgcgttacgtgatagtcgttcggtatcgtttttttattttcgtttttcgtttacgtgatttttttgtttaggtgattttcgttcgtttcggttttttttaggttcgggttacgtgagcgtagcgcgcgggataggaagcggcgcgggcggggcgtaggttttaggtgtttttcggggtttgagtttttcggcgggttgggcgcggcgggggtgtttagtcgggttttagtttttttttttatcgcgtttt

SEQ ID NO: 38964 - DNA, 1091 bp, Artificial Sequence
  chemically treated genomic DNA (Homo sapiens) CpG-island No: 38964
aaaacgcgataaaaaaaaaaactaaaacccgactaaacacccccgccgcgcccaacccgccgaaaaactcaaaccccgaaaaacacctaaaacctacgccccgcccgcgccgcttcctatcccgcgcgctacgctcacgtaacccgaacctaaaaaaaaccgaaacgaacgaaaatcacctaaacaaaaaaatcacgtaaacgaaaaacgaaaataaaaaaacgataccgaacgactatcacgtaacgcgattccgaaaccgccgctaccgctatcgctatcgccgaacccaatcgaaccgcgctcacctcgaactcccgctccgtctccacctccgcctttaccctaacgacgcgaccccgtcccgaacgcgacccccaacaatcgcgcgccgttcgcctaaacgcccgccgcgcaatcaaaacaaaaaacgataaaatccgctaccgaccgaaacccccacctaaaacccgcgcccgcccgccgcccgcaacgctctctactcctactacaactactactactcgtcgctaccccgaaatccacgcaaacccaaaccgccccgttccccgaactatacaaataaataacccgcccgaacgcaaactccgctcgcgatacccgaaataaacgaccgacgtaaaaaacgaaaaacgctcgaaaaactcctaaaatctccaaatcgcctccgttccgcgccgaaatccgccccgttcccgaaaaaaaattacctacgtaatatccgcgaatcccgccgaatcccgtacgcaaacgaaaaacgcgaaaacacacgcgatcgtaacgatcctaaaaccccgcgtccgaccacttataactatcgctaaatcgaaaataactttatacgaaacgatcgccccgacccttaaaatcgacgcctaccctcgcgcgaccgaacgtccgaaaaaattaaaaacaaaaactccaatttactttattcccgctacgcgtttacatcaaaatttcgccaacgaaacaccgataaaacccctcgatataaaaaaactcaccgaaacgttaaaacccgcaaaaataatcctaaaattaaatatttataatttcatttactaatt

SEQ ID NO: 38965 - DNA, 1401 bp, Artificial Sequence
  chemically treated genomic DNA (Homo sapiens) CpG-island No: 38965
ttttcgttcgagttattttcgaagtagtcgatttttggggagaagcgttgcggaaaggggcgatttcgatgtagatggttttgtttcggcgttttaggtcgtcgcgcgcgtagttgcggtagttattgcgttttttcgtttttatttttggatgttttttttttttttttcggttagattttgagtaggagtttcgtttttagcgcgtcgttttagtttcggcgttttaaaagtcgggcgtatcgtttcgtcgcgttttgtttgtcgtatttttttttttttttgtagttcgcgttgaagtcgtacgttcggtttcgatttcggtattatgagtttcggttcggagtattatttgtgttttttttttttttatcgtaaggtgttcggggatggttttcgtttgttcgttcgtttttttggggtcggcggcgcgggcggttttcgttcgtagtcgttgtttcgtagtaatgtggttttttcggtcgtttgtttttcggtttcgtcgttcggtttcggtttggtttatcgtcggtcgtcggcgttcgacgggttggatttgagttaggcggcggcgcgtattaacgagtataagattattcgtattaacgagaaggagtagttgtagggttttaacgatcgtttcgtcgtgtttatcgagaaggtgtattagttggagacgtagaatcgcgcgttggaggtcgagttggtcgcgttgcgatagcgttacgttgagtcgtcgcgcgtcggcgagtttttttagcgcgagttgcgcgatttgcgcgcgtagttggaggaggttagttcggttcgttcgtaggttttgttggagcgcgacgggttggcggaggaggtgtagcggttgcgggcgcgttgcgaggaggagagtcgcggacgcgaaggcgtcgagcgcgttttgaaggcgtagtagcgcgacgtggacggcgttacgttggttcgtttggatttggagaagaaggtggagtcgttgttggacgagttggttttcgtacgttaggtgtacgacgaggaggtagtcgagttgttggttacgttgtaggcgtcgtcgtaggtcgcggtcgaggtggacgtgattgtggttaaattagatttgatttcggttttgagggagattcgcgtttagtatgagtttttggtcgttaagaatttgtagttcgcggaagaatggtataagtttaagtttgttaatttgaacgagtaggcggcgcgtagtatcgaggttattcgggttagtcgcgaggagatttacgagtatcggcgttagttgtaggcgcgtattatcgagatcgagggtttgcgcggggttaacgagtttttggagaggtagattttggagttggaggagcggtatagtgtcgaggtagttggttattaggtaagggt

SEQ ID NO: 38966 - DNA, 1401 bp, Artificial Sequence
  chemically treated genomic DNA (Homo sapiens) CpG-island No: 38966
acccttacctaataaccaactacctcgacactataccgctcctccaactccaaaatctacctctccaaaaactcgttaaccccgcgcaaaccctcgatctcgataatacgcgcctacaactaacgccgatactcgtaaatctcctcgcgactaacccgaataacctcgatactacgcgccgcctactcgttcaaattaacaaacttaaacttataccattcttccgcgaactacaaattcttaacgaccaaaaactcatactaaacgcgaatctccctcaaaaccgaaatcaaatctaatttaaccacaatcacgtccacctcgaccgcgacctacgacgacgcctacaacgtaaccaacaactcgactacctcctcgtcgtacacctaacgtacgaaaaccaactcgtccaacaacgactccaccttcttctccaaatccaaacgaaccaacgtaacgccgtccacgtcgcgctactacgccttcaaaacgcgctcgacgccttcgcgtccgcgactctcctcctcgcaacgcgcccgcaaccgctacacctcctccgccaacccgtcgcgctccaacaaaacctacgaacgaaccgaactaacctcctccaactacgcgcgcaaatcgcgcaactcgcgctaaaaaaactcgccgacgcgcgacgactcaacgtaacgctatcgcaacgcgaccaactcgacctccaacgcgcgattctacgtctccaactaatacaccttctcgataaacacgacgaaacgatcgttaaaaccctacaactactccttctcgttaatacgaataatcttatactcgttaatacgcgccgccgcctaactcaaatccaacccgtcgaacgccgacgaccgacgataaaccaaaccgaaaccgaacgacgaaaccgaaaaacaaacgaccgaaaaaaccacattactacgaaacaacgactacgaacgaaaaccgcccgcgccgccgaccccaaaaaaacgaacgaacaaacgaaaaccatccccgaacaccttacgataaaaaaaaaaaaaacacaaataatactccgaaccgaaactcataataccgaaatcgaaaccgaacgtacgacttcaacgcgaactacaaaaaaaaaaaaaaatacgacaaacaaaacgcgacgaaacgatacgcccgacttttaaaacgccgaaactaaaacgacgcgctaaaaacgaaactcctactcaaaatctaaccgaaaaaaaaaaaaaaaacatccaaaaataaaaacgaaaaaacgcaataactaccgcaactacgcgcgcgacgacctaaaacgccgaaacaaaaccatctacatcgaaatcgcccctttccgcaacgcttctccccaaaaatcgactacttcgaaaataactcgaacgaaaa

SEQ ID NO: 38967 - DNA, 1401 bp, Artificial Sequence
  chemically treated genomic DNA (Homo sapiens) CpG-island No: 38967
gtttttatttggtagttagttatttcggtattgtgtcgtttttttagttttaggatttgtttttttaaggattcgttggtttcgcgtaggttttcgatttcgatggtgcgcgtttgtagttggcgtcgatattcgtggattttttcgcggttggttcggatggtttcggtgttgcgcgtcgtttgttcgtttaggttggtaaatttggatttgtattattttttcgcggattgtaggtttttagcggttagggatttatattgggcgcggattttttttagagtcgaggttaggtttggtttagttatagttacgtttatttcggtcgcggtttgcgacgacgtttgtagcgtggttagtagttcggttattttttcgtcgtgtatttggcgtacgaaggttagttcgtttagtagcgattttatttttttttttaggtttaggcgggttagcgtggcgtcgtttacgtcgcgttgttgcgtttttagggcgcgttcggcgttttcgcgttcgcggttttttttttcgtagcgcgttcgtagtcgttgtatttttttcgttagttcgtcgcgttttagtagggtttgcgagcgagtcgagttggttttttttagttgcgcgcgtaggtcgcgtagttcgcgttggaagagttcgtcgacgcgcgacggtttagcgtggcgttgtcgtagcgcggttagttcggtttttaacgcgcggttttgcgtttttagttgatgtattttttcgatgaatacggcgaagcggtcgttgaggttttgtagttgttttttttcgttggtgcggatgattttgtattcgttggtgcgcgtcgtcgtttggtttaggtttagttcgtcggacgtcggcggtcggcgataggttaggtcgaggtcgagcgacgaggtcgaggagtaggcggtcgaggaggttatattgttgcgggatagcgattgcgagcggaagtcgttcgcgtcgtcggttttagagaggcgggcggataggcgagagttattttcgaatattttgcggtaggaggaggaggagtataggtagtgtttcgagtcgaagtttatggtgtcgggatcggggtcggacgtgcggttttaacgcgagttatagaagaaaggagaggtgcggtaggtagggcgcggcggggcggtgcgttcggtttttaaggcgtcggggttggggcggcgcgttgggggcggagtttttgtttagagtttggtcgggagagggaaggggggtatttaggagtgggggcggggaggcgtagtgattatcgtagttgcgcgcgcgacgatttggggcgtcgggatagggttatttgtatcggagtcgttttttttcgtagcgtttttttttaagaatcgattgtttcggaagtgattcgagcggagg

SEQ ID NO: 38968 - DNA, 1401 bp, Artificial Sequence
  chemically treated genomic DNA (Homo sapiens) CpG-island No: 38968
cctccgctcgaatcacttccgaaacaatcgattcttaaaaaaaaacgctacgaaaaaaaacgactccgatacaaataaccctatcccgacgccccaaatcgtcgcgcgcgcaactacgataatcactacgcctccccgcccccactcctaaataccccccttccctctcccgaccaaactctaaacaaaaactccgcccccaacgcgccgccccaaccccgacgccttaaaaaccgaacgcaccgccccgccgcgccctacctaccgcacctctcctttcttctataactcgcgttaaaaccgcacgtccgaccccgatcccgacaccataaacttcgactcgaaacactacctatactcctcctcctcctaccgcaaaatattcgaaaataactctcgcctatccgcccgcctctctaaaaccgacgacgcgaacgacttccgctcgcaatcgctatcccgcaacaatataacctcctcgaccgcctactcctcgacctcgtcgctcgacctcgacctaacctatcgccgaccgccgacgtccgacgaactaaacctaaaccaaacgacgacgcgcaccaacgaatacaaaatcatccgcaccaacgaaaaaaaacaactacaaaacctcaacgaccgcttcgccgtattcatcgaaaaaatacatcaactaaaaacgcaaaaccgcgcgttaaaaaccgaactaaccgcgctacgacaacgccacgctaaaccgtcgcgcgtcgacgaactcttccaacgcgaactacgcgacctacgcgcgcaactaaaaaaaaccaactcgactcgctcgcaaaccctactaaaacgcgacgaactaacgaaaaaaatacaacgactacgaacgcgctacgaaaaaaaaaaccgcgaacgcgaaaacgccgaacgcgccctaaaaacgcaacaacgcgacgtaaacgacgccacgctaacccgcctaaacctaaaaaaaaaaataaaatcgctactaaacgaactaaccttcgtacgccaaatacacgacgaaaaaataaccgaactactaaccacgctacaaacgtcgtcgcaaaccgcgaccgaaataaacgtaactataactaaaccaaacctaacctcgactctaaaaaaaatccgcgcccaatataaatccctaaccgctaaaaacctacaatccgcgaaaaaataatacaaatccaaatttaccaacctaaacgaacaaacgacgcgcaacaccgaaaccatccgaaccaaccgcgaaaaaatccacgaatatcgacgccaactacaaacgcgcaccatcgaaatcgaaaacctacgcgaaaccaacgaatccttaaaaaaacaaatcctaaaactaaaaaaacgacacaataccgaaataactaactaccaaataaaaac

SEQ ID NO: 38969 - DNA, 533 bp, Artificial Sequence
  chemically treated genomic DNA (Homo sapiens) CpG-island No: 38969
tcggaagggcgggatttggagttatagttaatcgtcgtattaggtcgaatcgcgggggtcggttaaacgcgtgcgggggaggtggtttttttcggtcgggtcgagaggtggttatattcgttgaaggatattagttgcggaatttgcggttttggtaggtgggtgaagaggggagttcgggtttggatttggcgtttgtacgttgtaggatcgttcgtcgtttttggtcgaggagtaattcgagtttttagttttggaggagagaaacggtggggaatgggaaaggagttagaaaaaacgaggggcgtaagggggcggttagcgggtgagaagtttcgaggtgaggcggataggtgcgtttaagggtttttatagttttcgaagatttttagattgtattcgttagtggagaaaaatgaggtttttcgcgaagcgtttttcgaggttatttagtgacgtaatattggacgaggattagggtttttgatttttattatcggtcgaattaatttttttttttttgtatgtttata

SEQ ID NO: 38970 - DNA, 533 bp, Artificial Sequence
  chemically treated genomic DNA (Homo sapiens) CpG-island No: 38970
tataaacatacaaaaaaaaaaaaattaattcgaccgataataaaaatcaaaaaccctaatcctcgtccaatattacgtcactaaataacctcgaaaaacgcttcgcgaaaaacctcatttttctccactaacgaatacaatctaaaaatcttcgaaaactataaaaacccttaaacgcacctatccgcctcacctcgaaacttctcacccgctaaccgcccccttacgcccctcgttttttctaactcctttcccattccccaccgtttctctcctccaaaactaaaaactcgaattactcctcgaccaaaaacgacgaacgatcctacaacgtacaaacgccaaatccaaacccgaactcccctcttcacccacctaccaaaaccgcaaattccgcaactaatatccttcaacgaatataaccacctctcgacccgaccgaaaaaaaccacctcccccgcacgcgtttaaccgacccccgcgattcgacctaatacgacgattaactataactccaaatcccgcccttccga

SEQ ID NO: 38971 - DNA, 533 bp, Artificial Sequence
  chemically treated genomic DNA (Homo sapiens) CpG-island No: 38971
tatggatatatagaagaaaagaggttaattcggtcggtgatggggattagaagttttagttttcgtttaatattacgttattgggtgatttcgagggacgtttcgcggagggttttatttttttttattggcgaatgtaatttaagggttttcggaaattgtgggagtttttgggcgtatttattcgttttatttcgaggttttttattcgttggtcgtttttttgcgtttttcgttttttttagttttttttttattttttatcgttttttttttttaaagttaagaattcgagttgtttttcggttagaaacggcgggcggttttgtaacgtgtaggcgttaggtttaagttcggatttttttttttatttatttgttaaagtcgtaaatttcgtagttggtgttttttaacgaatgtaattatttttcggttcggtcggaagaagttatttttttcgtacgcgtttagtcggttttcgcgattcggtttaatgcgacgattggttatggttttaaatttcgttttttcga

SEQ ID NO: 38972 - DNA, 533 bp, Artificial Sequence
  chemically treated genomic DNA (Homo sapiens) CpG-island No: 38972
tcgaaaaaacgaaatttaaaaccataaccaatcgtcgcattaaaccgaatcgcgaaaaccgactaaacgcgtacgaaaaaaataacttcttccgaccgaaccgaaaaataattacattcgttaaaaaacaccaactacgaaatttacgactttaacaaataaataaaaaaaaaaatccgaacttaaacctaacgcctacacgttacaaaaccgcccgccgtttctaaccgaaaaacaactcgaattcttaactttaaaaaaaaaaaacgataaaaaataaaaaaaaaactaaaaaaaacgaaaaacgcaaaaaaacgaccaacgaataaaaaacctcgaaataaaacgaataaatacgcccaaaaactcccacaatttccgaaaacccttaaattacattcgccaataaaaaaaaataaaaccctccgcgaaacgtccctcgaaatcacccaataacgtaatattaaacgaaaactaaaacttctaatccccatcaccgaccgaattaacctcttttcttctatatatccata

SEQ ID NO: 38973 - DNA, 515 bp, Artificial Sequence
  chemically treated genomic DNA (Homo sapiens) CpG-island No: 38973
cgcgcgtttcgtagtttgtttcggagttgtagggtttgcgtttcgcggaggtgagggtcgttaaattatatttttcggcgagttttttaggttgtcgcgtttgcgtagtggtggcgttcgaggtcggtcgaattttcgcgttttttcgtcgtttcgtttcgtttggtgtttttttcgattatggagggggtcgcggtggtgacggcgggtagcgtaggcgttgttaaaatcgagggagttgtagttttgtcgttttcgttttttgttttttcgttcgtttttatttttgtattcgtagcgggtgaggagggatcggcgtttttgtttgagacgggggttttcggttgtttcggttttcggttttttgagttggagtcggagcgtagtttgggtcgttttagaggtcgtttcgaggacgaggacgaggagttggaagaagaagaggagttggaggaggaagaagaggaggaggaggaggatatgagttatttttcgttgaggttggagggaggtcg

SEQ ID NO: 38974 - DNA, 515 bp, Artificial Sequence
  chemically treated genomic DNA (Homo sapiens) CpG-island No: 38974
cgacctccctccaacctcaacgaaaaataactcatatcctcctcctcctcctcttcttcctcctccaactcctcttcttcttccaactcctcgtcctcgtcctcgaaacgacctctaaaacgacccaaactacgctccgactccaactcaaaaaaccgaaaaccgaaacaaccgaaaacccccgtctcaaacaaaaacgccgatccctcctcacccgctacgaatacaaaaataaaaacgaacgaaaaaacaaaaaacgaaaacgacaaaactacaactccctcgattttaacaacgcctacgctacccgccgtcaccaccgcgaccccctccataatcgaaaaaaacaccaaacgaaacgaaacgacgaaaaaacgcgaaaattcgaccgacctcgaacgccaccactacgcaaacgcgacaacctaaaaaactcgccgaaaaatataatttaacgaccctcacctccgcgaaacgcaaaccctacaactccgaaacaaactacgaaacgcgcg

SEQ ID NO: 38975 - DNA, 515 bp, Artificial Sequence
  chemically treated genomic DNA (Homo sapiens) CpG-island No: 38975
cggtttttttttagttttaacgagaagtgatttatgttttttttttttttttttttttttttttttagttttttttttttttttaatttttcgttttcgttttcgaagcggtttttgaagcggtttaggttgcgtttcggttttagtttagggggtcgggagtcggagtagtcgggagttttcgttttagatagaggcgtcggtttttttttattcgttgcgggtgtaggggtgagggcgggcggggagataggaggcggaggcggtaaggttgtagttttttcggttttggtagcgtttacgttgttcgtcgttattatcgcgattttttttatggtcgggagagatattaggcgaggcgaggcggcgggagagcgcgggagttcggtcggtttcggacgttattattgcgtaggcgcggtagtttgaggggttcgtcgggaaatgtggtttagcggtttttattttcgcggggcgtaaattttgtagtttcggggtaggttgcggggcgcgcg

SEQ ID NO: 38976 - DNA, 515 bp, Artificial Sequence
  chemically treated genomic DNA (Homo sapiens) CpG-island No: 38976
cgcgcgccccgcaacctaccccgaaactacaaaatttacgccccgcgaaaataaaaaccgctaaaccacatttcccgacgaacccctcaaactaccgcgcctacgcaataataacgtccgaaaccgaccgaactcccgcgctctcccgccgcctcgcctcgcctaatatctctcccgaccataaaaaaaatcgcgataataacgacgaacaacgtaaacgctaccaaaaccgaaaaaactacaaccttaccgcctccgcctcctatctccccgcccgccctcacccctacacccgcaacgaataaaaaaaaaccgacgcctctatctaaaacgaaaactcccgactactccgactcccgaccccctaaactaaaaccgaaacgcaacctaaaccgcttcaaaaaccgcttcgaaaacgaaaacgaaaaattaaaaaaaaaaaaaaaactaaaaaaaaaaaaaaaaaaaaaaaaaaaaaacataaatcacttctcgttaaaactaaaaaaaaaccg

SEQ ID NO: 38977 - DNA, 739 bp, Artificial Sequence
  chemically treated genomic DNA (Homo sapiens) CpG-island No: 38977
gttttttatgtggcgaaaatgtaattacgtttgacggcgcgaggtggtttagtcgtaagatggcggcgttggcggaggagtagacggaggtggcggttaagttagagtttgagggatcgttaacgttgttattttcgtaggcgggggacggcgtaggcgagggtagcggcggtattattaataacggttttaacggcggcggcgggaacgttgcggcgtcgtcgtttattggcggggatggcgggatttttaagtttacggtggttgttttcgtcgttgtttcggcgggggcggtttcggtgttcgtcgttgtttcggacgtcggcgtttcgtatgatcgatagattttattggtcgtgttgtagtttttacggtagagtaaatttcgcgaggtcgaagaggcgttgcgtcgtgaggtcgggttgttggaggaggtagtggcgggtttcggagtttcgggagaggtggatagcgtcggcgttgaggtgattagcgcgttttttagtcgggtgatcgtttcggtttttggttttgcggttttcgatttttcgggtattggcgtttcgggggttacggtcgttttaggtttagttttaggttttgcggtttcgggtaaaggtgagtcgtggggtttcgggtaggtacggtcgtcgcgaaggggagtaagtcggtaaggtaggggttggtaggtttgtatttttgcgggtttgttttgaattttttgggttcgtttttaggg

SEQ ID NO: 38978 - DNA, 739 bp, Artificial Sequence
  chemically treated genomic DNA (Homo sapiens) CpG-island No: 38978
ccctaaaaacgaacccaaaaaattcaaaacaaacccgcaaaaatacaaacctaccaacccctaccttaccgacttactccccttcgcgacgaccgtacctacccgaaaccccacgactcacctttacccgaaaccgcaaaacctaaaactaaacctaaaacgaccgtaacccccgaaacgccaatacccgaaaaatcgaaaaccgcaaaaccaaaaaccgaaacgatcacccgactaaaaaacgcgctaatcacctcaacgccgacgctatccacctctcccgaaactccgaaacccgccactacctcctccaacaacccgacctcacgacgcaacgcctcttcgacctcgcgaaatttactctaccgtaaaaactacaacacgaccaataaaatctatcgatcatacgaaacgccgacgtccgaaacaacgacgaacaccgaaaccgcccccgccgaaacaacgacgaaaacaaccaccgtaaacttaaaaatcccgccatccccgccaataaacgacgacgccgcaacgttcccgccgccgccgttaaaaccgttattaataataccgccgctaccctcgcctacgccgtcccccgcctacgaaaataacaacgttaacgatccctcaaactctaacttaaccgccacctccgtctactcctccgccaacgccgccatcttacgactaaaccacctcgcgccgtcaaacgtaattacattttcgccacataaaaaac

SEQ ID NO: 38979 - DNA, 739 bp, Artificial Sequence
  chemically treated genomic DNA (Homo sapiens) CpG-island No: 38979
ttttagaggcgggtttaggaaatttaaaataagttcgtagaggtgtaggtttgttagtttttgttttatcggtttgttttttttcgcggcggtcgtatttattcgggattttacggtttatttttattcggagtcgtaggatttgaggttgaatttgagacgatcgtggttttcgaagcgttagtgttcggagggtcgggggtcgtaaggttaggggtcgaggcggttattcggttgagaagcgcgttggttattttagcgtcggcgttgtttatttttttcggggtttcggagttcgttattgttttttttagtagttcggttttacggcgtagcgttttttcggtttcgcggagtttgttttgtcgtaggaattgtagtacggttagtagagtttgtcggttatgcggagcgtcggcgttcggagtagcggcgggtatcggggtcgttttcgtcggggtagcggcggagatagttatcgtgggtttgggggtttcgttattttcgttagtggacgacgacgtcgtaacgttttcgtcgtcgtcgttggggtcgttgttggtagtgtcgtcgttattttcgtttgcgtcgtttttcgtttgcggaggtagtagcgttggcggttttttaggttttagtttgatcgttattttcgtttgttttttcgttagcgtcgttattttgcggttgagttatttcgcgtcgttaagcgtgattgtattttcgttatatggagggt

SEQ ID NO: 38980 - DNA, 739 bp, Artificial Sequence
  chemically treated genomic DNA (Homo sapiens) CpG-island No: 38980
accctccatataacgaaaatacaatcacgcttaacgacgcgaaataactcaaccgcaaaataacgacgctaacgaaaaaacaaacgaaaataacgatcaaactaaaacctaaaaaaccgccaacgctactacctccgcaaacgaaaaacgacgcaaacgaaaataacgacgacactaccaacaacgaccccaacgacgacgacgaaaacgttacgacgtcgtcgtccactaacgaaaataacgaaacccccaaacccacgataactatctccgccgctaccccgacgaaaacgaccccgatacccgccgctactccgaacgccgacgctccgcataaccgacaaactctactaaccgtactacaattcctacgacaaaacaaactccgcgaaaccgaaaaaacgctacgccgtaaaaccgaactactaaaaaaaacaataacgaactccgaaaccccgaaaaaaataaacaacgccgacgctaaaataaccaacgcgcttctcaaccgaataaccgcctcgacccctaaccttacgacccccgaccctccgaacactaacgcttcgaaaaccacgatcgtctcaaattcaacctcaaatcctacgactccgaataaaaataaaccgtaaaatcccgaataaatacgaccgccgcgaaaaaaaacaaaccgataaaacaaaaactaacaaacctacacctctacgaacttattttaaatttcctaaacccgcctctaaaa

SEQ ID NO: 38981 - DNA, 1185 bp, Artificial Sequence
  chemically treated genomic DNA (Homo sapiens) CpG-island No: 38981
gggcgcgcgggttttttgtcgtttggagtcgagttggtattggagcgttttttttttggagcgtagaggtattcgacgttttgcggtagttcgtagttttttttttacgattttttagaatagttttgttttgttttttttcggtttttcgagtgcgttcgttattttgtttcgcgagaggtgaacgcggagaaagtaggatgattatttacgttttcgagaaattttgggtaaagaaaggtattattttagttcgtacgttgaaagtcgtttttttttttttttttttttcgttgtgtttgaatttttcgggatatttagacggttggagtttttcgattttaaggcgggcgacggtaaagttaaacgttagcgcgttgcggttttcgggtatcgaggcgttttcgttttcgttatttatatagggcgttaagtgtttcgattcgcgagtgacgaggacgtataggttagtgatacgattcgtagttagtattgagcgggacgacggggttcgagcgtaggagggtgcgcggggagttgaggagcgtcgggggttcgggcgcggcgcgtatttgaggtcgtcgtcgaggaggcgacggggagtagcgcggttaagagtagtagcgtcgtttaggatagtcggcgcggcgcgcgtagggtcgtttcggtttcgggggttatcgagagttcggggtgggtcggggttgggtgtttgcggttggtaggggggcgttggtcggagtttggggagtgtcgaggcgtcgtcgtcgggttttcgtcgtcgttcgtttgttttgcgcgttttgcgcggtgttcgtcgcgtttttgtttcgcggcgatcgttttcggtcgtatatcggtagtcgcgtttcgttattgaggtcgtcgatttttcgtcgagttttttagttgcgttcgggcgttttttgtcggtgtgcggggtcggggttagggtcggcgggggcgattcgggcgataggggcgacgggggcggcggggttcgggttggaggcgggcggggcgcgggacgaaggggtcggagcgtttcggattgatttagcggttttgaatttggggcggtcgttgtgtcgggttaagtggttgaggaagttttttttttcgtttaatttttttattttttggttggggaagtcgtttatcgcgtcgaggagtgttttttgtttt

SEQ ID NO: 38982 - DNA, 1185 bp, Artificial Sequence
  chemically treated genomic DNA (Homo sapiens) CpG-island No: 38982
aaaacaaaaaacactcctcgacgcgataaacgacttccccaaccaaaaaataaaaaaattaaacgaaaaaaaaaacttcctcaaccacttaacccgacacaacgaccgccccaaattcaaaaccgctaaatcaatccgaaacgctccgaccccttcgtcccgcgccccgcccgcctccaacccgaaccccgccgcccccgtcgcccctatcgcccgaatcgcccccgccgaccctaaccccgaccccgcacaccgacaaaaaacgcccgaacgcaactaaaaaactcgacgaaaaatcgacgacctcaataacgaaacgcgactaccgatatacgaccgaaaacgatcgccgcgaaacaaaaacgcgacgaacaccgcgcaaaacgcgcaaaacaaacgaacgacgacgaaaacccgacgacgacgcctcgacactccccaaactccgaccaacgcccccctaccaaccgcaaacacccaaccccgacccaccccgaactctcgataacccccgaaaccgaaacgaccctacgcgcgccgcgccgactatcctaaacgacgctactactcttaaccgcgctactccccgtcgcctcctcgacgacgacctcaaatacgcgccgcgcccgaacccccgacgctcctcaactccccgcgcaccctcctacgctcgaaccccgtcgtcccgctcaatactaactacgaatcgtatcactaacctatacgtcctcgtcactcgcgaatcgaaacacttaacgccctatataaataacgaaaacgaaaacgcctcgatacccgaaaaccgcaacgcgctaacgtttaactttaccgtcgcccgccttaaaatcgaaaaactccaaccgtctaaatatcccgaaaaattcaaacacaacgaaaaaaaaaaaaaaaaaaaaacgactttcaacgtacgaactaaaataatacctttctttacccaaaatttctcgaaaacgtaaataatcatcctactttctccgcgttcacctctcgcgaaacaaaataacgaacgcactcgaaaaaccgaaaaaaaacaaaacaaaactattctaaaaaatcgtaaaaaaaaaactacgaactaccgcaaaacgtcgaatacctctacgctccaaaaaaaaaacgctccaataccaactcgactccaaacgacaaaaaacccgcgcgccc

SEQ ID NO: 38983 - DNA, 1185 bp, Artificial Sequence
  chemically treated genomic DNA (Homo sapiens) CpG-island No: 38983
gggataaagggtatttttcggcgcgatgggcgatttttttagttagaaaatgagagggttagacgaggggaggaatttttttagttatttggttcggtatagcgatcgttttaagtttagaatcgttaagttagttcggggcgtttcggttttttcgtttcgcgtttcgttcgtttttagttcgggtttcgtcgttttcgtcgtttttgtcgttcgggtcgttttcgtcggttttggtttcggtttcgtatatcggtagggggcgttcgagcgtagttaaaaggttcggcgggaggtcggcggttttagtggcggagcgcggttgtcggtgtgcggtcgggagcgatcgtcgcggggtaggggcgcggcgggtatcgcgtagagcgcgtagaatagacggacggcggcggggattcgacggcggcgtttcggtattttttagatttcggttagcgtttttttgttagtcgtaagtatttagtttcggtttatttcgggttttcgatggttttcgaggtcggggcgattttgcgcgcgtcgcgtcggttgttttgggcggcgttgttgtttttggtcgcgttgtttttcgtcgttttttcggcggcggttttaggtacgcgtcgcgttcgggttttcggcgttttttagtttttcgcgtatttttttgcgttcgggtttcgtcgtttcgtttagtgttggttacgggtcgtgttattagtttgtgcgttttcgttattcgcgggtcggggtatttggcgttttgtgtgggtggcgggagcggggacgtttcggtgttcggggatcgtagcgcgttggcgtttaattttgtcgtcgttcgttttggagtcgggaggttttagtcgtttaagtgtttcgggagatttaggtatagcggggaaaaaaggaaaagaaaggcgatttttagcgtgcggattggggtaatgtttttttttgtttagaatttttcgggagcgtaggtggttattttatttttttcgcgtttatttttcgcgaggtaggatgacgggcgtattcgggagatcggagggaggtagagtagggttgttttagaaggtcgtgggggaaaggttgcgagttgtcgtagggcgtcgggtgtttttgcgttttagaggagaagcgttttagtgttagttcggttttaggcggtaggaggttcgcgcgttt

SEQ ID NO: 38984 - DNA, 1185 bp, Artificial Sequence
  chemically treated genomic DNA (Homo sapiens) CpG-island No: 38984
aaacgcgcgaacctcctaccgcctaaaaccgaactaacactaaaacgcttctcctctaaaacgcaaaaacacccgacgccctacgacaactcgcaacctttcccccacgaccttctaaaacaaccctactctacctccctccgatctcccgaatacgcccgtcatcctacctcgcgaaaaataaacgcgaaaaaaataaaataaccacctacgctcccgaaaaattctaaacaaaaaaaaacattaccccaatccgcacgctaaaaatcgcctttcttttccttttttccccgctatacctaaatctcccgaaacacttaaacgactaaaacctcccgactccaaaacgaacgacgacaaaattaaacgccaacgcgctacgatccccgaacaccgaaacgtccccgctcccgccacccacacaaaacgccaaataccccgacccgcgaataacgaaaacgcacaaactaataacacgacccgtaaccaacactaaacgaaacgacgaaacccgaacgcaaaaaaatacgcgaaaaactaaaaaacgccgaaaacccgaacgcgacgcgtacctaaaaccgccgccgaaaaaacgacgaaaaacaacgcgaccaaaaacaacaacgccgcccaaaacaaccgacgcgacgcgcgcaaaatcgccccgacctcgaaaaccatcgaaaacccgaaataaaccgaaactaaatacttacgactaacaaaaaaacgctaaccgaaatctaaaaaataccgaaacgccgccgtcgaatccccgccgccgtccgtctattctacgcgctctacgcgatacccgccgcgcccctaccccgcgacgatcgctcccgaccgcacaccgacaaccgcgctccgccactaaaaccgccgacctcccgccgaaccttttaactacgctcgaacgccccctaccgatatacgaaaccgaaaccaaaaccgacgaaaacgacccgaacgacaaaaacgacgaaaacgacgaaacccgaactaaaaacgaacgaaacgcgaaacgaaaaaaccgaaacgccccgaactaacttaacgattctaaacttaaaacgatcgctataccgaaccaaataactaaaaaaattcctcccctcgtctaaccctctcattttctaactaaaaaaatcgcccatcgcgccgaaaaataccctttatccc

SEQ ID NO: 38985 - DNA, 845 bp, Artificial Sequence
  chemically treated genomic DNA (Homo sapiens) CpG-island No: 38985
gtcggggacgaaaggcgaagggggaaaattagagttttcgtcggtcgggatagcgtagtcgggttttagttcgttttacggtttacgttagaagatcgttttcggcgtcgcggacgtcggagattattgtttgcgttttcgtacgtacgtatttacgtattcgcgtacgcgcgcgtcggtttcgtttatcgtttcgttgtggtttttttggatcgtacgagttatcgttcgtatagtttcgtttcgtacggttaggcgaagcggagtcggtcgtgcggtgtgtgtgtatgtgttcgcggggcgtcgttttagtttcgggaagatggtggttgtagcggcggtaattgaggtaaggttgaggaggaggacggcggcgacggtagcgttcgcgggtaggagcggcgggtcgtattgggattgggacgtgattagggttgggaggtcggggttgggggtcgggttgcgtttttcgcggttgttgtttttatcgttgcggttacggttgttgttgttgttgttgttgttttcgtcgtcgttgttgttgttgttgttgttttgtgaggtcgaggtcgcggcggcggcggcggcggtgtcgggtttagtcgtagtcgaggttaaggaatgtgatcggttttgtgttaacggcggtcgttgtaattttggtatcggttagtgcgtttgtttcgtcggttgggtgggcgagtaatgttagtattgcgggggtcgttttaggtgagtggcgggtggtgtcggagggtcgggtttaattagaggttggggttgaggggcgttcgagacggttttaggttagagggagatgttggatagaaagtggagagggtagg

SEQ ID NO: 38986 - DNA, 845 bp, Artificial Sequence
  chemically treated genomic DNA (Homo sapiens) CpG-island No: 38986
cctaccctctccactttctatccaacatctccctctaacctaaaaccgtctcgaacgcccctcaaccccaacctctaattaaacccgaccctccgacaccacccgccactcacctaaaacgacccccgcaatactaacattactcgcccacccaaccgacgaaacaaacgcactaaccgataccaaaattacaacgaccgccgttaacacaaaaccgatcacattccttaacctcgactacgactaaacccgacaccgccgccgccgccgccgcgacctcgacctcacaaaacaacaacaacaacaacaacgacgacgaaaacaacaacaacaacaacaacaaccgtaaccgcaacgataaaaacaacaaccgcgaaaaacgcaacccgacccccaaccccgacctcccaaccctaatcacgtcccaatcccaatacgacccgccgctcctacccgcgaacgctaccgtcgccgccgtcctcctcctcaaccttacctcaattaccgccgctacaaccaccatcttcccgaaactaaaacgacgccccgcgaacacatacacacacaccgcacgaccgactccgcttcgcctaaccgtacgaaacgaaactatacgaacgataactcgtacgatccaaaaaaaccacaacgaaacgataaacgaaaccgacgcgcgcgtacgcgaatacgtaaatacgtacgtacgaaaacgcaaacaataatctccgacgtccgcgacgccgaaaacgatcttctaacgtaaaccgtaaaacgaactaaaacccgactacgctatcccgaccgacgaaaactctaattttcccccttcgcctttcgtccccgac

SEQ ID NO: 38987 - DNA, 845 bp, Artificial Sequence
  chemically treated genomic DNA (Homo sapiens) CpG-island No: 38987
tttattttttttattttttgtttagtatttttttttgatttggagtcgtttcgaacgttttttagttttagtttttggttggattcgatttttcgatattattcgttatttatttgaagcggttttcgtagtgttggtattgttcgtttatttagtcggcggggtagacgtattggtcggtgttagggttgtagcgatcgtcgttgatatagggtcggttatattttttggtttcggttgcggttgagttcgatatcgtcgtcgtcgtcgtcgcggtttcggttttatagggtagtagtagtagtagtagcggcggcgagagtaataatagtagtagtagtagtcgtggtcgtagcggtggagatagtagtcgcgggaggcgtagttcggtttttagtttcggttttttagttttggttacgttttagttttagtgcggttcgtcgtttttgttcgcgagcgttgtcgtcgtcgtcgtttttttttttagttttgttttagttgtcgtcgttgtagttattattttttcggggttgagacggcgtttcgcgaatatatatatatatatcgtacggtcggtttcgtttcgtttggtcgtgcggggcggggttgtgcggacggtggttcgtgcggtttaaaggggttatagcggggcggtgggcggggtcggcgcgcgcgtgcgcgagtacgtgggtgcgtgcgtgcgggggcgtagatagtggttttcggcgttcgcggcgtcggaggcgattttttgacgtggatcgtagaacgagttgaaattcggttgcgttgtttcggtcggcgaaagttttagtttttttttttcgtttttcgttttcggt

SEQ ID NO: 38988 - DNA, 845 bp, Artificial Sequence
  chemically treated genomic DNA (Homo sapiens) CpG-island No: 38988
accgaaaacgaaaaacgaaaaaaaaaaactaaaactttcgccgaccgaaacaacgcaaccgaatttcaactcgttctacgatccacgtcaaaaaatcgcctccgacgccgcgaacgccgaaaaccactatctacgcccccgcacgcacgcacccacgtactcgcgcacgcgcgcgccgaccccgcccaccgccccgctataacccctttaaaccgcacgaaccaccgtccgcacaaccccgccccgcacgaccaaacgaaacgaaaccgaccgtacgatatatatatatatattcgcgaaacgccgtctcaaccccgaaaaaataataactacaacgacgacaactaaaacaaaactaaaaaaaaaaacgacgacgacgacaacgctcgcgaacaaaaacgacgaaccgcactaaaactaaaacgtaaccaaaactaaaaaaccgaaactaaaaaccgaactacgcctcccgcgactactatctccaccgctacgaccacgactactactactactattattactctcgccgccgctactactactactactaccctataaaaccgaaaccgcgacgacgacgacgacgatatcgaactcaaccgcaaccgaaaccaaaaaatataaccgaccctatatcaacgacgatcgctacaaccctaacaccgaccaatacgtctaccccgccgactaaataaacgaacaataccaacactacgaaaaccgcttcaaataaataacgaataatatcgaaaaatcgaatccaaccaaaaactaaaactaaaaaacgttcgaaacgactccaaatcaaaaaaaaatactaaacaaaaaataaaaaaaataaa

SEQ ID NO: 38989 - DNA, 616 bp, Artificial Sequence
  chemically treated genomic DNA (Homo sapiens) CpG-island No: 38989
gttagatgtcgtcgtggttgcggttaagttaggcggtttgttcggcggcggttgtatcggggtaggaatcgatttttagttttattttcgcggacggtttttggagcggtttcgattttttttcggagaagaggggcgggagttacggttaggcgggaagggatgcgcgtttgagatttcggaacgtttcgcgttagtttaggagaattcgtaagttagcggcgtttgagttcgagttgtagttattttttgcgggttacgcgagttcgagggcgtttttcggagttcgggttggcgttgagttgtaggcgcgcgtttaatcgttttattgggtttattttatcgagaggtcggaggttgcgagtgtcgttgttgaaggttgtagtggatcgggttggatcgcggattttgagttatatcgcgggtttgggggtgtattttggatttaggggtggatcgttgggtggggagggggatttcgaatttggagttgggtgggggtggaaaggttacgaggagtcgcggcgttttaggagcgggtggtgggtatttgagaagtcgttattatgaggaagttttttagttttgggagacgtttgggttaggcgtttttgag

SEQ ID NO: 38990 - DNA, 616 bp, Artificial Sequence
  chemically treated genomic DNA (Homo sapiens) CpG-island No: 38990
ctcaaaaacgcctaacccaaacgtctcccaaaactaaaaaacttcctcataataacgacttctcaaatacccaccacccgctcctaaaacgccgcgactcctcgtaacctttccacccccacccaactccaaattcgaaatccccctccccacccaacgatccacccctaaatccaaaatacacccccaaacccgcgatataactcaaaatccgcgatccaacccgatccactacaaccttcaacaacgacactcgcaacctccgacctctcgataaaataaacccaataaaacgattaaacgcgcgcctacaactcaacgccaacccgaactccgaaaaacgccctcgaactcgcgtaacccgcaaaaaataactacaactcgaactcaaacgccgctaacttacgaattctcctaaactaacgcgaaacgttccgaaatctcaaacgcgcatcccttcccgcctaaccgtaactcccgcccctcttctccgaaaaaaaatcgaaaccgctccaaaaaccgtccgcgaaaataaaactaaaaatcgattcctaccccgatacaaccgccgccgaacaaaccgcctaacttaaccgcaaccacgacgacatctaac

SEQ ID NO: 38991 - DNA, 616 bp, Artificial Sequence
  chemically treated genomic DNA (Homo sapiens) CpG-island No: 38991
tttaggagcgtttggtttaggcgttttttaaaattgaggagtttttttatggtggcgattttttagatgtttattattcgtttttgagacgtcgcggtttttcgtggtttttttatttttatttagttttaaattcgagatttttttttttatttagcgatttatttttaaatttaagatgtatttttaaattcgcgatgtagtttagaattcgcgatttagttcggtttattatagtttttagtagcgatattcgtagttttcgatttttcgatagagtgagtttagtaaagcggttaggcgcgcgtttatagtttagcgttagttcggatttcggaaggcgttttcgagttcgcgtggttcgtagagggtgattgtagttcgggtttaggcgtcgttggtttgcgggtttttttgggttggcgcgggacgtttcggaattttaggcgcgtattttttttcgtttggtcgtgattttcgtttttttttttcgaagagagatcggggtcgttttagggatcgttcgcggggatggggttgagggtcggtttttgtttcggtgtagtcgtcgtcgggtagatcgtttggtttggtcgtagttacggcgatatttagt

SEQ ID NO: 38992 - DNA, 616 bp, Artificial Sequence
  chemically treated genomic DNA (Homo sapiens) CpG-island No: 38992
actaaatatcgccgtaactacgaccaaaccaaacgatctacccgacgacgactacaccgaaacaaaaaccgaccctcaaccccatccccgcgaacgatccctaaaacgaccccgatctctcttcgaaaaaaaaaaacgaaaatcacgaccaaacgaaaaaaaatacgcgcctaaaattccgaaacgtcccgcgccaacccaaaaaaacccgcaaaccaacgacgcctaaacccgaactacaatcaccctctacgaaccacgcgaactcgaaaacgccttccgaaatccgaactaacgctaaactataaacgcgcgcctaaccgctttactaaactcactctatcgaaaaatcgaaaactacgaatatcgctactaaaaactataataaaccgaactaaatcgcgaattctaaactacatcgcgaatttaaaaatacatcttaaatttaaaaataaatcgctaaataaaaaaaaaaatctcgaatttaaaactaaataaaaataaaaaaaccacgaaaaaccgcgacgtctcaaaaacgaataataaacatctaaaaaatcgccaccataaaaaaactcctcaattttaaaaaacgcctaaaccaaacgctcctaaa

SEQ ID NO: 38993 - DNA, 687 bp, Artificial Sequence
  chemically treated genomic DNA (Homo sapiens) CpG-island No: 38993
ttcgtttttttttagtaaggagtcggggttttttttagtttttttagttaggcggcggcggcgattggtaatgtttggttttaaaagaaacgcggtaatcggatttaatttttattgtgggggggtcggtttgggggtcggtagcggcggcgttatttcgttcgggagggcgatttttggttacggagaaggaggtttcggttcggcgagagatagggggaggggaggtcggcgcggtgattggcggaagcgtcggcgtaagtttttcgtttatttttacgttagattttcggagggtcgcgcggtcgtcgtttattggcgtcgaggttttcgacgttatcgcgattttcgcgaggttgttttttttcgcgtttattcgtcgcggcgtcgtttgaggagatggaagtttcggtcgttgacgttattatgtcgttcgaagaggagttggacgggtacgagtcggagtttttcgggaagcggtcggttgttttgtcgttgttggagttggtcggggaatttggtaataatattagtacggacgggttattattttcgacgtcgtcgttagtagaggaggaggaggacgagttgtatcggtagtcgttggagattatttttcggtattttcgggagtaggttatcggcgttaaggatataaagttaatgggtaggtttggggttattagt

SEQ ID NO: 38994 - DNA, 687 bp, Artificial Sequence
  chemically treated genomic DNA (Homo sapiens) CpG-island No: 38994
actaataaccccaaacctacccattaactttatatccttaacgccgataacctactcccgaaaataccgaaaaataatctccaacgactaccgatacaactcgtcctcctcctcctctactaacgacgacgtcgaaaataataacccgtccgtactaatattattaccaaattccccgaccaactccaacaacgacaaaacaaccgaccgcttcccgaaaaactccgactcgtacccgtccaactcctcttcgaacgacataataacgtcaacgaccgaaacttccatctcctcaaacgacgccgcgacgaataaacgcgaaaaaaaacaacctcgcgaaaatcgcgataacgtcgaaaacctcgacgccaataaacgacgaccgcgcgaccctccgaaaatctaacgtaaaaataaacgaaaaacttacgccgacgcttccgccaatcaccgcgccgacctcccctccccctatctctcgccgaaccgaaacctccttctccgtaaccaaaaatcgccctcccgaacgaaataacgccgccgctaccgacccccaaaccgacccccccacaataaaaattaaatccgattaccgcgtttcttttaaaaccaaacattaccaatcgccgccgccgcctaactaaaaaaactaaaaaaaaccccgactccttactaaaaaaaaacgaa

SEQ ID NO: 38995 - DNA, 687 bp, Artificial Sequence
  chemically treated genomic DNA (Homo sapiens) CpG-island No: 38995
gttggtggttttagatttgtttattggttttgtgtttttggcgtcggtggtttgttttcgaaggtatcgagagataatttttagcgattgtcggtataattcgtttttttttttttttgttggcggcggcgtcgagggtagtgattcgttcgtattggtgttattattagatttttcgattaattttagtagcggtaggatagtcggtcgtttttcgagaggtttcggttcgtattcgtttagttttttttcgggcgatatgatggcgttagcggtcggggtttttatttttttaagcggcgtcgcggcgggtgggcgcgaagaaaagtagtttcgcgggggtcgcggtgacgtcggggatttcggcgttaatgggcggcggtcgcgcgatttttcgggagtttggcgtgagggtggacggggggtttgcgtcggcgttttcgttaattatcgcgtcggttttttttttttttatttttcgtcgggtcgaggttttttttttcgtagttaaaagtcgttttttcgggcggggtggcgtcgtcgttgtcggtttttaagtcggtttttttatagtagaggttgagttcgattatcgcgttttttttgaggttaaatattgttagtcgtcgtcgtcgtttggttgagaaaattggggaagatttcgattttttattggaaggaagcgga

SEQ ID NO: 38996 - DNA, 687 bp, Artificial Sequence
  chemically treated genomic DNA (Homo sapiens) CpG-island No: 38996
tccgcttccttccaataaaaaatcgaaatcttccccaattttctcaaccaaacgacgacgacgactaacaatatttaacctcaaaaaaaacgcgataatcgaactcaacctctactataaaaaaaccgacttaaaaaccgacaacgacgacgccaccccgcccgaaaaaacgacttttaactacgaaaaaaaaaacctcgacccgacgaaaaataaaaaaaaaaaaaaccgacgcgataattaacgaaaacgccgacgcaaaccccccgtccaccctcacgccaaactcccgaaaaatcgcgcgaccgccgcccattaacgccgaaatccccgacgtcaccgcgacccccgcgaaactacttttcttcgcgcccacccgccgcgacgccgcttaaaaaaataaaaaccccgaccgctaacgccatcatatcgcccgaaaaaaaactaaacgaatacgaaccgaaacctctcgaaaaacgaccgactatcctaccgctactaaaattaatcgaaaaatctaataataacaccaatacgaacgaatcactaccctcgacgccgccgccaacaaaaaaaaaaaaaaacgaattataccgacaatcgctaaaaattatctctcgataccttcgaaaacaaaccaccgacgccaaaaacacaaaaccaataaacaaatctaaaaccaccaac

SEQ ID NO: 38997 - DNA, 778 bp, Artificial Sequence
  chemically treated genomic DNA (Homo sapiens) CpG-island No: 38997
gcgggtattttcgtttagggcgtttttttttcggattagcggtttttttaggtcgtttcgttttaggcgtttttggaggttgtttcgtttgtgtcgcgtcggtcgcgtcgtgttcgtatcgtttattcgagcggttcggaggttcgggttgtttaagtttttagttttagtcgggtacgaggatagcgttcgggagcgattgtagtttttgatttcggttgggttagttcgggttgtttaagtttttagtttcggtcgggtacgaggatagcgttcgggagcgattgtagttttcgatttcggttgggttagttcgggttttagtttacgtagtcgtcggggggcgttcggcgtagttcggtttgggtggttttggcgagtggggttgcgaggtagatcggttttatttcggggttttgaggggcgcgggttggggcgcgtggcgtgcggggttgggcgggggcgggcgcgagggcggagttgcggtcgaggcgcggaagtcggagcgcggtttagcgttttttagtggcgtcgcggaaggattgtttggagagagatttggttagaagggttacgggttacggggttcgtagataggtagagatttttcgggattcgtttcgcgttttttttcgggttcgttagacgtcgttttcggttcgttcgttatttttttgcgttgtgcgtcggattcgttacgattcggattagtttcgtggttcggaaatttttagtttgggtcgaattttgggaggaatttattcgtgaatttggttta

SEQ ID NO: 38998 - DNA, 778 bp, Artificial Sequence
  chemically treated genomic DNA (Homo sapiens) CpG-island No: 38998
taaaccaaattcacgaataaattcctcccaaaattcgacccaaactaaaaatttccgaaccacgaaactaatccgaatcgtaacgaatccgacgcacaacgcaaaaaaataacgaacgaaccgaaaacgacgtctaacgaacccgaaaaaaaacgcgaaacgaatcccgaaaaatctctacctatctacgaaccccgtaacccgtaacccttctaaccaaatctctctccaaacaatccttccgcgacgccactaaaaaacgctaaaccgcgctccgacttccgcgcctcgaccgcaactccgccctcgcgcccgcccccgcccaaccccgcacgccacgcgccccaacccgcgcccctcaaaaccccgaaataaaaccgatctacctcgcaaccccactcgccaaaaccacccaaaccgaactacgccgaacgccccccgacgactacgtaaactaaaacccgaactaacccaaccgaaatcgaaaactacaatcgctcccgaacgctatcctcgtacccgaccgaaactaaaaacttaaacaacccgaactaacccaaccgaaatcaaaaactacaatcgctcccgaacgctatcctcgtacccgactaaaactaaaaacttaaacaacccgaacctccgaaccgctcgaataaacgatacgaacacgacgcgaccgacgcgacacaaacgaaacaacctccaaaaacgcctaaaacgaaacgacctaaaaaaaccgctaatccgaaaaaaaaacgccctaaacgaaaatacccgc

SEQ ID NO: 38999 - DNA, 778 bp, Artificial Sequence
  chemically treated genomic DNA (Homo sapiens) CpG-island No: 38999
tgggttaagtttacggataaattttttttagaattcgatttaggttgaagattttcgagttacggagttggttcgggtcgtggcgggttcgacgtatagcgtaggagagtgacgagcgggtcggggacggcgtttaacggattcggagaggggcgcggggcgggtttcgggaggtttttatttgtttgcgagtttcgtggttcgtaatttttttggttaggtttttttttaggtaattttttcgcggcgttattggagagcgttgagtcgcgtttcggttttcgcgtttcggtcgtaatttcgttttcgcgttcgttttcgtttagtttcgtacgttacgcgttttagttcgcgttttttagggtttcggggtggggtcggtttgtttcgtagttttattcgttaggattatttaaatcgggttgcgtcgggcgtttttcgacggttgcgtgagttgaagttcgggttggtttagtcggggtcggaggttgtagtcgttttcgggcgttgttttcgtgttcggtcgagattagggatttaagtagttcgggttggtttagtcggggttagaggttgtagtcgttttcgggcgttgttttcgtgttcggttgagattagggatttaagtaattcgggttttcgagtcgttcgggtgagcggtgcgaatacggcgcggtcggcgcggtataggcggggtagtttttaggggcgtttggagcgaggcggtttgggagagtcgttggttcgggagggaagcgttttggacggaggtattcgt

SEQ ID NO: 39000 - DNA, 778 bp, Artificial Sequence
  chemically treated genomic DNA (Homo sapiens) CpG-island No: 39000
acgaatacctccgtccaaaacgcttccctcccgaaccaacgactctcccaaaccgcctcgctccaaacgcccctaaaaactaccccgcctataccgcgccgaccgcgccgtattcgcaccgctcacccgaacgactcgaaaacccgaattacttaaatccctaatctcaaccgaacacgaaaacaacgcccgaaaacgactacaacctctaaccccgactaaaccaacccgaactacttaaatccctaatctcgaccgaacacgaaaacaacgcccgaaaacgactacaacctccgaccccgactaaaccaacccgaacttcaactcacgcaaccgtcgaaaaacgcccgacgcaacccgatttaaataatcctaacgaataaaactacgaaacaaaccgaccccaccccgaaaccctaaaaaacgcgaactaaaacgcgtaacgtacgaaactaaacgaaaacgaacgcgaaaacgaaattacgaccgaaacgcgaaaaccgaaacgcgactcaacgctctccaataacgccgcgaaaaaattacctaaaaaaaaacctaaccaaaaaaattacgaaccacgaaactcgcaaacaaataaaaacctcccgaaacccgccccgcgcccctctccgaatccgttaaacgccgtccccgacccgctcgtcactctcctacgctatacgtcgaacccgccacgacccgaaccaactccgtaactcgaaaatcttcaacctaaatcgaattctaaaaaaaatttatccgtaaacttaaccca

SEQ ID NO: 39001 - DNA, 515 bp, Artificial Sequence
  chemically treated genomic DNA (Homo sapiens) CpG-island No: 39001
  misc_feature (315)..(315): n is either a, c, g or t
ggcggggtcgcgatcgtatagcgtagggagaggggacgacgcgggcgtcggggcgggcgggtttaacgggattcgggagaggggcggtcggggcgggagtttcggcgaggtttttatttgttttgcgagttttcggtggttcgttaatttttttgcgtttaggcgtcgtttttaggtaatttcgtttcgggcggttattggggttttgagtcgcgtttcggttacgtcgtttcgttatattacgtgttcggttcggtgcgagtagtttggcgttattgttttaggacggtttgtcgaggtattgaggtgggtttnttgattcgtattttattagttagtaggacgtgttgggtgtgcgtgtggtttcgttagatgggtgcgtgagtgaagatcgtgttggttacgttgggtttgaggttgtagtgatttatggcggtgttttagtgcgcgttgagatttaggatttaagtagtatcgttgtttagacggagttagagggtgtagttattttcgtg

SEQ ID NO: 39002 - DNA, 515 bp, Artificial Sequence
  chemically treated genomic DNA (Homo sapiens) CpG-island No: 39002
  misc_feature (201)..(201): n is either a, c, g or t
cacgaaaataactacaccctctaactccgtctaaacaacgatactacttaaatcctaaatctcaacgcgcactaaaacaccgccataaatcactacaacctcaaacccaacgtaaccaacacgatcttcactcacgcacccatctaacgaaaccacacgcacacccaacacgtcctactaactaataaaatacgaatcaanaaacccacctcaatacctcgacaaaccgtcctaaaacaataacgccaaactactcgcaccgaaccgaacacgtaatataacgaaacgacgtaaccgaaacgcgactcaaaaccccaataaccgcccgaaacgaaattacctaaaaacgacgcctaaacgcaaaaaaattaacgaaccaccgaaaactcgcaaaacaaataaaaacctcgccgaaactcccgccccgaccgcccctctcccgaatcccgttaaacccgcccgccccgacgcccgcgtcgtcccctctccctacgctatacgatcgcgaccccgcc

SEQ ID NO: 39003 - DNA, 515 bp, Artificial Sequence
  chemically treated genomic DNA (Homo sapiens) CpG-island No: 39003
  misc_feature (201)..(201): n is either a, c, g or t
tacgagagtgattatattttttgatttcgtttgagtagcgatgttgtttaagttttaagttttagcgcgtattagagtatcgttatagattattgtagttttagatttagcgtggttagtacggtttttatttacgtatttatttagcgggattatacgtatatttagtacgttttgttaattagtgaagtgcgagttagnaaatttattttagtgtttcgataggtcgttttgaagtagtagcgttagattgttcgtatcgagtcgagtacgtagtgtagcgaagcggcgtgatcggagcgcggtttagggttttagtggtcgttcggagcgaggttgtttggagacgacgtttgggcgtagaagggttaacgggttatcgggggttcgtagagtaggtagagatttcgtcgagattttcgtttcggtcgtttttttttcgggtttcgttagattcgttcgtttcggcgttcgcgtcgttttttttttttgcgttgtgcggtcgcgatttcgtt

SEQ ID NO: 39004 - DNA, 515 bp, Artificial Sequence
  chemically treated genomic DNA (Homo sapiens) CpG-island No: 39004
  misc_feature (315)..(315): n is either a, c, g or t
aacgaaatcgcgaccgcacaacgcaaaaaaaaaaaacgacgcgaacgccgaaacgaacgaatctaacgaaacccgaaaaaaaaacgaccgaaacgaaaatctcgacgaaatctctacctactctacgaacccccgataacccgttaacccttctacgcccaaacgtcgtctccaaacaacctcgctccgaacgaccactaaaaccctaaaccgcgctccgatcacgccgcttcgctacactacgtactcgactcgatacgaacaatctaacgctactacttcaaaacgacctatcgaaacactaaaataaatttnctaactcgcacttcactaattaacaaaacgtactaaatatacgtataatcccgctaaataaatacgtaaataaaaaccgtactaaccacgctaaatctaaaactacaataatctataacgatactctaatacgcgctaaaacttaaaacttaaacaacatcgctactcaaacgaaatcaaaaaatataatcactctcgta

SEQ ID NO: 39005 - DNA, 910 bp, Artificial Sequence
  chemically treated genomic DNA (Homo sapiens) CpG-island No: 39005
tttagcggcggggggtagagttcggggttgcggcgttgtttaatttcggcggcggtagcggcggcgttggaaggtgttgtttttaagtttatgttcgtttatgtaggtttcgtgggtttcggcgagggcggcggcgcgggcgtcgtggcgggtttgggttcgtggttgcggtatgggtcggggggcgcgtttcgttttttttttttttttttttaggttcgtgtagtagatggggcgttattatcgtcgtagtaagtagcgcgtagtcggcgtagttagttcgcggcggtagtagcggggcgtaggggtatcgtggcggtcggaggcggtaggtagggaaaggggcggaagagaagatataaagatcgtgagcgattgttgagacgagtttcgagcgcgtcggtatttcggttttagttagcgtgggttcggcgggcgtggatttttaagaggttggtttagttttagcgattatttatcggcggttcggatatttttgcgcggtagttttcgcggtcgattaattttagtttcgtattgtcgtttcgtttcgttttgtgttcgttaatttacgacgttataatttttcgtcgtgtttttttttttttttttattggttgtgatcgtacgttagttcgatttagtttgttaatcgtaggatttagagggttttttttttcgttcgtttagtgtaattcgagttttttgtttatcgattttaagtttttttttttgcgtcgtatgttgtttcgcgttttttttttttttttttttattttttttcgcgatttattgttttttcgcgtttaatagaaatgggcgatcgtaagttttattttcgtcggcgttataaaggtatcggtttttgatttttttttgaattaatgtgattcgatttatttttttttta

SEQ ID NO: 39006 - DNA, 910 bp, Artificial Sequence
  chemically treated genomic DNA (Homo sapiens) CpG-island No: 39006
taaaaaaaaaataaatcgaatcacattaattcaaaaaaaaatcaaaaaccgatacctttataacgccgacgaaaataaaacttacgatcgcccatttctattaaacgcgaaaaaacaataaatcgcgaaaaaaaataaaaaaaaaaaaaaaaaaaacgcgaaacaacatacgacgcaaaaaaaaaaacttaaaatcgataaacaaaaaactcgaattacactaaacgaacgaaaaaaaaaaccctctaaatcctacgattaacaaactaaatcgaactaacgtacgatcacaaccaataaaaaaaaaaaaaaaaacacgacgaaaaattataacgtcgtaaattaacgaacacaaaacgaaacgaaacgacaatacgaaactaaaattaatcgaccgcgaaaactaccgcgcaaaaatatccgaaccgccgataaataatcgctaaaactaaaccaacctcttaaaaatccacgcccgccgaacccacgctaactaaaaccgaaataccgacgcgctcgaaactcgtctcaacaatcgctcacgatctttatatcttctcttccgcccctttccctacctaccgcctccgaccgccacgatacccctacgccccgctactaccgccgcgaactaactacgccgactacgcgctacttactacgacgataataacgccccatctactacacgaacctaaaaaaaaaaaaaaaaaaaacgaaacgcgccccccgacccataccgcaaccacgaacccaaacccgccacgacgcccgcgccgccgccctcgccgaaacccacgaaacctacataaacgaacataaacttaaaaacaacaccttccaacgccgccgctaccgccgccgaaattaaacaacgccgcaaccccgaactctaccccccgccgctaaa

SEQ ID NO: 39007 - DNA, 910 bp, Artificial Sequence
  chemically treated genomic DNA (Homo sapiens) CpG-island No: 39007
tggagggaagatgaatcggattatattaatttaaggagaggttaaaggtcggtatttttgtaacgtcggcgagagtaagatttgcggtcgtttatttttgttgggcgcgaggaaatagtaaatcgcggaagggggtagagggggaaggaaagggagcgcgaggtagtatgcggcgtaggagagaggatttggagtcgatggatagggaattcgaattatattgagcgggcgggggagagggttttttgggttttgcgattggtaggttgagtcgggttgacgtgcggttataattaatggggaggaagggagggatacggcgggggattatggcgtcgtggattggcgggtatagggcggggcgggacggtagtgcgggattgagattgatcgatcgcgggggttgtcgcgtagagatattcgggtcgtcggtgggtggtcgttagggttgggttagttttttggaggtttacgttcgtcgagtttacgttggttggggtcggggtgtcggcgcgttcgggattcgttttagtagtcgtttacggtttttgtgttttttttttcgtttttttttttgtttgtcgttttcggtcgttacgatgtttttgcgtttcgttgttgtcgtcgcggattggttgcgtcggttgcgcgttgtttgttgcggcggtggtggcgttttatttgttatacgggtttgaagaaggaagaagaggaagcgaagcgcgtttttcggtttatgtcgtagttacgggtttagattcgttacggcgttcgcgtcgtcgttttcgtcggagtttacgagatttgtatggacgggtatgggtttgagagtagtattttttagcgtcgtcgttgtcgtcgtcgaggttgagtagcgtcgtagtttcgggttttgtttttcgtcgttgga

SEQ ID NO: 39008 - DNA, 910 bp, Artificial Sequence
  chemically treated genomic DNA (Homo sapiens) CpG-island No: 39008
tccaacgacgaaaaacaaaacccgaaactacgacgctactcaacctcgacgacgacaacgacgacgctaaaaaatactactctcaaacccatacccgtccatacaaatctcgtaaactccgacgaaaacgacgacgcgaacgccgtaacgaatctaaacccgtaactacgacataaaccgaaaaacgcgcttcgcttcctcttcttccttcttcaaacccgtataacaaataaaacgccaccaccgccgcaacaaacaacgcgcaaccgacgcaaccaatccgcgacgacaacaacgaaacgcaaaaacatcgtaacgaccgaaaacgacaaacaaaaaaaaaaacgaaaaaaaaaacacaaaaaccgtaaacgactactaaaacgaatcccgaacgcgccgacaccccgaccccaaccaacgtaaactcgacgaacgtaaacctccaaaaaactaacccaaccctaacgaccacccaccgacgacccgaatatctctacgcgacaacccccgcgatcgatcaatctcaatcccgcactaccgtcccgccccgccctatacccgccaatccacgacgccataatcccccgccgtatccctcccttcctccccattaattataaccgcacgtcaacccgactcaacctaccaatcgcaaaacccaaaaaaccctctcccccgcccgctcaatataattcgaattccctatccatcgactccaaatcctctctcctacgccgcatactacctcgcgctccctttccttccccctctacccccttccgcgatttactatttcctcgcgcccaacaaaaataaacgaccgcaaatcttactctcgccgacgttacaaaaataccgacctttaacctctccttaaattaatataatccgattcatcttccctcca

SEQ ID NO: 39009 - DNA, 871 bp, Artificial Sequence
  chemically treated genomic DNA (Homo sapiens) CpG-island No: 39009
gggtcgcgagaaatgaagggtgtggattgggtgggaggaatgcgggtggacgtagggtgggggatgttgaagggtgtcgagggggacgaaataagatggaggaaattgagtgcgttttcggagcggggtttgttttatcgaagtttgatttggcgttttcggggttcggggggtcggggatcgggtgcgggtcgttgaggtatacgagttcggcgcgatttcgtagcgttttttttagcgtttcggtttttttacggaagtttcgttcgttttgtcggaagttcgttaggtataggattcgtaggggtcgttgcgcggttattatgttcggtaaggagcgacggaagttatcggaagcggttttttttcgagcggaagtataatgtacggggcggaatcgaacgttagtatcgtttcgagggcgggtttcggagcgttaaggcgtttttatgataacggtaaaaggcggggcgtatttagagcgggggttgatatttgaggttcgggagcgcgttaaggagttagcggcgttattttttcgtttttgtagttgtagttttcgtaagttacggtcgaagggggacgcgcggattttttttgtatttgaggtcgtagattttggttagggtttcgtttttgcgattttgcgttttttttcgtttcgtttttgtgcgtttttcgtcgcggtcgtagggcggcggttagtgtttaggcgcggtttttttttttttttggaagttttcgtttattttttttcgcgcgggtcggttcggggcgtggggacggcggttttggtcgtggtttatcgtttagggttttaaggagttgttagcgtagaagtttatcgggtagggttgttgttaggaaatgt

SEQ ID NO: 39010 - DNA, 871 bp, Artificial Sequence
  chemically treated genomic DNA (Homo sapiens) CpG-island No: 39010
acatttcctaacaacaaccctacccgataaacttctacgctaacaactccttaaaaccctaaacgataaaccacgaccaaaaccgccgtccccacgccccgaaccgacccgcgcgaaaaaaaataaacgaaaacttccaaaaaaaaaaaaaaaccgcgcctaaacactaaccgccgccctacgaccgcgacgaaaaacgcacaaaaacgaaacgaaaaaaaacgcaaaatcgcaaaaacgaaaccctaaccaaaatctacgacctcaaatacaaaaaaaatccgcgcgtcccccttcgaccgtaacttacgaaaactacaactacaaaaacgaaaaaataacgccgctaactccttaacgcgctcccgaacctcaaatatcaacccccgctctaaatacgccccgccttttaccgttatcataaaaacgccttaacgctccgaaacccgccctcgaaacgatactaacgttcgattccgccccgtacattatacttccgctcgaaaaaaaaccgcttccgataacttccgtcgctccttaccgaacataataaccgcgcaacgacccctacgaatcctatacctaacgaacttccgacaaaacgaacgaaacttccgtaaaaaaaccgaaacgctaaaaaaaacgctacgaaatcgcgccgaactcgtatacctcaacgacccgcacccgatccccgaccccccgaaccccgaaaacgccaaatcaaacttcgataaaacaaaccccgctccgaaaacgcactcaatttcctccatcttatttcgtccccctcgacacccttcaacatcccccaccctacgtccacccgcattcctcccacccaatccacacccttcatttctcgcgaccc

SEQ ID NO: 39011 - DNA, 871 bp, Artificial Sequence
  chemically treated genomic DNA (Homo sapiens) CpG-island No: 39011
atattttttggtagtagttttattcgatggatttttacgttggtagttttttggggttttggacggtgaattacggttaggatcgtcgtttttacgtttcgggtcggttcgcgcgggggaaggtaggcgggggtttttaggagggaggagagatcgcgtttgggtattggtcgtcgttttgcgatcgcgacgggaaacgtataggagcggagcggagggaaacgtagggtcgtaggagcgagattttaattaaagtttgcgattttaggtgtaggaggggttcgcgcgttttttttcggtcgtggtttgcgaggattgtagttgtagggacgagaaggtggcgtcgttggttttttgacgcgttttcgggttttaggtattagttttcgttttgggtgcgtttcgttttttgtcgttgttatgggaacgttttggcgtttcgaggttcgttttcggggcggtgttgacgttcggtttcgtttcgtgtattgtgttttcgttcggggaaagatcgttttcggtggttttcgtcgttttttgtcgggtataatggtcgcgtagcgatttttgcgggttttgtgtttggcgggttttcggtagagcgagcggggttttcgtgagaagatcggggcgttgaggaaggcgttgcggggtcgcgtcgagttcgtgtgttttagcggttcgtattcggttttcgatttttcgggtttcgagggcgttagattagatttcggtgagataagtttcgtttcggaaacgtatttagttttttttattttgtttcgtttttttcgatattttttagtattttttattttgcgtttattcgtattttttttatttagtttatattttttatttttcgcgattt

SEQ ID NO: 39012 - DNA, 871 bp, Artificial Sequence
  chemically treated genomic DNA (Homo sapiens) CpG-island No: 39012
aaatcgcgaaaaataaaaaatataaactaaataaaaaaaatacgaataaacgcaaaataaaaaatactaaaaaatatcgaaaaaaacgaaacaaaataaaaaaaactaaatacgtttccgaaacgaaacttatctcaccgaaatctaatctaacgccctcgaaacccgaaaaatcgaaaaccgaatacgaaccgctaaaacacacgaactcgacgcgaccccgcaacgccttcctcaacgccccgatcttctcacgaaaaccccgctcgctctaccgaaaacccgccaaacacaaaacccgcaaaaatcgctacgcgaccattatacccgacaaaaaacgacgaaaaccaccgaaaacgatctttccccgaacgaaaacacaatacacgaaacgaaaccgaacgtcaacaccgccccgaaaacgaacctcgaaacgccaaaacgttcccataacaacgacaaaaaacgaaacgcacccaaaacgaaaactaatacctaaaacccgaaaacgcgtcaaaaaaccaacgacgccaccttctcgtccctacaactacaatcctcgcaaaccacgaccgaaaaaaaacgcgcgaacccctcctacacctaaaatcgcaaactttaattaaaatctcgctcctacgaccctacgtttccctccgctccgctcctatacgtttcccgtcgcgatcgcaaaacgacgaccaatacccaaacgcgatctctcctccctcctaaaaacccccgcctaccttcccccgcgcgaaccgacccgaaacgtaaaaacgacgatcctaaccgtaattcaccgtccaaaaccccaaaaaactaccaacgtaaaaatccatcgaataaaactactaccaaaaaatat

SEQ ID NO: 39013 - DNA, 554 bp, Artificial Sequence
  chemically treated genomic DNA (Homo sapiens) CpG-island No: 39013
ttagtgcggggaagagtcgtcgagattgggagaaggggcgttggttagggaggagacggggtagggagcggattcgttattcgtattttgggcggcggttttcgcgttttagtcgcgtttttcgatgatttttagtcgcgaagggcgagcgggcgggggttgggttgcgggttcgggttttaggaggtttgcggggtcggggaggggcgtggagtggttcgaggatcggtttggggattgggggtaggtgtttggacggacgcgggtcgagtatttttttcgggggcgggcgtagtgaaaatattttgggaggcggcgtcgcgcggttgagcgttgttgttttgggaataggacggcgttcggtattgcgagttgagagtatttttataaattttgtatgggaggcgtttcgtgagcgggggcggggagcggagcgagagggagggagttagagagtaagggagggagggaggaggagaggagggggaagtcggggggaggaagggaggcgtttcgtttcgtcgatcgttcggttttgtaaacgcgcgtcgggt

SEQ ID NO: 39014 - DNA, 554 bp, Artificial Sequence
  chemically treated genomic DNA (Homo sapiens) CpG-island No: 39014
acccgacgcgcgtttacaaaaccgaacgatcgacgaaacgaaacgcctcccttcctccccccgacttccccctcctctcctcctccctccctcccttactctctaactccctccctctcgctccgctccccgcccccgctcacgaaacgcctcccatacaaaatttataaaaatactctcaactcgcaataccgaacgccgtcctattcccaaaacaacaacgctcaaccgcgcgacgccgcctcccaaaatattttcactacgcccgcccccgaaaaaaatactcgacccgcgtccgtccaaacacctacccccaatccccaaaccgatcctcgaaccactccacgcccctccccgaccccgcaaacctcctaaaacccgaacccgcaacccaacccccgcccgctcgcccttcgcgactaaaaatcatcgaaaaacgcgactaaaacgcgaaaaccgccgcccaaaatacgaataacgaatccgctccctaccccgtctcctccctaaccaacgccccttctcccaatctcgacgactcttccccgcactaa

SEQ ID NO: 39015 - DNA, 554 bp, Artificial Sequence
  chemically treated genomic DNA (Homo sapiens) CpG-island No: 39015
gttcggcgcgcgtttgtaggatcgagcgatcggcggagcggggcgttttttttttttttttcggtttttttttttttttttttttttttttttttttgttttttagttttttttttttcgtttcgtttttcgttttcgtttacggagcgttttttatataaaatttatgaaagtgtttttagttcgtagtgtcgagcgtcgttttatttttaaggtagtagcgtttagtcgcgcggcgtcgttttttaaggtgtttttattgcgttcgttttcggggaagatgttcggttcgcgttcgtttaggtatttgtttttagtttttaagtcggttttcggattattttacgttttttttcggtttcgtaggttttttggagttcgaattcgtagtttagttttcgttcgttcgtttttcgcggttggaggttatcgggagacgcggttgggacgcgaggatcgtcgtttagagtacggatggcgagttcgttttttgtttcgttttttttttggttagcgtttttttttttagtttcgacggttttttttcgtattga

SEQ ID NO: 39016 - DNA, 554 bp, Artificial Sequence
  chemically treated genomic DNA (Homo sapiens) CpG-island No: 39016
tcaatacgaaaaaaaaccgtcgaaactaaaaaaaaaaacgctaaccaaaaaaaaaacgaaacaaaaaacgaactcgccatccgtactctaaacgacgatcctcgcgtcccaaccgcgtctcccgataacctccaaccgcgaaaaacgaacgaacgaaaactaaactacgaattcgaactccaaaaaacctacgaaaccgaaaaaaaacgtaaaataatccgaaaaccgacttaaaaactaaaaacaaatacctaaacgaacgcgaaccgaacatcttccccgaaaacgaacgcaataaaaacaccttaaaaaacgacgccgcgcgactaaacgctactaccttaaaaataaaacgacgctcgacactacgaactaaaaacactttcataaattttatataaaaaacgctccgtaaacgaaaacgaaaaacgaaacgaaaaaaaaaaaactaaaaaacaaaaaaaaaaaaaaaaaaaaaaaaaaaaaaaaaccgaaaaaaaaaaaaaaaacgccccgctccgccgatcgctcgatcctacaaacgcgcgccgaac

SEQ ID NO: 39017 - DNA, 601 bp, Artificial Sequence
  chemically treated genomic DNA (Homo sapiens) CpG-island No: 39017
gtgagtaggattagtttattgtttttgtttatttgttgagcgttgattggttttcgtttaggaaacggaaaaaggggcgtgtacgcgggcgcggttgcgtgagaggcgcgcggcggcgtagtaaatagtttttttttataaaattatggcgtcgtttaaatgtagtatcgtcgtttgcgtgatttgtttggagaagtttaaatatcgttgtttagtttgtcgcgtgttttagtgagcggggaggtcgcggggtttaggggcgcgggtgttcggttatggcgggagggcgggaggtcgggaggtcgggcgggagcgggcgggttgttggaggggtcggggattttcggggttgacgcggtttgtggtttttgttgttatagttgttcggtagtttgttttcggaagtataaaggtgagtttcgttttcgttagttttcgtattattgcgtacggggtagtttttacgtttagttttcgttttgggggcgtggatttttggcgtgcgttttttttttcgtttcgggttttcgcgggttttgtaggaattttgttttttttgatttggtttttggtgtttttgtgtgtcggatagttttttttg

SEQ ID NO: 39018 - DNA, 601 bp, Artificial Sequence
  chemically treated genomic DNA (Homo sapiens) CpG-island No: 39018
caaaaaaaactatccgacacacaaaaacaccaaaaaccaaatcaaaaaaaacaaaattcctacaaaacccgcgaaaacccgaaacgaaaaaaaaaacgcacgccaaaaatccacgcccccaaaacgaaaactaaacgtaaaaactaccccgtacgcaataatacgaaaactaacgaaaacgaaactcacctttatacttccgaaaacaaactaccgaacaactataacaacaaaaaccacaaaccgcgtcaaccccgaaaatccccgacccctccaacaacccgcccgctcccgcccgacctcccgacctcccgccctcccgccataaccgaacacccgcgcccctaaaccccgcgacctccccgctcactaaaacacgcgacaaactaaacaacgatatttaaacttctccaaacaaatcacgcaaacgacgatactacatttaaacgacgccataattttataaaaaaaaactatttactacgccgccgcgcgcctctcacgcaaccgcgcccgcgtacacgcccctttttccgtttcctaaacgaaaaccaatcaacgctcaacaaataaacaaaaacaataaactaatcctactcac

SEQ ID NO: 39019 - DNA, 601 bp, Artificial Sequence
  chemically treated genomic DNA (Homo sapiens) CpG-island No: 39019
tagagggaattgttcgatatatagagatattagggattaagttagaggaagtaaggtttttgtagaattcgcggagattcgaggcgggaaaggaagcgtacgttaagggtttacgtttttaagacggaggttggacgtgggggttgtttcgtgcgtagtggtacgagggttggcggggacggggtttatttttgtgttttcggaagtagattatcgagtagttgtaataatagaggttataggtcgcgttagtttcgagggttttcggtttttttagtagttcgttcgttttcgttcggtttttcggtttttcgttttttcgttatggtcggatattcgcgtttttggatttcgcgattttttcgtttattagggtacgcggtaggttggatagcggtatttgggtttttttaagtagattacgtagacgacggtgttatatttgagcgacgttatggttttgtggaaggagattgtttattgcgtcgtcgcgcgttttttacgtagtcgcgttcgcgtgtacgttttttttttcgttttttaaacggggattaattagcgtttagtaggtaggtaaaagtaatggattgattttgtttat

SEQ ID NO: 39020 - DNA, 601 bp, Artificial Sequence
  chemically treated genomic DNA (Homo sapiens) CpG-island No: 39020
ataaacaaaatcaatccattacttttacctacctactaaacgctaattaatccccgtttaaaaaacgaaaaaaaaaacgtacacgcgaacgcgactacgtaaaaaacgcgcgacgacgcaataaacaatctccttccacaaaaccataacgtcgctcaaatataacaccgtcgtctacgtaatctacttaaaaaaacccaaataccgctatccaacctaccgcgtaccctaataaacgaaaaaatcgcgaaatccaaaaacgcgaatatccgaccataacgaaaaaacgaaaaaccgaaaaaccgaacgaaaacgaacgaactactaaaaaaaccgaaaaccctcgaaactaacgcgacctataacctctattattacaactactcgataatctacttccgaaaacacaaaaataaaccccgtccccgccaaccctcgtaccactacgcacgaaacaacccccacgtccaacctccgtcttaaaaacgtaaacccttaacgtacgcttcctttcccgcctcgaatctccgcgaattctacaaaaaccttacttcctctaacttaatccctaatatctctatatatcgaacaattccctcta

SEQ ID NO: 39021 - DNA, 664 bp, Artificial Sequence
  chemically treated genomic DNA (Homo sapiens) CpG-island No: 39021
tttacggcgaggtttattagggtaatggtgtcgtcggattcgtataatatttcgtcggattcgtataatatttcgtcgtattcgtataagatttcgtcgcggcgatttttattgaaagatttttagttttggtgtcgttcgaaggtttaggaaatcgtgttttcgcgttttttttttagaacgtgggaagttgtcgttttatttttattttattttagggtcgtaaaatattttatcgtagttgaagttagtaagtcggattaggcgtttcggttaagtaacgtgcgcgttttttcgcgagtgttcgtttcgtttttagggaggagtcggtcgattttcggttatttagtagtgtcgtagtcgacggggtgcggttcggcgtttttaggtttttttttttattgtacgtttttgttttttttttttttttttttgttcgtgtttttttcgtcgtttgatttggttcgttcgtttttttagtttggtcgggcggggtttgaagtacggcgttcgggcgtgggatcggtgagtgttaattcgaatttatatttgaagttttttagacgcggaaggggtttgggaggttagtttgtttcgtagcggtgaggaagaagtaggcgtttttatttttttttttaaagcgtcgttttttttttttttgttt

SEQ ID NO: 39022 - DNA, 664 bp, Artificial Sequence
  chemically treated genomic DNA (Homo sapiens) CpG-island No: 39022
aaacaaaaaaaaaaaaaacgacgctttaaaaaaaaaaataaaaacgcctacttcttcctcaccgctacgaaacaaactaacctcccaaaccccttccgcgtctaaaaaacttcaaatataaattcgaattaacactcaccgatcccacgcccgaacgccgtacttcaaaccccgcccgaccaaactaaaaaaacgaacgaaccaaatcaaacgacgaaaaaaacacgaacaaaaaaaaaaaaaaaaaaaacaaaaacgtacaataaaaaaaaaaacctaaaaacgccgaaccgcaccccgtcgactacgacactactaaataaccgaaaatcgaccgactcctccctaaaaacgaaacgaacactcgcgaaaaaacgcgcacgttacttaaccgaaacgcctaatccgacttactaacttcaactacgataaaatattttacgaccctaaaataaaataaaaataaaacgacaacttcccacgttctaaaaaaaaaacgcgaaaacacgatttcctaaaccttcgaacgacaccaaaactaaaaatctttcaataaaaatcgccgcgacgaaatcttatacgaatacgacgaaatattatacgaatccgacgaaatattatacgaatccgacgacaccattaccctaataaacctcgccgtaaa

SEQ ID NO: 39023 - DNA, 664 bp, Artificial Sequence
  chemically treated genomic DNA (Homo sapiens) CpG-island No: 39023
aggtaaaaaggagggaaacggcgttttggaaggggaggtggagacgtttattttttttttatcgttgcggggtaaattggttttttaagtttttttcgcgtttgaagggttttagatataggttcgggttgatatttatcggttttacgttcgagcgtcgtgttttaggtttcgttcggttagattggaaaggcgggcgggttaggttaggcggcgggaagaatacgggtaggagagaaaagaggaggggtaagagcgtgtagtgaggaaaggaatttgggagcgtcgaatcgtatttcgtcggttgcggtattgttaagtggtcgggggtcggtcggtttttttttaggggcggggcgagtattcgcgggggggcgcgtacgttgtttggtcgggacgtttggttcggtttgttggttttaattacggtgagatgttttgcgattttggggtaaaatgagggtaaagcggtagttttttacgttttgggggagaagcgcggaagtacggttttttgggttttcgggcgatattaggattgggggttttttagtagaggtcgtcgcggcggagttttgtgcgagtgcggcggagtgttgtgcgagttcggcggagtgttgtgcgagttcggcgatattattattttgataggtttcgtcgtgag

SEQ ID NO: 39024 - DNA, 664 bp, Artificial Sequence
  chemically treated genomic DNA (Homo sapiens) CpG-island No: 39024
ctcacgacgaaacctatcaaaataataatatcgccgaactcgcacaacactccgccgaactcgcacaacactccgccgcactcgcacaaaactccgccgcgacgacctctactaaaaaacccccaatcctaatatcgcccgaaaacccaaaaaaccgtacttccgcgcttctcccccaaaacgtaaaaaactaccgctttaccctcattttaccccaaaatcgcaaaacatctcaccgtaattaaaaccaacaaaccgaaccaaacgtcccgaccaaacaacgtacgcgcccccccgcgaatactcgccccgcccctaaaaaaaaaccgaccgacccccgaccacttaacaataccgcaaccgacgaaatacgattcgacgctcccaaattcctttcctcactacacgctcttacccctcctcttttctctcctacccgtattcttcccgccgcctaacctaacccgcccgcctttccaatctaaccgaacgaaacctaaaacacgacgctcgaacgtaaaaccgataaatatcaacccgaacctatatctaaaacccttcaaacgcgaaaaaaacttaaaaaaccaatttaccccgcaacgataaaaaaaaaataaacgtctccacctccccttccaaaacgccgtttccctcctttttacct

SEQ ID NO: 39025 - DNA, 629 bp, Artificial Sequence
  chemically treated genomic DNA (Homo sapiens) CpG-island No: 39025
ttgacgtcgaggggtttgtttttcgttcgtggggaagttttttcggttcgcggttggggttgaggttgggcgattattttttttattagttttagttcgggtttagcgaatggttgggtttcgagaaggcgtcggttacgggcgggacgtttagggcgatttcgtatattttgggcgtaaatttttttagcgggtttttagcgcggttagttttagtttcgcgagaggacgtgggtttcgttcggcgttcgatttcgttcggttttatttttttttcgtttttcgtttttttttttttatttttcgcggcgcgagcggttgattgttcgtagaggaaacgatattcggagttgcgttttcgtttaggtcggttttgacgcgggtttcgttagttagtaatagggagtagaggtgggagttagcgaggcgattacgaaaacggtgaaggtcggaatcgatagtttttttcgagaagggtgaggaaagggtttgagttttttcgttttttggatttcgtagagtcgttgcggggtcgattttttttaggggcggggtcgcgttgggtaattgtagttttggggtcgattgggcggggtgcgtttagaagcggggagaaggggttagttggg

SEQ ID NO: 39026 - DNA, 629 bp, Artificial Sequence
  chemically treated genomic DNA (Homo sapiens) CpG-island No: 39026
cccaactaaccccttctccccgcttctaaacgcaccccgcccaatcgaccccaaaactacaattacccaacgcgaccccgcccctaaaaaaaatcgaccccgcaacgactctacgaaatccaaaaaacgaaaaaactcaaaccctttcctcacccttctcgaaaaaaactatcgattccgaccttcaccgttttcgtaatcgcctcgctaactcccacctctactccctattactaactaacgaaacccgcgtcaaaaccgacctaaacgaaaacgcaactccgaatatcgtttcctctacgaacaatcaaccgctcgcgccgcgaaaaataaaaaaaaaaaaacgaaaaacgaaaaaaaaataaaaccgaacgaaatcgaacgccgaacgaaacccacgtcctctcgcgaaactaaaactaaccgcgctaaaaacccgctaaaaaaatttacgcccaaaatatacgaaatcgccctaaacgtcccgcccgtaaccgacgccttctcgaaacccaaccattcgctaaacccgaactaaaactaataaaaaaaataatcgcccaacctcaaccccaaccgcgaaccgaaaaaacttccccacgaacgaaaaacaaacccctcgacgtcaa

SEQ ID NO: 39027 - DNA, 629 bp, Artificial Sequence
  chemically treated genomic DNA (Homo sapiens) CpG-island No: 39027
tttaattgatttttttttttcgtttttgggcgtatttcgtttagtcggttttaggattgtagttgtttagcgcgatttcgtttttgggagggatcgatttcgtagcggttttgcggagtttagggaacggggaggtttagattttttttttatttttttcggaggaggttgtcggtttcgatttttatcgttttcgtggtcgtttcgttaatttttatttttgttttttgttattggttgacgaggttcgcgttagggtcggtttgggcgggagcgtagtttcgaatgtcgttttttttacgggtagttagtcgttcgcgtcgcggggagtggaagaaggagggcgggggacgaggggaaggtggggtcgggcggggtcgggcgtcgggcgggatttacgttttttcgcgagattggggttggtcgcgttggggattcgttggagaaatttgcgtttagagtgtgcggggtcgttttggacgtttcgttcgtggtcggcgttttttcggagtttagttattcgttagattcgaattaggattggtaggaggggtgatcgtttaattttagttttagtcgcgggtcgggaaggtttttttacggacgaagggtaagtttttcgacgttag

SEQ ID NO: 39028 - DNA, 629 bp, Artificial Sequence
  chemically treated genomic DNA (Homo sapiens) CpG-island No: 39028
ctaacgtcgaaaaacttacccttcgtccgtaaaaaaaccttcccgacccgcgactaaaactaaaattaaacgatcacccctcctaccaatcctaattcgaatctaacgaataactaaactccgaaaaaacgccgaccacgaacgaaacgtccaaaacgaccccgcacactctaaacgcaaatttctccaacgaatccccaacgcgaccaaccccaatctcgcgaaaaaacgtaaatcccgcccgacgcccgaccccgcccgaccccaccttcccctcgtcccccgccctccttcttccactccccgcgacgcgaacgactaactacccgtaaaaaaaacgacattcgaaactacgctcccgcccaaaccgaccctaacgcgaacctcgtcaaccaataacaaaaaacaaaaataaaaattaacgaaacgaccacgaaaacgataaaaatcgaaaccgacaacctcctccgaaaaaaataaaaaaaaaatctaaacctccccgttccctaaactccgcaaaaccgctacgaaatcgatccctcccaaaaacgaaatcgcgctaaacaactacaatcctaaaaccgactaaacgaaatacgcccaaaaacgaaaaaaaaaaatcaattaaa

SEQ ID NO: 39029 - DNA, 613 bp, Artificial Sequence
  chemically treated genomic DNA (Homo sapiens) CpG-island No: 39029
ttttttttcgggttcggcgttttcgttttttttgtgcgcgcgtggaggtcggggcggggcggggcggggggtcggtcgtagtcggcgttgagtttgtagggtcgttttttttattcgtttttttcgagttttcgggtttcgttttattcggttcgtgggggagtatttgttttgtcgttttcgtttacgttttgtatttcgggatcgtttttgcgcgttttgggcgtattatggttcgcggggttgcgttggcgttgttgtttttcggtttgttgggtgttttggtcgtcgtttcgggtgagcgagcggagggattcgggttgggggacgcggagggcgcgggtcgggattggggattcgtttgagatgcggcgttgggggcgtttcgcggggatattcggagttttttttttgttcggtaggacgcgttgtgtttacgggggtttaggttcggaggaggcgtttattttttttttaacgttttttttggagtcgttttagagagaaaagttagcgtttgttgtcggagttgtaaatttttatatgtggggcggttttgggagaggtgcgttcgattttttttaatttaggggatttttttatagattttttt

SEQ ID NO: 39030 - DNA, 613 bp, Artificial Sequence
  chemically treated genomic DNA (Homo sapiens) CpG-island No: 39030
aaaaaaatctataaaaaaatcccctaaattaaaaaaaatcgaacgcacctctcccaaaaccgccccacatataaaaatttacaactccgacaacaaacgctaacttttctctctaaaacgactccaaaaaaaacgttaaaaaaaaaataaacgcctcctccgaacctaaacccccgtaaacacaacgcgtcctaccgaacaaaaaaaaaactccgaatatccccgcgaaacgcccccaacgccgcatctcaaacgaatccccaatcccgacccgcgccctccgcgtcccccaacccgaatccctccgctcgctcacccgaaacgacgaccaaaacacccaacaaaccgaaaaacaacaacgccaacgcaaccccgcgaaccataatacgcccaaaacgcgcaaaaacgatcccgaaatacaaaacgtaaacgaaaacgacaaaacaaatactcccccacgaaccgaataaaacgaaacccgaaaactcgaaaaaaacgaataaaaaaaacgaccctacaaactcaacgccgactacgaccgaccccccgccccgccccgccccgacctccacgcgcgcacaaaaaaaacgaaaacgccgaacccgaaaaaaaa

SEQ ID NO: 39031 - DNA, 613 bp, Artificial Sequence
  chemically treated genomic DNA (Homo sapiens) CpG-island No: 39031
agagagatttgtaagaaggttttttagattgggaagaatcggacgtattttttttaaggtcgttttatatgtaagagtttgtaatttcgataataaacgttgatttttttttttggaacggttttaggaaaagcgttggggagaaagtgggcgtttttttcgggtttgggttttcgtgggtatagcgcgttttgtcgggtagggaggaggtttcgggtgttttcgcggggcgtttttaacgtcgtattttaagcggatttttagtttcggttcgcgtttttcgcgttttttaattcggattttttcgttcgtttattcggggcggcgattagaatatttagtaggtcgaagagtagtagcgttagcgtagtttcgcgggttatggtgcgtttagagcgcgtagggacggtttcggagtgtagggcgtgggcgaaggcggtaggatagatatttttttacgggtcgggtggggcgaagttcggggattcgaagggggcgggtgaggggagcggttttgtaagtttagcgtcggttgcgatcggtttttcgtttcgtttcgtttcggtttttacgcgcgtatagaaggggcgggaacgtcgggttcggggaggag

SEQ ID NO: 39032 - DNA, 613 bp, Artificial Sequence
  chemically treated genomic DNA (Homo sapiens) CpG-island No: 39032
ctcctccccgaacccgacgttcccgccccttctatacgcgcgtaaaaaccgaaacgaaacgaaacgaaaaaccgatcgcaaccgacgctaaacttacaaaaccgctcccctcacccgcccccttcgaatccccgaacttcgccccacccgacccgtaaaaaaatatctatcctaccgccttcgcccacgccctacactccgaaaccgtccctacgcgctctaaacgcaccataacccgcgaaactacgctaacgctactactcttcgacctactaaatattctaatcgccgccccgaataaacgaacgaaaaaatccgaattaaaaaacgcgaaaaacgcgaaccgaaactaaaaatccgcttaaaatacgacgttaaaaacgccccgcgaaaacacccgaaacctcctccctacccgacaaaacgcgctatacccacgaaaacccaaacccgaaaaaaacgcccactttctccccaacgcttttcctaaaaccgttccaaaaaaaaaaatcaacgtttattatcgaaattacaaactcttacatataaaacgaccttaaaaaaaatacgtccgattcttcccaatctaaaaaaccttcttacaaatctctct

SEQ ID NO: 39033 - DNA, 722 bp, Artificial Sequence
  chemically treated genomic DNA (Homo sapiens) CpG-island No: 39033
cgcgcgtagtcgtttgtattcgagcgcgtcggttttcgagtagttattattgttattatcgtcgtcgtcgagtagttatttaggtagcgtttgtttcgggtacggagtattgcggatgcgggcgcggggtcggcgcggggtttcgggcgcgttcgggggtcgtgagcgtcgcgtttcgcgttttcgcgcgtttttcgttttttcgcgcgtttcgttggggttatgtagttttttatttcgtcggtgattaaggcgattttggtggttttttttattttcgttattttttttattttttacgtgattttttggtatatttgtcgcgatgtggattgtgattacggtatttgagcgtcgcggattttcggggtcgttaggcggggggcgtttttagcgttagggttatggggattgagtcgtttcgcggtgttttttagttcggcgttcgcgttttttatttcgggttttatcgttcgttttgtatttttatcgttttttggttttgatttttagggacgtatcggggagagcgggtgagtgcgttcgtgcgggcgttttggggggttacggttggggagttttaatttcggggaggacgcggaattcggacgcgggattgaattcgaggatttacggagttcggggtttttttatggggtacgggaagcggtagatgcgcgtgtagagaggtgggcgtaggttttttttgtattttttttagg

SEQ ID NO: 39034 - DNA, 722 bp, Artificial Sequence
  chemically treated genomic DNA (Homo sapiens) CpG-island No: 39034
cctaaaaaaaatacaaaaaaaacctacgcccacctctctacacgcgcatctaccgcttcccgtaccccataaaaaaaccccgaactccgtaaatcctcgaattcaatcccgcgtccgaattccgcgtcctccccgaaattaaaactccccaaccgtaaccccccaaaacgcccgcacgaacgcactcacccgctctccccgatacgtccctaaaaatcaaaaccaaaaaacgataaaaatacaaaacgaacgataaaacccgaaataaaaaacgcgaacgccgaactaaaaaacaccgcgaaacgactcaatccccataaccctaacgctaaaaacgccccccgcctaacgaccccgaaaatccgcgacgctcaaataccgtaatcacaatccacatcgcgacaaatataccaaaaaatcacgtaaaaaataaaaaaaataacgaaaataaaaaaaaccaccaaaatcgccttaatcaccgacgaaataaaaaactacataaccccaacgaaacgcgcgaaaaaacgaaaaacgcgcgaaaacgcgaaacgcgacgctcacgacccccgaacgcgcccgaaaccccgcgccgaccccgcgcccgcatccgcaatactccgtacccgaaacaaacgctacctaaataactactcgacgacgacgataataacaataataactactcgaaaaccgacgcgctcgaatacaaacgactacgcgcg

SEQ ID NO: 39035 - DNA, 722 bp, Artificial Sequence
  chemically treated genomic DNA (Homo sapiens) CpG-island No: 39035
tttggagggggtatagggggggtttgcgtttatttttttgtacgcgtatttgtcgtttttcgtgttttataggggagtttcgggtttcgtgaattttcgggtttagtttcgcgttcggatttcgcgtttttttcgaagttggggttttttaatcgtggttttttaaagcgttcgtacgagcgtatttattcgtttttttcggtgcgtttttgaaggttaaggttaggaggcggtggaggtgtagggcgggcggtggggttcggagtagggggcgcgggcgtcgagttggggggtatcgcgggacggtttagtttttatggttttggcgttgggggcgtttttcgtttggcgatttcgggggttcgcggcgtttagatgtcgtggttatagtttatatcgcggtagatgtattagaggattacgtagaggatgaggaggatggcgaagatgaagagggttattaggatcgttttggttatcggcgagatgagagattgtatggttttagcggggcgcgcgggagggcggggggcgcgcgggggcgcggggcgcggcgtttacgattttcgagcgcgttcggagtttcgcgtcggtttcgcgttcgtattcgtaatgtttcgtgttcgggatagacgttgtttgggtggttgttcggcggcggcggtggtggtagtggtggttgttcggaggtcggcgcgttcgggtgtaggcggttgcgcgcg

SEQ ID NO: 39036 - DNA, 722 bp, Artificial Sequence
  chemically treated genomic DNA (Homo sapiens) CpG-island No: 39036
cgcgcgcaaccgcctacacccgaacgcgccgacctccgaacaaccaccactaccaccaccgccgccgccgaacaaccacccaaacaacgtctatcccgaacacgaaacattacgaatacgaacgcgaaaccgacgcgaaactccgaacgcgctcgaaaatcgtaaacgccgcgccccgcgcccccgcgcgccccccgccctcccgcgcgccccgctaaaaccatacaatctctcatctcgccgataaccaaaacgatcctaataaccctcttcatcttcgccatcctcctcatcctctacgtaatcctctaatacatctaccgcgatataaactataaccacgacatctaaacgccgcgaacccccgaaatcgccaaacgaaaaacgcccccaacgccaaaaccataaaaactaaaccgtcccgcgataccccccaactcgacgcccgcgccccctactccgaaccccaccgcccgccctacacctccaccgcctcctaaccttaaccttcaaaaacgcaccgaaaaaaacgaataaatacgctcgtacgaacgctttaaaaaaccacgattaaaaaaccccaacttcgaaaaaaacgcgaaatccgaacgcgaaactaaacccgaaaattcacgaaacccgaaactcccctataaaacacgaaaaacgacaaatacgcgtacaaaaaaataaacgcaaaccccccctataccccctccaaa

SEQ ID NO: 39037 - DNA, 602 bp, Artificial Sequence
  chemically treated genomic DNA (Homo sapiens) CpG-island No: 39037
cgttacgcggttacgtatattgtcgcgggagtttacgtatattgacgtgggaggttacgtatattgtcgtcgggaggttacgtatattaacgtgggaggttacgtatattgtcgcgggagtttacgtatattgacgtgggaggttacgtatattgtcgcgggaggtcgcgtttattgtcgtcgggaggtcgcgtttattgttgtcgggaggtcgcgtttattgtcgtcgggaggtcgcgtatattgtcgttgttgtgtgggtttgtgttgaaggtaaagggtcgggaggtcgcgtatattgtcgttgttgttcgggtttgtgttgaaggtaaagggtcgggaggtcgcgtatattgtcgttgttgttcgggtttgtgttgaaggtaaagggtcgggaggtcgcgtatattgtcgttgttgttcgggtttgtgttgaaggtaaagggtcgggaggtcgcgtatattgtcgttgttgttcgggtttgtgttgaaggtaaaggtcgggaggtcgcgtatattgtcgttgttgtttgggtttgtgttgaaggtaaggaatattcgtgtttatttttaaatttaggtttacgtgttttttttaggtt

SEQ ID NO: 39038 - DNA, 602 bp, Artificial Sequence
  chemically treated genomic DNA (Homo sapiens) CpG-island No: 39038
aacctaaaaaaaacacgtaaacctaaatttaaaaataaacacgaatattccttaccttcaacacaaacccaaacaacaacgacaatatacgcgacctcccgacctttaccttcaacacaaacccgaacaacaacgacaatatacgcgacctcccgaccctttaccttcaacacaaacccgaacaacaacgacaatatacgcgacctcccgaccctttaccttcaacacaaacccgaacaacaacgacaatatacgcgacctcccgaccctttaccttcaacacaaacccgaacaacaacgacaatatacgcgacctcccgaccctttaccttcaacacaaacccacacaacaacgacaatatacgcgacctcccgacgacaataaacgcgacctcccgacaacaataaacgcgacctcccgacgacaataaacgcgacctcccgcgacaatatacgtaacctcccacgtcaatatacgtaaactcccgcgacaatatacgtaacctcccacgttaatatacgtaacctcccgacgacaatatacgtaacctcccacgtcaatatacgtaaactcccgcgacaatatacgtaaccgcgtaacg

SEQ ID NO: 39039 - DNA, 602 bp, Artificial Sequence
  chemically treated genomic DNA (Homo sapiens) CpG-island No: 39039
aatttggggagaatacgtaaatttaagtttgaaaatgagtacggatgttttttatttttaatataaatttagataatagcggtagtgtgcgcggtttttcggtttttatttttaatataaattcggataatagcggtagtgtgcgcggtttttcggttttttatttttaatataaattcggataatagcggtagtgtgcgcggtttttcggttttttatttttaatataaattcggataatagcggtagtgtgcgcggtttttcggttttttatttttaatataaattcggataatagcggtagtgtgcgcggtttttcggttttttatttttaatataaatttatataatagcggtagtgtgcgcggtttttcggcggtagtgggcgcgatttttcggtagtagtgggcgcgatttttcggcggtagtgggcgcgatttttcgcggtagtgtgcgtgattttttacgttagtgtgcgtgaattttcgcggtagtgtgcgtgattttttacgttagtgtgcgtgatttttcggcggtagtgtgcgtgattttttacgttagtgtgcgtgaattttcgcggtagtgtgcgtgatcgcgtggcg

SEQ ID NO: 39040 - DNA, 602 bp, Artificial Sequence
  chemically treated genomic DNA (Homo sapiens) CpG-island No: 39040
cgccacgcgatcacgcacactaccgcgaaaattcacgcacactaacgtaaaaaatcacgcacactaccgccgaaaaatcacgcacactaacgtaaaaaatcacgcacactaccgcgaaaattcacgcacactaacgtaaaaaatcacgcacactaccgcgaaaaatcgcgcccactaccgccgaaaaatcgcgcccactactaccgaaaaatcgcgcccactaccgccgaaaaaccgcgcacactaccgctattatataaatttatattaaaaataaaaaaccgaaaaaccgcgcacactaccgctattatccgaatttatattaaaaataaaaaaccgaaaaaccgcgcacactaccgctattatccgaatttatattaaaaataaaaaaccgaaaaaccgcgcacactaccgctattatccgaatttatattaaaaataaaaaaccgaaaaaccgcgcacactaccgctattatccgaatttatattaaaaataaaaaccgaaaaaccgcgcacactaccgctattatctaaatttatattaaaaataaaaaacatccgtactcattttcaaacttaaatttacgtattctccccaaatt

SEQ ID NO: 39041 - DNA, 553 bp, Artificial Sequence
  chemically treated genomic DNA (Homo sapiens) CpG-island No: 39041
  misc_feature (328)..(328): n is either a, c, g or t
aggttttgcgggtacggggcggtatcgcgggtgcgcggttttatcgcgtaacgagagttgatacggtttttttttacgtatcgatattttttcgtttttttcgtatttgtttttgggcgtggtttcgttttttttttcgtcgtttttcgtggatttttattacgggattcgttttcggttgtttggtggtcgtcgttttttttcgatttttatatatttatttttttaattatattcggtttacgaattcgggttgttcgatcgggatttttttttcgtttatacgtttcgtttttttttattttttaaatttttattcgatcgggtntcgttggttttcgtatcgtatttacgatgtttcgtttttcgtttttttaatatttttcgttttttttttttcgtatatttttttagcgcgattttttttttttttttcgtttcgattatttttttttttataacggtttttttttttttttattcgatgttgtattttttttcgtttatcgtatttttatttttttatttttatacgtaattgtttaataaattt

SEQ ID NO: 39042 - DNA, 553 bp, Artificial Sequence
  chemically treated genomic DNA (Homo sapiens) CpG-island No: 39042
  misc_feature (226)..(226): n is either a, c, g or t
aaatttattaaacaattacgtataaaaataaaaaaataaaaatacgataaacgaaaaaaaatacaacatcgaataaaaaaaaaaaaaaaccgttataaaaaaaaaaataatcgaaacgaaaaaaaaaaaaaaaatcgcgctaaaaaaatatacgaaaaaaaaaaaacgaaaaatattaaaaaaacgaaaaacgaaacatcgtaaatacgatacgaaaaccaacganacccgatcgaataaaaatttaaaaaataaaaaaaaacgaaacgtataaacgaaaaaaaaatcccgatcgaacaacccgaattcgtaaaccgaatataattaaaaaaataaatatataaaaatcgaaaaaaaacgacgaccaccaaacaaccgaaaacgaatcccgtaataaaaatccacgaaaaacgacgaaaaaaaaaacgaaaccacgcccaaaaacaaatacgaaaaaaacgaaaaaatatcgatacgtaaaaaaaaaccgtatcaactctcgttacgcgataaaaccgcgcacccgcgataccgccccgtacccgcaaaacct

SEQ ID NO: 39043 - DNA, 553 bp, Artificial Sequence
  chemically treated genomic DNA (Homo sapiens) CpG-island No: 39043
  misc_feature (226)..(226): n is either a, c, g or t
gaatttattgggtaattgcgtataaaaataaaagggtgggagtacggtgggcgggagagggtgtaatatcgggtgggagagggaaaaaatcgttgtgggggggggggtaatcggggcgggggggggggggggaatcgcgttggaaaaatgtgcggggggaaaagggcggagggtgttgagaaggcggggggcggggtatcgtgggtgcggtacgggggttaacganattcgatcgaataagaatttagggggtggggggggacggagcgtgtggacgggggggaaatttcggtcgggtaattcgggttcgtgggtcggatgtgattgaagaaatgggtgtatgggaatcgggaggagacggcggttattaggtagtcgggggcgaatttcgtggtgagggtttacgaggggcggcggggggaagggcggggttacgtttagagataaatgcggggaaaacgggggggtatcggtgcgtaaggggaaatcgtgttagttttcgttgcgcggtaaaatcgcgtattcgcggtgtcgtttcgtattcgtagagttt

SEQ ID NO: 39044 - DNA, 553 bp, Artificial Sequence
  chemically treated genomic DNA (Homo sapiens) CpG-island No: 39044
  misc_feature (328)..(328): n is either a, c, g or t
aaactctacgaatacgaaacgacaccgcgaatacgcgattttaccgcgcaacgaaaactaacacgatttccccttacgcaccgatacccccccgttttccccgcatttatctctaaacgtaaccccgcccttccccccgccgcccctcgtaaaccctcaccacgaaattcgcccccgactacctaataaccgccgtctcctcccgattcccatacacccatttcttcaatcacatccgacccacgaacccgaattacccgaccgaaatttcccccccgtccacacgctccgtccccccccaccccctaaattcttattcgatcgaatntcgttaacccccgtaccgcacccacgataccccgccccccgccttctcaacaccctccgcccttttccccccgcacatttttccaacgcgattcccccccccccccccgccccgattacccccccccccacaacgattttttccctctcccacccgatattacaccctctcccgcccaccgtactcccacccttttatttttatacgcaattacccaataaattc

SEQ ID NO: 39045 - DNA, 657 bp, Artificial Sequence
  chemically treated genomic DNA (Homo sapiens) CpG-island No: 39045
taaaggtgaagtagtcggcgaagggtgcgcggtgggcgcggagtcgggtcgggttcggtttttcggaggcgcgttttagggcgtgtaggagtttatcgtaggttcgcgttattaggtcgggttcgggcggtcgtggttttgttagtagtagtattaggtttagacgtagcggggtattagcgagaaggtggcgcgtagtcgtttagatcgtcgtttttgcgtattacgcggtagttcgttgcgcgtggaatttttacggcgtgttcgtttcgttggcgaagtaggcgttcgggtaggttagtagcggcgttagtagcgttttggtcgcgtcgggtcgtaggagtcgtcggggttcgtcgtttaggagcgttacggttagtttggttaggtcggcggcggtagagtatatttggttcgacggtcggtattagtttaggttatagagtggcgtcggtcgttcgttgtcgtagaagttcgcggttaggcgcgcgcgtacgtcgggcgtgaggttaaagttcgtgtttgttatttttagcggttttagtacgtttttcgagatttagcgttggtagtcgttttgggcggtgtgagttgttaggacgtgggttaggagcgagaaggttagcgtgttgtaatggtatttggaaggagagtagt

SEQ ID NO: 39046 - DNA, 657 bp, Artificial Sequence
  chemically treated genomic DNA (Homo sapiens) CpG-island No: 39046
actactctccttccaaataccattacaacacgctaaccttctcgctcctaacccacgtcctaacaactcacaccgcccaaaacgactaccaacgctaaatctcgaaaaacgtactaaaaccgctaaaaataacaaacacgaactttaacctcacgcccgacgtacgcgcgcgcctaaccgcgaacttctacgacaacgaacgaccgacgccactctataacctaaactaataccgaccgtcgaaccaaatatactctaccgccgccgacctaaccaaactaaccgtaacgctcctaaacgacgaaccccgacgactcctacgacccgacgcgaccaaaacgctactaacgccgctactaacctacccgaacgcctacttcgccaacgaaacgaacacgccgtaaaaattccacgcgcaacgaactaccgcgtaatacgcaaaaacgacgatctaaacgactacgcgccaccttctcgctaataccccgctacgtctaaacctaatactactactaacaaaaccacgaccgcccgaacccgacctaataacgcgaacctacgataaactcctacacgccctaaaacgcgcctccgaaaaaccgaacccgacccgactccgcgcccaccgcgcacccttcgccgactacttcaccttta

SEQ ID NO: 39047 - DNA, 657 bp, Artificial Sequence
  chemically treated genomic DNA (Homo sapiens) CpG-island No: 39047
attgttttttttttagatgttattatagtacgttggttttttcgtttttggtttacgttttggtagtttatatcgtttagggcgattattagcgttgggtttcggagaacgtgttggagtcgttggggatggtagatacgggttttgattttacgttcgacgtgcgcgcgcgtttggtcgcgggtttttacggtagcgggcggtcggcgttattttatgatttgggttggtatcggtcgtcgggttagatgtattttatcgtcgtcgatttggttaagttggtcgtggcgtttttgggcggcgggtttcggcggtttttgcggttcgacgcggttaagacgttgttggcgtcgttgttggtttgttcgggcgtttatttcgttaacgagacgggtacgtcgtgggagttttacgcgtagcgggttatcgcgtggtgcgtaaggacggcgatttggacggttacgcgttattttttcgttggtgtttcgttgcgtttgggtttggtgttgttgttggtagggttacggtcgttcgggttcgatttggtggcgcgggtttacgatgagtttttgtacgttttggagcgcgttttcgggaggtcgagttcggttcggtttcgcgtttatcgcgtatttttcgtcggttattttatttttg

SEQ ID NO: 39048 - DNA, 657 bp, Artificial Sequence
  chemically treated genomic DNA (Homo sapiens) CpG-island No: 39048
caaaaataaaataaccgacgaaaaatacgcgataaacgcgaaaccgaaccgaactcgacctcccgaaaacgcgctccaaaacgtacaaaaactcatcgtaaacccgcgccaccaaatcgaacccgaacgaccgtaaccctaccaacaacaacaccaaacccaaacgcaacgaaacaccaacgaaaaaataacgcgtaaccgtccaaatcgccgtccttacgcaccacgcgataacccgctacgcgtaaaactcccacgacgtacccgtctcgttaacgaaataaacgcccgaacaaaccaacaacgacgccaacaacgtcttaaccgcgtcgaaccgcaaaaaccgccgaaacccgccgcccaaaaacgccacgaccaacttaaccaaatcgacgacgataaaatacatctaacccgacgaccgataccaacccaaatcataaaataacgccgaccgcccgctaccgtaaaaacccgcgaccaaacgcgcgcgcacgtcgaacgtaaaatcaaaacccgtatctaccatccccaacgactccaacacgttctccgaaacccaacgctaataatcgccctaaacgatataaactaccaaaacgtaaaccaaaaacgaaaaaaccaacgtactataataacatctaaaaaaaaaacaat

SEQ ID NO: 39049 - DNA, 545 bp, Artificial Sequence
  chemically treated genomic DNA (Homo sapiens) CpG-island No: 39049
  misc_feature (336)..(336): n is either a, c, g or t
gacgacgttattcgtgtcgttcgttcgttttttttttttttgttttttttttttttcgttttttacgttttttttttttcgcgtttttcgtgtttttttttttcgtttttcgttgtcgcgtttttgtttttttcgttttgttttattttcgtttttttttttttttcgttcgtttttttgtttttttatttattttttttagtattgttcggttatttcgtcgattgttcgtcgcgttttttgttttttttcgtttttttttttcgtattttttttcggtttttgttttcgttcgcggtttttttttttttttttttttttttttttttgtgtttnttgtttgtcgcggttacgtttttttttttcgtcgtttgtgtttgcgttcgttcggtttcgtttcggttgtcgtgggtattttttatttttcgttgttcgtttttttaacggtaggcgttgacgcgtagattcgcgcgtttttgtttcgttttagtagttgcgtacgttgttacgtattgtttgttgttcgttcgtcgtttcgcgaattt

SEQ ID NO: 39050 - DNA, 545 bp, Artificial Sequence
  chemically treated genomic DNA (Homo sapiens) CpG-island No: 39050
  misc_feature (210)..(210): n is either a, c, g or t
aaattcgcgaaacgacgaacgaacaacaaacaatacgtaacaacgtacgcaactactaaaacgaaacaaaaacgcgcgaatctacgcgtcaacgcctaccgttaaaaaaacgaacaacgaaaaataaaaaatacccacgacaaccgaaacgaaaccgaacgaacgcaaacacaaacgacgaaaaaaaaaaacgtaaccgcgacaaacaanaaacacaaaaaaaaaaaaaaaaaaaaaaaaaaaaaaaccgcgaacgaaaacaaaaaccgaaaaaaaatacgaaaaaaaaaaacgaaaaaaaacaaaaaacgcgacgaacaatcgacgaaataaccgaacaatactaaaaaaaataaataaaaaaacaaaaaaacgaacgaaaaaaaaaaaaaaacgaaaataaaacaaaacgaaaaaaacaaaaacgcgacaacgaaaaacgaaaaaaaaaaacacgaaaaacgcgaaaaaaaaaaaacgtaaaaaacgaaaaaaaaaaaaaacaaaaaaaaaaaaaacgaacgaacgacacgaataacgtcgtc

SEQ ID NO: 39051 - DNA, 545 bp, Artificial Sequence
  chemically treated genomic DNA (Homo sapiens) CpG-island No: 39051
  misc_feature (210)..(210): n is either a, c, g or t
agattcgcggggcgacgaacggataataggtaatacgtggtagcgtgcgtagttattaagacggggtaggagcgcgcggatttgcgcgttaacgtttatcgttgaagggacgagtagcggggagtggggggtgtttacgatagtcggagcggggtcgggcgagcgtaaatataaacggcggggagagggggcgtgatcgcggtaaataanagatataaaaggagggagggggggggggggaagagaatcgcgaacgagggtaggggtcgagagagggtacgaaaagaggaggcgaaggaaagtaggaggcgcggcgaatagtcggcgaggtggtcgggtaatgttggagaagataaatgaaagaataggagggcggacggaaaggaagggggagcgggggtggagtagggcggaggagataagggcgcgataacgaggagcggagaggagagatacgaggggcgcggggagagagggacgtggagagcgaaggagggggagaataaggggaggggggacgggcgagcggtacggatggcgtcgtt

SEQ ID NO: 39052 - DNA, 545 bp, Artificial Sequence
  chemically treated genomic DNA (Homo sapiens) CpG-island No: 39052
  misc_feature (336)..(336): n is either a, c, g or t
aacgacgccatccgtaccgctcgcccgtcccccctccccttattctccccctccttcgctctccacgtccctctctccccgcgcccctcgtatctctcctctccgctcctcgttatcgcgcccttatctcctccgccctactccacccccgctcccccttcctttccgtccgccctcctattctttcatttatcttctccaacattacccgaccacctcgccgactattcgccgcgcctcctactttccttcgcctcctcttttcgtaccctctctcgacccctaccctcgttcgcgattctcttccccccccccccctccctccttttatatctnttatttaccgcgatcacgccccctctccccgccgtttatatttacgctcgcccgaccccgctccgactatcgtaaacaccccccactccccgctactcgtcccttcaacgataaacgttaacgcgcaaatccgcgcgctcctaccccgtcttaataactacgcacgctaccacgtattacctattatccgttcgtcgccccgcgaatct

SEQ ID NO: 39053 - DNA, 692 bp, Artificial Sequence
  chemically treated genomic DNA (Homo sapiens) CpG-island No: 39053
cgatagagcgagcggtttttacggtcgtcggcggttcggcggttcgagatgttatttgggaagaaggcggtagtcgcggcggcggcggttgtagcggtagtaatcgggacggaggttggttttgggatagtaggcggtttcgagaacgggtttgaggtggtcgcgtagttcgcgggtttgtcgggtttagtcgaggtcgggtcgggggcggtgggggagcgtatatttcgtaagaaagagttttcgcgggtttcgtttttcgggggtttggcggaatcgtcggggttcgtagggttttaggtcggttttattgtcgtgtttgggtttgcgatttttatggaaattggaatagtagagatttcggaggggcgtcggattagtcggcgtaagcgggcgaaggtaaggttcgattttttttttaaacgatatcgtttggtgtcgagttttttcgaggttttttcgttttttttcgtcgtcgtcgggttttgggttttgcgattatttagatttttttttgtatcgttgcgtacgttacgttttttttagttggacgggtggggtgagaaaggaaaagtttttgtcggtgttgattgcggtttttgtgttgggtttcgagcgacgtgggaaggggtatcgatgattgttgggaggggtattttattttttaggttttttttgtatatttttttatt

SEQ ID NO: 39054 - DNA, 692 bp, Artificial Sequence
  chemically treated genomic DNA (Homo sapiens) CpG-island No: 39054
aataaaaaaatatacaaaaaaaacctaaaaaataaaatacccctcccaacaatcatcgataccccttcccacgtcgctcgaaacccaacacaaaaaccgcaatcaacaccgacaaaaacttttcctttctcaccccacccgtccaactaaaaaaaacgtaacgtacgcaacgatacaaaaaaaaatctaaataatcgcaaaacccaaaacccgacgacgacgaaaaaaaacgaaaaaacctcgaaaaaactcgacaccaaacgatatcgtttaaaaaaaaaatcgaaccttaccttcgcccgcttacgccgactaatccgacgcccctccgaaatctctactattccaatttccataaaaatcgcaaacccaaacacgacaataaaaccgacctaaaaccctacgaaccccgacgattccgccaaacccccgaaaaacgaaacccgcgaaaactctttcttacgaaatatacgctcccccaccgcccccgacccgacctcgactaaacccgacaaacccgcgaactacgcgaccacctcaaacccgttctcgaaaccgcctactatcccaaaaccaacctccgtcccgattactaccgctacaaccgccgccgccgcgactaccgccttcttcccaaataacatctcgaaccgccgaaccgccgacgaccgtaaaaaccgctcgctctatcg

SEQ ID NO: 39055 - DNA, 692 bp, Artificial Sequence
  chemically treated genomic DNA (Homo sapiens) CpG-island No: 39055
aatgaaaaggtgtgtaagaaagatttaaggaataaaatattttttttagtaattatcgatgtttttttttacgtcgttcgggatttagtataaagatcgtagttaatatcggtaaagatttttttttttttattttattcgtttagttagaggggacgtggcgtgcgtagcgatataaggggaggtttgagtggtcgtagggtttaagattcggcggcggcgggggagggcggagaagtttcggggaagttcggtattaggcggtgtcgtttgagggaagggtcgagttttattttcgttcgtttgcgtcggttggttcgacgttttttcggagtttttgttattttagtttttatgggggtcgtagatttaggtacgatagtagggtcggtttgaggttttgcggatttcggcggtttcgttaggttttcggggggcgaggttcgcggaggtttttttttgcggggtgtgcgtttttttatcgttttcggttcgatttcggttgggttcgataggttcgcgggttgcgcggttattttagattcgttttcggagtcgtttgttgttttagggttagttttcgtttcggttgttgtcgttgtagtcgtcgtcgtcgcggttgtcgttttttttttagataatatttcgggtcgtcgggtcgtcgacggtcgtaggggtcgttcgttttgtcg

SEQ ID NO: 39056 - DNA, 692 bp, Artificial Sequence
  chemically treated genomic DNA (Homo sapiens) CpG-island No: 39056
cgacaaaacgaacgacccctacgaccgtcgacgacccgacgacccgaaatattatctaaaaaaaaaacgacaaccgcgacgacgacgactacaacgacaacaaccgaaacgaaaactaaccctaaaacaacaaacgactccgaaaacgaatctaaaataaccgcgcaacccgcgaacctatcgaacccaaccgaaatcgaaccgaaaacgataaaaaaacgcacaccccgcaaaaaaaaacctccgcgaacctcgccccccgaaaacctaacgaaaccgccgaaatccgcaaaacctcaaaccgaccctactatcgtacctaaatctacgacccccataaaaactaaaataacaaaaactccgaaaaaacgtcgaaccaaccgacgcaaacgaacgaaaataaaactcgacccttccctcaaacgacaccgcctaataccgaacttccccgaaacttctccgccctcccccgccgccgccgaatcttaaaccctacgaccactcaaacctccccttatatcgctacgcacgccacgtcccctctaactaaacgaataaaataaaaaaaaaaaaatctttaccgatattaactacgatctttatactaaatcccgaacgacgtaaaaaaaaacatcgataattactaaaaaaaatattttattccttaaatctttcttacacaccttttcatt

SEQ ID NO: 39057 - DNA, 564 bp, Artificial Sequence
  chemically treated genomic DNA (Homo sapiens) CpG-island No: 39057
atgcgtattttaggttttttcgcgttttatttcgtttttcgcgtagttttttttttttttcggtgttttttcgtttttttttttttcgttattttcgtacgttttcgtatttttcgtcgtattttcgacgttcgttttttcgttttattcgttatcgttatcggttttttttcggtatcggagtcgcgttttttgtttttatatcgtcgattatttgtgcgtcggttggagggggcggtattgtcgagggtcggtagttcgtcgggtgttttgcgtttttttttttttttttttttttttttcgtttttttcgttttatttttattttttttttcgtttcgatttgttattcgttatttatttttttttcgtttttcggtttttatattcgtatttttatcgatcgttcgtttttttcgttcgtcgcgttttcgttattgttcgcgattttattttattttacgttcgttcgattttttcgttcggtcggtttcgttttcgtttttcgtttttattatttcgtatgcgtgttaatttttcgtcgttatacgttcgttgtttcgt

SEQ ID NO: 39058 - DNA, 564 bp, Artificial Sequence
  chemically treated genomic DNA (Homo sapiens) CpG-island No: 39058
acgaaacaacgaacgtataacgacgaaaaattaacacgcatacgaaataataaaaacgaaaaacgaaaacgaaaccgaccgaacgaaaaaatcgaacgaacgtaaaataaaataaaatcgcgaacaataacgaaaacgcgacgaacgaaaaaaacgaacgatcgataaaaatacgaatataaaaaccgaaaaacgaaaaaaaaataaataacgaataacaaatcgaaacgaaaaaaaaaataaaaataaaacgaaaaaaacgaaaaaaaaaaaaaaaaaaaaaaaaaaacgcaaaacacccgacgaactaccgaccctcgacaataccgccccctccaaccgacgcacaaataatcgacgatataaaaacaaaaaacgcgactccgataccgaaaaaaaaccgataacgataacgaataaaacgaaaaaacgaacgtcgaaaatacgacgaaaaatacgaaaacgtacgaaaataacgaaaaaaaaaaaaacgaaaaaacaccgaaaaaaaaaaaaaactacgcgaaaaacgaaataaaacgcgaaaaaacctaaaatacgcat

SEQ ID NO: 39059 - DNA, 564 bp, Artificial Sequence
  chemically treated genomic DNA (Homo sapiens) CpG-island No: 39059
acgggataacgagcgtatggcgacgaggaattggtacgtatgcgggatggtggaagcgaaaaacgggggcggggtcgatcggacggaaaaatcggacgggcgtaaggtggaataaaatcgcggataatggcggggacgcggcgggcggggagggcgaacgatcgatgggagtgcgaatatgggggtcgggaaacggaagaagggtggatggcggatgataaatcgaagcggagagaaggatggaaatggagcgggaagggcggaagggggggggggggggggggaaaagcgtaggatattcggcgggttgtcgattttcggtaatgtcgttttttttagtcggcgtatagatggtcgacggtatgggaataaagggcgcgatttcggtgtcgaggagaaatcggtggcggtggcgggtggggcggaaaggcgggcgtcggggatgcggcggggaatacgggggcgtacggaagtgacgggggggagggggacggaggggtatcgagaagggagggaaattgcgcggggggcggggtggggcgcggggaaatttggggtacgtat

SEQ ID NO: 39060 - DNA, 564 bp, Artificial Sequence
  chemically treated genomic DNA (Homo sapiens) CpG-island No: 39060
atacgtaccccaaatttccccgcgccccaccccgccccccgcgcaatttccctcccttctcgatacccctccgtccccctcccccccgtcacttccgtacgcccccgtattccccgccgcatccccgacgcccgcctttccgccccacccgccaccgccaccgatttctcctcgacaccgaaatcgcgccctttattcccataccgtcgaccatctatacgccgactaaaaaaaacgacattaccgaaaatcgacaacccgccgaatatcctacgcttttcccccccccccccccccccttccgcccttcccgctccatttccatccttctctccgcttcgatttatcatccgccatccacccttcttccgtttcccgacccccatattcgcactcccatcgatcgttcgccctccccgcccgccgcgtccccgccattatccgcgattttattccaccttacgcccgtccgatttttccgtccgatcgaccccgcccccgtttttcgcttccaccatcccgcatacgtaccaattcctcgtcgccatacgctcgttatcccgt

SEQ ID NO: 39061 - DNA, 519 bp, Artificial Sequence
  chemically treated genomic DNA (Homo sapiens) CpG-island No: 39061
  misc_feature (351)..(351): n is either a, c, g or t
ttttttcgtttttgttcgttttcgttttttttttcgttttttttttttcgtttttcgttttttttttgttttcgtttttgttttcgtttttttttttttttttgtttttttcgtcgtcgtttttcgttttcgttcgtttttcgggttgatttgttttttttcgtttttgttttcgttttttcgttcgttttcgggttttcgtttttcgttcgtcgtttttttttcgtttttttttttgttttttgttcgtcgttttttcgtttttttgttttttcgcggttttcgttttttcgttttttcgattttttatttcgtcgttttttcgtcgttcgtatcgttttttgtcgcggnttgttattttgtttttttgcgttttttattcgttttcgttcgttcgttttatgttcgcgtttttttttcgttcgtatatcgttgtcgatttttcgtcgttttcgttcgatcgtcgttttttcgtcgtttcgatcgttttcgttgttgtttttgttacgacgcgttttt

SEQ ID NO: 39062 - DNA, 519 bp, Artificial Sequence
  chemically treated genomic DNA (Homo sapiens) CpG-island No: 39062
  misc_feature (169)..(169): n is either a, c, g or t
aaaaacgcgtcgtaacaaaaacaacaacgaaaacgatcgaaacgacgaaaaaacgacgatcgaacgaaaacgacgaaaaatcgacaacgatatacgaacgaaaaaaaaacgcgaacataaaacgaacgaacgaaaacgaataaaaaacgcaaaaaaacaaaataacaanccgcgacaaaaaacgatacgaacgacgaaaaaacgacgaaataaaaaatcgaaaaaacgaaaaaacgaaaaccgcgaaaaaacaaaaaaacgaaaaaacgacgaacaaaaaacaaaaaaaaaaacgaaaaaaaaacgacgaacgaaaaacgaaaacccgaaaacgaacgaaaaaacgaaaacaaaaacgaaaaaaaacaaatcaacccgaaaaacgaacgaaaacgaaaaacgacgacgaaaaaaacaaaaaaaaaaaaaaaaacgaaaacaaaaacgaaaacaaaaaaaaaacgaaaaacgaaaaaaaaaaaacgaaaaaaaaaacgaaaacgaacaaaaacgaaaaaa

SEQ ID NO: 39063 - DNA, 519 bp, Artificial Sequence
  chemically treated genomic DNA (Homo sapiens) CpG-island No: 39063
  misc_feature (169)..(169): n is either a, c, g or t
aagagcgcgtcgtgatagaaatagtagcgaaggcgatcggggcgacggaaaaacggcggtcgggcggagacgacgaaaaatcggtaacgatgtacgagcggaaagaaggcgcggatatgaggcgaacgggcgggggcggatggagaacgtaggagggtagagtgataantcgcgataaggaacggtacgagcgacgggagagcgacggaatagggaatcggggggacgaaggaacgggaatcgcgaaggaataaaggggcggggaggcggcgggtaaaggataggaaaggaggcgggaggggggcggcgaacggggggcgggaattcgggggcgaacggagggacgagggtaagggcgaaaaaaggtaagttagttcgggaggcgggcgaaagcggaggacgacgacggagggagtaaggaaaagggggggggcggggataagggcgggaataggggggaggcgggaaacggagggggggggacgggggaggaggcggaaacgagtaaggacgggaaaa

SEQ ID NO: 39064 - DNA, 519 bp, Artificial Sequence
  chemically treated genomic DNA (Homo sapiens) CpG-island No: 39064
  misc_feature (351)..(351): n is either a, c, g or t
ttttcccgtccttactcgtttccgcctcctcccccgtccccccccctccgtttcccgcctcccccctattcccgcccttatccccgcccccccccttttccttactccctccgtcgtcgtcctccgctttcgcccgcctcccgaactaacttaccttttttcgcccttaccctcgtccctccgttcgcccccgaattcccgccccccgttcgccgcccccctcccgcctcctttcctatcctttacccgccgcctccccgcccctttattccttcgcgattcccgttccttcgtccccccgattccctattccgtcgctctcccgtcgctcgtaccgttccttatcgcganttatcactctaccctcctacgttctccatccgcccccgcccgttcgcctcatatccgcgccttctttccgctcgtacatcgttaccgatttttcgtcgtctccgcccgaccgccgtttttccgtcgccccgatcgccttcgctactatttctatcacgacgcgctctt

SEQ ID NO: 39065 - DNA, 517 bp, Artificial Sequence
  chemically treated genomic DNA (Homo sapiens) CpG-island No: 39065
cgggtcgatttttcgaggttttatatttgggtttgaggggcgcggttcgtagcggcgggtgtaggggcgattgttagtttttatttcgtttcggggtgcgttcggaggtcgatatttggaggacgtttttagttttcgcgggacgttacgtttgcgcgttagggattcgggataagaagtgcgcgtcgggtttcggttgcgcgtcgcggggttattagtttgcgcgtagggtttaggcgatcgtgcggttatggatacgttacggggtatcggtattttcgtggtgtgggattacgtggtgttcgcgggtatgttggttatttcggtcgttatcggtatttattacgttttcgttgggggcggttagtagatttttaaggattttttgatgggcggtcgtagaatgatcgtagtgttcgtggcgttgttttttatcgttagttttatgttagtcgttattgttttgggtatttttttcgaggtttatcgttttggggttatttttagtatttttgtt

SEQ ID NO: 39066 - DNA, 517 bp, Artificial Sequence
  chemically treated genomic DNA (Homo sapiens) CpG-island No: 39066
aacaaaaatactaaaaataaccccaaaacgataaacctcgaaaaaaatacccaaaacaataacgactaacataaaactaacgataaaaaacaacgccacgaacactacgatcattctacgaccgcccatcaaaaaatccttaaaaatctactaaccgcccccaacgaaaacgtaataaataccgataacgaccgaaataaccaacatacccgcgaacaccacgtaatcccacaccacgaaaataccgataccccgtaacgtatccataaccgcacgatcgcctaaaccctacgcgcaaactaataaccccgcgacgcgcaaccgaaacccgacgcgcacttcttatcccgaatccctaacgcgcaaacgtaacgtcccgcgaaaactaaaaacgtcctccaaatatcgacctccgaacgcaccccgaaacgaaataaaaactaacaatcgcccctacacccgccgctacgaaccgcgcccctcaaacccaaatataaaacctcgaaaaatcgacccg

SEQ ID NO: 39067 - DNA, 517 bp, Artificial Sequence
  chemically treated genomic DNA (Homo sapiens) CpG-island No: 39067
ggtaaagatgttaaaaatggttttaaaacggtagatttcggagggggtgtttaggatagtgacggttgatatgaagttagcggtgagggatagcgttacgggtattgcggttattttgcggtcgtttattaggaagtttttggaggtttgttggtcgtttttagcgaaggcgtagtagatgtcgatggcggtcgagatgattagtatgttcgcgaatattacgtagttttatattacgaaggtgtcgatgtttcgtggcgtgtttatggtcgtacggtcgtttgagttttgcgcgtaaattggtggtttcgcggcgcgtagtcggagttcggcgcgtattttttatttcggatttttggcgcgtaggcgtggcgtttcgcggggattggaggcgttttttaggtgtcggttttcgaacgtatttcgaggcggggtgagggttggtagtcgtttttgtattcgtcgttgcgagtcgcgttttttaaatttaggtatgggatttcggaaaatcgattcg

SEQ ID NO: 39068 - DNA, 517 bp, Artificial Sequence
  chemically treated genomic DNA (Homo sapiens) CpG-island No: 39068
cgaatcgattttccgaaatcccatacctaaatttaaaaaacgcgactcgcaacgacgaatacaaaaacgactaccaaccctcaccccgcctcgaaatacgttcgaaaaccgacacctaaaaaacgcctccaatccccgcgaaacgccacgcctacgcgccaaaaatccgaaataaaaaatacgcgccgaactccgactacgcgccgcgaaaccaccaatttacgcgcaaaactcaaacgaccgtacgaccataaacacgccacgaaacatcgacaccttcgtaatataaaactacgtaatattcgcgaacatactaatcatctcgaccgccatcgacatctactacgccttcgctaaaaacgaccaacaaacctccaaaaacttcctaataaacgaccgcaaaataaccgcaatacccgtaacgctatccctcaccgctaacttcatatcaaccgtcactatcctaaacaccccctccgaaatctaccgttttaaaaccatttttaacatctttacc

SEQ ID NO: 39069 - DNA, 530 bp, Artificial Sequence
  chemically treated genomic DNA (Homo sapiens) CpG-island No: 39069
ttgtggttggggtcggttaagtcgaatatcggttatacgtaagcggcggcgggtgtggttggtgtgattaagatggtgatggcgatgcggtacgggtagttgttacgtacgttgttcgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgaggatgattcggtgatgatgcggttggtgtggggttttttttcgtagcgttatacgtatagttttcgttcgtcgtttattttatttgtttcggcgtttttcgtcgtttttttttttttgtttcgcgattttttttgtcgtatttttgttttgtatcgttgtagtaggcgtggtcgtttcgttttttttatcgtttttattatgtttagttt

SEQ ID NO: 39070 - DNA, 530 bp, Artificial Sequence
  chemically treated genomic DNA (Homo sapiens) CpG-island No: 39070
aaactaaacataataaaaacgataaaaaaaacgaaacgaccacgcctactacaacgatacaaaacaaaaatacgacaaaaaaaatcgcgaaacaaaaaaaaaaaaacgacgaaaaacgccgaaacaaataaaataaacgacgaacgaaaactatacgtataacgctacgaaaaaaaaccccacaccaaccgcatcatcaccgaatcatcctcgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgaacaacgtacgtaacaactacccgtaccgcatcgccatcaccatcttaatcacaccaaccacacccgccgccgcttacgtataaccgatattcgacttaaccgaccccaaccacaa

SEQ ID NO: 39071 - DNA, 530 bp, Artificial Sequence
  chemically treated genomic DNA (Homo sapiens) CpG-island No: 39071
aagttagatatagtggaaacggtgaaaaggacgagacgattacgtttattgtaacggtgtagagtaagaatacggtagaaaaaatcgcggaataggggaaagggggcgacggggaacgtcggagtaggtagggtgaacgacgaacgggaattatgcgtatagcgttgcggggaaagattttatattaatcgtattattatcggattattttcgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgaataacgtgcgtggtagttgttcgtgtcgtatcgttattattattttgattatattagttatattcgtcgtcgtttgcgtatgatcgatgttcgatttgatcgattttaattataa

SEQ ID NO: 39072 - DNA, 530 bp, Artificial Sequence
  chemically treated genomic DNA (Homo sapiens) CpG-island No: 39072
ttataattaaaatcgatcaaatcgaacatcgatcatacgcaaacgacgacgaatataactaatataatcaaaataataataacgatacgacacgaacaactaccacgcacgttattcgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgaaaataatccgataataatacgattaatataaaatctttccccgcaacgctatacgcataattcccgttcgtcgttcaccctacctactccgacgttccccgtcgccccctttcccctattccgcgattttttctaccgtattcttactctacaccgttacaataaacgtaatcgtctcgtccttttcaccgtttccactatatctaactt

SEQ ID NO: 39073 - DNA, 1140 bp, Artificial Sequence
  chemically treated genomic DNA (Homo sapiens) CpG-island No: 39073
tttggtggcggaaacgttgtagtattgtagtatgaatgaagggtcggttcggcgcggttaggaaagtttttttgggtcgaaggaaggtgtggttgggtatttttgggtagttatcgttagttttcgttcggagtgaaggggcgagaggtgacggagacggaggggttttagacggtcggcgggatagtttgtatcgtttttgttgagcggaggtcgtttcgggaagggggacgcggttttcggtttggaacgattcgagacggcggtggttgaggtttttcgcgcgaggcgtggaggtcggcggggcgcgggtagtggttaagtcgggatttttgggtatttggcgagcgttttcgcgattagggcggggattcggtttcgtaggtcggtgcggatcgagcgaggcgcgatatcgggaggttcgagtttttaggcggtaggaagttggttttcggacgtttaggtttttgggtcgtcgtttagtatatgggtcgtttttttttagggtcgttttcgcgagggtcgtattttagggacggtagtcgtagttttcggcggacgagaaggtgggggagggagattggttcggaggttggggagaggttttgaggtttcgggttggattcgtcgtagtttttatcgatcgcggtcgatggggtaagtttaagttgcgttcgacgaggtaggaaatttttcgatttggtggggaaaatattaaaataaacggtcgttaggcgttttagttcgttcgttttagtcgtcgttttttttagttagattttcgttagtttatatcgttaggtacgattttcgtcgattttttcgtaagtaggttacgaggatttggagttaggacgttacgacgggttttatttttttagtcgttattatcgttttagtttattttgttagcgtcggtcgttatagtgattttgattgaaatttattcggtgtatcgttacgggaacgcgtattttttaagggtttttttattttttttttcgcgtcgtagtttaggaatgttacgtgaacgacgttacggaagtcgtgttggtagagggtagaaaaaagggtaaggtaatttttaacgggtttttaggcgttattttagttaagggttggaagttttaaatttcggga

SEQ ID NO: 39074 - DNA, 1140 bp, Artificial Sequence
  chemically treated genomic DNA (Homo sapiens) CpG-island No: 39074
tcccgaaatttaaaacttccaacccttaactaaaataacgcctaaaaacccgttaaaaattaccttacccttttttctaccctctaccaacacgacttccgtaacgtcgttcacgtaacattcctaaactacgacgcgaaaaaaaaaataaaaaaacccttaaaaaatacgcgttcccgtaacgatacaccgaataaatttcaatcaaaatcactataacgaccgacgctaacaaaataaactaaaacgataataacgactaaaaaaataaaacccgtcgtaacgtcctaactccaaatcctcgtaacctacttacgaaaaaatcgacgaaaatcgtacctaacgatataaactaacgaaaatctaactaaaaaaaacgacgactaaaacgaacgaactaaaacgcctaacgaccgtttattttaatattttccccaccaaatcgaaaaatttcctacctcgtcgaacgcaacttaaacttaccccatcgaccgcgatcgataaaaactacgacgaatccaacccgaaacctcaaaacctctccccaacctccgaaccaatctccctcccccaccttctcgtccgccgaaaactacgactaccgtccctaaaatacgaccctcgcgaaaacgaccctaaaaaaaaacgacccatatactaaacgacgacccaaaaacctaaacgtccgaaaaccaacttcctaccgcctaaaaactcgaacctcccgatatcgcgcctcgctcgatccgcaccgacctacgaaaccgaatccccgccctaatcgcgaaaacgctcgccaaatacccaaaaatcccgacttaaccactacccgcgccccgccgacctccacgcctcgcgcgaaaaacctcaaccaccgccgtctcgaatcgttccaaaccgaaaaccgcgtcccccttcccgaaacgacctccgctcaacaaaaacgatacaaactatcccgccgaccgtctaaaacccctccgtctccgtcacctctcgccccttcactccgaacgaaaactaacgataactacccaaaaatacccaaccacaccttccttcgacccaaaaaaactttcctaaccgcgccgaaccgacccttcattcatactacaatactacaacgtttccgccaccaaa

SEQ ID NO: 39075 - DNA, 1140 bp, Artificial Sequence
  chemically treated genomic DNA (Homo sapiens) CpG-island No: 39075
tttcgaggtttgaagtttttagtttttaattaagatggcgtttggaggttcgttaaaaattattttgtttttttttttgttttttattaatacggttttcgtggcgtcgtttacgtgatatttttggattacggcgcgggagagggggtaggagggtttttgaagggtgcgcgttttcgtggcggtgtatcgggtaggttttagttagagttattatggcggtcggcgttggtaaggtaagttgaggcggtggtggcggttagggaggtaggattcgtcgtggcgttttggttttaaattttcgtagtttgtttgcggagaggtcggcggaggtcgtgtttagcggtgtgggttggcgggggtttggttggagggggcgacggttgaggcgggcgggttgaggcgtttgacggtcgtttgttttgatgttttttttattaggtcggaaagttttttgtttcgtcgggcgtagtttgagtttgttttatcggtcgcgatcggtggaggttgcggcggatttagttcggggttttaaggtttttttttaattttcgggttagttttttttttttattttttcgttcgtcgggagttgcggttgtcgtttttgagatgcgattttcgcgggggcgattttgaggggaggcggtttatgtgttgagcggcggtttagaagtttaggcgttcggggattaattttttgtcgtttgggaattcgagtttttcggtgtcgcgtttcgttcggttcgtatcggtttgcggagtcgggttttcgttttggtcgcggggacgttcgttaggtgtttaggagtttcgatttggttattgttcgcgtttcgtcggtttttacgtttcgcgcggagaattttagttatcgtcgtttcggatcgttttaggtcggggatcgcgttttttttttcggggcggttttcgtttagtaggggcgatgtagattgtttcgtcggtcgtttagagttttttcgttttcgttatttttcgtttttttatttcgggcgaggattggcggtggttgtttagaggtgtttagttatattttttttcggtttaaaaggatttttttggtcgcgtcgaatcgattttttatttatgttgtagtgttgtaacgttttcgttattaag

SEQ ID NO: 39076 - DNA, 1140 bp, Artificial Sequence
  chemically treated genomic DNA (Homo sapiens) CpG-island No: 39076
cttaataacgaaaacgttacaacactacaacataaataaaaaatcgattcgacgcgaccaaaaaaatccttttaaaccgaaaaaaaatataactaaacacctctaaacaaccaccgccaatcctcgcccgaaataaaaaaacgaaaaataacgaaaacgaaaaaactctaaacgaccgacgaaacaatctacatcgcccctactaaacgaaaaccgccccgaaaaaaaaaacgcgatccccgacctaaaacgatccgaaacgacgataactaaaattctccgcgcgaaacgtaaaaaccgacgaaacgcgaacaataaccaaatcgaaactcctaaacacctaacgaacgtccccgcgaccaaaacgaaaacccgactccgcaaaccgatacgaaccgaacgaaacgcgacaccgaaaaactcgaattcccaaacgacaaaaaattaatccccgaacgcctaaacttctaaaccgccgctcaacacataaaccgcctcccctcaaaatcgcccccgcgaaaatcgcatctcaaaaacgacaaccgcaactcccgacgaacgaaaaaataaaaaaaaaaaactaacccgaaaattaaaaaaaaaccttaaaaccccgaactaaatccgccgcaacctccaccgatcgcgaccgataaaacaaactcaaactacgcccgacgaaacaaaaaactttccgacctaataaaaaaaacatcaaaacaaacgaccgtcaaacgcctcaacccgcccgcctcaaccgtcgccccctccaaccaaacccccgccaacccacaccgctaaacacgacctccgccgacctctccgcaaacaaactacgaaaatttaaaaccaaaacgccacgacgaatcctacctccctaaccgccaccaccgcctcaacttaccttaccaacgccgaccgccataataactctaactaaaacctacccgatacaccgccacgaaaacgcgcacccttcaaaaaccctcctaccccctctcccgcgccgtaatccaaaaatatcacgtaaacgacgccacgaaaaccgtattaataaaaaacaaaaaaaaaaacaaaataatttttaacgaacctccaaacgccatcttaattaaaaactaaaaacttcaaacctcgaaa

SEQ ID NO: 39077 - DNA, 534 bp, Artificial Sequence
  chemically treated genomic DNA (Homo sapiens) CpG-island No: 39077
ttcgtttcgttttttcgagtttttcggtgaacgaagtggttttttatatttttgtttagtatttcgtgtattagttcggcggtgatttttttggttgttttagtacgcgcgcgtatagggtatggcgagggttggatttgtggttatatgtcgcgttttatatgcgtttgtgcgcggtcgtttcgatcgttttagtcgcgttcggtttcgtgtttttttatatttttttttgaaagtcgtgtcgtttcggcgttacgttcgtaatcgttcgtcgcgttcgttttatttttattttttttcgtcgttttttttttttatcgttatgtttgttaacgggaatgtcgaggtcgtttttattgaatttttacgtttagttttttttttttattgttatgaaattcgacgtttcgtttttttcgcgagtttttgacgtcgattatcgtcgatagtttttttcgtttttttgcgttttcgttcgtttttttcgttgatcgcgtatttttcgcgttcgttcgcgtgtagttacgagattat

SEQ ID NO: 39078 - DNA, 534 bp, Artificial Sequence
  chemically treated genomic DNA (Homo sapiens) CpG-island No: 39078
ataatctcgtaactacacgcgaacgaacgcgaaaaatacgcgatcaacgaaaaaaacgaacgaaaacgcaaaaaaacgaaaaaaactatcgacgataatcgacgtcaaaaactcgcgaaaaaaacgaaacgtcgaatttcataacaataaaaaaaaaaaactaaacgtaaaaattcaataaaaacgacctcgacattcccgttaacaaacataacgataaaaaaaaaaaacgacgaaaaaaaataaaaataaaacgaacgcgacgaacgattacgaacgtaacgccgaaacgacacgactttcaaaaaaaaatataaaaaaacacgaaaccgaacgcgactaaaacgatcgaaacgaccgcgcacaaacgcatataaaacgcgacatataaccacaaatccaaccctcgccataccctatacgcgcgcgtactaaaacaaccaaaaaaatcaccgccgaactaatacacgaaatactaaacaaaaatataaaaaaccacttcgttcaccgaaaaactcgaaaaaacgaaacgaa

SEQ ID NO: 39079 - DNA, 534 bp, Artificial Sequence
  chemically treated genomic DNA (Homo sapiens) CpG-island No: 39079
gtaatttcgtggttatacgcgagcgggcgcggggaatgcgcggttaacgggagaaacgggcgagagcgtagagaaacgggaggaattatcgacgatggtcggcgttagaagttcgcgaaagaagcggagcgtcgagttttataataatggaggggaagaattgggcgtaagggtttaataggggcgatttcggtattttcgttggtagatataacggtgagggaagggggcggcggagaaaggtgggaatggggcgaacgcggcgggcgattgcgaacgtagcgtcgaagcggtacggtttttaaggggaaatgtggggggatacgggatcgaacgcggttagagcggtcggggcggtcgcgtataagcgtatgtggaacgcggtatatggttataaatttagttttcgttatgttttgtgcgcgcgcgtgttaaagtaattaaaagggttatcgtcgggttaatatacggggtgttaaataggggtatgaaaggttatttcgtttatcggggaattcgagaaggcggggcgaa

SEQ ID NO: 39080 - DNA, 534 bp, Artificial Sequence
  chemically treated genomic DNA (Homo sapiens) CpG-island No: 39080
ttcgccccgccttctcgaattccccgataaacgaaataacctttcatacccctatttaacaccccgtatattaacccgacgataacccttttaattactttaacacgcgcgcgcacaaaacataacgaaaactaaatttataaccatataccgcgttccacatacgcttatacgcgaccgccccgaccgctctaaccgcgttcgatcccgtatccccccacatttccccttaaaaaccgtaccgcttcgacgctacgttcgcaatcgcccgccgcgttcgccccattcccacctttctccgccgcccccttccctcaccgttatatctaccaacgaaaataccgaaatcgcccctattaaacccttacgcccaattcttcccctccattattataaaactcgacgctccgcttctttcgcgaacttctaacgccgaccatcgtcgataattcctcccgtttctctacgctctcgcccgtttctcccgttaaccgcgcattccccgcgcccgctcgcgtataaccacgaaattac

SEQ ID NO: 39081 - DNA, 700 bp, Artificial Sequence
  chemically treated genomic DNA (Homo sapiens) CpG-island No: 39081
tcgttgtggttggggtcggttaagtcgaatatcggttatacgtaagcggcggcgggtgtggttggtgtgattaagatggtgatggcgatgcggtacgggtagttgttacgtacgttgtacgtggaatcgtcgtcgtcggaggtggattggtcggcggggacggtttaattttttacggagaatacgttttggtttaggagtggtcgtgttcgtcgggtgggggtgtcgtcgttcgggattagtggtattaacgcgtacgttattttcgaatagttttcgggagtgtcgagttagtttgcggggtcgggttcgggttttgtcgtggatgtttcggtggtgtcgtggatggtgtcgggtaaaatattcgaagcgttattcgcgtaggtaacggcgttgatgatttatttggacgagcgatttgatgttttttcgttggatgttgggtattcgttggcgttgatacggtcggcgttggatgagcgagcggtggtggttgggtcggatcgtgaaacgttgttgtgcggtgtgaaagcgttgtttgtcggttatgaggtttttgggttgtgatcggatttgtgggggttgagggttcgatcgggtttgtgttttttcggttaggtggttagtggtttggggatgggtcgagggttttatcgggtttttacggggttcgttgttgttttttaataagttttgtggt

SEQ ID NO: 39082 - DNA, 700 bp, Artificial Sequence
  chemically treated genomic DNA (Homo sapiens) CpG-island No: 39082
accacaaaacttattaaaaaacaacaacgaaccccgtaaaaacccgataaaaccctcgacccatccccaaaccactaaccacctaaccgaaaaaacacaaacccgatcgaaccctcaacccccacaaatccgatcacaacccaaaaacctcataaccgacaaacaacgctttcacaccgcacaacaacgtttcacgatccgacccaaccaccaccgctcgctcatccaacgccgaccgtatcaacgccaacgaatacccaacatccaacgaaaaaacatcaaatcgctcgtccaaataaatcatcaacgccgttacctacgcgaataacgcttcgaatattttacccgacaccatccacgacaccaccgaaacatccacgacaaaacccgaacccgaccccgcaaactaactcgacactcccgaaaactattcgaaaataacgtacgcgttaataccactaatcccgaacgacgacacccccacccgacgaacacgaccactcctaaaccaaaacgtattctccgtaaaaaattaaaccgtccccgccgaccaatccacctccgacgacgacgattccacgtacaacgtacgtaacaactacccgtaccgcatcgccatcaccatcttaatcacaccaaccacacccgccgccgcttacgtataaccgatattcgacttaaccgaccccaaccacaacga

SEQ ID NO: 39083 - DNA, 700 bp, Artificial Sequence
  chemically treated genomic DNA (Homo sapiens) CpG-island No: 39083
gttataaggtttgttaaaaggtagtagcgaatttcgtgaaagttcggtaaagttttcggtttatttttaagttattgattatttgatcggaaaaatataaattcgatcgggtttttagtttttatagattcggttataatttagaagttttatgatcggtagatagcgtttttatatcgtataataacgttttacggttcgatttagttattatcgttcgtttatttagcgtcgatcgtgttaacgttagcgagtatttaatatttagcgaggagatattaggtcgttcgtttagataggttattaacgtcgttgtttgcgcggatagcgtttcgggtgttttgttcgatattatttacggtattatcggaatatttacgatagaattcgaattcggtttcgtagattgattcggtattttcgggggttgttcgaggatgacgtgcgcgttagtattattgatttcgaacgacgatatttttattcgacgaatacgattatttttgggttagggcgtgtttttcgtaaggagttgaatcgttttcgtcgattaatttattttcggcgacggcgattttacgtgtaacgtgcgtggtagttgttcgtgtcgtatcgttattattattttgattatattagttatattcgtcgtcgtttgcgtatgatcgatgttcgatttgatcgattttaattataacgg

SEQ ID NO: 39084 - DNA, 700 bp, Artificial Sequence
  chemically treated genomic DNA (Homo sapiens) CpG-island No: 39084
ccgttataattaaaatcgatcaaatcgaacatcgatcatacgcaaacgacgacgaatataactaatataatcaaaataataataacgatacgacacgaacaactaccacgcacgttacacgtaaaatcgccgtcgccgaaaataaattaatcgacgaaaacgattcaactccttacgaaaaacacgccctaacccaaaaataatcgtattcgtcgaataaaaatatcgtcgttcgaaatcaataatactaacgcgcacgtcatcctcgaacaacccccgaaaataccgaatcaatctacgaaaccgaattcgaattctatcgtaaatattccgataataccgtaaataatatcgaacaaaacacccgaaacgctatccgcgcaaacaacgacgttaataacctatctaaacgaacgacctaatatctcctcgctaaatattaaatactcgctaacgttaacacgatcgacgctaaataaacgaacgataataactaaatcgaaccgtaaaacgttattatacgatataaaaacgctatctaccgatcataaaacttctaaattataaccgaatctataaaaactaaaaacccgatcgaatttatatttttccgatcaaataatcaataacttaaaaataaaccgaaaactttaccgaactttcacgaaattcgctactaccttttaacaaaccttataac

SEQ ID NO: 39085 - DNA, 600 bp, Artificial Sequence
  chemically treated genomic DNA (Homo sapiens) CpG-island No: 39085
  misc_feature (72)..(72): n is either a, c, g or t
attcgtcgtaattttacgtttgggataaggtatttttttttcgtcgaattttttacgagtcgtttcgcgttncgcggattcgcggtatgtatttttttcgttatttttttttttcgaggttttttttatttattttttttcgtcgtttttcgttcgtcgttttttttttacgtcggttcgtcggtagttcgcgtcgtttttttttacgtttcgcgtattacgtcgtttttcgttttcgatttcgttcgtttttcgtttttttttttcgtttcgtttttcgtttttcgttttttttttttttttttttttttttttttttttttttttattttttttttttcgtttttttttttttttttttttagttttttttttttttttttttttttcgtttttttttttttttttttttttttttttttttttttttttttacgtttcgttttttttttcgtttcgtttcgcgttttttttttttttttttttttttttttttttttttcgttttttttttttttttttatttttcgtttttttttttttttttttttttttttttttttttttttttttttttttttttttttttttttttttttt

SEQ ID NO: 39086 - DNA, 600 bp, Artificial Sequence
  chemically treated genomic DNA (Homo sapiens) CpG-island No: 39086
  misc_feature (529)..(529): n is either a, c, g or t
aaaaaaaaaaaaaaaaaaaaaaaaaaaaaaaaaaaaaaaaaaaaaaaaaaaaaaaaaaaaaaaaaaaaaacgaaaaataaaaaaaaaaaaaaaaaacgaaaaaaaaaaaaaaaaaaaaaaaaaaaaaaaaaaaacgcgaaacgaaacgaaaaaaaaaacgaaacgtaaaaaaaaaaaaaaaaaaaaaaaaaaaaaaaaaaaaaaaaaaacgaaaaaaaaaaaaaaaaaaaaaaaactaaaaaaaaaaaaaaaaaaaaacgaaaaaaaaaaaataaaaaaaaaaaaaaaaaaaaaaaaaaaaaaaaaaaaaaaacgaaaaacgaaaaacgaaacgaaaaaaaaaaacgaaaaacgaacgaaatcgaaaacgaaaaacgacgtaatacgcgaaacgtaaaaaaaaacgacgcgaactaccgacgaaccgacgtaaaaaaaaaacgacgaacgaaaaacgacgaaaaaaaataaataaaaaaaacctcgaaaaaaaaaaataacgaaaaaaatacataccgcgaatccgcgnaacgcgaaacgactcgtaaaaaattcgacgaaaaaaaaataccttatcccaaacgtaaaattacgacgaat

SEQ ID NO: 39087 - DNA, 600 bp, Artificial Sequence
  chemically treated genomic DNA (Homo sapiens) CpG-island No: 39087
  misc_feature (529)..(529): n is either a, c, g or t
ggggggggggggggggggggggggggggggggggggggggggggggggggggggggggggggggggggagcggggggtggggggggggggggggggcgggggggggggggggggggggggggggggggggggggcgcggggcggggcggaggggggggcggggcgtgggggggggggggggggggggggggggggggggggggaggggacgggggggggggggggggggggggagttgggggggggggggggggggggcgggggggggggggtggggggggggggggggggggggggggggggggggggggggcggggggcggggggcggggcggggggggggggcggggggcgggcgggatcgggggcgaggagcggcgtggtgcgcggggcgtgggggggggcgacgcgagttgtcggcgggtcggcgtggggggggggcggcgggcggggggcggcgaggaggggtgagtagggggggtttcggggggaggggatggcggaggagatgtatgtcgcgagttcgcgnggcgcggggcggttcgtagggggttcggcggggggagggtgttttgttttagacgtggggttgcggcggat

SEQ ID NO: 39088 - DNA, 600 bp, Artificial Sequence
  chemically treated genomic DNA (Homo sapiens) CpG-island No: 39088
  misc_feature (72)..(72): n is either a, c, g or t
atccgccgcaaccccacgtctaaaacaaaacaccctccccccgccgaaccccctacgaaccgccccgcgccncgcgaactcgcgacatacatctcctccgccatcccctccccccgaaaccccccctactcacccctcctcgccgccccccgcccgccgccccccccccacgccgacccgccgacaactcgcgtcgcccccccccacgccccgcgcaccacgccgctcctcgcccccgatcccgcccgccccccgccccccccccccgccccgccccccgccccccgccccccccccccccccccccccccccccccccccccccccacccccccccccccgcccccccccccccccccccccaactcccccccccccccccccccccccgtcccctcccccccccccccccccccccccccccccccccccccacgccccgcccccccctccgccccgccccgcgcccccccccccccccccccccccccccccccccccccgccccccccccccccccccaccccccgctcccccccccccccccccccccccccccccccccccccccccccccccccccccccccccccccccccc

SEQ ID NO: 39089 - DNA, 528 bp, Artificial Sequence
  chemically treated genomic DNA (Homo sapiens) CpG-island No: 39089
gtggttggggtcggttaagtcgaatatcggttatacgtaagcggcggcgggtgtggttggtgacgatgttaagtttttgttggtttgtgatggtatcggtcgatcggtgatttcggtggatcgattcgtattgcggtcggttgcggttcggcggatcggtgcgcgtcgataggtttattaagttcggttgtatcggttgagttggttaacggtttaattgtcgatattcgtttagttatcgttttgcgtgtttttcggtattttagaagtgttcgttgatatataggtgtattcggattttcggtcgttgacggttgcgttggatgtcggtgtcgaattattcggcgtcgttatcgtatttacgtttttcggcggtggacgaatagcggatgttcgggagacgattcggtatgtattcgatttggtataaggttggtttttcgattagcgatttaacgaatttcgattgtagtagcgtttatttgtttgtttataggtaaatattgttgatgtgtttcgaatggtaat

SEQ ID NO: 39090 - DNA, 528 bp, Artificial Sequence
  chemically treated genomic DNA (Homo sapiens) CpG-island No: 39090
attaccattcgaaacacatcaacaatatttacctataaacaaacaaataaacgctactacaatcgaaattcgttaaatcgctaatcgaaaaaccaaccttataccaaatcgaatacataccgaatcgtctcccgaacatccgctattcgtccaccgccgaaaaacgtaaatacgataacgacgccgaataattcgacaccgacatccaacgcaaccgtcaacgaccgaaaatccgaatacacctatatatcaacgaacacttctaaaataccgaaaaacacgcaaaacgataactaaacgaatatcgacaattaaaccgttaaccaactcaaccgatacaaccgaacttaataaacctatcgacgcgcaccgatccgccgaaccgcaaccgaccgcaatacgaatcgatccaccgaaatcaccgatcgaccgataccatcacaaaccaacaaaaacttaacatcgtcaccaaccacacccgccgccgcttacgtataaccgatattcgacttaaccgaccccaaccac

SEQ ID NO: 39091 - DNA, 528 bp, Artificial Sequence
  chemically treated genomic DNA (Homo sapiens) CpG-island No: 39091
attgttattcggaatatattaatagtatttgtttgtgggtaaataggtggacgttgttgtaatcgggattcgttgagtcgttgatcggaaagttagttttgtattaggtcgagtgtatgtcgagtcgtttttcggatattcgttgttcgtttatcgtcggggggcgtgggtgcgatgacgacgtcgggtggttcggtatcggtatttaacgtagtcgttaacgatcggaggttcggatatatttgtatgttagcggatatttttgaggtgtcgagaagtacgtaggacggtggttgagcggatgtcggtagttgaatcgttggttagtttaatcggtataatcgagtttgatgggtttgtcggcgcgtatcggttcgtcgggtcgtagtcgatcgtaatacgagtcggtttatcgagattatcggtcgatcggtgttattataaattagtagggatttggtatcgttattagttatattcgtcgtcgtttgcgtatgatcgatgttcgatttgatcgattttaattat

SEQ ID NO: 39092 - DNA, 528 bp, Artificial Sequence
  chemically treated genomic DNA (Homo sapiens) CpG-island No: 39092
ataattaaaatcgatcaaatcgaacatcgatcatacgcaaacgacgacgaatataactaataacgataccaaatccctactaatttataataacaccgatcgaccgataatctcgataaaccgactcgtattacgatcgactacgacccgacgaaccgatacgcgccgacaaacccatcaaactcgattataccgattaaactaaccaacgattcaactaccgacatccgctcaaccaccgtcctacgtacttctcgacacctcaaaaatatccgctaacatacaaatatatccgaacctccgatcgttaacgactacgttaaataccgataccgaaccacccgacgtcgtcatcgcacccacgccccccgacgataaacgaacaacgaatatccgaaaaacgactcgacatacactcgacctaatacaaaactaactttccgatcaacgactcaacgaatcccgattacaacaacgtccacctatttacccacaaacaaatactattaatatattccgaataacaat

SEQ ID NO: 39093 - DNA, 852 bp, Artificial Sequence
  chemically treated genomic DNA (Homo sapiens) CpG-island No: 39093
gttcgggcgataattcgcgcgttacgttgattcggaatggtttaaggattggcgtgttacgggtgatatcgaatttgaaagtcgaatttgtcgcgttggattttttttaattcggacgttgtttagggcggtagttaaaattagttttttaagggtggcggggagtaaagcgttttcgtttaaagtattttgagtagcgcgcgtttgatttcgattcgtagggtcggtgttttcgtagatttcgtttagggttttagtttattcgatgatttgcgttatcgcggcgcgtattaagtttaagtcgtagtgtcgtagtacgggtagttagcgtagttcggggatcgagtttaggtttacgttgaagcgcggcgttgttgggggcgaggcggttgatagttcggtttcggttagtagtagtagtagtagggacggaagtttcgggcgcgtttttcggttcgcggttcgtatggttcgggttttagcggtcgtaatttggagatttgtagtcgttgtcggagttcgggtaagtcgtggaggaggaggagttggggttgggttgcgatcgttggaggtggggttcgcgtacgattcgttcgtttttgttatcggtaagtcggagcggcgatatttttcgttttcgtcgcgtatttattagttcgtttcgattttttatcgggtttggaggtttttgatcgcggggtcgttaagggttggggttgtcggtagtcggttttttattaattgtcggttttagcgtatttgtttgggtcgaaggagtgtaggttgcggtcgggaggggttgtaagatttttagtagcgaaaaggtgttaggaaagattttttagttaaatt

SEQ ID NO: 39094 - DNA, 852 bp, Artificial Sequence
  chemically treated genomic DNA (Homo sapiens) CpG-island No: 39094
aatttaactaaaaaatctttcctaacaccttttcgctactaaaaatcttacaacccctcccgaccgcaacctacactccttcgacccaaacaaatacgctaaaaccgacaattaataaaaaaccgactaccgacaaccccaacccttaacgaccccgcgatcaaaaacctccaaacccgataaaaaatcgaaacgaactaataaatacgcgacgaaaacgaaaaatatcgccgctccgacttaccgataacaaaaacgaacgaatcgtacgcgaaccccacctccaacgatcgcaacccaaccccaactcctcctcctccacgacttacccgaactccgacaacgactacaaatctccaaattacgaccgctaaaacccgaaccatacgaaccgcgaaccgaaaaacgcgcccgaaacttccgtccctactactactactactaaccgaaaccgaactatcaaccgcctcgcccccaacaacgccgcgcttcaacgtaaacctaaactcgatccccgaactacgctaactacccgtactacgacactacgacttaaacttaatacgcgccgcgataacgcaaatcatcgaataaactaaaaccctaaacgaaatctacgaaaacaccgaccctacgaatcgaaatcaaacgcgcgctactcaaaatactttaaacgaaaacgctttactccccgccacccttaaaaaactaattttaactaccgccctaaacaacgtccgaattaaaaaaaatccaacgcgacaaattcgactttcaaattcgatatcacccgtaacacgccaatccttaaaccattccgaatcaacgtaacgcgcgaattatcgcccgaac

SEQ ID NO: 39095 - DNA, 852 bp, Artificial Sequence
  chemically treated genomic DNA (Homo sapiens) CpG-island No: 39095
agtttaattgaaaagttttttttgatattttttcgttattgaaaattttatagtttttttcggtcgtagtttatattttttcggtttaagtaggtgcgttggaatcggtagttggtgagaagtcggttgtcggtagttttaatttttagcggtttcgcggttagggatttttaggttcgatggagagtcggggcgggttagtggatgcgcggcggggacgggaggtgtcgtcgtttcggtttgtcggtgataggggcgggcgggtcgtgcgcgggttttatttttagcgatcgtagtttagttttagtttttttttttttacggtttattcgggtttcgatagcggttgtaggtttttaagttgcggtcgttggagttcgagttatgcggatcgcggatcgggaggcgcgttcggggttttcgtttttgttgttgttgttgttggtcggggtcgggttgttagtcgtttcgtttttagtagcgtcgcgttttaacgtgagtttggattcggttttcgagttgcgttggttgttcgtgttgcggtattacgatttggatttggtgcgcgtcgcgatggcgtaagttatcgggtgagttggggttttggacggggtttgcggggatatcggttttgcgggtcggagttaaacgcgcgttgtttagagtgttttaaacggggacgttttatttttcgttatttttggagaattggttttggttgtcgttttgagtagcgttcgggttggggagaatttagcgcggtaggttcggtttttaagttcggtgttattcgtggtacgttagtttttgagttatttcgggttagcgtggcgcgcgagttgtcgttcgggt

SEQ ID NO: 39096 - DNA, 852 bp, Artificial Sequence
  chemically treated genomic DNA (Homo sapiens) CpG-island No: 39096
acccgaacgacaactcgcgcgccacgctaacccgaaataactcaaaaactaacgtaccacgaataacaccgaacttaaaaaccgaacctaccgcgctaaattctccccaacccgaacgctactcaaaacgacaaccaaaaccaattctccaaaaataacgaaaaataaaacgtccccgtttaaaacactctaaacaacgcgcgtttaactccgacccgcaaaaccgatatccccgcaaaccccgtccaaaaccccaactcacccgataacttacgccatcgcgacgcgcaccaaatccaaatcgtaataccgcaacacgaacaaccaacgcaactcgaaaaccgaatccaaactcacgttaaaacgcgacgctactaaaaacgaaacgactaacaacccgaccccgaccaacaacaacaacaacaaaaacgaaaaccccgaacgcgcctcccgatccgcgatccgcataactcgaactccaacgaccgcaacttaaaaacctacaaccgctatcgaaacccgaataaaccgtaaaaaaaaaaaaactaaaactaaactacgatcgctaaaaataaaacccgcgcacgacccgcccgcccctatcaccgacaaaccgaaacgacgacacctcccgtccccgccgcgcatccactaacccgccccgactctccatcgaacctaaaaatccctaaccgcgaaaccgctaaaaattaaaactaccgacaaccgacttctcaccaactaccgattccaacgcacctacttaaaccgaaaaaatataaactacgaccgaaaaaaactataaaattttcaataacgaaaaaatatcaaaaaaaacttttcaattaaact

SEQ ID NO: 39097 - DNA, 531 bp, Artificial Sequence
  chemically treated genomic DNA (Homo sapiens) CpG-island No: 39097
  misc_feature (375)..(376): n is either a, c, g or t
  misc_feature (387)..(388): n is either a, c, g or t
  misc_feature (527)..(527): n is either a, c, g or t
tgcgcgttttgtttttgtatttatagttattatttatcggggagtcggtatatcggttcgtttagataattaggcgttatgggtgcgttattaattagtgacgggagaagacggggcggagagagattcgtgaaggaagtgacgtaaaacgagcgttatagagaacgcgagtcgggagttcgtggaggttatggtttttcggcgttttttgttggttggggaggggaatttttttttcgtcgtcgttttgagcgaaattttggattagagtatttaatttatcgttatttgtttttagcgttcggtcgagttggttcgggatttattggtttgggagaatttgtagtgtttgcgcgagcgaggtagcgagttcgnntttttgcgaannttcgtttagcggtcggcgcgttttaaagtggaaagggtgggggcgtggggatgtaatttacgtggagattgtttttgatcgttttacggatatttatataaagtcggttttgtgtttagatttgggttggtttgtacgnttta

SEQ ID NO: 39098 - DNA, 531 bp, Artificial Sequence
  chemically treated genomic DNA (Homo sapiens) CpG-island No: 39098
  misc_feature (5)..(5): n is either a, c, g or t
  misc_feature (144)..(145): n is either a, c, g or t
  misc_feature (156)..(157): n is either a, c, g or t
taaancgtacaaaccaacccaaatctaaacacaaaaccgactttatataaatatccgtaaaacgatcaaaaacaatctccacgtaaattacatccccacgcccccaccctttccactttaaaacgcgccgaccgctaaacgaannttcgcaaaaanncgaactcgctacctcgctcgcgcaaacactacaaattctcccaaaccaataaatcccgaaccaactcgaccgaacgctaaaaacaaataacgataaattaaatactctaatccaaaatttcgctcaaaacgacgacgaaaaaaaaattcccctccccaaccaacaaaaaacgccgaaaaaccataacctccacgaactcccgactcgcgttctctataacgctcgttttacgtcacttccttcacgaatctctctccgccccgtcttctcccgtcactaattaataacgcacccataacgcctaattatctaaacgaaccgatataccgactccccgataaataataactataaatacaaaaacaaaacgcgca

SEQ ID NO: 39099 - DNA, 531 bp, Artificial Sequence
  chemically treated genomic DNA (Homo sapiens) CpG-island No: 39099
  misc_feature (5)..(5): n is either a, c, g or t
  misc_feature (144)..(145): n is either a, c, g or t
  misc_feature (156)..(157): n is either a, c, g or t
taaancgtgtagattagtttaagtttgggtataaagtcggttttatgtgaatattcgtgggacgattaagaataatttttacgtgggttatatttttacgtttttattttttttattttgggacgcgtcggtcgttgggcgggnnttcgtagaggnncgggttcgttatttcgttcgcgtaggtattgtagatttttttaggttagtggatttcgagttaattcggtcgggcgttggaggtaggtggcggtaagttgagtgttttgatttagggtttcgtttagagcggcggcgaaggagaaatttttttttttaattaataggaggcgtcgaggggttatggtttttacggattttcggttcgcgttttttgtggcgttcgttttacgttattttttttacggattttttttcgtttcgttttttttcgttattagttgatgacgtatttatggcgtttggttgtttagacgagtcggtgtatcgatttttcggtggatgataattatgagtgtaaaagtaagacgcgta

SEQ ID NO: 39100 - DNA, 531 bp, Artificial Sequence
  chemically treated genomic DNA (Homo sapiens) CpG-island No: 39100
  misc_feature (375)..(376): n is either a, c, g or t
  misc_feature (387)..(388): n is either a, c, g or t
  misc_feature (527)..(527): n is either a, c, g or t
tacgcgtcttacttttacactcataattatcatccaccgaaaaatcgatacaccgactcgtctaaacaaccaaacgccataaatacgtcatcaactaataacgaaaaaaaacgaaacgaaaaaaaatccgtaaaaaaaataacgtaaaacgaacgccacaaaaaacgcgaaccgaaaatccgtaaaaaccataacccctcgacgcctcctattaattaaaaaaaaaaatttctccttcgccgccgctctaaacgaaaccctaaatcaaaacactcaacttaccgccacctacctccaacgcccgaccgaattaactcgaaatccactaacctaaaaaaatctacaatacctacgcgaacgaaataacgaacccgnncctctacgaanncccgcccaacgaccgacgcgtcccaaaataaaaaaaataaaaacgtaaaaatataacccacgtaaaaattattcttaatcgtcccacgaatattcacataaaaccgactttatacccaaacttaaactaatctacacgnttta

SEQ ID NO: 39101 - DNA, 510 bp, Artificial Sequence
  chemically treated genomic DNA (Homo sapiens) CpG-island No: 39101
  misc_feature (460)..(460): n is either a, c, g or t
ggttagtgcgtggtgggaaggggcgggattttgttagtcgcggttgtcgttggagtcggtgttcgggttggtgatggggttaattttttttcgtaagatttttatttgtatttatttagtttcgtcgtcgtttcgtcgcgtcgcgttttaatcgtttttttttttttagtaacgcgggtaagagatgtttttttttttttcgtttagtttttcgggaataacgcgttttgtttttttttttcgttcgttaatcggtagcgttaacggagaaggaggtaggtaggggagagatgtggtgtgtggaaaggtggtttttttcgtcgggtcgtcggcgttttagttagggttttttgacgtttcgttgttgttagttcgtcgttaggtcgggtttcgagtgatcgaggttcgtttggtcgcggttgcggttttcgtgtagttgtagttattgttttgtgtttanttcgttattcgggggttatgtgaaaagtaaatttttcgaggtttagcgga

SEQ ID NO: 39102 - DNA, 510 bp, Artificial Sequence
  chemically treated genomic DNA (Homo sapiens) CpG-island No: 39102
  misc_feature (51)..(51): n is either a, c, g or t
tccgctaaacctcgaaaaatttacttttcacataacccccgaataacgaantaaacacaaaacaataactacaactacacgaaaaccgcaaccgcgaccaaacgaacctcgatcactcgaaacccgacctaacgacgaactaacaacaacgaaacgtcaaaaaaccctaactaaaacgccgacgacccgacgaaaaaaaccacctttccacacaccacatctctcccctacctacctccttctccgttaacgctaccgattaacgaacgaaaaaaaaaaacaaaacgcgttattcccgaaaaactaaacgaaaaaaaaaaaaacatctcttacccgcgttactaaaaaaaaaaaaacgattaaaacgcgacgcgacgaaacgacgacgaaactaaataaatacaaataaaaatcttacgaaaaaaaattaaccccatcaccaacccgaacaccgactccaacgacaaccgcgactaacaaaatcccgccccttcccaccacgcactaacc

SEQ ID NO: 39103 - DNA, 510 bp, Artificial Sequence
  chemically treated genomic DNA (Homo sapiens) CpG-island No: 39103
  misc_feature (51)..(51): n is either a, c, g or t
ttcgttaggtttcgaggggtttgttttttatatggttttcgggtggcgggntgggtataaggtagtggttgtagttgtacgggagtcgtagtcgcggttaggcgagtttcggttattcggaattcgatttaacggcgggttggtagtagcgggacgttagaaggttttggttgaagcgtcgacgattcggcggggaaggttatttttttatatattatattttttttttgtttgttttttttttcgttagcgttatcggttggcgggcgggggaggggagtaaggcgcgttattttcggggagttggacgggggagggaagggtattttttattcgcgttattgaggaggaggaggcggttggagcgcggcgcggcggggcgacggcggggttgggtgggtgtaagtaagagttttacgaaagggaattaattttattattagttcggatatcggttttagcggtagtcgcggttggtagaatttcgtttttttttattacgtattagtt

SEQ ID NO: 39104 - DNA, 510 bp, Artificial Sequence
  chemically treated genomic DNA (Homo sapiens) CpG-island No: 39104
  misc_feature (460)..(460): n is either a, c, g or t
aactaatacgtaataaaaaaaaacgaaattctaccaaccgcgactaccgctaaaaccgatatccgaactaataataaaattaattccctttcgtaaaactcttacttacacccacccaaccccgccgtcgccccgccgcgccgcgctccaaccgcctcctcctcctcaataacgcgaataaaaaatacccttccctcccccgtccaactccccgaaaataacgcgccttactcccctcccccgcccgccaaccgataacgctaacgaaaaaaaaaacaaacaaaaaaaaaatataatatataaaaaaataaccttccccgccgaatcgtcgacgcttcaaccaaaaccttctaacgtcccgctactaccaacccgccgttaaatcgaattccgaataaccgaaactcgcctaaccgcgactacgactcccgtacaactacaaccactaccttatacccancccgccacccgaaaaccatataaaaaacaaacccctcgaaacctaacgaa

SEQ ID NO: 39105 - DNA, 603 bp, Artificial Sequence
  chemically treated genomic DNA (Homo sapiens) CpG-island No: 39105
tttcgagtttttttcgggtcgggaagcgcggagatgacggcgttcgttttttcgtcgtcgttttaaggtattcgggggtgtttgttcggggtgttcgcgcgggggtgtttgttcggggttgttcggtgggagtattcgtcgcgttttgttttgcggattttgaatttttcgggcggacggcgtcggtcgggagggggtcgcgggtagtttcgcgttttcgcgggttttcggttggcggtcgtggttacgtcgattatcgtttcggggggtttggggaggaggggatcgggttttagtcgtgcgggtacgtattgttttttcgttttttcgttggcggggtgagtgttttcgtgggagttttcggtgtggagttagtttgtttcgcgggcggggggggtggggggttcggcgtcgttacgagtataggaaggaggtcgggagtattcgaggcggggtcggtcgtcggggttcgtttcgtcgtttagttgtggagcgcgttcggaaatttttgttcgtcgttcgttggattagttttttacgagttttggggtttttttttttttttttatttcggttttcggcgtttagttgggtggggggagg

SEQ ID NO: 39106 - DNA, 603 bp, Artificial Sequence
  chemically treated genomic DNA (Homo sapiens) CpG-island No: 39106
cctccccccacccaactaaacgccgaaaaccgaaataaaaaaaaaaaaaaaaaccccaaaactcgtaaaaaactaatccaacgaacgacgaacaaaaatttccgaacgcgctccacaactaaacgacgaaacgaaccccgacgaccgaccccgcctcgaatactcccgacctccttcctatactcgtaacgacgccgaaccccccaccccccccgcccgcgaaacaaactaactccacaccgaaaactcccacgaaaacactcaccccgccaacgaaaaaacgaaaaaacaatacgtacccgcacgactaaaacccgatcccctcctccccaaaccccccgaaacgataatcgacgtaaccacgaccgccaaccgaaaacccgcgaaaacgcgaaactacccgcgaccccctcccgaccgacgccgtccgcccgaaaaattcaaaatccgcaaaacaaaacgcgacgaatactcccaccgaacaaccccgaacaaacacccccgcgcgaacaccccgaacaaacacccccgaataccttaaaacgacgacgaaaaaacgaacgccgtcatctccgcgcttcccgacccgaaaaaaactcgaaa

SEQ ID NO: 39107 - DNA, 603 bp, Artificial Sequence
  chemically treated genomic DNA (Homo sapiens) CpG-island No: 39107
tttttttttatttagttagacgtcgggggtcgggatgggaggaggaagggaagttttagaattcgtgaaaaattggtttagcgggcggcggataaaagttttcgagcgcgttttatagttgggcggcggagcgggtttcggcggtcggtttcgtttcggatgttttcggttttttttttgtgttcgtgacggcgtcgagttttttatttttttcgttcgcgaggtaggttagttttatatcgagggtttttacgaaaatatttatttcgttaacggaagggcgagggaataatacgtgttcgtacggttagggttcggtttttttttttttaggtttttcggggcggtggtcggcgtgattacgatcgttagtcgggaattcgcgagggcgcggggttgttcgcggttttttttcggtcggcgtcgttcgttcgggaggtttaaagttcgtagagtagggcgcggcggatgtttttatcgagtagtttcgagtaggtattttcgcgcgagtatttcgggtaggtattttcggatattttagggcggcggcgggagggcgggcgtcgttattttcgcgtttttcggttcgagaaggattcgaaa

SEQ ID NO: 39108 - DNA, 603 bp, Artificial Sequence
  chemically treated genomic DNA (Homo sapiens) CpG-island No: 39108
tttcgaatccttctcgaaccgaaaaacgcgaaaataacgacgcccgccctcccgccgccgccctaaaatatccgaaaatacctacccgaaatactcgcgcgaaaatacctactcgaaactactcgataaaaacatccgccgcgccctactctacgaactttaaacctcccgaacgaacgacgccgaccgaaaaaaaaccgcgaacaaccccgcgccctcgcgaattcccgactaacgatcgtaatcacgccgaccaccgccccgaaaaacctaaaaaaaaaaaaaccgaaccctaaccgtacgaacacgtattattccctcgcccttccgttaacgaaataaatattttcgtaaaaaccctcgatataaaactaacctacctcgcgaacgaaaaaaataaaaaactcgacgccgtcacgaacacaaaaaaaaaaccgaaaacatccgaaacgaaaccgaccgccgaaacccgctccgccgcccaactataaaacgcgctcgaaaacttttatccgccgcccgctaaaccaatttttcacgaattctaaaacttcccttcctcctcccatcccgacccccgacgtctaactaaataaaaaaaaa

SEQ ID NO: 39109 - DNA, 564 bp, Artificial Sequence
  chemically treated genomic DNA (Homo sapiens) CpG-island No: 39109
cgcgtttcgttatcgtgtgcgtttcggggcggggcggggcgggggcgggggcgggggcgggggcgggatcgggcgttcgggtttcgttttcggtatttttgtaggcgattttgttttcgtcgtggttttcgggtgttaggagatagttgtcggcgttgggttgtgcgagacgttaattgtatttttcgggtttaacgttgtgaggtagcgcgcggaggaattggggataagcgtttcggagtttttaaatagagcgcggtcgttgggggatagcgcgcggcgtcgggtcggggcggggcggtttttttgtcggaggacgcgaatcggtacgttgcgtttttaaggagtttagttgggttgggcgtcggagttgggagcggcgcgggtaggagttcggcggtaggttttagttcggggttagagatcgagggtcggggttcgggttcggcggcgggatttaggcggttgaggttggttaggtgagcggaggcgggcgggcgggcggtggtgcgtttttagggggatggggcgttttgatggtttcgtgattttttttttagtgtt

SEQ ID NO: 39110 - DNA, 564 bp, Artificial Sequence
  chemically treated genomic DNA (Homo sapiens) CpG-island No: 39110
aacactaaaaaaaaaatcacgaaaccatcaaaacgccccatccccctaaaaacgcaccaccgcccgcccgcccgcctccgctcacctaaccaacctcaaccgcctaaatcccgccgccgaacccgaaccccgaccctcgatctctaaccccgaactaaaacctaccgccgaactcctacccgcgccgctcccaactccgacgcccaacccaactaaactccttaaaaacgcaacgtaccgattcgcgtcctccgacaaaaaaaccgccccgccccgacccgacgccgcgcgctatcccccaacgaccgcgctctatttaaaaactccgaaacgcttatccccaattcctccgcgcgctacctcacaacgttaaacccgaaaaatacaattaacgtctcgcacaacccaacgccgacaactatctcctaacacccgaaaaccacgacgaaaacaaaatcgcctacaaaaataccgaaaacgaaacccgaacgcccgatcccgcccccgcccccgcccccgcccccgccccgccccgccccgaaacgcacacgataacgaaacgcg

SEQ ID NO: 39111 - DNA, 564 bp, Artificial Sequence
  chemically treated genomic DNA (Homo sapiens) CpG-island No: 39111
gatattgggggagaggttacggggttattagggcgttttatttttttaggagcgtattatcgttcgttcgttcgttttcgtttatttgattagttttaatcgtttgggtttcgtcgtcgggttcggatttcggttttcggtttttagtttcgggttgggatttgtcgtcgggtttttattcgcgtcgtttttagtttcggcgtttagtttagttggattttttaaaggcgtagcgtgtcggttcgcgtttttcgatagaaaagtcgtttcgtttcgattcggcgtcgcgcgttgttttttagcggtcgcgttttgtttgggggtttcggggcgtttatttttagttttttcgcgcgttgttttatagcgttaaattcggagggtatagttagcgtttcgtataatttaacgtcggtaattgttttttagtattcgaaagttacggcgagagtaggatcgtttatagaggtatcgggggcggagttcgagcgttcggtttcgttttcgttttcgttttcgttttcgtttcgtttcgtttcggaacgtatacggtggcggggcgcg

SEQ ID NO: 39112 - DNA, 564 bp, Artificial Sequence
  chemically treated genomic DNA (Homo sapiens) CpG-island No: 39112
cgcgccccgccaccgtatacgttccgaaacgaaacgaaacgaaaacgaaaacgaaaacgaaaacgaaaccgaacgctcgaactccgcccccgatacctctataaacgatcctactctcgccgtaactttcgaatactaaaaaacaattaccgacgttaaattatacgaaacgctaactataccctccgaatttaacgctataaaacaacgcgcgaaaaaactaaaaataaacgccccgaaacccccaaacaaaacgcgaccgctaaaaaacaacgcgcgacgccgaatcgaaacgaaacgacttttctatcgaaaaacgcgaaccgacacgctacgcctttaaaaaatccaactaaactaaacgccgaaactaaaaacgacgcgaataaaaacccgacgacaaatcccaacccgaaactaaaaaccgaaaaccgaaatccgaacccgacgacgaaacccaaacgattaaaactaatcaaataaacgaaaacgaacgaacgaacgataatacgctcctaaaaaaataaaacgccctaataaccccgtaacctctcccccaatatc

SEQ ID NO: 39113 - DNA, 581 bp, Artificial Sequence
  chemically treated genomic DNA (Homo sapiens) CpG-island No: 39113
cggttttcgttcgacgattttgttcggttcgcgttaggtagttcgtagttttttcgcggttcggggtcgttttacgtcgttcgttcgttcgttgggtcgcgtatcgtgtgggattgtaggttttggttcgtttcgatggttgttgttagcggtatcgtgtcgtttagtagtattttgtcggttggcggtttttttatgaaggttatttcgggacgttcggtcgtcgtcgtttagggacgcgaggtaggaattcgaggcgtcgattttcgtcgttcgttcggttttatcgtcgtcgttgttaatacgcgtcgttttacgcgtcgtcgggttcgcggggttttagcgtcgttttttttacggtcgtcgtttcggagttttagcgtcgatttagcgtagaacgtgtgggggtcgttagtattgtcgttcgttggttcgttttttcgtttcgcggttgttatgggtttgcgtttttttgtttttcgtagtcgtatcgtagattcggtgtttttagtttcgggtttcggattagggaatattattttaagttattattattaggatttttagatttagagacgttt

SEQ ID NO: 39114 - DNA, 581 bp, Artificial Sequence
  chemically treated genomic DNA (Homo sapiens) CpG-island No: 39114
aaacgtctctaaatctaaaaatcctaataataataacttaaaataatattccctaatccgaaacccgaaactaaaaacaccgaatctacgatacgactacgaaaaacaaaaaaacgcaaacccataacaaccgcgaaacgaaaaaacgaaccaacgaacgacaatactaacgacccccacacgttctacgctaaatcgacgctaaaactccgaaacgacgaccgtaaaaaaaacgacgctaaaaccccgcgaacccgacgacgcgtaaaacgacgcgtattaacaacgacgacgataaaaccgaacgaacgacgaaaatcgacgcctcgaattcctacctcgcgtccctaaacgacgacgaccgaacgtcccgaaataaccttcataaaaaaaccgccaaccgacaaaatactactaaacgacacgataccgctaacaacaaccatcgaaacgaaccaaaacctacaatcccacacgatacgcgacccaacgaacgaacgaacgacgtaaaacgaccccgaaccgcgaaaaaactacgaactacctaacgcgaaccgaacaaaatcgtcgaacgaaaaccg

SEQ ID NO: 39115 - DNA, 581 bp, Artificial Sequence
  chemically treated genomic DNA (Homo sapiens) CpG-island No: 39115
aggcgtttttggatttgaggattttggtagtgatggtttagggtggtgttttttggttcgaagttcggagttaagggtatcgggtttgcggtgcggttgcgaggagtagggaagcgtaggtttatggtagtcgcgaggcggaggagcgggttagcgggcggtagtgttggcggtttttatacgttttgcgttgggtcggcgttaggatttcggggcggcggtcgtgggaagggcggcgttaggatttcgcgggttcggcggcgcgtggggcggcgcgtgttgatagcggcggcggtggaatcgggcgggcggcgggagtcggcgtttcgggtttttatttcgcgtttttaggcggcggcggtcgggcgtttcgggatggtttttatggagaagtcgttagtcggtaaggtgttgttggacgatacggtgtcgttgatagtagttatcgaggcgagttagagtttgtagttttatacggtgcgcggtttagcgggcgggcgggcggcgtggggcggtttcgggtcgcgagggggttgcgggttgtttggcgcgggtcgggtagggtcgtcggacggagatcg

SEQ ID NO: 39116 - DNA, 581 bp, Artificial Sequence
  chemically treated genomic DNA (Homo sapiens) CpG-island No: 39116
cgatctccgtccgacgaccctacccgacccgcgccaaacaacccgcaaccccctcgcgacccgaaaccgccccacgccgcccgcccgcccgctaaaccgcgcaccgtataaaactacaaactctaactcgcctcgataactactatcaacgacaccgtatcgtccaacaacaccttaccgactaacgacttctccataaaaaccatcccgaaacgcccgaccgccgccgcctaaaaacgcgaaataaaaacccgaaacgccgactcccgccgcccgcccgattccaccgccgccgctatcaacacgcgccgccccacgcgccgccgaacccgcgaaatcctaacgccgcccttcccacgaccgccgccccgaaatcctaacgccgacccaacgcaaaacgtataaaaaccgccaacactaccgcccgctaacccgctcctccgcctcgcgactaccataaacctacgcttccctactcctcgcaaccgcaccgcaaacccgatacccttaactccgaacttcgaaccaaaaaacaccaccctaaaccatcactaccaaaatcctcaaatccaaaaacgcct

SEQ ID NO: 39117 - DNA, 737 bp, Artificial Sequence
  chemically treated genomic DNA (Homo sapiens) CpG-island No: 39117
aggtgcggggaatttgggtcgtaagcgtcgaagttattcggtgaagaaggtttggagtattggttttcgattcgtcgtcgaagatttgggttgagcgatggtggtattaggtttaagggatttgatttttaaaaggcggaacgggagcgttggtgtgttcggttcgttaaagttgtagtcgttcgcggttttcggcgtttggtttgtttcgtttgcgcgaggttttcggtaggcggcgttgttgtttcggttgagcgggcggaacggtttggatttcgcggtttttgtttttagttttgcggtcgatttgagagttgggatttcgggcggggagcgggaggttgagtaggggtagtcggagtcgtcgtaggaggggttgaggggtgtttcgcggtttttttcggtcgtttcggtggtttttcgggttttttggttaagggcgttgggttgcgggtgggtttcggggggagtcgtttcgtatagtaggcgcgagttaatttatttttttttattttttcggtggcgttgtggtttttaaaattttcgttttttttttttatagttattagaaggcgcggtttgttatttggataaacgcggttttttttagagttcggttgcgttttaaagtcgggtttcgttttattttcgataaagatattttttgatttgtttttcgttagattttagtaattttttgggttttcgggaagttgatttcgtttttgggtttttat

SEQ ID NO: 39118 - DNA, 737 bp, Artificial Sequence
  chemically treated genomic DNA (Homo sapiens) CpG-island No: 39118
ataaaaacccaaaaacgaaatcaacttcccgaaaacccaaaaaattactaaaatctaacgaaaaacaaatcaaaaaatatctttatcgaaaataaaacgaaacccgactttaaaacgcaaccgaactctaaaaaaaaccgcgtttatccaaataacaaaccgcgccttctaataactataaaaaaaaaaaacgaaaattttaaaaaccacaacgccaccgaaaaaataaaaaaaaataaattaactcgcgcctactatacgaaacgactccccccgaaacccacccgcaacccaacgcccttaaccaaaaaacccgaaaaaccaccgaaacgaccgaaaaaaaccgcgaaacacccctcaacccctcctacgacgactccgactacccctactcaacctcccgctccccgcccgaaatcccaactctcaaatcgaccgcaaaactaaaaacaaaaaccgcgaaatccaaaccgttccgcccgctcaaccgaaacaacaacgccgcctaccgaaaacctcgcgcaaacgaaacaaaccaaacgccgaaaaccgcgaacgactacaactttaacgaaccgaacacaccaacgctcccgttccgccttttaaaaatcaaatcccttaaacctaataccaccatcgctcaacccaaatcttcgacgacgaatcgaaaaccaatactccaaaccttcttcaccgaataacttcgacgcttacgacccaaattccccgcacct

SEQ ID NO: 39119 - DNA, 737 bp, Artificial Sequence
  chemically treated genomic DNA (Homo sapiens) CpG-island No: 39119
atggaagtttagaggcgaaattagtttttcggggatttagaaaattgttggagtttggcgaggggtaaattaggaagtgtttttgtcggagatgggacggaattcggttttggggcgtaatcgggttttgggggagatcgcgtttgtttaggtggtaggtcgcgttttttgatggttgtgaagagaaggagcgggggttttaagagttatagcgttatcgagagagtggaaaggagtagattagttcgcgtttgttatgcgaggcgatttttttcgagatttattcgtagtttagcgtttttggttaggaggttcggaaagttatcgaggcggtcgaaaggggtcgcggggtattttttagttttttttgcggcggtttcggttgtttttgtttagtttttcgtttttcgttcggagttttagtttttagatcggtcgtagagttgggaatagaagtcgcggggtttaggtcgtttcgttcgtttagtcggagtagtagcgtcgtttgtcgggggtttcgcgtaggcgagataggttagacgtcggaggtcgcgggcggttgtagttttgacgggtcgaatatattagcgttttcgtttcgttttttgaaaattaaattttttgggtttggtgttattatcgtttagtttaggttttcgacgacgggtcgaaggttagtgttttaggttttttttatcgagtggtttcggcgtttgcggtttaggtttttcgtattt

SEQ ID NO: 39120 - DNA, 737 bp, Artificial Sequence
  chemically treated genomic DNA (Homo sapiens) CpG-island No: 39120
aaatacgaaaaacctaaaccgcaaacgccgaaaccactcgataaaaaaaacctaaaacactaaccttcgacccgtcgtcgaaaacctaaactaaacgataataacaccaaacccaaaaaatttaattttcaaaaaacgaaacgaaaacgctaatatattcgacccgtcaaaactacaaccgcccgcgacctccgacgtctaacctatctcgcctacgcgaaacccccgacaaacgacgctactactccgactaaacgaacgaaacgacctaaaccccgcgacttctattcccaactctacgaccgatctaaaaactaaaactccgaacgaaaaacgaaaaactaaacaaaaacaaccgaaaccgccgcaaaaaaaactaaaaaataccccgcgacccctttcgaccgcctcgataactttccgaacctcctaaccaaaaacgctaaactacgaataaatctcgaaaaaaatcgcctcgcataacaaacgcgaactaatctactcctttccactctctcgataacgctataactcttaaaacccccgctccttctcttcacaaccatcaaaaaacgcgacctaccacctaaacaaacgcgatctcccccaaaacccgattacgccccaaaaccgaattccgtcccatctccgacaaaaacacttcctaatttacccctcgccaaactccaacaattttctaaatccccgaaaaactaatttcgcctctaaacttccat

SEQ ID NO: 39121 - DNA, 731 bp, Artificial Sequence
  chemically treated genomic DNA (Homo sapiens) CpG-island No: 39121
gaatttgttttcgggtcgtgttttttttggcgtcgagtttttagatagttcgggacgtttttgtgcgtattggacgcgcgacgcgtagtagttattggttcgattcgcgtttttttaagtatttttcgaaggggcgtagtttttgtttattttggttgtcgagggattgttgcgtcggttttcgtatttattcgtataggtttcgtcgttggtcgtcgggagatagttgttcggcggtagcggtggcggcgggtttaggagggtcggggttgagcgtttgtagtagtttagaagcgtaggaaggcgcggcggtcgggtggtgcgggtggtgatgcgggtggtggtgcggatggtagtttgcggggttgttgtagtttatggttgcggtcggggagttatcgttgaggtcgtgagttacggcgttggcggcggtcgcggcgttttcgggcgcgtagttattttagttttttcggagtggggcgttatacgttgtcggttaggatggtttcggggattgcgcgttgtttaagttcgttgtcgttgtagttgcggtcgttacgtggtaatcgtcgtagttcgggtattgcggggggttgacgaagttttgcggcgttaggttgaggtcgttagagtggcgtacggagttagggtatatgtttacgtttttgtttaggaggtagtttacgtatatggtggcgagggttcgggagtagattttattatgttgtttg

SEQ ID NO: 39122 - DNA, 731 bp, Artificial Sequence
  chemically treated genomic DNA (Homo sapiens) CpG-island No: 39122
caaacaacataataaaatctactcccgaaccctcgccaccatatacgtaaactacctcctaaacaaaaacgtaaacatataccctaactccgtacgccactctaacgacctcaacctaacgccgcaaaacttcgtcaaccccccgcaatacccgaactacgacgattaccacgtaacgaccgcaactacaacgacaacgaacttaaacaacgcgcaatccccgaaaccatcctaaccgacaacgtataacgccccactccgaaaaaactaaaataactacgcgcccgaaaacgccgcgaccgccgccaacgccgtaactcacgacctcaacgataactccccgaccgcaaccataaactacaacaaccccgcaaactaccatccgcaccaccacccgcatcaccacccgcaccacccgaccgccgcgccttcctacgcttctaaactactacaaacgctcaaccccgaccctcctaaacccgccgccaccgctaccgccgaacaactatctcccgacgaccaacgacgaaacctatacgaataaatacgaaaaccgacgcaacaatccctcgacaaccaaaataaacaaaaactacgccccttcgaaaaatacttaaaaaaacgcgaatcgaaccaataactactacgcgtcgcgcgtccaatacgcacaaaaacgtcccgaactatctaaaaactcgacgccaaaaaaaacacgacccgaaaacaaattc

SEQ ID NO: 39123 - DNA, 731 bp, Artificial Sequence
  chemically treated genomic DNA (Homo sapiens) CpG-island No: 39123
taggtagtatggtgaggtttgttttcggattttcgttattatgtacgtgagttattttttggataaggacgtgagtatgtattttagtttcgtgcgttattttggcggttttaatttggcgtcgtagaatttcgttagtttttcgtagtattcggattacggcggttattacgtggcggtcgtagttgtagcggtagcgaatttggatagcgcgtagttttcggggttattttggtcggtagcgtatggcgttttatttcgggaggattggaatggttacgcgttcggaggcgtcgcggtcgtcgttaacgtcgtggtttacggttttaacggtggtttttcggtcgtagttatgggttatagtagtttcgtagattattattcgtattattattcgtattattattcgtattattcggtcgtcgcgtttttttgcgtttttgggttgttgtaaacgtttaatttcggtttttttgggttcgtcgttatcgttgtcgtcgagtagttgtttttcggcggttagcggcggaatttgtgcgagtggatgcggaagtcggcgtagtagtttttcggtagttaaggtaagtagaggttgcgttttttcggagggtgtttgggaaggcgcgggtcgagttagtggttgttgcgcgtcgcgcgtttagtgcgtataggggcgtttcgggttgtttgggagttcggcgttaggaggggtacggttcggagataaattt

SEQ ID NO: 39124 - DNA, 731 bp, Artificial Sequence
  chemically treated genomic DNA (Homo sapiens) CpG-island No: 39124
aaatttatctccgaaccgtacccctcctaacgccgaactcccaaacaacccgaaacgcccctatacgcactaaacgcgcgacgcgcaacaaccactaactcgacccgcgccttcccaaacaccctccgaaaaaacgcaacctctacttaccttaactaccgaaaaactactacgccgacttccgcatccactcgcacaaattccgccgctaaccgccgaaaaacaactactcgacgacaacgataacgacgaacccaaaaaaaccgaaattaaacgtttacaacaacccaaaaacgcaaaaaaacgcgacgaccgaataatacgaataataatacgaataataatacgaataataatctacgaaactactataacccataactacgaccgaaaaaccaccgttaaaaccgtaaaccacgacgttaacgacgaccgcgacgcctccgaacgcgtaaccattccaatcctcccgaaataaaacgccatacgctaccgaccaaaataaccccgaaaactacgcgctatccaaattcgctaccgctacaactacgaccgccacgtaataaccgccgtaatccgaatactacgaaaaactaacgaaattctacgacgccaaattaaaaccgccaaaataacgcacgaaactaaaatacatactcacgtccttatccaaaaaataactcacgtacataataacgaaaatccgaaaacaaacctcaccatactaccta

SEQ ID NO: 39125 - DNA, 911 bp, Artificial Sequence
  chemically treated genomic DNA (Homo sapiens) CpG-island No: 39125
agtcgtaaatttcgagttttagcggtcgttttttttttttttcgttttttttgatttaaggttttaaaagataaacgtgttatttttcgtttcgtttttggattttggtttcgatcgaatgtagtggggatcgagaagcgtaaggtttaggatttgttagaggggcgcgttaagggcgtttttgtttcgttaggatattatcgtttgggtattttattttattttttcgtagttttttttggggtcgggcggggcggggcggggtaggggggtcgggcgcggtttacgcgttttttcgagtgcgcggtgcgggacgggcgcggttgacgcgttttcgtcggtgtttgtgttttttcgtaggttaggagggtattttgcgttgttattcggatttggcgggtagcgagttgtagcggggtacgtttacggtcgagtcgtagcgggaatagagcggcgtaggtttgaggagtttgggcgcggacgagcggttgcggttggtcgagtttaacgcgtagtatcgcgcgcgtttcggtttttttttcgtgttcgtcgcgcgttttagcgatcggacggcggtgtcgcgcgagttggcgcgtcggttgttttgttcgttcgcgtaggagttgcgtattgttttgggcgaggtgaagaagatcggtagtttgcgtttggtcgatttttttcgcgtagatttcgttaagttgtagttgtcgcgcgggttagggattcgggacgtataatcggacgcgcgggggttacggttcggagttgtgcgttttgggcgggaggcggattcgggtttggaatagcgtttatatacgtgtataaaggaagtggagaattgaggtaattatacgagtaatgagtttttttgttcgtttatttatacgcgtacgcgttgttaaaatatt

SEQ ID NO: 39126 - DNA, 911 bp, Artificial Sequence
  chemically treated genomic DNA (Homo sapiens) CpG-island No: 39126
aatattttaacaacgcgtacgcgtataaataaacgaacaaaaaaactcattactcgtataattacctcaattctccacttcctttatacacgtatataaacgctattccaaacccgaatccgcctcccgcccaaaacgcacaactccgaaccgtaacccccgcgcgtccgattatacgtcccgaatccctaacccgcgcgacaactacaacttaacgaaatctacgcgaaaaaaatcgaccaaacgcaaactaccgatcttcttcacctcgcccaaaacaatacgcaactcctacgcgaacgaacaaaacaaccgacgcgccaactcgcgcgacaccgccgtccgatcgctaaaacgcgcgacgaacacgaaaaaaaaaccgaaacgcgcgcgatactacgcgttaaactcgaccaaccgcaaccgctcgtccgcgcccaaactcctcaaacctacgccgctctattcccgctacgactcgaccgtaaacgtaccccgctacaactcgctacccgccaaatccgaataacaacgcaaaataccctcctaacctacgaaaaaacacaaacaccgacgaaaacgcgtcaaccgcgcccgtcccgcaccgcgcactcgaaaaaacgcgtaaaccgcgcccgacccccctaccccgccccgccccgcccgaccccaaaaaaaactacgaaaaaataaaataaaatacccaaacgataatatcctaacgaaacaaaaacgcccttaacgcgcccctctaacaaatcctaaaccttacgcttctcgatccccactacattcgatcgaaaccaaaatccaaaaacgaaacgaaaaataacacgtttatcttttaaaaccttaaatcaaaaaaaacgaaaaaaaaaaaaaacgaccgctaaaactcgaaatttacgact

SEQ ID NO: 39127 - DNA, 911 bp, Artificial Sequence
  chemically treated genomic DNA (Homo sapiens) CpG-island No: 39127
gatattttggtaacgcgtgcgcgtgtgggtgggcggataaaaggatttattattcgtatgattgttttaattttttattttttttgtgtacgtgtgtggacgttgttttaggttcgagttcgtttttcgtttaggacgtatagtttcgggtcgtggttttcgcgcgttcggttgtgcgtttcgggtttttggttcgcgcggtagttatagtttggcggggtttgcgcggaggaggtcggttaggcgtaggttgtcgattttttttatttcgtttagagtagtgcgtagtttttgcgcggacgggtagagtagtcggcgcgttagttcgcgcggtatcgtcgttcggtcgttgaagcgcgcggcgagtacgaaggggaaatcgaagcgcgcgcggtattgcgcgttgagttcggttagtcgtagtcgttcgttcgcgtttaggttttttaggtttgcgtcgttttgttttcgttgcgattcggtcgtgagcgtgtttcgttgtagttcgttgttcgttaggttcgggtggtagcgtaggatgtttttttggtttgcggagaagtatagatatcggcgggagcgcgttaatcgcgttcgtttcgtatcgcgtattcgagggggcgcgtaggtcgcgttcggtttttttgtttcgtttcgtttcgttcggttttaaagaaggttgcgggagggtgaagtagagtatttaggcggtgatgttttggcggaataggggcgtttttggcgcgtttttttaataagttttggattttgcgtttttcggtttttattatattcggtcgggattaggatttaggggcggggcgggaagtgatacgtttgttttttgagattttgggttaagaagagcggaggagagagagggcggtcgttgaggttcggaatttacgatt

SEQ ID NO: 39128 - DNA, 911 bp, Artificial Sequence
  chemically treated genomic DNA (Homo sapiens) CpG-island No: 39128
aatcgtaaattccgaacctcaacgaccgccctctctctcctccgctcttcttaacccaaaatctcaaaaaacaaacgtatcacttcccgccccgcccctaaatcctaatcccgaccgaatataataaaaaccgaaaaacgcaaaatccaaaacttattaaaaaaacgcgccaaaaacgcccctattccgccaaaacatcaccgcctaaatactctacttcaccctcccgcaaccttctttaaaaccgaacgaaacgaaacgaaacaaaaaaaccgaacgcgacctacgcgccccctcgaatacgcgatacgaaacgaacgcgattaacgcgctcccgccgatatctatacttctccgcaaaccaaaaaaacatcctacgctaccacccgaacctaacgaacaacgaactacaacgaaacacgctcacgaccgaatcgcaacgaaaacaaaacgacgcaaacctaaaaaacctaaacgcgaacgaacgactacgactaaccgaactcaacgcgcaataccgcgcgcgcttcgatttccccttcgtactcgccgcgcgcttcaacgaccgaacgacgataccgcgcgaactaacgcgccgactactctacccgtccgcgcaaaaactacgcactactctaaacgaaataaaaaaaatcgacaacctacgcctaaccgacctcctccgcgcaaaccccgccaaactataactaccgcgcgaaccaaaaacccgaaacgcacaaccgaacgcgcgaaaaccacgacccgaaactatacgtcctaaacgaaaaacgaactcgaacctaaaacaacgtccacacacgtacacaaaaaaaataaaaaattaaaacaatcatacgaataataaatccttttatccgcccacccacacgcgcacgcgttaccaaaatatc

SEQ ID NO: 39129 - DNA, 577 bp, Artificial Sequence
  chemically treated genomic DNA (Homo sapiens) CpG-island No: 39129
ggcgattaagatattttcgcgagggtttagggcgcgtttttttcgttaggttttagatttcggttttgcgttatttttttttacgtttcggcgcgggcgtagttagttcggttttttttaggtttttaagtttcggatcgagtgtggggtcgtttttttttttcggaaggagttatcgtcgttttaagtggaagaggagaggaagggggcgggggagcggggggcggggagcggaggcggaggaggggaagggggatttttttggtttttacgtggttcgggcgtttgtgaatcgcgtttatcggagggttttatagcgaaatataaaagtagttgggaagcggcggggattcgagtttttagcgtcgggcggagcggcggatagagtttcgtagcgtttcgcggtcgcgatggggtcgaagcgttcgaattttcggagtttataaattggcggggttcggttcgtcgtcgggattcgggtgtcgggttttgggttggaagcgcggcggcgtatcgttataattcgggagatttggtaggaggtttgggggttcgttcgtttcggggggttttgtgt

SEQ ID NO: 39130 - DNA, 577 bp, Artificial Sequence
  chemically treated genomic DNA (Homo sapiens) CpG-island No: 39130
acacaaaaccccccgaaacgaacgaacccccaaacctcctaccaaatctcccgaattataacgatacgccgccgcgcttccaacccaaaacccgacacccgaatcccgacgacgaaccgaaccccgccaatttataaactccgaaaattcgaacgcttcgaccccatcgcgaccgcgaaacgctacgaaactctatccgccgctccgcccgacgctaaaaactcgaatccccgccgcttcccaactacttttatatttcgctataaaaccctccgataaacgcgattcacaaacgcccgaaccacgtaaaaaccaaaaaaatcccccttcccctcctccgcctccgctccccgccccccgctcccccgcccccttcctctcctcttccacttaaaacgacgataactccttccgaaaaaaaaaaacgaccccacactcgatccgaaacttaaaaacctaaaaaaaaccgaactaactacgcccgcgccgaaacgtaaaaaaaaataacgcaaaaccgaaatctaaaacctaacgaaaaaaacgcgccctaaaccctcgcgaaaatatcttaatcgcc

SEQ ID NO: 39131 - DNA, 577 bp, Artificial Sequence
  chemically treated genomic DNA (Homo sapiens) CpG-island No: 39131
atataaggtttttcggggcgggcgggtttttaaattttttgttaagtttttcgggttgtggcggtgcgtcgtcgcgtttttagtttaagattcggtattcgggtttcggcggcgagtcgggtttcgttagtttgtgggtttcgggggttcgggcgtttcggttttatcgcggtcgcggggcgttgcggggttttgttcgtcgtttcgttcggcgttggaaattcgagttttcgtcgttttttaattgtttttgtatttcgttgtgagatttttcggtgggcgcgatttataggcgttcggattacgtgggagttagggggatttttttttttttttttcgttttcgtttttcgtttttcgttttttcgttttttttttttttttttttatttaaagcggcgatggtttttttcgagagggagaggcggttttatattcggttcgggatttgggggtttggaggaagtcggattggttgcgttcgcgtcggggcgtaggagggggtggcgtagagtcggagtttggggtttggcgggagggacgcgttttgggttttcgcgggggtgttttggtcgtt

SEQ ID NO: 39132 - DNA, 577 bp, Artificial Sequence
  chemically treated genomic DNA (Homo sapiens) CpG-island No: 39132
aacgaccaaaacacccccgcgaaaacccaaaacgcgtccctcccgccaaaccccaaactccgactctacgccaccccctcctacgccccgacgcgaacgcaaccaatccgacttcctccaaacccccaaatcccgaaccgaatataaaaccgcctctccctctcgaaaaaaaccatcgccgctttaaataaaaaaaaaaaaaaaaaaaacgaaaaaacgaaaaacgaaaaacgaaaacgaaaaaaaaaaaaaaaaatccccctaactcccacgtaatccgaacgcctataaatcgcgcccaccgaaaaatctcacaacgaaatacaaaaacaattaaaaaacgacgaaaactcgaatttccaacgccgaacgaaacgacgaacaaaaccccgcaacgccccgcgaccgcgataaaaccgaaacgcccgaacccccgaaacccacaaactaacgaaacccgactcgccgccgaaacccgaataccgaatcttaaactaaaaacgcgacgacgcaccgccacaacccgaaaaacttaacaaaaaatttaaaaacccgcccgccccgaaaaaccttatat

SEQ ID NO: 39133 - DNA, 583 bp, Artificial Sequence
  chemically treated genomic DNA (Homo sapiens) CpG-island No: 39133
cggcgttgaaatttagtacgttttttcggagataggcgcgtacggcgggtagcggtatcgagttttgtagcgcgtataggtattcgtagtgggagaagaagttcgtcgcgttgtcgcggcgtagttttacggagtcgattatggttcgagggcggtttcgggggatgttcgtcgcggagacgtcgttcgcgtttatttaagaacgttgagtcgtaattcggtcgtttcggtatttacggttaggcgatagcggtagtttcgtatcgggtttaggagcggtgattcggtcggaagacgtaaggttagagttttaagttaggtcggttttttaacgttttattttcgcgttgtttttcgttttgcggtttaagtagttggcgttcgttttatagttttttgaggcgtcgggatttaagtcggtgggcggtgtcgtggaacggtgcgttaagacgttaacgtgttcgttgtgcgtcggtacgtaggtttcgttttttgaggacgggtgagttcgttgttatttgagatagtggtcgggagagtttgagggtttgcgaaagagtttattgatcgattcgaataaaag

SEQ ID NO: 39134 - DNA, 583 bp, Artificial Sequence
  chemically treated genomic DNA (Homo sapiens) CpG-island No: 39134
cttttattcgaatcgatcaataaactctttcgcaaaccctcaaactctcccgaccactatctcaaataacaacgaactcacccgtcctcaaaaaacgaaacctacgtaccgacgcacaacgaacacgttaacgtcttaacgcaccgttccacgacaccgcccaccgacttaaatcccgacgcctcaaaaaactataaaacgaacgccaactacttaaaccgcaaaacgaaaaacaacgcgaaaataaaacgttaaaaaaccgacctaacttaaaactctaaccttacgtcttccgaccgaatcaccgctcctaaacccgatacgaaactaccgctatcgcctaaccgtaaataccgaaacgaccgaattacgactcaacgttcttaaataaacgcgaacgacgtctccgcgacgaacatcccccgaaaccgccctcgaaccataatcgactccgtaaaactacgccgcgacaacgcgacgaacttcttctcccactacgaatacctatacgcgctacaaaactcgataccgctacccgccgtacgcgcctatctccgaaaaaacgtactaaatttcaacgccg

SEQ ID NO: 39135 - DNA, 583 bp, Artificial Sequence
  chemically treated genomic DNA (Homo sapiens) CpG-island No: 39135
tttttattcggatcgattagtaaattttttcgtaaatttttaaattttttcgattattattttaggtagtagcgaatttattcgtttttaggaggcgggatttgcgtgtcgacgtatagcgagtacgttgacgttttggcgtatcgttttacggtatcgtttatcggtttgaatttcggcgttttagaggattatgaggcgggcgttaattgtttgggtcgtagggcgggaggtagcgcgggagtggggcgttgaggggtcggtttagtttggggttttggttttgcgtttttcgatcgaattatcgtttttgagttcggtgcggggttgtcgttatcgtttggtcgtgggtgtcggagcggtcgggttgcgatttagcgtttttgggtgggcgcgggcggcgttttcgcggcgggtatttttcgaggtcgttttcgggttatgatcgatttcgtgaagttgcgtcgcgatagcgcggcggatttttttttttattacgagtatttgtgcgcgttgtagaattcggtgtcgttgttcgtcgtgcgcgtttgttttcgggagggcgtgttggattttaacgtcg

SEQ ID NO: 39136 - DNA, 583 bp, Artificial Sequence
  chemically treated genomic DNA (Homo sapiens) CpG-island No: 39136
cgacgttaaaatccaacacgccctcccgaaaacaaacgcgcacgacgaacaacgacaccgaattctacaacgcgcacaaatactcgtaataaaaaaaaaaatccgccgcgctatcgcgacgcaacttcacgaaatcgatcataacccgaaaacgacctcgaaaaatacccgccgcgaaaacgccgcccgcgcccacccaaaaacgctaaatcgcaacccgaccgctccgacacccacgaccaaacgataacgacaaccccgcaccgaactcaaaaacgataattcgatcgaaaaacgcaaaaccaaaaccccaaactaaaccgacccctcaacgccccactcccgcgctacctcccgccctacgacccaaacaattaacgcccgcctcataatcctctaaaacgccgaaattcaaaccgataaacgataccgtaaaacgatacgccaaaacgtcaacgtactcgctatacgtcgacacgcaaatcccgcctcctaaaaacgaataaattcgctactacctaaaataataatcgaaaaaatttaaaaatttacgaaaaaatttactaatcgatccgaataaaaa

SEQ ID NO: 39137 - DNA, 1007 bp, Artificial Sequence
  chemically treated genomic DNA (Homo sapiens) CpG-island No: 39137
atttgcgcggttttattttcgggttttcgtagggcgtttcgagagttgcggatgggggtagtaggagtcgggcgggaatagaggaaagcgtcggttttgagatttagggaggagtttcggtgaaggaattcggggcgggtttttgtttagatttttaagaagttttaaaaatggcgggcggtaattcggcgagtcggacgcgtaggcgttatcgtggtcgttttttcgttagtcgcgggcggtttaagaatcgtttatagcgtttttatttagaagtttacgtttttcgcgattggttgaattgcgcgagcgtttcgtgtgggggcggggtcgttacgtagcggttacgtttttcgtttcgttggtgcgcgtgcgcgtaatttttattggaaagcgtttgcgcgcgtttttgtcgcggtttttagttcgcgttttagttttttttttttttcgggtaggttcgtttcgttagtaaggtagtgagtatcgcggttagtagagggcggttcggatttaagtttgtagcggcgttattggcgtgtggaaaatgttattagatggcgggttaggattgtagtttcgttgaaggcgcggttttcgttttcgaattttcggcgattatttcgtaataattttttttatatcgggaataatatatcggagatttttggggggaaattaggtcgatggtcggcggcgttcggatgggtagttgaggtgagtgcgggcggcggcgacggcggcggggggcgggaaagagggggaatgcggcggtagcggcgcgggggttggaagcgtcgatttaagatggaggtcgggcgagagcgagagagcgcgagcggcgagcgggcgggtcgggcgcgggtttcgtgcgggggagggaggtcgcgcgggtttgtgcggggtgcggcggtcgtgggtcgttcgagtgttcggagagacgtttgtgggcgcggtgggtatttcggcgttttcgtcgtttgttatttttttcgcgggtattaaaa

SEQ ID NO: 39138 - DNA, 1007 bp, Artificial Sequence
  chemically treated genomic DNA (Homo sapiens) CpG-island No: 39138
ttttaatacccgcgaaaaaaataacaaacgacgaaaacgccgaaatacccaccgcgcccacaaacgtctctccgaacactcgaacgacccacgaccgccgcaccccgcacaaacccgcgcgacctccctcccccgcacgaaacccgcgcccgacccgcccgctcgccgctcgcgctctctcgctctcgcccgacctccatcttaaatcgacgcttccaacccccgcgccgctaccgccgcattccccctctttcccgccccccgccgccgtcgccgccgcccgcactcacctcaactacccatccgaacgccgccgaccatcgacctaatttccccccaaaaatctccgatatattattcccgatataaaaaaaattattacgaaataatcgccgaaaattcgaaaacgaaaaccgcgccttcaacgaaactacaatcctaacccgccatctaataacattttccacacgccaataacgccgctacaaacttaaatccgaaccgccctctactaaccgcgatactcactaccttactaacgaaacgaacctacccgaaaaaaaaaaaaaactaaaacgcgaactaaaaaccgcgacaaaaacgcgcgcaaacgctttccaataaaaattacgcgcacgcgcaccaacgaaacgaaaaacgtaaccgctacgtaacgaccccgcccccacacgaaacgctcgcgcaattcaaccaatcgcgaaaaacgtaaacttctaaataaaaacgctataaacgattcttaaaccgcccgcgactaacgaaaaaacgaccacgataacgcctacgcgtccgactcgccgaattaccgcccgccatttttaaaacttcttaaaaatctaaacaaaaacccgccccgaattccttcaccgaaactcctccctaaatctcaaaaccgacgctttcctctattcccgcccgactcctactacccccatccgcaactctcgaaacgccctacgaaaacccgaaaataaaaccgcgcaaat

SEQ ID NO: 39139 - DNA, 1007 bp, Artificial Sequence
  chemically treated genomic DNA (Homo sapiens) CpG-island No: 39139
ttttggtgttcgcgggaggggtggtaagcgacgaagacgtcggggtgtttatcgcgtttatagacgttttttcgggtattcggacggtttacgatcgtcgtatttcgtataggttcgcgcggtttttttttttcgtacggggttcgcgttcggttcgttcgttcgtcgttcgcgttttttcgttttcgttcggtttttattttggatcggcgtttttagttttcgcgtcgttgtcgtcgtattttttttttttttcgtttttcgtcgtcgtcgtcgtcgttcgtatttattttagttgtttattcgggcgtcgtcgattatcgatttagtttttttttaaaagttttcggtgtgttattttcgatgtggggggggttgttacggggtggtcgtcgggggttcgggagcgggggtcgcgtttttaacggagttgtaattttaattcgttatttggtggtattttttatacgttaatggcgtcgttgtagatttgggttcggatcgttttttgttggtcgcggtgtttattgttttgttgacgggacgggtttgttcggaaaggggagggagttgaggcgcgagttaggggtcgcggtaggggcgcgcgtaaacgttttttagtggggattgcgcgtacgcgtattagcggggcgggaaacgtggtcgttgcgtggcggtttcgtttttatacggagcgttcgcgtagtttagttaatcgcgagaggcgtaggtttttggataagggcgttgtggacggtttttgggtcgttcgcggttggcggaaggacggttacggtggcgtttgcgcgttcggttcgtcgagttgtcgttcgttatttttggagttttttggagatttaggtaggaattcgtttcgggtttttttatcgaggtttttttttaggttttagggtcggcgtttttttttgttttcgttcggtttttgttgtttttattcgtagttttcgagacgttttgcggaaattcgagggtgaggtcgcgtagat

SEQ ID NO: 39140 - DNA, 1007 bp, Artificial Sequence
  chemically treated genomic DNA (Homo sapiens) CpG-island No: 39140
atctacgcgacctcaccctcgaatttccgcaaaacgtctcgaaaactacgaataaaaacaacaaaaaccgaacgaaaacaaaaaaaaacgccgaccctaaaacctaaaaaaaaacctcgataaaaaaacccgaaacgaattcctacctaaatctccaaaaaactccaaaaataacgaacgacaactcgacgaaccgaacgcgcaaacgccaccgtaaccgtccttccgccaaccgcgaacgacccaaaaaccgtccacaacgcccttatccaaaaacctacgcctctcgcgattaactaaactacgcgaacgctccgtataaaaacgaaaccgccacgcaacgaccacgtttcccgccccgctaatacgcgtacgcgcaatccccactaaaaaacgtttacgcgcgcccctaccgcgacccctaactcgcgcctcaactccctcccctttccgaacaaacccgtcccgtcaacaaaacaataaacaccgcgaccaacaaaaaacgatccgaacccaaatctacaacgacgccattaacgtataaaaaataccaccaaataacgaattaaaattacaactccgttaaaaacgcgacccccgctcccgaacccccgacgaccaccccgtaacaaccccccccacatcgaaaataacacaccgaaaacttttaaaaaaaaactaaatcgataatcgacgacgcccgaataaacaactaaaataaatacgaacgacgacgacgacgacgaaaaacgaaaaaaaaaaaaaatacgacgacaacgacgcgaaaactaaaaacgccgatccaaaataaaaaccgaacgaaaacgaaaaaacgcgaacgacgaacgaacgaaccgaacgcgaaccccgtacgaaaaaaaaaaaccgcgcgaacctatacgaaatacgacgatcgtaaaccgtccgaatacccgaaaaaacgtctataaacgcgataaacaccccgacgtcttcgtcgcttaccacccctcccgcgaacaccaaaa

SEQ ID NO: 39141 - DNA, 543 bp, Artificial Sequence
  chemically treated genomic DNA (Homo sapiens) CpG-island No: 39141
taggcgatatttacgtttatattttattcggcgatatttacgtttatattttattcgggcgatatttacgtttatattttattcgggcgatatttacgtttatattttattcgggcgatatttacgtttatattttattcgggcgatatttacgtttatattttattcgggcgatatttacgtttatattttattcgggcgatatttacgtttatattttagttcgggcgatatttacgtttatattttattcgggcgatatttacgtttatattttattcgggcgatatttacgtttatattttattcgggcgatatttacgtttatattttattcgggcgatatttatattttatttaggcgatatttatatttatattttatttaggcgatatttatatttatattttatttaggcgatatttatattttatttaggcgatatttatatttatattttatttgggcgatatttacgtttatattttattcgggtgatatttatattttatttaggcgatatttatagttatattttattt

SEQ ID NO: 39142 - DNA, 543 bp, Artificial Sequence
  chemically treated genomic DNA (Homo sapiens) CpG-island No: 39142
aaataaaatataactataaatatcgcctaaataaaatataaatatcacccgaataaaatataaacgtaaatatcgcccaaataaaatataaatataaatatcgcctaaataaaatataaatatcgcctaaataaaatataaatataaatatcgcctaaataaaatataaatataaatatcgcctaaataaaatataaatatcgcccgaataaaatataaacgtaaatatcgcccgaataaaatataaacgtaaatatcgcccgaataaaatataaacgtaaatatcgcccgaataaaatataaacgtaaatatcgcccgaactaaaatataaacgtaaatatcgcccgaataaaatataaacgtaaatatcgcccgaataaaatataaacgtaaatatcgcccgaataaaatataaacgtaaatatcgcccgaataaaatataaacgtaaatatcgcccgaataaaatataaacgtaaatatcgcccgaataaaatataaacgtaaatatcgccgaataaaatataaacgtaaatatcgccta

SEQ ID NO: 39143 - DNA, 543 bp, Artificial Sequence
  chemically treated genomic DNA (Homo sapiens) CpG-island No: 39143
ggataaggtgtggttgtgggtgtcgtttggataaggtgtgggtgttattcggataaggtgtgggcgtgggtgtcgtttagataaggtgtgggtgtgggtgtcgtttggataaggtgtgggtgtcgtttggataaggtgtgggtgtgggtgtcgtttggataaggtgtgggtgtgggtgtcgtttggataaggtgtgggtgtcgttcggataaggtgtgggcgtgggtgtcgttcggataaggtgtgggcgtgggtgtcgttcggataaggtgtgggcgtgggtgtcgttcggataaggtgtgggcgtgggtgtcgttcggattaaggtgtgggcgtgggtgtcgttcggataaggtgtgggcgtgggtgtcgttcggataaggtgtgggcgtgggtgtcgttcggataaggtgtgggcgtgggtgtcgttcggataaggtgtgggcgtgggtgtcgttcggataaggtgtgggcgtgggtgtcgttcggataaggtgtgggcgtgggtgtcgtcggataaggtgtgggcgtgggtgtcgtttg

SEQ ID NO: 39144 - DNA, 543 bp, Artificial Sequence
  chemically treated genomic DNA (Homo sapiens) CpG-island No: 39144
caaacgacacccacgcccacaccttatccgacgacacccacgcccacaccttatccgaacgacacccacgcccacaccttatccgaacgacacccacgcccacaccttatccgaacgacacccacgcccacaccttatccgaacgacacccacgcccacaccttatccgaacgacacccacgcccacaccttatccgaacgacacccacgcccacaccttaatccgaacgacacccacgcccacaccttatccgaacgacacccacgcccacaccttatccgaacgacacccacgcccacaccttatccgaacgacacccacgcccacaccttatccgaacgacacccacaccttatccaaacgacacccacacccacaccttatccaaacgacacccacacccacaccttatccaaacgacacccacaccttatccaaacgacacccacacccacaccttatctaaacgacacccacgcccacaccttatccgaataacacccacaccttatccaaacgacacccacaaccacaccttatcc

SEQ ID NO: 39145 - DNA, 598 bp, Artificial Sequence
  chemically treated genomic DNA (Homo sapiens) CpG-island No: 39145
  misc_feature (321)..(321): n is either a, c, g or t
  misc_feature (354)..(354): n is either a, c, g or t
tcgcgtttgttgagttcgttttttttttttcgttcgtttttgtcgttttttttcgtcgcgtttcgtttcggttttttcgttttcgttttcgtttttttttcgttcggttttttttggcgcgtttcgttttttttttttcgcggttcgcgtttttgtttttttttttgcgttttttttttttttttcgcgttttttttttttcgttcgtttttttttttttcgttcgttttttttgtttttttttttcgttttttttttttttcgttttttttttcgcgtttttttttcgttcgttttttttttttttttcgttcgtttttntttttttttcgttttttttttttttcgtttttntttttgtttcgtttcgttttttttttttttcgtcgttttttttttttgttttttttgcgcgttttttcgcgttttcggcgtttttcgtttttttttcgttttttttttgtttttttttcgtttttttttttttttttttttttcgtttttttcgtttttttttttcgcgtcgtttcgttcgcgttcgcgtttttttttttttttcgtttcgttgtttttttttttcgtttttttttttcgtttt

SEQ ID NO: 39146 - DNA, 598 bp, Artificial Sequence
  chemically treated genomic DNA (Homo sapiens) CpG-island No: 39146
  misc_feature (245)..(245): n is either a, c, g or t
  misc_feature (278)..(278): n is either a, c, g or t
aaaacgaaaaaaaaaaacgaaaaaaaaaaacaacgaaacgaaaaaaaaaaaaaaacgcgaacgcgaacgaaacgacgcgaaaaaaaaaaacgaaaaaaacgaaaaaaaaaaaaaaaaaaaaaaacgaaaaaaaaacaaaaaaaaaacgaaaaaaaaacgaaaaacgccgaaaacgcgaaaaaacgcgcaaaaaaaacaaaaaaaaaaaacgacgaaaaaaaaaaaaaacgaaacgaaacaaaaanaaaaacgaaaaaaaaaaaaaacgaaaaaaaaanaaaaacgaacgaaaaaaaaaaaaaaaacgaacgaaaaaaaaacgcgaaaaaaaaaacgaaaaaaaaaaaaaacgaaaaaaaaaaacaaaaaaaacgaacgaaaaaaaaaaaaacgaacgaaaaaaaaaaaacgcgaaaaaaaaaaaaaaaacgcaaaaaaaaaaacaaaaacgcgaaccgcgaaaaaaaaaaaacgaaacgcgccaaaaaaaaccgaacgaaaaaaaaacgaaaacgaaaacgaaaaaaccgaaacgaaacgcgacgaaaaaaaacgacaaaaacgaacgaaaaaaaaaaaacgaactcaacaaacgcga

SEQ ID NO: 39147 - DNA, 598 bp, Artificial Sequence
  chemically treated genomic DNA (Homo sapiens) CpG-island No: 39147
  misc_feature (245)..(245): n is either a, c, g or t
  misc_feature (278)..(278): n is either a, c, g or t
gggacggagaggggaggcgagggagaggggtagcgggacgaggggaaagaggggacgcgggcgcgggcggggcggcgcgaggagggaaaacgggagaggcgggagaggggagggagggaagaggcggaggggggataagagggagacgaaggggggacgagagacgtcgggggcgcgaggaggcgcgtagggaggatagagaggggaagcggcggggaggaaagggggcggaacgaggtagaagngagggcggggaggggggggagcgggggggaagnaggggcgggcggggagggggggaggggcgggcggaaggggggcgcgggggggggggcggggggaggagaggacgggggggggggatagggggggcgagcggaggaggggggggcgggcgggggggggggggcgcgggggagggggggggggcgtagggggaggaataagggcgcgagtcgcggggaaggaagggcgggacgcgttaggaaaggtcgaacggggggaggacgggggcggggacgggggggtcggagcggggcgcggcgggggaggacggtaggagcgggcgggggggggagggcgagtttagtagacgcgg

SEQ ID NO: 39148 - DNA, 598 bp, Artificial Sequence
  chemically treated genomic DNA (Homo sapiens) CpG-island No: 39148
  misc_feature (321)..(321): n is either a, c, g or t
  misc_feature (354)..(354): n is either a, c, g or t
ccgcgtctactaaactcgccctcccccccccgcccgctcctaccgtcctcccccgccgcgccccgctccgacccccccgtccccgcccccgtcctccccccgttcgacctttcctaacgcgtcccgcccttccttccccgcgactcgcgcccttattcctccccctacgccccccccccctcccccgcgcccccccccccccgcccgcccccccctcctccgctcgccccccctatcccccccccccgtcctctcctccccccgcccccccccccgcgccccccttccgcccgcccctccccccctccccgcccgcccctncttcccccccgctcccccccctccccgccctcncttctacctcgttccgccccctttcctccccgccgcttcccctctctatcctccctacgcgcctcctcgcgcccccgacgtctctcgtccccccttcgtctccctcttatcccccctccgcctcttccctccctcccctctcccgcctctcccgttttccctcctcgcgccgccccgcccgcgcccgcgtcccctctttcccctcgtcccgctacccctctccctcgcctcccctctccgtccc

SEQ ID NO: 39149 - DNA, 562 bp, Artificial Sequence
  chemically treated genomic DNA (Homo sapiens) CpG-island No: 39149
cgcgcgggtaaagattttcggggatgatatttcgcgcgtcgcggtttcgtgcgcgcggtttttcgtattcgcgggtcgttttatttttttttttgtattttaagagttcggtttggttttcgaggtcgggagttacgcggtatcgtagtttcgagggagaggacgttcgtaattaatacgtacgcgggtattaagagggtataggttagggcggcgagggtcgaacggggtcggggggtacgcggagttggattagaattagcgagggcgcgtagatattgaacggatgcgaaggtttcggacgcggagcggtttcgggcgttttgcgtggggcgcgagcggaggtttcgacgtatttacggtgtcgagggcgggcggttgtattcgcgttcgcgggcgtttatcgtacggaataacgtttttatgttcggacgtcgtcgttagagacggatcgatcgttacgttttttgtaaatttattaatatattttatttttttttattggtgtattcgttttatcgttttatttatttttttttgttcggttatttttgaaattttt

SEQ ID NO: 39150 - DNA, 562 bp, Artificial Sequence
  chemically treated genomic DNA (Homo sapiens) CpG-island No: 39150
aaaaatttcaaaaataaccgaacaaaaaaaaataaataaaacgataaaacgaatacaccaataaaaaaaaataaaatatattaataaatttacaaaaaacgtaacgatcgatccgtctctaacgacgacgtccgaacataaaaacgttattccgtacgataaacgcccgcgaacgcgaatacaaccgcccgccctcgacaccgtaaatacgtcgaaacctccgctcgcgccccacgcaaaacgcccgaaaccgctccgcgtccgaaaccttcgcatccgttcaatatctacgcgccctcgctaattctaatccaactccgcgtaccccccgaccccgttcgaccctcgccgccctaacctataccctcttaatacccgcgtacgtattaattacgaacgtcctctccctcgaaactacgataccgcgtaactcccgacctcgaaaaccaaaccgaactcttaaaatacaaaaaaaaaaataaaacgacccgcgaatacgaaaaaccgcgcgcacgaaaccgcgacgcgcgaaatatcatccccgaaaatctttacccgcgcg

SEQ ID NO: 39151 - DNA, 562 bp, Artificial Sequence
  chemically treated genomic DNA (Homo sapiens) CpG-island No: 39151
gggagttttaggagtggtcgagtaggggggggtgggtggggcggtgaggcgaatatattaatagggggggataggatatattggtgggtttatagggggcgtggcggtcggttcgtttttaacggcggcgttcgaatatgggggcgttatttcgtgcggtgggcgttcgcggacgcgggtatagtcgttcgttttcggtatcgtaagtgcgtcggggttttcgttcgcgttttacgtaggacgttcggggtcgtttcgcgttcgggattttcgtattcgtttagtgtttgcgcgttttcgttggttttggtttagtttcgcgtgtttttcggtttcgttcggttttcgtcgttttggtttgtgtttttttggtgttcgcgtgcgtgttggttgcgggcgttttttttttcgaggttgcggtgtcgcgtggttttcggtttcggagattaggtcggatttttggagtgtaggggaggaggtggggcggttcgcgagtgcgggggatcgcgcgtacggagtcgcggcgcgcggggtattattttcgggggtttttattcgcgcg

SEQ ID NO: 39152 - DNA, 562 bp, Artificial Sequence
  chemically treated genomic DNA (Homo sapiens) CpG-island No: 39152
cgcgcgaataaaaacccccgaaaataataccccgcgcgccgcgactccgtacgcgcgatcccccgcactcgcgaaccgccccacctcctcccctacactccaaaaatccgacctaatctccgaaaccgaaaaccacgcgacaccgcaacctcgaaaaaaaaaacgcccgcaaccaacacgcacgcgaacaccaaaaaaacacaaaccaaaacgacgaaaaccgaacgaaaccgaaaaacacgcgaaactaaaccaaaaccaacgaaaacgcgcaaacactaaacgaatacgaaaatcccgaacgcgaaacgaccccgaacgtcctacgtaaaacgcgaacgaaaaccccgacgcacttacgataccgaaaacgaacgactatacccgcgtccgcgaacgcccaccgcacgaaataacgcccccatattcgaacgccgccgttaaaaacgaaccgaccgccacgccccctataaacccaccaatatatcctatccccccctattaatatattcgcctcaccgccccacccacccccccctactcgaccactcctaaaactccc

SEQ ID NO: 39153 - DNA, 668 bp, Artificial Sequence
  chemically treated genomic DNA (Homo sapiens) CpG-island No: 39153
gcgacgcgttttgttgtaatgggcggatcggttgcgtgtaatcgtttgagatatgtcgtaacgaataggggtacgttagttataagtatacgtttttttcgttcgttcgtttttagggaagggagacgtggatagtagaatgttttaaacgatatttgcgcggaatcgggggggtggtttattgcggtacggcgtttgcgtaacgaatgtaatcggtggtgtttaaattatatttttttttttatttttttcgatggtggtggtggattagaatgttttaatcgattatacggcggatgcggacggcgttttgatggttaaagtggcgaggcggttgacgtgcgttgcgttagagaatatgatataacgaatgggggtacgcgtgcgtataagtatacgtttttttttcgtttttatgggattacgttatatttatggaatttggtatgggcgatttttttcgtgtggcgtttgatttggcgttcgcgtgggattttttttaatttatatcgtacgttttttatgggcgattttgcgggttttttgcggttttgcggttacggtttttttttgttcgtacgttacggtacgacggtacgtacggatttaaatagtgcgtttaatgatacgtatataaatttgtgtaaaatcgatcgtttattttatta

SEQ ID NO: 39154 - DNA, 668 bp, Artificial Sequence
  chemically treated genomic DNA (Homo sapiens) CpG-island No: 39154
taataaaataaacgatcgattttacacaaatttatatacgtatcattaaacgcactatttaaatccgtacgtaccgtcgtaccgtaacgtacgaacaaaaaaaaaccgtaaccgcaaaaccgcaaaaaacccgcaaaatcgcccataaaaaacgtacgatataaattaaaaaaaatcccacgcgaacgccaaatcaaacgccacacgaaaaaaatcgcccataccaaattccataaatataacgtaatcccataaaaacgaaaaaaaaacgtatacttatacgcacgcgtacccccattcgttatatcatattctctaacgcaacgcacgtcaaccgcctcgccactttaaccatcaaaacgccgtccgcatccgccgtataatcgattaaaacattctaatccaccaccaccatcgaaaaaaataaaaaaaaaaatataatttaaacaccaccgattacattcgttacgcaaacgccgtaccgcaataaaccacccccccgattccgcgcaaatatcgtttaaaacattctactatccacgtctcccttccctaaaaacgaacgaacgaaaaaaacgtatacttataactaacgtacccctattcgttacgacatatctcaaacgattacacgcaaccgatccgcccattacaacaaaacgcgtcgc

SEQ ID NO: 39155 - DNA, 668 bp, Artificial Sequence
  chemically treated genomic DNA (Homo sapiens) CpG-island No: 39155
tagtggaatgaacggtcgattttgtataaatttatgtacgtattattaggcgtattgtttgagttcgtacgtgtcgtcgtgtcgtgacgtgcggatagggagggatcgtagtcgtaaaatcgtaggaggttcgtaaagtcgtttatggggagcgtgcgatgtaggttgaaaaggattttacgcgagcgttaaattaggcgttatacgggggaggtcgtttatgttaaattttataagtatagcgtgattttataggggcggggggggggcgtatatttatgcgtacgcgtgtttttattcgttatgttatgttttttagcgtaacgtacgttaatcgtttcgttattttggttattaaggcgtcgttcgtattcgtcgtatgatcgattaggatattttggtttattattattatcgaagggggtgagggggaggatatagtttgggtattatcggttgtattcgttgcgtaaacgtcgtatcgtaatgagttattttttcggtttcgcgtaaatgtcgtttaggatattttgttatttacgttttttttttttaggggcgggcgggcggggggggcgtatatttatggttggcgtgtttttattcgttacgatatgttttaagcggttgtacgtaatcggttcgtttattgtaataaggcgcgtcgt

SEQ ID NO: 39156 - DNA, 668 bp, Artificial Sequence
  chemically treated genomic DNA (Homo sapiens) CpG-island No: 39156
acgacgcgccttattacaataaacgaaccgattacgtacaaccgcttaaaacatatcgtaacgaataaaaacacgccaaccataaatatacgccccccccgcccgcccgcccctaaaaaaaaaaaacgtaaataacaaaatatcctaaacgacatttacgcgaaaccgaaaaaataactcattacgatacgacgtttacgcaacgaatacaaccgataatacccaaactatatcctccccctcacccccttcgataataataataaaccaaaatatcctaatcgatcatacgacgaatacgaacgacgccttaataaccaaaataacgaaacgattaacgtacgttacgctaaaaaacataacataacgaataaaaacacgcgtacgcataaatatacgccccccccccgcccctataaaatcacgctatacttataaaatttaacataaacgacctcccccgtataacgcctaatttaacgctcgcgtaaaatccttttcaacctacatcgcacgctccccataaacgactttacgaacctcctacgattttacgactacgatccctccctatccgcacgtcacgacacgacgacacgtacgaactcaaacaatacgcctaataatacgtacataaatttatacaaaatcgaccgttcattccacta

SEQ ID NO: 39157 - DNA, 869 bp, Artificial Sequence
  chemically treated genomic DNA (Homo sapiens) CpG-island No: 39157
aagagtagcgacgtatcgaatggatggttatcgaatcgttggtcgattttttcgatttatatgattcgggtaaaacggtggaaggttattcggtatttaaacgcgcggtgttgattgcgcgtaagtcgtagaggtttggtattattgtcggatgcggcgtgaacgttttattcggtttacggagggtgcgggaatttgtaggtttgataagacgcgtaagcgtcgtattaggtagtcggtattattgtcggatgcggcgtaaacgttttattcggtttacggagggtgcgggaatttgtaggtttgataagacgcgtaagcgtcgtattaggtagtcggtatcgttgtcggatgcggcgtaaacgttttattcggtttacggatggtgcgggaatttgtaggtttgataagacgcgtaagcgtcgtattaggtagttggtattgttgtcggatgcggcgtaaacgttttattcggtttacggagggtgcgggaatttgtaggtttgataagacgcgtaagcgtcgtattaggtagtcggtatcgttgtcggatgcggcgtaaacgttttattcggtttacggagggtgcgggaatttgtaggtttgataagacgcgttagcgtcgtattaggtattatgtattaattgtcggatgcggcgtaaacgttttattcggtttacggttcggattatttgtaggtacgataagacgcgatagcgtcgtattaggtattatgtattaattgtcggatgcggcgtaaacgttttattcggtttacggttcggattatttgtaggtacgataagacgcgatagcgtcgtatcgggtatggtttgttagatacgttatagatttaaatgttattgaa

SEQ ID NO: 39158 - DNA, 869 bp, Artificial Sequence
  chemically treated genomic DNA (Homo sapiens) CpG-island No: 39158
ttcaataacatttaaatctataacgtatctaacaaaccatacccgatacgacgctatcgcgtcttatcgtacctacaaataatccgaaccgtaaaccgaataaaacgtttacgccgcatccgacaattaatacataatacctaatacgacgctatcgcgtcttatcgtacctacaaataatccgaaccgtaaaccgaataaaacgtttacgccgcatccgacaattaatacataatacctaatacgacgctaacgcgtcttatcaaacctacaaattcccgcaccctccgtaaaccgaataaaacgtttacgccgcatccgacaacgataccgactacctaatacgacgcttacgcgtcttatcaaacctacaaattcccgcaccctccgtaaaccgaataaaacgtttacgccgcatccgacaacaataccaactacctaatacgacgcttacgcgtcttatcaaacctacaaattcccgcaccatccgtaaaccgaataaaacgtttacgccgcatccgacaacgataccgactacctaatacgacgcttacgcgtcttatcaaacctacaaattcccgcaccctccgtaaaccgaataaaacgtttacgccgcatccgacaataataccgactacctaatacgacgcttacgcgtcttatcaaacctacaaattcccgcaccctccgtaaaccgaataaaacgttcacgccgcatccgacaataataccaaacctctacgacttacgcgcaatcaacaccgcgcgtttaaataccgaataaccttccaccgttttacccgaatcatataaatcgaaaaaatcgaccaacgattcgataaccatccattcgatacgtcgctactctt

SEQ ID NO: 39159 - DNA, 869 bp, Artificial Sequence
  chemically treated genomic DNA (Homo sapiens) CpG-island No: 39159
tttagtggtatttagatttatgacgtatttggtaaattatgttcgatgcgacgttgtcgcgttttatcgtgtttataaatagttcgaatcgtaggtcggataaggcgtttacgtcgtattcggtaattggtgtatgatgtttgatgcgacgttgtcgcgttttatcgtgtttataaatagttcgaatcgtaggtcggataaggcgtttacgtcgtattcggtaattggtgtatgatgtttgatgcgacgttggcgcgttttattaggtttataaattttcgtatttttcgtaggtcggataaggcgtttacgtcgtattcggtaacggtgtcgattgtttgatgcgacgtttgcgcgttttattaggtttataaattttcgtatttttcgtaggtcggataaggcgtttacgtcgtattcggtaatagtgttaattgtttgatgcgacgtttgcgcgttttattaggtttataaattttcgtattattcgtaggtcggataaggcgtttacgtcgtattcggtaacggtgtcgattgtttgatgcgacgtttgcgcgttttattaggtttataaattttcgtatttttcgtaggtcggataaggcgtttacgtcgtattcggtaatggtgtcgattgtttgatgcgacgtttgcgcgttttattaggtttataaattttcgtatttttcgtaggtcggataaggcgtttacgtcgtattcggtagtaatattagatttttacggtttgcgcgtaattagtatcgcgcgtttaggtgtcggataattttttatcgttttattcggattatgtgggtcgaggaaatcggttagcgattcggtaattatttattcggtgcgtcgttgttttt

SEQ ID NO: 39160 - DNA, 869 bp, Artificial Sequence
  chemically treated genomic DNA (Homo sapiens) CpG-island No: 39160
aaaaacaacgacgcaccgaataaataattaccgaatcgctaaccgatttcctcgacccacataatccgaataaaacgataaaaaattatccgacacctaaacgcgcgatactaattacgcgcaaaccgtaaaaatctaatattactaccgaatacgacgtaaacgccttatccgacctacgaaaaatacgaaaatttataaacctaataaaacgcgcaaacgtcgcatcaaacaatcgacaccattaccgaatacgacgtaaacgccttatccgacctacgaaaaatacgaaaatttataaacctaataaaacgcgcaaacgtcgcatcaaacaatcgacaccgttaccgaatacgacgtaaacgccttatccgacctacgaataatacgaaaatttataaacctaataaaacgcgcaaacgtcgcatcaaacaattaacactattaccgaatacgacgtaaacgccttatccgacctacgaaaaatacgaaaatttataaacctaataaaacgcgcaaacgtcgcatcaaacaatcgacaccgttaccgaatacgacgtaaacgccttatccgacctacgaaaaatacgaaaatttataaacctaataaaacgcgccaacgtcgcatcaaacatcatacaccaattaccgaatacgacgtaaacgccttatccgacctacgattcgaactatttataaacacgataaaacgcgacaacgtcgcatcaaacatcatacaccaattaccgaatacgacgtaaacgccttatccgacctacgattcgaactatttataaacacgataaaacgcgacaacgtcgcatcgaacataatttaccaaatacgtcataaatctaaataccactaaa

SEQ ID NO: 39161 - DNA, 560 bp, Artificial Sequence
  chemically treated genomic DNA (Homo sapiens) CpG-island No: 39161
cgcgatcgatatttgattgtttgtagttattaaacgtcgtatgtgtcgggtaagcgtgataatagttggtttatacgcgtttagtttgtatgtcgcgttttattttataggttagattatcgttgcggttttagacgttcgcgtttaggttatattgcgtatcgttcgttagttttagcgttttttttatcgttttgaaggtggttatcgttagtatcgggttaaaaatttttttttggaatattcgtatattgttttgattaaatagaatcgtcggttcgaggtagtagtcgttttttagtttattttttagtagtttgcgtcgttcgtttgtgagtacgttagcgtgattgtgtcgttgtaatgggcgtgaacgtgataggtaaaaacgacgcggaaggtgttgaagtttgtattaacgttattcgtgaattggcgaagaaagtggatatttcggtaggtttacgcgatttgaacgtgaaagaagaagatttcgcggtattggcgattaatgttttgaaagatgtttgtggttttattaattcgatttaggtaattta

SEQ ID NO: 39162 - DNA, 560 bp, Artificial Sequence
  chemically treated genomic DNA (Homo sapiens) CpG-island No: 39162
taaattacctaaatcgaattaataaaaccacaaacatctttcaaaacattaatcgccaataccgcgaaatcttcttctttcacgttcaaatcgcgtaaacctaccgaaatatccactttcttcgccaattcacgaataacgttaatacaaacttcaacaccttccgcgtcgtttttacctatcacgttcacgcccattacaacgacacaatcacgctaacgtactcacaaacgaacgacgcaaactactaaaaaataaactaaaaaacgactactacctcgaaccgacgattctatttaatcaaaacaatatacgaatattccaaaaaaaaatttttaacccgatactaacgataaccaccttcaaaacgataaaaaaaacgctaaaactaacgaacgatacgcaatataacctaaacgcgaacgtctaaaaccgcaacgataatctaacctataaaataaaacgcgacatacaaactaaacgcgtataaaccaactattatcacgcttacccgacacatacgacgtttaataactacaaacaatcaaatatcgatcgcg

SEQ ID NO: 39163 - DNA, 560 bp, Artificial Sequence
  chemically treated genomic DNA (Homo sapiens) CpG-island No: 39163
tgagttgtttggatcgggttagtaaagttataggtattttttagggtattagtcgttaatatcgcgaaattttttttttttacgtttaggtcgcgtaggtttgtcgggatatttatttttttcgttagtttacggatggcgttaatgtaggttttagtatttttcgcgtcgtttttatttgttacgtttacgtttattgtagcggtatagttacgttgacgtgtttataggcgggcggcgtaagttgttggaaggtgaattgaaagacggttattatttcgaatcgacgattttgtttggttagaataatatgcgggtgttttaggaggagatttttggttcggtgttggcggtgattatttttaaaacgatggaagaagcgttggagttggcgaacgatacgtaatatggtttgggcgcgggcgtttggagtcgtaacggtaatttggtttataagatggggcgcggtatataggttgggcgcgtgtggattaattgttattacgtttattcggtatatgcggcgtttggtggttataaataattaggtatcggtcgcg

SEQ ID NO: 39164 - DNA, 560 bp, Artificial Sequence
  chemically treated genomic DNA (Homo sapiens) CpG-island No: 39164
cgcgaccgatacctaattatttataaccaccaaacgccgcatataccgaataaacgtaataacaattaatccacacgcgcccaacctatataccgcgccccatcttataaaccaaattaccgttacgactccaaacgcccgcgcccaaaccatattacgtatcgttcgccaactccaacgcttcttccatcgttttaaaaataatcaccgccaacaccgaaccaaaaatctcctcctaaaacacccgcatattattctaaccaaacaaaatcgtcgattcgaaataataaccgtctttcaattcaccttccaacaacttacgccgcccgcctataaacacgtcaacgtaactataccgctacaataaacgtaaacgtaacaaataaaaacgacgcgaaaaatactaaaacctacattaacgccatccgtaaactaacgaaaaaaataaatatcccgacaaacctacgcgacctaaacgtaaaaaaaaaaaatttcgcgatattaacgactaataccctaaaaaatacctataactttactaacccgatccaaacaactca

SEQ ID NO: 39165 - DNA, 796 bp, Artificial Sequence
  chemically treated genomic DNA (Homo sapiens) CpG-island No: 39165
cgaaacgggtcgtttcgttttatattttttttcgggtgtttgggttttttcggaataaagtgattttttatttgttcgtaggtaggtggagttcgttttacgcggtacgcgttttttttttttatagtcgcgtgtagacgcggatttttagggatattgcggacgcgagaaaggatacgttttttcgcgggagtataagtttatcgtatagaattcgcgcgttttttttcgaacgaacgcgtacgcgcgcgtagggggcgggtttttttttcgatatttattgagcgttcggtttttttattttattttatcgaatttcggtcgtttaggtttcgttttcgcgacgggtcgtcgggaggaggcgatcggaagttatttaaagtagagatcgaggtgataggcgagttggttggattcggagcgcggtcgaggttttttgcgttcgcggcggcggaatggttcgtgcgcggttcgtcgcgtcgcggttttgtggtttttagacgtcggttttcgttttcggcgttgattttcggcgcgggtattgttttttattcggtttttgtcgttcgtttttttaggttttcgtttaggtaaagggtttcgggagggtattgaggggttgaagaattttagcggggagtgcgagcgtcggtttcgcggtttcggtttcggtttcggtttcgcgtcggtagtgtgcggggttttcgcggatcggggtgattgattttgagattgttttttgtatcgaatttattcgggtttcgttagtatgaagatggaattggtttatattttt

SEQ ID NO: 39166 - DNA, 796 bp, Artificial Sequence
  chemically treated genomic DNA (Homo sapiens) CpG-island No: 39166
aaaaatataaaccaattccatcttcatactaacgaaacccgaataaattcgatacaaaaaacaatctcaaaatcaatcaccccgatccgcgaaaaccccgcacactaccgacgcgaaaccgaaaccgaaaccgaaaccgcgaaaccgacgctcgcactccccgctaaaattcttcaacccctcaataccctcccgaaaccctttacctaaacgaaaacctaaaaaaacgaacgacaaaaaccgaataaaaaacaatacccgcgccgaaaatcaacgccgaaaacgaaaaccgacgtctaaaaaccacaaaaccgcgacgcgacgaaccgcgcacgaaccattccgccgccgcgaacgcaaaaaacctcgaccgcgctccgaatccaaccaactcgcctatcacctcgatctctactttaaataacttccgatcgcctcctcccgacgacccgtcgcgaaaacgaaacctaaacgaccgaaattcgataaaataaaataaaaaaaccgaacgctcaataaatatcgaaaaaaaaacccgccccctacgcgcgcgtacgcgttcgttcgaaaaaaaacgcgcgaattctatacgataaacttatactcccgcgaaaaaacgtatcctttctcgcgtccgcaatatccctaaaaatccgcgtctacacgcgactataaaaaaaaaaaacgcgtaccgcgtaaaacgaactccacctacctacgaacaaataaaaaatcactttattccgaaaaaacccaaacacccgaaaaaaaatataaaacgaaacgacccgtttcg

SEQ ID NO: 39167 - DNA, 796 bp, Artificial Sequence
  chemically treated genomic DNA (Homo sapiens) CpG-island No: 39167
agaagtgtaaattaattttatttttatgttgacgggattcgagtgaattcggtataaagggtagttttaaaattaattatttcgattcgcgagagtttcgtatattgtcggcgcggggtcggggtcggggtcggagtcgcgaggtcggcgttcgtatttttcgttagggttttttagttttttagtgttttttcggagttttttatttgaacgggagtttgagagaacggacgataggagtcgagtggaaagtagtgttcgcgtcggagattagcgtcgagggcgggagtcgacgtttagggattatagagtcgcgacgcggcgagtcgcgtacgggttatttcgtcgtcgcgaacgtagaaagtttcgatcgcgtttcgagtttagttagttcgtttgttatttcgatttttgttttaagtggttttcggtcgttttttttcgacggttcgtcgcggaggcggagtttgggcggtcggagttcggtggggtggggtgaggaggtcgggcgtttagtgggtgtcgggaagaagattcgttttttgcgcgcgcgtgcgcgttcgttcgaggggaggcgcgcgagttttgtgcggtggatttatgttttcgcgagggggcgtgttttttttcgcgttcgtagtgtttttgagggttcgcgtttatacgcggttgtgaggaaggaaggcgcgtgtcgcgtgggacgggttttatttgtttgcggatagatggagggttattttgtttcgagaagatttagatattcgagggaggatgtgaaacggaacgattcgtttcg

SEQ ID NO: 39168 - DNA, 796 bp, Artificial Sequence
  chemically treated genomic DNA (Homo sapiens) CpG-island No: 39168
cgaaacgaatcgttccgtttcacatcctccctcgaatatctaaatcttctcgaaacaaaataaccctccatctatccgcaaacaaataaaacccgtcccacgcgacacgcgccttccttcctcacaaccgcgtataaacgcgaaccctcaaaaacactacgaacgcgaaaaaaaacacgccccctcgcgaaaacataaatccaccgcacaaaactcgcgcgcctcccctcgaacgaacgcgcacgcgcgcgcaaaaaacgaatcttcttcccgacacccactaaacgcccgacctcctcaccccaccccaccgaactccgaccgcccaaactccgcctccgcgacgaaccgtcgaaaaaaaacgaccgaaaaccacttaaaacaaaaatcgaaataacaaacgaactaactaaactcgaaacgcgatcgaaactttctacgttcgcgacgacgaaataacccgtacgcgactcgccgcgtcgcgactctataatccctaaacgtcgactcccgccctcgacgctaatctccgacgcgaacactactttccactcgactcctatcgtccgttctctcaaactcccgttcaaataaaaaactccgaaaaaacactaaaaaactaaaaaaccctaacgaaaaatacgaacgccgacctcgcgactccgaccccgaccccgaccccgcgccgacaatatacgaaactctcgcgaatcgaaataattaattttaaaactaccctttataccgaattcactcgaatcccgtcaacataaaaataaaattaatttacacttct

SEQ ID NO: 39169 - DNA, 828 bp, Artificial Sequence
  chemically treated genomic DNA (Homo sapiens) CpG-island No: 39169
aggcgtcgaaggatttagttggggtcgtaggcgtttgtttttttttcgttcgttagggtgggggcgcgtttatgcggtttttttcgcgggtcgatttcgggtgttttgaggcgtttaggagttttttttagatttcgggggggagggtacggtagttacgggagtttttcggttatttcgcgtttcgggttgtagtttagaagtttggaagatgtttttatattaattttgagagcgtataagttttcgttttttttttcgtcgtcgcgggaagcgttcgtcgtttttttttcgcgtttcgcggtttagttttgcgagtttttaagattcgttggacgtttttcgggaggtgagttgagggggtaaagaagaattagagagagaaggcgtcgcgagtagtttttgggatgtagggaggtcggggcgggtcgttggttcgaaggaggttggataggagttggggggcgtttaggcgtttgttgaggggaaggcgggggcggggacgttcgggaatattcggaattgtagagtcgggcggcgttttagttgtattgcgcggagttggcgcggttcgggattaggagttgagtaaatcgtcgcggttaataggaggcgttattcggattcgggttcggcgtcggggtgtcgcgcggcggcgggcgggtaggttttggagcggtagttttttcggaaagtgtttttggtcgggagtgtcgtagaattttagcgttacgaggtgaggggtgtcgcggtgtgtcgtttgtcgttggagatcggaggatgtgttttttttatttttatttttttgttatgaaaattaattgagga

SEQ ID NO: 39170 - DNA, 828 bp, Artificial Sequence
  chemically treated genomic DNA (Homo sapiens) CpG-island No: 39170
tcctcaattaattttcataacaaaaaaataaaaataaaaaaaacacatcctccgatctccaacgacaaacgacacaccgcgacacccctcacctcgtaacgctaaaattctacgacactcccgaccaaaaacactttccgaaaaaactaccgctccaaaacctacccgcccgccgccgcgcgacaccccgacgccgaacccgaatccgaataacgcctcctattaaccgcgacgatttactcaactcctaatcccgaaccgcgccaactccgcgcaatacaactaaaacgccgcccgactctacaattccgaatattcccgaacgtccccgcccccgccttcccctcaacaaacgcctaaacgccccccaactcctatccaacctccttcgaaccaacgacccgccccgacctccctacatcccaaaaactactcgcgacgccttctctctctaattcttctttaccccctcaactcacctcccgaaaaacgtccaacgaatcttaaaaactcgcaaaactaaaccgcgaaacgcgaaaaaaaaacgacgaacgcttcccgcgacgacgaaaaaaaaaacgaaaacttatacgctctcaaaattaatataaaaacatcttccaaacttctaaactacaacccgaaacgcgaaataaccgaaaaactcccgtaactaccgtaccctcccccccgaaatctaaaaaaaactcctaaacgcctcaaaacacccgaaatcgacccgcgaaaaaaaccgcataaacgcgcccccaccctaacgaacgaaaaaaaaacaaacgcctacgaccccaactaaatccttcgacgcct

SEQ ID NO: 39171 - DNA, 828 bp, Artificial Sequence
  chemically treated genomic DNA (Homo sapiens) CpG-island No: 39171
tttttaattagtttttataatagaaaaataaagatgagaagaatatatttttcggtttttagcggtaggcgatatatcgcgatattttttatttcgtgacgttggggttttgcggtattttcggttaaaagtatttttcgaaaaaattgtcgttttaaagtttgttcgttcgtcgtcgcgcgatatttcggcgtcgagttcgggttcgagtgacgttttttgttggtcgcggcggtttgtttagtttttggtttcgggtcgcgttaatttcgcgtagtgtagttgaggcgtcgttcggttttgtaatttcgggtgttttcgggcgttttcgttttcgttttttttttagtaggcgtttgggcgttttttaatttttgtttagtttttttcggattaacgattcgtttcggtttttttgtattttagagattattcgcggcgttttttttttttaatttttttttatttttttagtttatttttcgaggagcgtttaacgggttttgggggttcgtagaattgagtcgcgaagcgcgggggaaaggcggcgagcgtttttcgcggcggcggggaggaagacgaagatttgtgcgtttttaaagttaatgtgaaaatattttttaaatttttgggttgtagttcgaaacgcggggtagtcggaaggttttcgtagttgtcgtgttttttttttcggggtttgggaagggtttttaggcgttttagagtattcggggtcggttcgcgggggaggtcgtatagacgcgtttttattttgacgaacggggaaggggtaggcgtttgcgattttaattaaatttttcggcgttt

SEQ ID NO: 39172 - DNA, 828 bp, Artificial Sequence
  chemically treated genomic DNA (Homo sapiens) CpG-island No: 39172
aaacgccgaaaaatttaattaaaatcgcaaacgcctaccccttccccgttcgtcaaaataaaaacgcgtctatacgacctcccccgcgaaccgaccccgaatactctaaaacgcctaaaaacccttcccaaaccccgaaaaaaaaaacacgacaactacgaaaaccttccgactaccccgcgtttcgaactacaacccaaaaatttaaaaaatattttcacattaactttaaaaacgcacaaatcttcgtcttcctccccgccgccgcgaaaaacgctcgccgcctttcccccgcgcttcgcgactcaattctacgaacccccaaaacccgttaaacgctcctcgaaaaataaactaaaaaaataaaaaaaaattaaaaaaaaaaaacgccgcgaataatctctaaaatacaaaaaaaccgaaacgaatcgttaatccgaaaaaaactaaacaaaaattaaaaaacgcccaaacgcctactaaaaaaaaaacgaaaacgaaaacgcccgaaaacacccgaaattacaaaaccgaacgacgcctcaactacactacgcgaaattaacgcgacccgaaaccaaaaactaaacaaaccgccgcgaccaacaaaaaacgtcactcgaacccgaactcgacgccgaaatatcgcgcgacgacgaacgaacaaactttaaaacgacaattttttcgaaaaatacttttaaccgaaaataccgcaaaaccccaacgtcacgaaataaaaaatatcgcgatatatcgcctaccgctaaaaaccgaaaaatatattcttctcatctttatttttctattataaaaactaattaaaaa

SEQ ID NO: 39173 - DNA, 680 bp, Artificial Sequence
  chemically treated genomic DNA (Homo sapiens) CpG-island No: 39173
aaacgggtcgcgaatcgtagtattatgttggttaagaagattattattaaggacggaggtacggtgagttgagtttcgcgtcggcgagcgtttttcggggtttttattcggttttttttttagatttttatattgtcgtttttaggcgtttcggtgtttttttttttttttttattttgttcgcgttgtcggtgtttcggggtcgcggattcgtatgtcgtcgtttcgggaatcgtttttcgttgttcgggtttgcggttttcggggttcgttttttttttttttcgtatttgtcgttttttgttttggtcgtttttgtaggttttgcggtttcgaattttacgtgcgtttttgtcgcggggaggaatgtgcggggttttttcggcggttcgttcgtcgcgtttttcgtcgtcgtagtttcgtttcgttttcgtcgttaggtttcgcggagtcgtcgttgcgtttgttaaggggttgggaattatttttgtttttttatatgttgttaacggggtggcgtttggcgcggggatttcgttgcggtttcgtagtacgttcgttttttgtttttacgtttttttgcgtcggtgtttcggttttgggttgtttatagtaaattttgatcggagatgggttttttttatttttcggagtcggaagtatgacggtagatatttggg

SEQ ID NO: 39174 - DNA, 680 bp, Artificial Sequence
  chemically treated genomic DNA (Homo sapiens) CpG-island No: 39174
cccaaatatctaccgtcatacttccgactccgaaaaataaaaaaaacccatctccgatcaaaatttactataaacaacccaaaaccgaaacaccgacgcaaaaaaacgtaaaaacaaaaaacgaacgtactacgaaaccgcaacgaaatccccgcgccaaacgccaccccgttaacaacatataaaaaaacaaaaataattcccaaccccttaacaaacgcaacgacgactccgcgaaacctaacgacgaaaacgaaacgaaactacgacgacgaaaaacgcgacgaacgaaccgccgaaaaaaccccgcacattcctccccgcgacaaaaacgcacgtaaaattcgaaaccgcaaaacctacaaaaacgaccaaaacaaaaaacgacaaatacgaaaaaaaaaaaaaacgaaccccgaaaaccgcaaacccgaacaacgaaaaacgattcccgaaacgacgacatacgaatccgcgaccccgaaacaccgacaacgcgaacaaaataaaaaaaaaaaaaaaaacaccgaaacgcctaaaaacgacaatataaaaatctaaaaaaaaaaccgaataaaaaccccgaaaaacgctcgccgacgcgaaactcaactcaccgtacctccgtccttaataataatcttcttaaccaacataatactacgattcgcgacccgttt

SEQ ID NO: 39175 - DNA, 680 bp, Artificial Sequence
  chemically treated genomic DNA (Homo sapiens) CpG-island No: 39175
tttaggtgtttgtcgttatgttttcgatttcgggaagtgagggaagtttattttcggttagggtttattgtaagtagtttagagtcggagtatcgacgtagagagacgtggaaatagaaagcgaacgtattacggggtcgtagcgggattttcgcgttagacgttatttcgttagtaatatatgggagagtagggatggtttttagttttttgataagcgtagcgacggtttcgcggggtttggcggcgaaggcgaggcgaggttgcggcgacgaggggcgcggcgggcgggtcgtcgggggagtttcgtatattttttttcgcggtagaggcgtacgtggggttcgaggtcgtagggtttgtagaggcggttagagtagagggcggtaggtgcgggaaagaaagaggacgggtttcggaggtcgtaagttcgagtagcggaggacgattttcggagcggcggtatgcgggttcgcgatttcgaggtatcggtagcgcggatagggtgggggaagggagggaggtatcgggacgtttagagacggtagtgtgggggtttgaaggagagatcggatgggggtttcgagggacgttcgtcggcgcggaatttagtttatcgtgttttcgtttttaatgatgatttttttggttagtatgatattgcggttcgcggttcgttt

SEQ ID NO: 39176 - DNA, 680 bp, Artificial Sequence
  chemically treated genomic DNA (Homo sapiens) CpG-island No: 39176
aaacgaaccgcgaaccgcaatatcatactaaccaaaaaaatcatcattaaaaacgaaaacacgataaactaaattccgcgccgacgaacgtccctcgaaacccccatccgatctctccttcaaacccccacactaccgtctctaaacgtcccgatacctccctcccttcccccaccctatccgcgctaccgatacctcgaaatcgcgaacccgcataccgccgctccgaaaatcgtcctccgctactcgaacttacgacctccgaaacccgtcctctttctttcccgcacctaccgccctctactctaaccgcctctacaaaccctacgacctcgaaccccacgtacgcctctaccgcgaaaaaaaatatacgaaactcccccgacgacccgcccgccgcgcccctcgtcgccgcaacctcgcctcgccttcgccgccaaaccccgcgaaaccgtcgctacgcttatcaaaaaactaaaaaccatccctactctcccatatattactaacgaaataacgtctaacgcgaaaatcccgctacgaccccgtaatacgttcgctttctatttccacgtctctctacgtcgatactccgactctaaactacttacaataaaccctaaccgaaaataaacttccctcacttcccgaaatcgaaaacataacgacaaacacctaaa

SEQ ID NO: 39177 - DNA, 702 bp, Artificial Sequence
  chemically treated genomic DNA (Homo sapiens) CpG-island No: 39177
ttaaaggatgtaatcgaaaggtatttgttacgtttgcgaatacggtcgtttttttttttcgttttttttttatcgaggtttttcggagggttacggtcgagttcgagtttggggttgtcgggttcgtcgcgttcgcggtttttcggttttgaggtttttcgaaagcgtcggggatatagtttttcgttagttgttgtcgttgttgtaggcggcgattgcgttttcggaggtagtacgcgaattaggcggcgtagttttggaagatgagtagttttattacgttgattaatagttttaggacgtcgacgatgagtattagttcggggttatcgatgcgttcgggtcgggttaggcgtagtacggtttttacgaagatggtgaagtagagcgcggtgaggaagatcgcgttgtttagcgcgtttattatttcggcgcgggcgtagtcgtaggtggcgttgaagtttcgggtggggttcgggcgatgtagtcggcgtttaggtttacgtatagcgagattaggtcggagagtatgttgaaggagtcggagagtagcgcgatggagttgtttaggtagtcggagattagtttcgttacgaagaaggcgacggtgagtattagtatgaagagtagtcggtacgttttgttagagtagcggtttatttcgttattagtttcgcgttcgcgtcgtttaggggagcgtag

SEQ ID NO: 39178 - DNA, 702 bp, Artificial Sequence
  chemically treated genomic DNA (Homo sapiens) CpG-island No: 39178
ctacgctcccctaaacgacgcgaacgcgaaactaataacgaaataaaccgctactctaacaaaacgtaccgactactcttcatactaatactcaccgtcgccttcttcgtaacgaaactaatctccgactacctaaacaactccatcgcgctactctccgactccttcaacatactctccgacctaatctcgctatacgtaaacctaaacgccgactacatcgcccgaaccccacccgaaacttcaacgccacctacgactacgcccgcgccgaaataataaacgcgctaaacaacgcgatcttcctcaccgcgctctacttcaccatcttcgtaaaaaccgtactacgcctaacccgacccgaacgcatcgataaccccgaactaatactcatcgtcgacgtcctaaaactattaatcaacgtaataaaactactcatcttccaaaactacgccgcctaattcgcgtactacctccgaaaacgcaatcgccgcctacaacaacgacaacaactaacgaaaaactatatccccgacgctttcgaaaaacctcaaaaccgaaaaaccgcgaacgcgacgaacccgacaaccccaaactcgaactcgaccgtaaccctccgaaaaacctcgataaaaaaaaaacgaaaaaaaaaaacgaccgtattcgcaaacgtaacaaatacctttcgattacatcctttaa

SEQ ID NO: 39179 - DNA, 702 bp, Artificial Sequence
  chemically treated genomic DNA (Homo sapiens) CpG-island No: 39179
ttgcgtttttttgggcggcgcgggcgcggggttggtggcgagatgggtcgttattttggtaagacgtgtcggttgttttttatgttggtgtttatcgtcgtttttttcgtggcggagttggttttcggttatttgggtaattttatcgcgttgtttttcgatttttttaatatgtttttcgatttgatttcgttgtgcgtgggtttgagcgtcggttatatcgttcgggttttattcggggttttagcgttatttacggttacgttcgcgtcgaggtggtgggcgcgttgagtaacgcggttttttttatcgcgttttgttttattattttcgtggaggtcgtgttgcgtttggttcggttcgagcgtatcgatgatttcgagttggtgtttatcgtcggcgttttggggttgttggttaacgtggtggggttgtttattttttaggattgcgtcgtttggttcgcgtgttgttttcggggacgtagtcgtcgtttgtagtagcggtagtagttggcggagggttgtgttttcggcgttttcggggggttttagggtcggaggatcgcgggcgcggcggattcgatagttttaggttcggattcggtcgtaatttttcgggggatttcggtggaaaggaagcgggagaagggggcgatcgtgttcgtaaacgtagtaggtgtttttcggttgtattttttgg

SEQ ID NO: 39180 - DNA, 702 bp, Artificial Sequence
  chemically treated genomic DNA (Homo sapiens) CpG-island No: 39180
ccaaaaaatacaaccgaaaaacacctactacgtttacgaacacgatcgcccccttctcccgcttcctttccaccgaaatcccccgaaaaattacgaccgaatccgaacctaaaactatcgaatccgccgcgcccgcgatcctccgaccctaaaaccccccgaaaacgccgaaaacacaaccctccgccaactactaccgctactacaaacgacgactacgtccccgaaaacaacacgcgaaccaaacgacgcaatcctaaaaaataaacaaccccaccacgttaaccaacaaccccaaaacgccgacgataaacaccaactcgaaatcatcgatacgctcgaaccgaaccaaacgcaacacgacctccacgaaaataataaaacaaaacgcgataaaaaaaaccgcgttactcaacgcgcccaccacctcgacgcgaacgtaaccgtaaataacgctaaaaccccgaataaaacccgaacgatataaccgacgctcaaacccacgcacaacgaaatcaaatcgaaaaacatattaaaaaaatcgaaaaacaacgcgataaaattacccaaataaccgaaaaccaactccgccacgaaaaaaacgacgataaacaccaacataaaaaacaaccgacacgtcttaccaaaataacgacccatctcgccaccaaccccgcgcccgcgccgcccaaaaaaacgcaa

SEQ ID NO: 39181 - DNA, 729 bp, Artificial Sequence
  chemically treated genomic DNA (Homo sapiens) CpG-island No: 39181
tggtcgtgcgattttgcgttttagcgcgtttgcgtcggcgttttttgttcgtttcgattggttgagggttgcgtatgtttcgaggttcgtcgcggttcggcgttcgttcgcgttttttttttattttatttttttagcggttttcggagtcggttcgaaagatgtcggcggcggtgattggttgcggcgggttcgtttttcgggtttttcgttttcgtcgtcgttattacggagtttttagtggtgagtgtgcggagcgtcgaggttcgcgtttcgtcgttgttttcgtcgtcggggcgggcgtcgcggtgtttttgtcgagcgtgagtttcgaattgttatcgcgtcgagttttagttttattcgtcggtgttcgcggttcgagtttttttcgtttcgttggcggttcgcgttttttttcgtcgtgcgcgttcgtcgttgtggtttgtagttatttcgtttcgttgttttgttttcgttgtttttgtcgtttttttcgcggttttatgcgggcggggttgtcggttgtcgttttgatgtttcgcgacgtcggttttgagtttcgttttttcggtgggaaacgtagaattggttattcgttattttaggcggtggggtttgaatgagagcggtgtttcggtaggtcgttagaaagttatagtcgtttatttgagcgtttgtaagagatggaggtaggagtggtgaggtgagagttttagatttgagggt

SEQ ID NO: 39182 - DNA, 729 bp, Artificial Sequence
  chemically treated genomic DNA (Homo sapiens) CpG-island No: 39182
accctcaaatctaaaactctcacctcaccactcctacctccatctcttacaaacgctcaaataaacgactataactttctaacgacctaccgaaacaccgctctcattcaaaccccaccgcctaaaataacgaataaccaattctacgtttcccaccgaaaaaacgaaactcaaaaccgacgtcgcgaaacatcaaaacgacaaccgacaaccccgcccgcataaaaccgcgaaaaaaacgacaaaaacaacgaaaacaaaacaacgaaacgaaataactacaaaccacaacgacgaacgcgcacgacgaaaaaaaacgcgaaccgccaacgaaacgaaaaaaactcgaaccgcgaacaccgacgaataaaactaaaactcgacgcgataacaattcgaaactcacgctcgacaaaaacaccgcgacgcccgccccgacgacgaaaacaacgacgaaacgcgaacctcgacgctccgcacactcaccactaaaaactccgtaataacgacgacgaaaacgaaaaacccgaaaaacgaacccgccgcaaccaatcaccgccgccgacatctttcgaaccgactccgaaaaccgctaaaaaaataaaataaaaaaaaaacgcgaacgaacgccgaaccgcgacgaacctcgaaacatacgcaaccctcaaccaatcgaaacgaacaaaaaacgccgacgcaaacgcgctaaaacgcaaaatcgcacgacca

SEQ ID NO: 39183 - DNA, 729 bp, Artificial Sequence
  chemically treated genomic DNA (Homo sapiens) CpG-island No: 39183
atttttagatttggggtttttattttattatttttgtttttattttttataaacgtttagatgggcgattgtaattttttgacgatttatcgaggtatcgtttttatttaaattttatcgtttaaggtggcgagtaattagttttacgttttttatcgggggagcgagatttaaggtcggcgtcgcggagtattaaagcgatagtcgatagtttcgttcgtataaggtcgcgggaaggacggtaagagtagcggagataaagtagcgaggcgaggtagttataggttatagcggcgaacgcgtacggcgggggagagcgcgggtcgttagcgaggcggggaaagttcggatcgcggatatcgacggatgaggttggggttcggcgcggtgatagttcggggtttacgttcggtagggatatcgcggcgttcgtttcggcgacggaagtagcggcggaacgcgagtttcggcgtttcgtatatttattattgggagtttcgtaatggcggcggcgggggcggagaattcggggggcgggttcgtcgtagttagttatcgtcgtcggtatttttcgaatcggtttcgaaaatcgttgagggagtggggtgaggggagggcgcgggcggacgtcggatcgcggcgggtttcggagtatgcgtagtttttagttaatcggggcgggtagaggacgtcgacgtaggcgcgttgggacgtagggtcgtacggtta

SEQ ID NO: 39184 - DNA, 729 bp, Artificial Sequence
  chemically treated genomic DNA (Homo sapiens) CpG-island No: 39184
taaccgtacgaccctacgtcccaacgcgcctacgtcgacgtcctctacccgccccgattaactaaaaactacgcatactccgaaacccgccgcgatccgacgtccgcccgcgccctcccctcaccccactccctcaacgattttcgaaaccgattcgaaaaataccgacgacgataactaactacgacgaacccgccccccgaattctccgcccccgccgccgccattacgaaactcccaataataaatatacgaaacgccgaaactcgcgttccgccgctacttccgtcgccgaaacgaacgccgcgatatccctaccgaacgtaaaccccgaactatcaccgcgccgaaccccaacctcatccgtcgatatccgcgatccgaactttccccgcctcgctaacgacccgcgctctcccccgccgtacgcgttcgccgctataacctataactacctcgcctcgctactttatctccgctactcttaccgtccttcccgcgaccttatacgaacgaaactatcgactatcgctttaatactccgcgacgccgaccttaaatctcgctcccccgataaaaaacgtaaaactaattactcgccaccttaaacgataaaatttaaataaaaacgatacctcgataaatcgtcaaaaaattacaatcgcccatctaaacgtttataaaaaataaaaacaaaaataataaaataaaaaccccaaatctaaaaat

SEQ ID NO: 39185 - DNA, 609 bp, Artificial Sequence
  chemically treated genomic DNA (Homo sapiens) CpG-island No: 39185
ttttcggtttttcgtttttcgaagtttttttcgggataaggaagaggaagaggaggagaggtcggggacgagttcgtttttagttttaggtcggttcgttgttaggtgggagtcgaggagggggtcgcgggggggttttgtatatattcgcgggatgaaggttttcggtttgatcgtcggtagcgggtcgtttttgggttaggttgtagttcgttcgttattttttgtttttttttttttattgttaaagtttttttttttttgtttcgttttcgtgtcgtattattcgttttttttttgtaggttaaatcggggtgaagtttttgttcggtagtcggacgtatatttttcgattttcgtttggtttcgcgtttttttttttttatttttttttgttcggacgtgattgggttttcgttttatatacgttttattttttaagttttgtggtaaaagcgattttttcggcgtttcgtttgtagtaatgggaaatatttgtgagtcgagcggagtcgtcggttaggggaattgggggcgcgattttagtattatttgtgtgggaggagatcggggtaaaagtggaaaaggtaaagttttggggcgttattt

SEQ ID NO: 39186 - DNA, 609 bp, Artificial Sequence
  chemically treated genomic DNA (Homo sapiens) CpG-island No: 39186
aaataacgccccaaaactttaccttttccacttttaccccgatctcctcccacacaaataatactaaaatcgcgcccccaattcccctaaccgacgactccgctcgactcacaaatatttcccattactacaaacgaaacgccgaaaaaatcgcttttaccacaaaacttaaaaaataaaacgtatataaaacgaaaacccaatcacgtccgaacaaaaaaaaataaaaaaaaaaaaacgcgaaaccaaacgaaaatcgaaaaatatacgtccgactaccgaacaaaaacttcaccccgatttaacctacaaaaaaaaaacgaataatacgacacgaaaacgaaacaaaaaaaaaaaaactttaacaataaaaaaaaaaaaacaaaaaataacgaacgaactacaacctaacccaaaaacgacccgctaccgacgatcaaaccgaaaaccttcatcccgcgaatatatacaaaacccccccgcgaccccctcctcgactcccacctaacaacgaaccgacctaaaactaaaaacgaactcgtccccgacctctcctcctcttcctcttccttatcccgaaaaaaacttcgaaaaacgaaaaaccgaaaa

SEQ ID NO: 39187 - DNA, 609 bp, Artificial Sequence
  chemically treated genomic DNA (Homo sapiens) CpG-island No: 39187
gggtgacgttttaaagttttattttttttatttttgtttcgatttttttttatataagtggtgttgggatcgcgtttttaatttttttggtcgacggtttcgttcggtttataagtgttttttattattgtaggcgggacgtcggggaaatcgtttttgttatagaatttggagagtagagcgtgtgtggaacgggaatttaattacgttcgggtaggggaaagtgggaaaggaagagcgcggagttaggcggggatcgggggatatgcgttcggttgtcgggtaagaattttatttcgatttaatttgtagaggagaggcgagtagtgcggtacgggaacggggtaaggaggaggaaattttagtaatggaggaaggagaatagaaagtggcgagcgaattgtagtttggtttaagagcggttcgttgtcggcggttaggtcgggagtttttatttcgcgaatatgtgtagggttttttcgcgatttttttttcgatttttatttggtagcggatcggtttggagttggaggcgggttcgttttcggttttttttttttttttttttttttgtttcgggaaggatttcggggagcgaagaatcgggag

SEQ ID NO: 39188 - DNA, 609 bp, Artificial Sequence
  chemically treated genomic DNA (Homo sapiens) CpG-island No: 39188
ctcccgattcttcgctccccgaaatccttcccgaaacaaaaaaaaaaaaaaaaaaaaaaaaccgaaaacgaacccgcctccaactccaaaccgatccgctaccaaataaaaatcgaaaaaaaaatcgcgaaaaaaccctacacatattcgcgaaataaaaactcccgacctaaccgccgacaacgaaccgctcttaaaccaaactacaattcgctcgccactttctattctccttcctccattactaaaatttcctcctccttaccccgttcccgtaccgcactactcgcctctcctctacaaattaaatcgaaataaaattcttacccgacaaccgaacgcatatcccccgatccccgcctaactccgcgctcttcctttcccactttcccctacccgaacgtaattaaattcccgttccacacacgctctactctccaaattctataacaaaaacgatttccccgacgtcccgcctacaataataaaaaacacttataaaccgaacgaaaccgtcgaccaaaaaaattaaaaacgcgatcccaacaccacttatataaaaaaaaatcgaaacaaaaataaaaaaaataaaactttaaaacgtcaccc

SEQ ID NO: 39189 - DNA, 516 bp, Artificial Sequence
  chemically treated genomic DNA (Homo sapiens) CpG-island No: 39189
tttttcgcgtttacgtgcgaggaggtagatcgttcgattcgtgagtagtagtcgtgagggatcggcggttattcgcgcgtggtaggcgtagggcggtttcgtttatttcgggtagtaaacgagaggtggatcgtagtgttcggggtttttaacgttagcggttttcgaattattaaggcggtttcgcgcgttaattggagttgtcgaatggttttagcggagtttcggttttttttatcggtaacgttattcgttttaggttcggaatttttttttttgcgttgttgtagttcgtcgtataatttttcgacgttttttagtttatgcgggtattttggatttcgttatcgtagcgtttttttagcgatacggataattcgtaatttttgtttcgtcgttttttatatatttttatttttttttttttaaatgcgttattatagtttagtttttatttttttcggtagtattttcgtttcggtttatcgggcgtataattagtattttattcgattt

SEQ ID NO: 39190 - DNA, 516 bp, Artificial Sequence
  chemically treated genomic DNA (Homo sapiens) CpG-island No: 39190
aaatcgaataaaatactaattatacgcccgataaaccgaaacgaaaatactaccgaaaaaaataaaaactaaactataataacgcatttaaaaaaaaaaaaataaaaatatataaaaaacgacgaaacaaaaattacgaattatccgtatcgctaaaaaaacgctacgataacgaaatccaaaatacccgcataaactaaaaaacgtcgaaaaattatacgacgaactacaacaacgcaaaaaaaaaaattccgaacctaaaacgaataacgttaccgataaaaaaaaccgaaactccgctaaaaccattcgacaactccaattaacgcgcgaaaccgccttaataattcgaaaaccgctaacgttaaaaaccccgaacactacgatccacctctcgtttactacccgaaataaacgaaaccgccctacgcctaccacgcgcgaataaccgccgatccctcacgactactactcacgaatcgaacgatctacctcctcgcacgtaaacgcgaaaaa

SEQ ID NO: 39191 - DNA, 516 bp, Artificial Sequence
  chemically treated genomic DNA (Homo sapiens) CpG-island No: 39191
gggtcgggtggggtgttggttgtgcgttcggtgggtcggggcgagggtgttgtcggagggggtgggggttgggttgtggtggcgtatttgggaggaggggggtgggggtgtgtggggggcgacggggtaggggttgcggattgttcgtgtcgttgggggggcgttgcggtagcgaggtttagggtattcgtatgggttggggggcgtcgggagattgtgcggcgggttgtagtagcgtagggaagagggtttcgggtttggggcgaatggcgttgtcggtggggagagtcggggtttcgttgaagttattcggtagttttagttaacgcgcggggtcgttttggtggttcggaggtcgttggcgttgaaagtttcgggtattgcggtttatttttcgtttgttgttcgaaatgggcggggtcgttttgcgtttgttacgcgcgagtggtcgtcggttttttacggttgttgtttacgggtcgggcggtttgttttttcgtacgtgggcgcgaaggg

SEQ ID NO: 39192 - DNA, 516 bp, Artificial Sequence
  chemically treated genomic DNA (Homo sapiens) CpG-island No: 39192
cccttcgcgcccacgtacgaaaaaacaaaccgcccgacccgtaaacaacaaccgtaaaaaaccgacgaccactcgcgcgtaacaaacgcaaaacgaccccgcccatttcgaacaacaaacgaaaaataaaccgcaatacccgaaactttcaacgccaacgacctccgaaccaccaaaacgaccccgcgcgttaactaaaactaccgaataacttcaacgaaaccccgactctccccaccgacaacgccattcgccccaaacccgaaaccctcttccctacgctactacaacccgccgcacaatctcccgacgccccccaacccatacgaataccctaaacctcgctaccgcaacgcccccccaacgacacgaacaatccgcaacccctaccccgtcgccccccacacacccccacccccctcctcccaaatacgccaccacaacccaacccccaccccctccgacaacaccctcgccccgacccaccgaacgcacaaccaacaccccacccgaccc

SEQ ID NO: 39193 - DNA, 945 bp, Artificial Sequence
  chemically treated genomic DNA (Homo sapiens) CpG-island No: 39193
cgcgcgggtaaagattttcggggatgatatttcgcgcgtcgcggtttcgtgcgcgcggtttttcgtattcgcgggtcgttttatttttttttttgtattttaagagttcggtttggttttcgaggtcgggagttacgcggtatcgtagtttcgagggagaggacgttcgtaattaatacgtacgcgggtattaagagggtataggttagggcggcgagggtcgaatggggtcggggggtacgcggagttggattagaattagcgagggcgcgtagatattgaacggatgcgaaggtttcggacgcggagcggttcggggcgtcgtgcgtggggcgcgagcggaggttcgggcgttatttacggcggggagggcgggtggttgtttcgagtttagggagcgcgtatcggacggtaaagggtcggaggttcggaggcgcgggagagaagggtcgtttggtcgcgtcgtgacggcgagaagtttttgttagcgcgggagtcggtcgggagaatgcggtcgggttgtagggataggcgcgaggcggcgtcgtagttcgtagtgggtttcgtcgttcggtcggagcgcgcggcgatgtagtaattttagttcgtcgtggggtcgtttttttttcgatagtcgttcggttcggagtcgagagggttatagtagtttatagcggagagtcggggcgatcgtagtttttatttatcggttcgcggtttcgtcgtcggcgtcggggttgcgttttgagttttatggtttcgtcgcgtcgcggtcgttcggcgtattcgtttcgtattatatcgtacgtagcggcgcgagcgattttcgttttcggttcgtttacgggcgcggttacgttttttttcggcgggggggttcggtcggagtaggaggggggtttagtgtcggttttattaattagggttaatttacggggtcgtttt

SEQ ID NO: 39194 - DNA, 945 bp, Artificial Sequence
  chemically treated genomic DNA (Homo sapiens) CpG-island No: 39194
aaaacgaccccgtaaattaaccctaattaataaaaccgacactaaacccccctcctactccgaccgaacccccccgccgaaaaaaaacgtaaccgcgcccgtaaacgaaccgaaaacgaaaatcgctcgcgccgctacgtacgatataatacgaaacgaatacgccgaacgaccgcgacgcgacgaaaccataaaactcaaaacgcaaccccgacgccgacgacgaaaccgcgaaccgataaataaaaactacgatcgccccgactctccgctataaactactataaccctctcgactccgaaccgaacgactatcgaaaaaaaaacgaccccacgacgaactaaaattactacatcgccgcgcgctccgaccgaacgacgaaacccactacgaactacgacgccgcctcgcgcctatccctacaacccgaccgcattctcccgaccgactcccgcgctaacaaaaacttctcgccgtcacgacgcgaccaaacgacccttctctcccgcgcctccgaacctccgaccctttaccgtccgatacgcgctccctaaactcgaaacaaccacccgccctccccgccgtaaataacgcccgaacctccgctcgcgccccacgcacgacgccccgaaccgctccgcgtccgaaaccttcgcatccgttcaatatctacgcgccctcgctaattctaatccaactccgcgtaccccccgaccccattcgaccctcgccgccctaacctataccctcttaatacccgcgtacgtattaattacgaacgtcctctccctcgaaactacgataccgcgtaactcccgacctcgaaaaccaaaccgaactcttaaaatacaaaaaaaaaaataaaacgacccgcgaatacgaaaaaccgcgcgcacgaaaccgcgacgcgcgaaatatcatccccgaaaatctttacccgcgcg

SEQ ID NO: 39195 - DNA, 945 bp, Artificial Sequence
  chemically treated genomic DNA (Homo sapiens) CpG-island No: 39195
gaagcggtttcgtgagttggttttggttggtggagtcggtattgagttttttttttgtttcggtcgagttttttcgtcgggagggggcgtggtcgcgttcgtggacgggtcggaggcgagagtcgttcgcgtcgttgcgtgcggtgtggtgcgaggcgggtgcgtcgggcggtcgcggcgcggcgggattatggagtttagagcgtagtttcggcgtcggcggcgggatcgcggatcggtgagtgagggttgcggtcgtttcggtttttcgttgtaggttgttgtggttttttcggtttcgggtcgggcggttgtcgggggaggggcggttttacggcgaattgaagttgttgtatcgtcgcgcgtttcggtcgggcggcggggtttattgcgggttgcggcgtcgtttcgcgtttatttttgtagttcggtcgtattttttcggtcggttttcgcgttggtaggggtttttcgtcgttacggcgcggttaggcggtttttttttttcgcgttttcgggttttcggttttttgtcgttcggtgcgcgttttttggattcgggatagttattcgtttttttcgtcgtaagtggcgttcgggttttcgttcgcgttttacgtacgacgtttcgggtcgtttcgcgttcgggattttcgtattcgtttagtgtttgcgcgttttcgttggttttggtttagtttcgcgtgtttttcggttttattcggttttcgtcgttttggtttgtgtttttttggtgttcgcgtgcgtgttggttgcgggcgttttttttttcgaggttgcggtgtcgcgtggttttcggtttcggagattaggtcggatttttggagtgtaggggaggaggtggggcggttcgcgagtgcgggggatcgcgcgtacggagtcgcggcgcgcggggtattattttcgggggtttttattcgcgcg

SEQ ID NO: 39196 - DNA, 945 bp, Artificial Sequence
  chemically treated genomic DNA (Homo sapiens) CpG-island No: 39196
cgcgcgaataaaaacccccgaaaataataccccgcgcgccgcgactccgtacgcgcgatcccccgcactcgcgaaccgccccacctcctcccctacactccaaaaatccgacctaatctccgaaaccgaaaaccacgcgacaccgcaacctcgaaaaaaaaaacgcccgcaaccaacacgcacgcgaacaccaaaaaaacacaaaccaaaacgacgaaaaccgaataaaaccgaaaaacacgcgaaactaaaccaaaaccaacgaaaacgcgcaaacactaaacgaatacgaaaatcccgaacgcgaaacgacccgaaacgtcgtacgtaaaacgcgaacgaaaacccgaacgccacttacgacgaaaaaaacgaataactatcccgaatccaaaaaacgcgcaccgaacgacaaaaaaccgaaaacccgaaaacgcgaaaaaaaaaaaccgcctaaccgcgccgtaacgacgaaaaacccctaccaacgcgaaaaccgaccgaaaaaatacgaccgaactacaaaaataaacgcgaaacgacgccgcaacccgcaataaaccccgccgcccgaccgaaacgcgcgacgatacaacaacttcaattcgccgtaaaaccgcccctcccccgacaaccgcccgacccgaaaccgaaaaaaccacaacaacctacaacgaaaaaccgaaacgaccgcaaccctcactcaccgatccgcgatcccgccgccgacgccgaaactacgctctaaactccataatcccgccgcgccgcgaccgcccgacgcacccgcctcgcaccacaccgcacgcaacgacgcgaacgactctcgcctccgacccgtccacgaacgcgaccacgccccctcccgacgaaaaaactcgaccgaaacaaaaaaaaaactcaataccgactccaccaaccaaaaccaactcacgaaaccgcttc

SEQ ID NO: 39197 - DNA, 521 bp, Artificial Sequence
  chemically treated genomic DNA (Homo sapiens) CpG-island No: 39197
  misc_feature (414)..(414): n is either a, c, g or t
gtgggagtgcgggatcgggcggggcggcgtgggggatacggtgggtgtatggggggggtcgggtttcgttgggcggcggggcggtcgtttgtggtcggggggtgttggggtgggtggcggcggtttgcgcgtggcgttggcgggcgggggtggcgtcgggcgggggcgggtgtggcggggtgggggggggcgcggggcgggggggcggtgggggcgggggcgtgggcggtcggtttcggcggggttggggggtttttcggtcgggcgggggggggtcggcgtgcgggcggggggcgcgcggtgttcgcggttgcgggcgcggcgttgcgcgtgtggcgtttgtcggcgggggcgtcgcgcggtgatgcggcgtgtcggggggcgtgggggggcgcggcgcgcggcgcgcgcgtngggtgtgtcgtcggtgcgttgggttgtgggggtggggcgcgcgggtcggttcgttcgggtggggcgggcgtcggcggggggtgaagggcggggggtgtgagcggggg

SEQ ID NO: 39198 - DNA, 521 bp, Artificial Sequence
  chemically treated genomic DNA (Homo sapiens) CpG-island No: 39198
  misc_feature (108)..(108): n is either a, c, g or t
cccccgctcacaccccccgcccttcaccccccgccgacgcccgccccacccgaacgaaccgacccgcgcgccccacccccacaacccaacgcaccgacgacacacccnacgcgcgcgccgcgcgccgcgcccccccacgccccccgacacgccgcatcaccgcgcgacgcccccgccgacaaacgccacacgcgcaacgccgcgcccgcaaccgcgaacaccgcgcgccccccgcccgcacgccgacccccccccgcccgaccgaaaaaccccccaaccccgccgaaaccgaccgcccacgcccccgcccccaccgcccccccgccccgcgcccccccccaccccgccacacccgcccccgcccgacgccacccccgcccgccaacgccacgcgcaaaccgccgccacccaccccaacaccccccgaccacaaacgaccgccccgccgcccaacgaaacccgaccccccccatacacccaccgtatcccccacgccgccccgcccgatcccgcactcccac

SEQ ID NO: 39199 - DNA, 521 bp, Artificial Sequence
  chemically treated genomic DNA (Homo sapiens) CpG-island No: 39199
  misc_feature (108)..(108): n is either a, c, g or t
ttttcgtttatatttttcgttttttatttttcgtcggcgttcgttttattcgaacgggtcgattcgcgcgttttatttttataatttagcgtatcggcgatatatttngcgcgcgcgtcgcgcgtcgcgtttttttacgtttttcggtacgtcgtattatcgcgcgacgttttcgtcggtaagcgttatacgcgtaacgtcgcgttcgtaatcgcgagtatcgcgcgtttttcgttcgtacgtcggttttttttcgttcggtcgaaagattttttaatttcgtcgaggtcggtcgtttacgttttcgtttttatcgttttttcgtttcgcgtttttttttatttcgttatattcgttttcgttcggcgttattttcgttcgttagcgttacgcgtaggtcgtcgttatttattttagtatttttcgattataggcgatcgtttcgtcgtttagcgaagttcggttttttttatatatttatcgtattttttacgtcgtttcgttcggtttcgtatttttat

SEQ ID NO: 39200 - DNA, 521 bp, Artificial Sequence
  chemically treated genomic DNA (Homo sapiens) CpG-island No: 39200
  misc_feature (414)..(414): n is either a, c, g or t
ataaaaatacgaaaccgaacgaaacgacgtaaaaaatacgataaatatataaaaaaaaccgaacttcgctaaacgacgaaacgatcgcctataatcgaaaaatactaaaataaataacgacgacctacgcgtaacgctaacgaacgaaaataacgccgaacgaaaacgaatataacgaaataaaaaaaaacgcgaaacgaaaaaacgataaaaacgaaaacgtaaacgaccgacctcgacgaaattaaaaaatctttcgaccgaacgaaaaaaaaccgacgtacgaacgaaaaacgcgcgatactcgcgattacgaacgcgacgttacgcgtataacgcttaccgacgaaaacgtcgcgcgataatacgacgtaccgaaaaacgtaaaaaaacgcgacgcgcgacgcgcgcgcnaaatatatcgccgatacgctaaattataaaaataaaacgcgcgaatcgacccgttcgaataaaacgaacgccgacgaaaaataaaaaacgaaaaatataaacgaaaa

SEQ ID NO: 39201 - DNA, 924 bp, Artificial Sequence
  chemically treated genomic DNA (Homo sapiens) CpG-island No: 39201
gggcgtcgggcgacggattggtaggggcgcgcggggcgggcggaagcgtaggggtggggtgtagggcggggggagcgcgtatcggggggcggggggcggcgtcggcgttgggagtgggggagcgggttgggcggttgcgtcggttttgttttagtcgttgtcgttagggcgcggggggcggggggttcggcgtcgcgagttcggttattgtgggagtcgtttttttcggtttcgttacgtttttttcgattgcgttttagtttggggcgcgttcggtcgtcgtcgttttcgttgtcgttacgggttcgttttttttttttttcggtttttagggtaaggcgcggggcgcggggttggatgtaggcgttttgttcgttgcgcgggatgcgtagcggcggttggggagcggtgattgatcgttttcggcggtcgcgttttagttttcggtagtcggcggtcgcggataggcggtttgataggcgcgggtatagcggtagtgcgggtttcgtatttgtagttttcgcggtcggcgtcggggagcggcgaagattcggagttggggttttttttttgcgggcgttgttagggtggaagggaggcgtgtttttcgggaaaatgggatacggagttttgtaggggtcgggcgtcggattttagggagcgggtagggttgggcggggaaggtcgtttttcggttttagggttcggtcgttggttttagcgttttgtcggttttcggtcgcgcgttttcgttttttgttagttacgtttggcgggcgcgcggatttattcgcgtcgttttaggttcgcgggcgcgtttttttttcgtcgtggggaaacgggtgggggttaggtggggagggtcgtagggggtgagagtatttggtgaggtgtttgtcgtcgatcggtttgcggtttaggggg

SEQ ID NO: 39202 - DNA, 924 bp, Artificial Sequence
  chemically treated genomic DNA (Homo sapiens) CpG-island No: 39202
ccccctaaaccgcaaaccgatcgacgacaaacacctcaccaaatactctcaccccctacgaccctccccacctaacccccacccgtttccccacgacgaaaaaaaaacgcgcccgcgaacctaaaacgacgcgaataaatccgcgcgcccgccaaacgtaactaacaaaaaacgaaaacgcgcgaccgaaaaccgacaaaacgctaaaaccaacgaccgaaccctaaaaccgaaaaacgaccttccccgcccaaccctacccgctccctaaaatccgacgcccgacccctacaaaactccgtatcccattttcccgaaaaacacgcctcccttccaccctaacaacgcccgcaaaaaaaaaaccccaactccgaatcttcgccgctccccgacgccgaccgcgaaaactacaaatacgaaacccgcactaccgctatacccgcgcctatcaaaccgcctatccgcgaccgccgactaccgaaaactaaaacgcgaccgccgaaaacgatcaatcaccgctccccaaccgccgctacgcatcccgcgcaacgaacaaaacgcctacatccaaccccgcgccccgcgccttaccctaaaaaccgaaaaaaaaaaaaaacgaacccgtaacgacaacgaaaacgacgacgaccgaacgcgccccaaactaaaacgcaatcgaaaaaaacgtaacgaaaccgaaaaaaacgactcccacaataaccgaactcgcgacgccgaaccccccgccccccgcgccctaacgacaacgactaaaacaaaaccgacgcaaccgcccaacccgctcccccactcccaacgccgacgccgccccccgccccccgatacgcgctccccccgccctacaccccacccctacgcttccgcccgccccgcgcgcccctaccaatccgtcgcccgacgccc

SEQ ID NO: 39203 - DNA, 924 bp, Artificial Sequence
  chemically treated genomic DNA (Homo sapiens) CpG-island No: 39203
ttttttaggtcgtaggtcggtcggcgataggtattttattaggtgtttttattttttgcgattttttttatttggtttttattcgtttttttacggcggaggaggggcgcgttcgcgagtttggggcggcgcgggtgggttcgcgcgttcgttaagcgtggttgataaagagcggggacgcgcgatcgaggatcgatagggcgttggggttagcggtcgagttttggggtcgggaagcgatttttttcgtttagttttgttcgttttttaaggttcggcgttcggtttttgtagggtttcgtgttttattttttcggggaatacgttttttttttattttggtagcgttcgtagaggggaaattttagtttcgagttttcgtcgtttttcggcgtcggtcgcgggggttgtaggtgcgaggttcgtattgtcgttgtgttcgcgtttgttaagtcgtttgttcgcggtcgtcggttgtcgggagttggggcgcggtcgtcgggggcgattaattatcgttttttagtcgtcgttgcgtatttcgcgtagcgggtagggcgtttgtatttaatttcgcgtttcgcgttttattttgggagtcgaaggaggaagaagacgggttcgtggcggtagcgaaggcggcggcggtcgggcgcgttttaggttggagcgtagtcgaggggagcgtggcggagtcgaggggagcggtttttataatggtcgagttcgcggcgtcgagtttttcgtttttcgcgttttagcggtagcggttgaagtagagtcggcgtagtcgtttaattcgtttttttatttttagcgtcgacgtcgtttttcgtttttcgatgcgcgtttttttcgttttgtattttatttttgcgttttcgttcgtttcgcgcgtttttgttagttcgtcgttcggcgttt

SEQ ID NO: 39204 - DNA, 924 bp, Artificial Sequence
  chemically treated genomic DNA (Homo sapiens) CpG-island No: 39204
aaacgccgaacgacgaactaacaaaaacgcgcgaaacgaacgaaaacgcaaaaataaaatacaaaacgaaaaaaacgcgcatcgaaaaacgaaaaacgacgtcgacgctaaaaataaaaaaacgaattaaacgactacgccgactctacttcaaccgctaccgctaaaacgcgaaaaacgaaaaactcgacgccgcgaactcgaccattataaaaaccgctcccctcgactccgccacgctcccctcgactacgctccaacctaaaacgcgcccgaccgccgccgccttcgctaccgccacgaacccgtcttcttcctccttcgactcccaaaataaaacgcgaaacgcgaaattaaatacaaacgccctacccgctacgcgaaatacgcaacgacgactaaaaaacgataattaatcgcccccgacgaccgcgccccaactcccgacaaccgacgaccgcgaacaaacgacttaacaaacgcgaacacaacgacaatacgaacctcgcacctacaacccccgcgaccgacgccgaaaaacgacgaaaactcgaaactaaaatttcccctctacgaacgctaccaaaataaaaaaaaaacgtattccccgaaaaaataaaacacgaaaccctacaaaaaccgaacgccgaaccttaaaaaacgaacaaaactaaacgaaaaaaatcgcttcccgaccccaaaactcgaccgctaaccccaacgccctatcgatcctcgatcgcgcgtccccgctctttatcaaccacgcttaacgaacgcgcgaacccacccgcgccgccccaaactcgcgaacgcgcccctcctccgccgtaaaaaaacgaataaaaaccaaataaaaaaaatcgcaaaaaataaaaacacctaataaaatacctatcgccgaccgacctacgacctaaaaaa

SEQ ID NO: 39205 - DNA, 1097 bp, Artificial Sequence
  chemically treated genomic DNA (Homo sapiens) CpG-island No: 39205
gtaggttagcgttgattggggttttcgttcgttttgtggagtcggttcgggtttttttgtcgttcggtcggtttagttttttattttgacgcgcggggttttttatttagcgggattttcgcgtgggtcggtttttcgcgtttttcggttcgggttttagttcgggtcgggcgggggtcggtagtttttgggggattcgtgtgggtagttcgggtttagtcggtcgtagtttggggtcgaggattcgtcgggattcggaggcggcggggagagggggcggggaacgggtcgggtttggcgtttttgataggaggagtcgtcgtcgtcgttcgtcgttgtagtcgcgtcggggcgggttgagggaggagcggagtcgaggggtgaggacgcggaaacgcgagtcgggatcggcggagcgcgagcgggtcgggtgcgagcggattgaggagcggagcgcgattgtcgggtcgggcgaggcgggcggacggcggagagcgagggcgtcgtcgtcgtttttgagacgtataaagggtcgaggttggggtcgtcgtcgttttagcgcgcgggtttggaatcggtagttttcggggttcggcgagaaggcggtgcgggcggttatggtcggttacgtgtcgggttagtagtcggttaatcgtagttaggagaaggagttcgtgtaggcgtacgaggatgtgttggagcggtataaaggtagggtcggggattggtcggcgttgaggttcgcgggtcggcgtagcgtggttttcggagtcggtcggttcggcggttgtaggtggggcggtcgggcggggtcgtatttatcgcgcggggtttggttttgagttgttgtttttcggggttagtttatttatagagttgagataagttttcggaaatcgttttcggggtagtcggcgcgtttagagcgttagttatatgatttgttttattattcggttttagttggaagaaggcgagataaggcgttggtttggagatcggtcgtcgtggggagttgttggggaggaggaggaggaggagttgggcgcgggagaaattattcgttttgttttgggtgcgagtttttttttagaggg

SEQ ID NO: 39206 - DNA, 1097 bp, Artificial Sequence
  chemically treated genomic DNA (Homo sapiens) CpG-island No: 39206
ccctctaaaaaaaaactcgcacccaaaacaaaacgaataatttctcccgcgcccaactcctcctcctcctcctccccaacaactccccacgacgaccgatctccaaaccaacgccttatctcgccttcttccaactaaaaccgaataataaaacaaatcatataactaacgctctaaacgcgccgactaccccgaaaacgatttccgaaaacttatctcaactctataaataaactaaccccgaaaaacaacaactcaaaaccaaaccccgcgcgataaatacgaccccgcccgaccgccccacctacaaccgccgaaccgaccgactccgaaaaccacgctacgccgacccgcgaacctcaacgccgaccaatccccgaccctacctttataccgctccaacacatcctcgtacgcctacacgaactccttctcctaactacgattaaccgactactaacccgacacgtaaccgaccataaccgcccgcaccgccttctcgccgaaccccgaaaactaccgattccaaacccgcgcgctaaaacgacgacgaccccaacctcgaccctttatacgtctcaaaaacgacgacgacgccctcgctctccgccgtccgcccgcctcgcccgacccgacaatcgcgctccgctcctcaatccgctcgcacccgacccgctcgcgctccgccgatcccgactcgcgtttccgcgtcctcacccctcgactccgctcctccctcaacccgccccgacgcgactacaacgacgaacgacgacgacgactcctcctatcaaaaacgccaaacccgacccgttccccgccccctctccccgccgcctccgaatcccgacgaatcctcgaccccaaactacgaccgactaaacccgaactacccacacgaatcccccaaaaactaccgacccccgcccgacccgaactaaaacccgaaccgaaaaacgcgaaaaaccgacccacgcgaaaatcccgctaaataaaaaaccccgcgcgtcaaaataaaaaactaaaccgaccgaacgacaaaaaaacccgaaccgactccacaaaacgaacgaaaaccccaatcaacgctaacctac

SEQ ID NO: 39207 - DNA, 1097 bp, Artificial Sequence
  chemically treated genomic DNA (Homo sapiens) CpG-island No: 39207
ttttttgggaggaagttcgtatttagagtagagcgggtggtttttttcgcgtttaatttttttttttttttttttttagtaattttttacggcggtcggtttttaggttagcgttttgtttcgtttttttttagttggggtcggataatagggtaaattatgtaattggcgttttgagcgcgtcgattgtttcgggggcggttttcgaaggtttattttaattttgtaaataaattggtttcgagaagtagtagtttagggttaagtttcgcgcggtgggtgcgatttcgttcggtcgttttatttgtagtcgtcgagtcgatcggtttcgaaggttacgttgcgtcggttcgcgggttttagcgtcggttagttttcggttttatttttgtatcgttttagtatattttcgtacgtttgtacgaatttttttttttggttgcggttggtcggttgttgattcggtacgtagtcggttatggtcgttcgtatcgttttttcgtcgagtttcgggggttgtcggttttaggttcgcgcgttgaggcggcggcggttttagtttcgattttttgtgcgttttagagacggcgacggcgttttcgtttttcgtcgttcgttcgtttcgttcggttcggtagtcgcgtttcgttttttagttcgttcgtattcggttcgttcgcgtttcgtcggtttcggttcgcgttttcgcgtttttatttttcggtttcgttttttttttagttcgtttcggcgcggttgtagcggcgggcggcggcggcggttttttttgttaggagcgttaggttcggttcgtttttcgtttttttttttcgtcgttttcgggtttcggcgagttttcggttttaggttgcggtcggttgggttcgggttgtttatacgggttttttaggggttgtcgattttcgttcggttcggattggggttcgagtcgaggggcgcgagaggtcggtttacgcgggagtttcgttgggtgggaggtttcgcgcgttaggatgaaaggttgggtcggtcgaacggtagggagattcgggtcggttttatagggcgagcgggagttttagttagcgttgatttat

SEQ ID NO: 39208 - DNA, 1097 bp, Artificial Sequence
  chemically treated genomic DNA (Homo sapiens) CpG-island No: 39208
ataaatcaacgctaactaaaactcccgctcgccctataaaaccgacccgaatctccctaccgttcgaccgacccaacctttcatcctaacgcgcgaaacctcccacccaacgaaactcccgcgtaaaccgacctctcgcgcccctcgactcgaaccccaatccgaaccgaacgaaaatcgacaacccctaaaaaacccgtataaacaacccgaacccaaccgaccgcaacctaaaaccgaaaactcgccgaaacccgaaaacgacgaaaaaaaaaaacgaaaaacgaaccgaacctaacgctcctaacaaaaaaaaccgccgccgccgcccgccgctacaaccgcgccgaaacgaactaaaaaaaaaacgaaaccgaaaaataaaaacgcgaaaacgcgaaccgaaaccgacgaaacgcgaacgaaccgaatacgaacgaactaaaaaacgaaacgcgactaccgaaccgaacgaaacgaacgaacgacgaaaaacgaaaacgccgtcgccgtctctaaaacgcacaaaaaatcgaaactaaaaccgccgccgcctcaacgcgcgaacctaaaaccgacaacccccgaaactcgacgaaaaaacgatacgaacgaccataaccgactacgtaccgaatcaacaaccgaccaaccgcaaccaaaaaaaaaaattcgtacaaacgtacgaaaatatactaaaacgatacaaaaataaaaccgaaaactaaccgacgctaaaacccgcgaaccgacgcaacgtaaccttcgaaaccgatcgactcgacgactacaaataaaacgaccgaacgaaatcgcacccaccgcgcgaaacttaaccctaaactactacttctcgaaaccaatttatttacaaaattaaaataaaccttcgaaaaccgcccccgaaacaatcgacgcgctcaaaacgccaattacataatttaccctattatccgaccccaactaaaaaaaaacgaaacaaaacgctaacctaaaaaccgaccgccgtaaaaaattactaaaaaaaaaaaaaaaaaaaaattaaacgcgaaaaaaaccacccgctctactctaaatacgaacttcctcccaaaaaa

SEQ ID NO: 39209 - DNA, 1079 bp, Artificial Sequence
  chemically treated genomic DNA (Homo sapiens) CpG-island No: 39209
gggcggatatgtcgtatattatatggcggataatttgggggtgtggttggtttgcgggggatatcggatgttattatggatgatttgtatatgggatggatcgatggatggtttgggggcggttatatgacgcggggttattgatgatggggcgtcgggcgacggattggtatgggcgcgcggggcgggcggaatcgtatgggtggggtgtatggcggggggatcgcgtatcggggggcggggggcggcgtcggcgttgggagtgggggagcgggttgggcggttgcgtcggttttgttttagtcgttgtcgttagggcgcggggggcggggggttcggcgtcgcgagttcggttattgtgggagtcgtttttttcggtttcgttacgtttttttcgattgcgttttagtttggggcgcgttcggtcgtcgtcgttttcgttgtcgttacgggttcgttttttttttttttcggtttttagggtaaggcgcggggcgcggggttggatgtatgcgttttgttcgttgcgcgggatgcgtatcggcggttggggagcggtgattgatcgttttcggcggtcgcgttttatttttcggcgaggcggcggtcgcggataggcggtttgataggcgcgggtatatcggtagtgcgggtttcgtatttgtatttttcgcggtcggcgtcggggagcggcgaatattcggagttggggttttttttttgcgggcgttgttatggtggaatggaggcgtgtttttcgggaaaatgggatacggatttttgtatgggtcgggcgtcggattttatggagcgggtagggttggggcggggaatgtcgtttttcggttttatggttcggtcgttggttttatcgttttgtcggttttcggtcgcgcgttttcgttttttgttatttacgtttggcgggcgcgcggatttattcgcgtcgttttatgttcgcgggcgcgtttttttttcgtcgtggggaaacgggtgggggttatgtggggagggtcgtatggggtgatattatttggtgaggtgtttgtcgtcgatcggtttgcggtttatggggtggg

SEQ ID NO: 39210 - DNA, 1079 bp, Artificial Sequence
  chemically treated genomic DNA (Homo sapiens) CpG-island No: 39210
cccaccccataaaccgcaaaccgatcgacgacaaacacctcaccaaataatatcaccccatacgaccctccccacataacccccacccgtttccccacgacgaaaaaaaaacgcgcccgcgaacataaaacgacgcgaataaatccgcgcgcccgccaaacgtaaataacaaaaaacgaaaacgcgcgaccgaaaaccgacaaaacgataaaaccaacgaccgaaccataaaaccgaaaaacgacattccccgccccaaccctacccgctccataaaatccgacgcccgacccatacaaaaatccgtatcccattttcccgaaaaacacgcctccattccaccataacaacgcccgcaaaaaaaaaaccccaactccgaatattcgccgctccccgacgccgaccgcgaaaaatacaaatacgaaacccgcactaccgatatacccgcgcctatcaaaccgcctatccgcgaccgccgcctcgccgaaaaataaaacgcgaccgccgaaaacgatcaatcaccgctccccaaccgccgatacgcatcccgcgcaacgaacaaaacgcatacatccaaccccgcgccccgcgccttaccctaaaaaccgaaaaaaaaaaaaaacgaacccgtaacgacaacgaaaacgacgacgaccgaacgcgccccaaactaaaacgcaatcgaaaaaaacgtaacgaaaccgaaaaaaacgactcccacaataaccgaactcgcgacgccgaaccccccgccccccgcgccctaacgacaacgactaaaacaaaaccgacgcaaccgcccaacccgctcccccactcccaacgccgacgccgccccccgccccccgatacgcgatccccccgccatacaccccacccatacgattccgcccgccccgcgcgcccataccaatccgtcgcccgacgccccatcatcaataaccccgcgtcatataaccgcccccaaaccatccatcgatccatcccatatacaaatcatccataataacatccgatatcccccgcaaaccaaccacacccccaaattatccgccatataatatacgacatatccgccc

SEQ ID NO: 39211 - DNA, 1079 bp, Artificial Sequence
  chemically treated genomic DNA (Homo sapiens) CpG-island No: 39211
tttattttataggtcgtaggtcggtcggcgataggtattttattaggtgatattattttatgcgattttttttatatggtttttattcgtttttttacggcggaggaggggcgcgttcgcgagtatggggcggcgcgggtgggttcgcgcgttcgttaagcgtggatgataaagagcggggacgcgcgatcgaggatcgatagggcgatggggttagcggtcgagttatggggtcgggaagcgatatttttcgttttagttttgttcgttttataaggttcggcgttcggtttatgtagggattcgtgttttattttttcggggaatacgtttttattttattatggtagcgttcgtagaggggaaattttagtttcgagtattcgtcgtttttcggcgtcggtcgcgggggatgtaggtgcgaggttcgtattgtcgatgtgttcgcgtttgttaagtcgtttgttcgcggtcgtcgtttcgtcgggagatggggcgcggtcgtcgggggcgattaattatcgttttttagtcgtcgatgcgtatttcgcgtagcgggtagggcgtatgtatttaatttcgcgtttcgcgttttattttgggagtcgaaggaggaagaagacgggttcgtggcggtagcgaaggcggcggcggtcgggcgcgttttaggttggagcgtagtcgaggggagcgtggcggagtcgaggggagcggtttttataatggtcgagttcgcggcgtcgagtttttcgtttttcgcgttttagcggtagcggttgaagtagagtcggcgtagtcgtttaattcgtttttttatttttagcgtcgacgtcgtttttcgtttttcgatgcgcgattttttcgttatgtattttatttatgcgatttcgttcgtttcgcgcgtttatgttagttcgtcgttcggcgttttattattaatgatttcgcgttatatggtcgtttttaggttatttatcggtttattttatatgtaaattatttatagtggtattcggtgtttttcgtaggttaattatatttttaaattattcgttatatgatatgcgatatattcgttt

SEQ ID NO: 39212 - DNA, 1079 bp, Artificial Sequence
  chemically treated genomic DNA (Homo sapiens) CpG-island No: 39212
aaacgaatatatcgcatatcatataacgaataatttaaaaatataattaacctacgaaaaacaccgaataccactataaataatttacatataaaataaaccgataaataacctaaaaacgaccatataacgcgaaatcattaataataaaacgccgaacgacgaactaacataaacgcgcgaaacgaacgaaatcgcataaataaaatacataacgaaaaaatcgcgcatcgaaaaacgaaaaacgacgtcgacgctaaaaataaaaaaacgaattaaacgactacgccgactctacttcaaccgctaccgctaaaacgcgaaaaacgaaaaactcgacgccgcgaactcgaccattataaaaaccgctcccctcgactccgccacgctcccctcgactacgctccaacctaaaacgcgcccgaccgccgccgccttcgctaccgccacgaacccgtcttcttcctccttcgactcccaaaataaaacgcgaaacgcgaaattaaatacatacgccctacccgctacgcgaaatacgcatcgacgactaaaaaacgataattaatcgcccccgacgaccgcgccccatctcccgacgaaacgacgaccgcgaacaaacgacttaacaaacgcgaacacatcgacaatacgaacctcgcacctacatcccccgcgaccgacgccgaaaaacgacgaatactcgaaactaaaatttcccctctacgaacgctaccataataaaataaaaacgtattccccgaaaaaataaaacacgaatccctacataaaccgaacgccgaaccttataaaacgaacaaaactaaaacgaaaaatatcgcttcccgaccccataactcgaccgctaaccccatcgccctatcgatcctcgatcgcgcgtccccgctctttatcatccacgcttaacgaacgcgcgaacccacccgcgccgccccatactcgcgaacgcgcccctcctccgccgtaaaaaaacgaataaaaaccatataaaaaaaatcgcataaaataatatcacctaataaaatacctatcgccgaccgacctacgacctataaaataaa

SEQ ID NO: 39213 - DNA, 776 bp, Artificial Sequence
  chemically treated genomic DNA (Homo sapiens) CpG-island No: 39213
  misc_feature (20)..(20): n is either a, c, g or t
tagtaggtttcgtttttcgntgttcgttatcggttttttcgtgaaaaaaattaaatcggtatttttattcggtcgttttttattggatatgtgagtgagcgatgttcgttcggattaatgagtcgtagttacggtttggcgagcgtttttcggttcgttttcgcgcggtcgtttttcggattatcggattggtttggggcgggacgtgggcgcgggggcgcggcgtgcggtacgttgtagggttgaagcggcggcggcggtggggattgtacgtagttcggcgttcggtatggtttttttggtgttcggtaggtgcgggttagcggagggaggcgggcgagttggggtcggtttgaaaggtttcgaatttttaggtcgtttttcggcgggtcgcggtcgtaggcggtcggaagtgggtttggcgggcgggaggcgcgggtttcggcgttcggaggagttgttaggttgtttcggcggaggtgcgggtgcgcgggagattcgggcgttcgtggggaggggttttcgtagtcgcggggggcgggagtttcgtgcgttggagtcgggcgcggggtttagggtcgggcgggagagtcgcggagtttagtttcggtcggatttcggggagggggtttgtattttcggagagtcgtaggggagtttgtttcgggtttttttcgaattcgtgcgtggggacggaggttggcgggcgttttgtattgttgtttgtttttgttatttgttttatgtagtttttatttttaaaaattgaaatgtta

SEQ ID NO: 39214 - DNA, 776 bp, Artificial Sequence
  chemically treated genomic DNA (Homo sapiens) CpG-island No: 39214
  misc_feature (757)..(757): n is either a, c, g or t
taacatttcaatttttaaaaataaaaactacataaaacaaataacaaaaacaaacaacaatacaaaacgcccgccaacctccgtccccacgcacgaattcgaaaaaaacccgaaacaaactcccctacgactctccgaaaatacaaaccccctccccgaaatccgaccgaaactaaactccgcgactctcccgcccgaccctaaaccccgcgcccgactccaacgcacgaaactcccgccccccgcgactacgaaaacccctccccacgaacgcccgaatctcccgcgcacccgcacctccgccgaaacaacctaacaactcctccgaacgccgaaacccgcgcctcccgcccgccaaacccacttccgaccgcctacgaccgcgacccgccgaaaaacgacctaaaaattcgaaacctttcaaaccgaccccaactcgcccgcctccctccgctaacccgcacctaccgaacaccaaaaaaaccataccgaacgccgaactacgtacaatccccaccgccgccgccgcttcaaccctacaacgtaccgcacgccgcgcccccgcgcccacgtcccgccccaaaccaatccgataatccgaaaaacgaccgcgcgaaaacgaaccgaaaaacgctcgccaaaccgtaactacgactcattaatccgaacgaacatcgctcactcacatatccaataaaaaacgaccgaataaaaataccgatttaatttttttcacgaaaaaaccgataacgaacancgaaaaacgaaacctacta

SEQ ID NO: 39215 - DNA, 776 bp, Artificial Sequence
  chemically treated genomic DNA (Homo sapiens) CpG-island No: 39215
  misc_feature (757)..(757): n is either a, c, g or t
taatattttagtttttaaaagtaggagttgtataaagtaggtggtagaaataagtagtagtgtaggacgttcgttaattttcgtttttacgtacgagttcgagaagagttcggaataagtttttttgcgatttttcgggaatatagatttttttttcgggattcggtcggggttgggtttcgcggttttttcgttcggttttggatttcgcgttcggttttagcgtacgaggttttcgtttttcgcggttgcggaagtttttttttacgggcgttcgagtttttcgcgtattcgtattttcgtcggggtaatttagtagttttttcggacgtcgaggttcgcgtttttcgttcgttaggtttattttcggtcgtttgcggtcgcggttcgtcggggaacggtttagagattcgaaattttttaggtcgattttagttcgttcgttttttttcgttggttcgtatttatcgagtattaggagagttatgtcgagcgtcgggttacgtgtagtttttatcgtcgtcgtcgttttagttttgtagcgtgtcgtacgtcgcgttttcgcgtttacgtttcgttttaggttagttcggtggttcgaggggcggtcgcgcgggggcgggtcggaaggcgttcgttaagtcgtggttgcggtttattggttcgggcggatatcgtttatttatatatttaatgggaggcggtcgggtagaggtatcggtttggttttttttacgggggggtcggtggcgagtancggaaggcggggtttgttg

SEQ ID NO: 39216 - DNA, 776 bp, Artificial Sequence
  chemically treated genomic DNA (Homo sapiens) CpG-island No: 39216
  misc_feature (20)..(20): n is either a, c, g or t
caacaaaccccgccttccgntactcgccaccgacccccccgtaaaaaaaaccaaaccgatacctctacccgaccgcctcccattaaatatataaataaacgatatccgcccgaaccaataaaccgcaaccacgacttaacgaacgccttccgacccgcccccgcgcgaccgcccctcgaaccaccgaactaacctaaaacgaaacgtaaacgcgaaaacgcgacgtacgacacgctacaaaactaaaacgacgacgacgataaaaactacacgtaacccgacgctcgacataactctcctaatactcgataaatacgaaccaacgaaaaaaaacgaacgaactaaaatcgacctaaaaaatttcgaatctctaaaccgttccccgacgaaccgcgaccgcaaacgaccgaaaataaacctaacgaacgaaaaacgcgaacctcgacgtccgaaaaaactactaaattaccccgacgaaaatacgaatacgcgaaaaactcgaacgcccgtaaaaaaaaacttccgcaaccgcgaaaaacgaaaacctcgtacgctaaaaccgaacgcgaaatccaaaaccgaacgaaaaaaccgcgaaacccaaccccgaccgaatcccgaaaaaaaaatctatattcccgaaaaatcgcaaaaaaacttattccgaactcttctcgaactcgtacgtaaaaacgaaaattaacgaacgtcctacactactacttatttctaccacctactttatacaactcctacttttaaaaactaaaatatta

SEQ ID NO: 39217 - DNA, 772 bp, Artificial Sequence
  chemically treated genomic DNA (Homo sapiens) CpG-island No: 39217
  misc_feature (338)..(338): n is either a, c, g or t
tttcgcgtagatttaacgtagttttttttcgttttgattgtttatggtttggggacgaattggttcgtcgtagtatttgcggagatgttattagttcggtcgcggggaagcgcgcggaggtgtacgttgtttacgtttttaatgggaaagcgtaggttggtgcgtagtcggatttcgtgtttgtgtttttatttcgtttttgtttcgggttttcgtttcgcggtgcgtttttatcgggagtcggcggggcgcgggtcgcgcggtagggggttgcgggcgacgggcggcgggtgcggggtcggagcgttttgtcggttttcgggaggtagcggtttcgntgtttcgcgtttcgtttcgttttttatttcgggttttggaggcggtttcggtttcgtaggatatttgtatacgggtcgttcgtttttcgtttcgttttagttaggggttcgagagtcggggagtaggtgtaggcgtcgggtaggaaggcgcggaggagacgcgtagggtttttagttttttacgcgcgagggtcggggttttgggggtttttgcggcgcgttttacggggttttttgtcgtacgattgcgttgtcgcgttcgggacgcgtggacggttgagtcgggtgggagtcgggaaaaggttttgagttcgggattatttcgttttttcgttgcggtcgtcgtagtttcgtttgtttatttattttcgttttatagagatatgcgcggattttaggggaattatttatttttaggtgtttttaggttagtg

SEQ ID NO: 39218 - DNA, 772 bp, Artificial Sequence
  chemically treated genomic DNA (Homo sapiens) CpG-island No: 39218
  misc_feature (435)..(435): n is either a, c, g or t
cactaacctaaaaacacctaaaaataaataattcccctaaaatccgcgcatatctctataaaacgaaaataaataaacaaacgaaactacgacgaccgcaacgaaaaaacgaaataatcccgaactcaaaaccttttcccgactcccacccgactcaaccgtccacgcgtcccgaacgcgacaacgcaatcgtacgacaaaaaaccccgtaaaacgcgccgcaaaaacccccaaaaccccgaccctcgcgcgtaaaaaactaaaaaccctacgcgtctcctccgcgccttcctacccgacgcctacacctactccccgactctcgaacccctaactaaaacgaaacgaaaaacgaacgacccgtatacaaatatcctacgaaaccgaaaccgcctccaaaacccgaaataaaaaacgaaacgaaacgcgaaacancgaaaccgctacctcccgaaaaccgacaaaacgctccgaccccgcacccgccgcccgtcgcccgcaaccccctaccgcgcgacccgcgccccgccgactcccgataaaaacgcaccgcgaaacgaaaacccgaaacaaaaacgaaataaaaacacaaacacgaaatccgactacgcaccaacctacgctttcccattaaaaacgtaaacaacgtacacctccgcgcgcttccccgcgaccgaactaataacatctccgcaaatactacgacgaaccaattcgtccccaaaccataaacaatcaaaacgaaaaaaaactacgttaaatctacgcgaaa

SEQ ID NO: 39219 - DNA, 772 bp, Artificial Sequence
  chemically treated genomic DNA (Homo sapiens) CpG-island No: 39219
  misc_feature (435)..(435): n is either a, c, g or t
tattggtttggagatatttgggagtaggtgatttttttgagattcgcgtatgtttttgtgaggcgagagtgggtgggtaagcggggttgcggcggtcgtagcgggagggcggggtggtttcgagtttagagttttttttcgatttttattcggtttagtcgtttacgcgtttcggacgcggtagcgtagtcgtgcggtaggagatttcgtgggacgcgtcgtagaagtttttagggtttcggttttcgcgcgtaggggattggagattttgcgcgtttttttcgcgtttttttgttcggcgtttgtatttgtttttcggttttcgggtttttggttggagcgaggcgggaggcggacggttcgtatgtaaatattttgcggggtcggggtcgtttttagagttcgggataaaaggcggggcggggcgcggggtancgaagtcgttgtttttcgggagtcggtagagcgtttcggtttcgtattcgtcgttcgtcgttcgtagttttttatcgcgcggttcgcgtttcgtcggttttcggtaaggacgtatcgcggagcggggattcgaggtaggggcggggtggggatataggtacggggttcggttgcgtattagtttgcgtttttttattggaaacgtgggtagcgtgtattttcgcgcgttttttcgcggtcgggttggtagtattttcgtaggtgttgcggcgggttagttcgtttttaggttatgggtagttaaggcggaaaggagttgcgttgggtttgcgcgggg

SEQ ID NO: 39220 - DNA, 772 bp, Artificial Sequence
  chemically treated genomic DNA (Homo sapiens) CpG-island No: 39220
  misc_feature (338)..(338): n is either a, c, g or t
ccccgcgcaaacccaacgcaactcctttccgccttaactacccataacctaaaaacgaactaacccgccgcaacacctacgaaaatactaccaacccgaccgcgaaaaaacgcgcgaaaatacacgctacccacgtttccaataaaaaaacgcaaactaatacgcaaccgaaccccgtacctatatccccaccccgcccctacctcgaatccccgctccgcgatacgtccttaccgaaaaccgacgaaacgcgaaccgcgcgataaaaaactacgaacgacgaacgacgaatacgaaaccgaaacgctctaccgactcccgaaaaacaacgacttcgntaccccgcgccccgccccgccttttatcccgaactctaaaaacgaccccgaccccgcaaaatatttacatacgaaccgtccgcctcccgcctcgctccaaccaaaaacccgaaaaccgaaaaacaaatacaaacgccgaacaaaaaaacgcgaaaaaaacgcgcaaaatctccaatcccctacgcgcgaaaaccgaaaccctaaaaacttctacgacgcgtcccacgaaatctcctaccgcacgactacgctaccgcgtccgaaacgcgtaaacgactaaaccgaataaaaatcgaaaaaaaactctaaactcgaaaccaccccgccctcccgctacgaccgccgcaaccccgcttacccacccactctcgcctcacaaaaacatacgcgaatctcaaaaaaatcacctactcccaaatatctccaaaccaata

SEQ ID NO: 39221 - DNA, 534 bp, Artificial Sequence
  chemically treated genomic DNA (Homo sapiens) CpG-island No: 39221
cgggtcggagtcgaagaggagaggggagcggtttagatagcgggtcgcgaataattataacggattaacgaaagaaataagtatcgtagatataaatatatcgacgaagataacgcgtagatttagtcgttacgtcggatttattaatagatcgtatagcggacgtcgcgtcgacgcgacgagcgagtcggttcgtttagtaagtaacgggcgtcgatcgcgcgttcgcgcgtcgcgtagagtattcgacgggggtcgatacgaatcgagttatagcgacggcgcgcggcggcgttaacggcggaatcggtcgcggcggacgacggcgcgacgcgttacgggtaggagcgtagtaggttaaaagtcggtagcgtcgttataaggatcggtatagtagacgagcgggtcgtggtattatcgtaggaagagcgagcgcgacggtgcgggagggcggagaggggtcgcgggagagtcggagtagggtaggagtgcggcgaggtaggttggggtatcgagaggggtagtattagtgag

SEQ ID NO: 39222 - DNA, 534 bp, Artificial Sequence
  chemically treated genomic DNA (Homo sapiens) CpG-island No: 39222
ctcactaatactacccctctcgataccccaacctacctcgccgcactcctaccctactccgactctcccgcgacccctctccgccctcccgcaccgtcgcgctcgctcttcctacgataataccacgacccgctcgtctactataccgatccttataacgacgctaccgacttttaacctactacgctcctacccgtaacgcgtcgcgccgtcgtccgccgcgaccgattccgccgttaacgccgccgcgcgccgtcgctataactcgattcgtatcgacccccgtcgaatactctacgcgacgcgcgaacgcgcgatcgacgcccgttacttactaaacgaaccgactcgctcgtcgcgtcgacgcgacgtccgctatacgatctattaataaatccgacgtaacgactaaatctacgcgttatcttcgtcgatatatttatatctacgatacttatttctttcgttaatccgttataattattcgcgacccgctatctaaaccgctcccctctcctcttcgactccgacccg

SEQ ID NO: 39223 - DNA, 534 bp, Artificial Sequence
  chemically treated genomic DNA (Homo sapiens) CpG-island No: 39223
tttattggtgttgtttttttcgatgttttagtttgtttcgtcgtatttttgttttgtttcggttttttcgcggttttttttcgttttttcgtatcgtcgcgttcgttttttttgcggtggtgttacggttcgttcgtttgttgtgtcggtttttgtagcggcgttgtcggtttttggtttgttgcgtttttgttcgtggcgcgtcgcgtcgtcgttcgtcgcggtcggtttcgtcgttggcgtcgtcgcgcgtcgtcgttgtggttcggttcgtgtcggttttcgtcgggtgttttgcgcggcgcgcgggcgcgcggtcggcgttcgttgtttgttgggcgggtcggttcgttcgtcgcgtcggcgcggcgttcgttgtgcggtttgttgatgggttcggcgtggcggttgggtttgcgcgttgttttcgtcggtgtgtttgtgtttgcggtgtttgtttttttcgttggttcgttgtggttgttcgcggttcgttgtttgggtcgtttttttttttttttcggtttcggttcg

SEQ ID NO: 39224 - DNA, 534 bp, Artificial Sequence
  chemically treated genomic DNA (Homo sapiens) CpG-island No: 39224
cgaaccgaaaccgaaaaaaaaaaaaaaacgacccaaacaacgaaccgcgaacaaccacaacgaaccaacgaaaaaaacaaacaccgcaaacacaaacacaccgacgaaaacaacgcgcaaacccaaccgccacgccgaacccatcaacaaaccgcacaacgaacgccgcgccgacgcgacgaacgaaccgacccgcccaacaaacaacgaacgccgaccgcgcgcccgcgcgccgcgcaaaacacccgacgaaaaccgacacgaaccgaaccacaacgacgacgcgcgacgacgccaacgacgaaaccgaccgcgacgaacgacgacgcgacgcgccacgaacaaaaacgcaacaaaccaaaaaccgacaacgccgctacaaaaaccgacacaacaaacgaacgaaccgtaacaccaccgcaaaaaaaacgaacgcgacgatacgaaaaaacgaaaaaaaaccgcgaaaaaaccgaaacaaaacaaaaatacgacgaaacaaactaaaacatcgaaaaaaacaacaccaataaa

SEQ ID NO: 39225 - DNA, 632 bp, Artificial Sequence
  chemically treated genomic DNA (Homo sapiens) CpG-island No: 39225
aagtcgaggttttaagcgcggggaatgcggttttgttcgatcgttggtttcgcgttttttttcgggtgtataagttttgttttttcgcgtttttttcgagtatttagtttttcgagtagagaggggaattagaggagcgtcgaagtcgggagagaaaaggggcgggcgtcgttttggtaagaagttcgggtttggtttttaagcgtcggcgaatcggttattcggcgagttagtaattagttcgtttcgacggttgcgttcggtggttagattcggcgttcgatatttggagcgagtgcgttggggcgtcggataggagaggttaggttggtaaaggcgcgggaggcggggtcggagcgtgggtcgggtatcgcggggcggggcgcgtcgttcgtttcgtgtgcgcggcggagcgttagggcgggggtatagtcggtttttaatcgcgtataatgagatagcgttgagcgttcgaagtggggtcgaaggaaatatcgagaggagttcggtcgggataggaagagggtggggatcgcgcgaaaggtggtgagtgtttttgggcgtttttttttaacgttttgttagattcgttttcgggttgattttttagttggttttttggattttagagt

SEQ ID NO: 39226 - DNA, 632 bp, Artificial Sequence
  chemically treated genomic DNA (Homo sapiens) CpG-island No: 39226
actctaaaatccaaaaaaccaactaaaaaatcaacccgaaaacgaatctaacaaaacgttaaaaaaaaacgcccaaaaacactcaccacctttcgcgcgatccccaccctcttcctatcccgaccgaactcctctcgatatttccttcgaccccacttcgaacgctcaacgctatctcattatacgcgattaaaaaccgactatacccccgccctaacgctccgccgcgcacacgaaacgaacgacgcgccccgccccgcgatacccgacccacgctccgaccccgcctcccgcgcctttaccaacctaacctctcctatccgacgccccaacgcactcgctccaaatatcgaacgccgaatctaaccaccgaacgcaaccgtcgaaacgaactaattactaactcgccgaataaccgattcgccgacgcttaaaaaccaaacccgaacttcttaccaaaacgacgcccgccccttttctctcccgacttcgacgctcctctaattcccctctctactcgaaaaactaaatactcgaaaaaaacgcgaaaaaacaaaacttatacacccgaaaaaaaacgcgaaaccaacgatcgaacaaaaccgcattccccgcgcttaaaacctcgactt

SEQ ID NO: 39227 - DNA, 632 bp, Artificial Sequence
  chemically treated genomic DNA (Homo sapiens) CpG-island No: 39227
attttggagtttaggaaattaattggagaattagttcggaggcgagtttggtaggacgttgggagaaggcgtttaagagtatttattatttttcgcgcggtttttattttttttttgtttcggtcgggtttttttcggtgtttttttcggttttatttcgggcgtttagcgttgttttattgtgcgcgattgggagtcgattgtgttttcgttttagcgtttcgtcgcgtatacggaacgagcgacgcgtttcgtttcgcggtgttcggtttacgtttcgatttcgtttttcgcgtttttgttagtttggttttttttgttcggcgttttagcgtattcgttttaggtgtcgggcgtcgggtttggttatcgggcgtaatcgtcggagcgggttaattattggttcgtcgaatagtcggttcgtcggcgtttgggggttaggttcgaattttttattagagcggcgttcgttttttttttttttcggtttcgacgtttttttggtttttttttttgttcgggaggttaagtgttcgggagaggcgcgggaaaataagatttatgtattcggagagggacgcggagttagcggtcgggtaaagtcgtatttttcgcgtttggggtttcggttt

SEQ ID NO: 39228 - DNA, 632 bp, Artificial Sequence
  chemically treated genomic DNA (Homo sapiens) CpG-island No: 39228
aaaccgaaaccccaaacgcgaaaaatacgactttacccgaccgctaactccgcgtccctctccgaatacataaatcttattttcccgcgcctctcccgaacacttaacctcccgaacaaaaaaaaaaaccaaaaaaacgtcgaaaccgaaaaaaaaaaaaaacgaacgccgctctaataaaaaattcgaacctaacccccaaacgccgacgaaccgactattcgacgaaccaataattaacccgctccgacgattacgcccgataaccaaacccgacgcccgacacctaaaacgaatacgctaaaacgccgaacaaaaaaaaccaaactaacaaaaacgcgaaaaacgaaatcgaaacgtaaaccgaacaccgcgaaacgaaacgcgtcgctcgttccgtatacgcgacgaaacgctaaaacgaaaacacaatcgactcccaatcgcgcacaataaaacaacgctaaacgcccgaaataaaaccgaaaaaaacaccgaaaaaaacccgaccgaaacaaaaaaaaaataaaaaccgcgcgaaaaataataaatactcttaaacgccttctcccaacgtcctaccaaactcgcctccgaactaattctccaattaatttcctaaactccaaaat

SEQ ID NO: 39229 - DNA, 1178 bp, Artificial Sequence
  chemically treated genomic DNA (Homo sapiens) CpG-island No: 39229
tttcgcgcgttgaatggaagaaatttcgttcgggtatttcggaaggaaagtttcggagtttattcggttttggagtcggatattaatcgttaggggttttttaggttcgtttcgggaaatggtttttttaggcgagtgcgaggcgggtttttcggtttcgatgtaggcgtattagatgtcggtaaggcggggattaggtttaggggatttcggtcgtttcgaggtcgcggagattttaaggttacggaaggattcgcgttttcgtagttcgtacgtcgggaagcgtgtagagttttcggcggggtttcgagttcgttggttagagcgtggagcggcggggtgggagggacgtggtttttagagcgcggggttatcgtaggggtttttgatggggagggagggaagggtcggttcgacggggttttagtagtttttcgcgcgtagtcgttcggtttttttttcgtttagttgggagtcgttagttttgggcgttcgaagatagcgggtgttcggggtagtttttaggggtgcgggcgagggcgtagggcggtttagatagttttcgcgtggaaggcgttcgtttagattcgcgacgtttcggatttttaggttttcgtatttcgtgttcgaggtttcgggacgcgtaggatagtggagtcgtggtcgtcgtttgtttttagttatttgcgttcgggaggcgggggcgggggcgcggttcggggaggtgaaggaagggaagggaagttttaggacgcgagggcgatttcgtcgcgggagggcggggcggggcggatttttgtttattggataagagttcgaggtcgaggttgagatcgtttagcgttgcggagcgggaggggaggtttcgcggaacgttttcggcgttaggattcgcgtgtaaagtttaggttcgggcggttaggtgaggttagcgtcgttcgcggtatcggggcgtttcgtttttttcgtagatttcgaagtggggcgtaggggcgggggtcggggatcgggtatagtttggggttttcgcgtttcgtagatcgcgtcgtttttaaagtcgttaatagtcgcgggtgtcgagcgtttttcgatagcgttatatgggattttgaggtcgttcgaggcgcgaggagggtgtagggttgtttttggtttcgttttaggtttagaatcgggtg

SEQ ID NO: 39230 - DNA, 1178 bp, Artificial Sequence
  chemically treated genomic DNA (Homo sapiens) CpG-island No: 39230
cacccgattctaaacctaaaacgaaaccaaaaacaaccctacaccctcctcgcgcctcgaacgacctcaaaatcccatataacgctatcgaaaaacgctcgacacccgcgactattaacgactttaaaaacgacgcgatctacgaaacgcgaaaaccccaaactatacccgatccccgacccccgcccctacgccccacttcgaaatctacgaaaaaaacgaaacgccccgataccgcgaacgacgctaacctcacctaaccgcccgaacctaaactttacacgcgaatcctaacgccgaaaacgttccgcgaaacctcccctcccgctccgcaacgctaaacgatctcaacctcgacctcgaactcttatccaataaacaaaaatccgccccgccccgccctcccgcgacgaaatcgccctcgcgtcctaaaacttcccttcccttccttcacctccccgaaccgcgcccccgcccccgcctcccgaacgcaaataactaaaaacaaacgacgaccacgactccactatcctacgcgtcccgaaacctcgaacacgaaatacgaaaacctaaaaatccgaaacgtcgcgaatctaaacgaacgccttccacgcgaaaactatctaaaccgccctacgccctcgcccgcacccctaaaaactaccccgaacacccgctatcttcgaacgcccaaaactaacgactcccaactaaacgaaaaaaaaaccgaacgactacgcgcgaaaaactactaaaaccccgtcgaaccgacccttccctccctccccatcaaaaacccctacgataaccccgcgctctaaaaaccacgtccctcccaccccgccgctccacgctctaaccaacgaactcgaaaccccgccgaaaactctacacgcttcccgacgtacgaactacgaaaacgcgaatccttccgtaaccttaaaatctccgcgacctcgaaacgaccgaaatcccctaaacctaatccccgccttaccgacatctaatacgcctacatcgaaaccgaaaaacccgcctcgcactcgcctaaaaaaaccatttcccgaaacgaacctaaaaaacccctaacgattaatatccgactccaaaaccgaataaactccgaaactttccttccgaaatacccgaacgaaatttcttccattcaacgcgcgaaa

SEQ ID NO: 39231 - DNA, 1178 bp, Artificial Sequence
  chemically treated genomic DNA (Homo sapiens) CpG-island No: 39231
tattcggttttgagtttggagcggggttaggggtagttttgtatttttttcgcgtttcggacggttttagggttttatgtggcgttatcggggggcgttcggtattcgcgattgttggcgattttggagacggcgcggtttgcgggacgcggggattttagattgtgttcggttttcggttttcgtttttgcgttttatttcggggtttgcggaaggagcggggcgtttcgatgtcgcgagcgacgttggttttatttggtcgttcgggtttgggttttgtacgcgagttttggcgtcgagagcgtttcgcgaagttttttttttcgtttcgtagcgttgggcggttttagtttcggtttcgggtttttatttagtagataggggttcgtttcgtttcgttttttcgcgacggggtcgttttcgcgttttggggttttttttttttttttttattttttcgggtcgcgttttcgttttcgtttttcggacgtagatggttgggagtaagcggcggttacggttttattgttttgcgcgtttcggagtttcggatacggggtgcgggggtttgggggttcgagacgtcgcggatttagacgggcgttttttacgcgggaattgtttgggtcgttttgcgttttcgttcgtatttttgggggttgtttcgggtattcgttattttcggacgtttagggttggcggtttttagttggacggggagggagtcgagcggttgcgcgcggggaattgttgggatttcgtcgggtcgatttttttttttttttttattaggggtttttacggtggtttcgcgttttggggattacgttttttttatttcgtcgttttacgttttgattagcgggttcgggatttcgtcgaggattttgtacgtttttcggcgtgcgggttgcggagacgcgggttttttcgtggttttggggttttcgcgatttcgaggcgatcgaggttttttaggtttagttttcgttttgtcggtatttagtgcgtttgtatcggaatcgaggggttcgtttcgtattcgtttaagaaaattatttttcgggacgggtttggaaagtttttggcggttggtattcggttttagggtcgaatggatttcgaggtttttttttcgagatgttcgggcgggattttttttatttagcgcgcggag

SEQ ID NO: 39232 - DNA, 1178 bp, Artificial Sequence
  chemically treated genomic DNA (Homo sapiens) CpG-island No: 39232
ctccgcgcgctaaataaaaaaaatcccgcccgaacatctcgaaaaaaaaacctcgaaatccattcgaccctaaaaccgaataccaaccgccaaaaactttccaaacccgtcccgaaaaataattttcttaaacgaatacgaaacgaacccctcgattccgatacaaacgcactaaataccgacaaaacgaaaactaaacctaaaaaacctcgatcgcctcgaaatcgcgaaaaccccaaaaccacgaaaaaacccgcgtctccgcaacccgcacgccgaaaaacgtacaaaatcctcgacgaaatcccgaacccgctaatcaaaacgtaaaacgacgaaataaaaaaaacgtaatccccaaaacgcgaaaccaccgtaaaaacccctaataaaaaaaaaaaaaaaaatcgacccgacgaaatcccaacaattccccgcgcgcaaccgctcgactccctccccgtccaactaaaaaccgccaaccctaaacgtccgaaaataacgaatacccgaaacaacccccaaaaatacgaacgaaaacgcaaaacgacccaaacaattcccgcgtaaaaaacgcccgtctaaatccgcgacgtctcgaacccccaaacccccgcaccccgtatccgaaactccgaaacgcgcaaaacaataaaaccgtaaccgccgcttactcccaaccatctacgtccgaaaaacgaaaacgaaaacgcgacccgaaaaaataaaaaaaaaaaaaaaaaaccccaaaacgcgaaaacgaccccgtcgcgaaaaaacgaaacgaaacgaacccctatctactaaataaaaacccgaaaccgaaactaaaaccgcccaacgctacgaaacgaaaaaaaaaacttcgcgaaacgctctcgacgccaaaactcgcgtacaaaacccaaacccgaacgaccaaataaaaccaacgtcgctcgcgacatcgaaacgccccgctccttccgcaaaccccgaaataaaacgcaaaaacgaaaaccgaaaaccgaacacaatctaaaatccccgcgtcccgcaaaccgcgccgtctccaaaatcgccaacaatcgcgaataccgaacgccccccgataacgccacataaaaccctaaaaccgtccgaaacgcgaaaaaaatacaaaactacccctaaccccgctccaaactcaaaaccgaata

SEQ ID NO: 39233 - DNA, 686 bp, Artificial Sequence
  chemically treated genomic DNA (Homo sapiens) CpG-island No: 39233
gtagttggcgtcgtcggagtacgggcgggtgtagacgatgtcgtatatgatttagtaggtgtgtattacgtagattacgaatacgtttattattaagttggtgaaggagttgcggtcgttttatatggcggtttcgcgttcggcgttttcggttcgttcgttttttagtcgcgagtttcgttcgttcggcgtttagttcgtcgtttcgggtttcgtcgtttattggagagtcgtcgcgcgttatcgttatcgtcgcgggggaacgaatgcgtcgcgcgtcgtagatcgtcggtcgtttcgtatgtttcggtttcgtttttatttggcgtcgcgggattcgtcggtttcgcgcgtcgttttcgggtttcgtcgtttgtcggaagtggacgcgtcgcgcggttttttgggaaacggagtttcggtcgttgtcgcgtacgcgtatttaggatgcggcgcgtgtgtgacgttattcgttcgcgtcgtttttttggggtgttttttagggatttaggcgtttagttgttggggtcgcggagggcgttcgcggggcgtcggggaaggttagggtcgcggggttttcggggcgtcgtttttaatcgtcgacgtttgttagattattaagtgggggttatgtcgacgtgtgaggagtttggtggaaggtgatattggaatttcggtattgggtt

SEQ ID NO: 39234 - DNA, 686 bp, Artificial Sequence
  chemically treated genomic DNA (Homo sapiens) CpG-island No: 39234
aacccaataccgaaattccaatatcaccttccaccaaactcctcacacgtcgacataacccccacttaataatctaacaaacgtcgacgattaaaaacgacgccccgaaaaccccgcgaccctaaccttccccgacgccccgcgaacgccctccgcgaccccaacaactaaacgcctaaatccctaaaaaacaccccaaaaaaacgacgcgaacgaataacgtcacacacgcgccgcatcctaaatacgcgtacgcgacaacgaccgaaactccgtttcccaaaaaaccgcgcgacgcgtccacttccgacaaacgacgaaacccgaaaacgacgcgcgaaaccgacgaatcccgcgacgccaaataaaaacgaaaccgaaacatacgaaacgaccgacgatctacgacgcgcgacgcattcgttcccccgcgacgataacgataacgcgcgacgactctccaataaacgacgaaacccgaaacgacgaactaaacgccgaacgaacgaaactcgcgactaaaaaacgaacgaaccgaaaacgccgaacgcgaaaccgccatataaaacgaccgcaactccttcaccaacttaataataaacgtattcgtaatctacgtaatacacacctactaaatcatatacgacatcgtctacacccgcccgtactccgacgacgccaactac

SEQ ID NO: 39235 - DNA, 686 bp, Artificial Sequence
  chemically treated genomic DNA (Homo sapiens) CpG-island No: 39235
ggtttagtgtcggaattttagtattattttttattaggttttttatacgtcgatatggtttttatttggtggtttggtaggcgtcggcggttggggacggcgtttcggggatttcgcggttttagtttttttcggcgtttcgcgaacgtttttcgcggttttagtagttgagcgtttgggtttttgagaggtattttaggagggcggcgcgggcgggtaacgttatatacgcgtcgtattttggatgcgcgtgcgcggtagcggtcgagatttcgttttttagggagtcgcgcggcgcgtttattttcggtaggcggcggggttcggaagcggcgcgcggggtcggcgaatttcgcggcgttaggtgggagcggggtcggagtatgcggggcggtcggcggtttgcggcgcgcggcgtattcgttttttcgcggcggtggcggtggcgcgcggcggttttttagtgagcggcggagttcggagcggcgggttgggcgtcgggcgggcggggttcgcggttgagaggcgggcgggtcgggggcgtcgggcgcggggtcgttatgtggagcggtcgtagtttttttattagtttggtggtgggcgtgttcgtggtttacgtggtgtatatttgttgggttatgtacggtatcgtttatattcgttcgtgtttcggcgacgttaattgt

SEQ ID NO: 39236 - DNA, 686 bp, Artificial Sequence
  chemically treated genomic DNA (Homo sapiens) CpG-island No: 39236
acaattaacgtcgccgaaacacgaacgaatataaacgataccgtacataacccaacaaatatacaccacgtaaaccacgaacacgcccaccaccaaactaataaaaaaactacgaccgctccacataacgaccccgcgcccgacgcccccgacccgcccgcctctcaaccgcgaaccccgcccgcccgacgcccaacccgccgctccgaactccgccgctcactaaaaaaccgccgcgcgccaccgccaccgccgcgaaaaaacgaatacgccgcgcgccgcaaaccgccgaccgccccgcatactccgaccccgctcccacctaacgccgcgaaattcgccgaccccgcgcgccgcttccgaaccccgccgcctaccgaaaataaacgcgccgcgcgactccctaaaaaacgaaatctcgaccgctaccgcgcacgcgcatccaaaatacgacgcgtatataacgttacccgcccgcgccgccctcctaaaatacctctcaaaaacccaaacgctcaactactaaaaccgcgaaaaacgttcgcgaaacgccgaaaaaaactaaaaccgcgaaatccccgaaacgccgtccccaaccgccgacgcctaccaaaccaccaaataaaaaccatatcgacgtataaaaaacctaataaaaaataatactaaaattccgacactaaacc

SEQ ID NO: 39237 - DNA, 639 bp, Artificial Sequence
  chemically treated genomic DNA (Homo sapiens) CpG-island No: 39237
  misc_feature (581)..(581): n is either a, c, g or t
ggggttttcgcgtttggagtcgggggttttttaagattttttagttttttttacggggcgcgcggaagtacgacgttttgggtttcggggattattttatttttcgggttagggtattgggcgttcgtacgtattaattcggggagggacggtgtttttggttgcgaaagtagtaggatttcggttagaggggtcgcggtcgtttttcgggttcggttttttgttttattttttcgatatatagggttatataggttttagaagtagttaagttcgtcgcggtgtttcggtgcgcgttttttatcgttcgaggggagcgcgcgggtcgtcgcggcgtattcgggtatttgtgcgcgcgtatataatcggtttcgttttcgttaattgggttcggggttcggtcgtattattttcgggatgatggagtggggggtgtcgtttcgcgggcgcggcgggttgtgaggcggggtgggggtgttggtcgcgagttgagagggtggggttcggtttggcgcggagttagtaaggtttggcgttgtgatatttttttagacgttgcgttatgtttgtattttgtgttnatatttttcgttcgcggtggaaattgcgataaatgcggattttcgtgtcgttgttatt

SEQ ID NO: 39238 - DNA, 639 bp, Artificial Sequence
  chemically treated genomic DNA (Homo sapiens) CpG-island No: 39238
  misc_feature (59)..(59): n is either a, c, g or t
aataacaacgacacgaaaatccgcatttatcgcaatttccaccgcgaacgaaaaatatnaacacaaaatacaaacataacgcaacgtctaaaaaaatatcacaacgccaaaccttactaactccgcgccaaaccgaaccccaccctctcaactcgcgaccaacacccccaccccgcctcacaacccgccgcgcccgcgaaacgacaccccccactccatcatcccgaaaataatacgaccgaaccccgaacccaattaacgaaaacgaaaccgattatatacgcgcgcacaaatacccgaatacgccgcgacgacccgcgcgctcccctcgaacgataaaaaacgcgcaccgaaacaccgcgacgaacttaactacttctaaaacctatataaccctatatatcgaaaaaataaaacaaaaaaccgaacccgaaaaacgaccgcgacccctctaaccgaaatcctactactttcgcaaccaaaaacaccgtccctccccgaattaatacgtacgaacgcccaataccctaacccgaaaaataaaataatccccgaaacccaaaacgtcgtacttccgcgcgccccgtaaaaaaaactaaaaaatcttaaaaaacccccgactccaaacgcgaaaacccc

SEQ ID NO: 39239 - DNA, 639 bp, Artificial Sequence
  chemically treated genomic DNA (Homo sapiens) CpG-island No: 39239
  misc_feature (59)..(59): n is either a, c, g or t
ggtaatagcgatacggagattcgtatttgtcgtagtttttatcgcgggcgggaagtgtnaatatagaatataaatatagcgtaacgtttaaaggagtgttatagcgttaaattttgttggtttcgcgttaggtcgagttttatttttttagttcgcggttaatatttttatttcgttttatagttcgtcgcgttcgcggggcgatattttttattttattatttcggaggtggtgcggtcgagtttcggatttaattggcggaagcggggtcggttgtgtgcgcgcgtataaatgttcggatgcgtcgcgacgattcgcgcgtttttttcgggcggtagggggcgcgtatcgaggtatcgcggcgagtttggttgtttttggggtttgtgtggttttgtgtgtcggaaagatggagtaagaagtcgagttcgaggggcggtcgcgatttttttgatcgagattttgttgttttcgtagttaggagtatcgttttttttcggattagtgcgtacgagcgtttagtgttttggttcggagagtggaatgattttcgaggtttagggcgtcgtgttttcgcgcgtttcgtgaaggaaattggggagttttgagggattttcgattttaagcgcgaaaatttt

SEQ ID NO: 39240 - DNA, 639 bp, Artificial Sequence
  chemically treated genomic DNA (Homo sapiens) CpG-island No: 39240
  misc_feature (581)..(581): n is either a, c, g or t
aaaattttcgcgcttaaaatcgaaaatccctcaaaactccccaatttccttcacgaaacgcgcgaaaacacgacgccctaaacctcgaaaatcattccactctccgaaccaaaacactaaacgctcgtacgcactaatccgaaaaaaaacgatactcctaactacgaaaacaacaaaatctcgatcaaaaaaatcgcgaccgcccctcgaactcgacttcttactccatctttccgacacacaaaaccacacaaaccccaaaaacaaccaaactcgccgcgatacctcgatacgcgccccctaccgcccgaaaaaaacgcgcgaatcgtcgcgacgcatccgaacatttatacgcgcgcacacaaccgaccccgcttccgccaattaaatccgaaactcgaccgcaccacctccgaaataataaaataaaaaatatcgccccgcgaacgcgacgaactataaaacgaaataaaaatattaaccgcgaactaaaaaaataaaactcgacctaacgcgaaaccaacaaaatttaacgctataacactcctttaaacgttacgctatatttatattctatattnacacttcccgcccgcgataaaaactacgacaaatacgaatctccgtatcgctattacc

SEQ ID NO: 39241 - DNA, 766 bp, Artificial Sequence
  chemically treated genomic DNA (Homo sapiens) CpG-island No: 39241
aggagcgcggatggtttatttcgggggcggatcgtaggtagtttcgcggttagggaggcggttcggtagaggaagttttcggatagcggcgttagtttttttcggaggtttgtgttaggttcggtttttcggttatcgtattgggtcgtgttaggggcgcgtgcggggggtacgaggcgtagcggggcgcggacggtatcgaggggcgggcggcgtttgggcgcgcgaggttgggttttgtaggcggcggggggttggcgtttgtgttttcggtgttttcgcgcgcggtcgggtcgtggtattttaggtgttcgtagggttcgcggggcgcggggttggcgcgtaggattagggagagcgcggcgatgcggtggatggttttgcgtagcgtggcgattttggagagttttttgtcgtttaggtcgtgtcgtagcgttcggcgtagcgcgttgaaggtttcgttgtagtttaggatgcgtttgcgttttcgtacgttggcggttatgcgtcgcgttttggatcgtatcggtcgcgcgcgttttttgttcgtcggttttttcgtttcgtttcggttgtaggaagcgtcgttcgtttttagtattttcgaatcgttttcgggttcggggtaggggttttttaagtttttcgtagagttttcggttttttttcgcgtcgtgaggtttagttttggcgcgtttcgtagtatggttttttcgggtattcgttttttgttttagtttcggttttttgttttttgttttttgtt

SEQ ID NO: 39242 - DNA, 766 bp, Artificial Sequence
  chemically treated genomic DNA (Homo sapiens) CpG-island No: 39242
aacaaaaaacaaaaaacaaaaaaccgaaactaaaacaaaaaacgaatacccgaaaaaaccatactacgaaacgcgccaaaactaaacctcacgacgcgaaaaaaaaccgaaaactctacgaaaaacttaaaaaacccctaccccgaacccgaaaacgattcgaaaatactaaaaacgaacgacgcttcctacaaccgaaacgaaacgaaaaaaccgacgaacaaaaaacgcgcgcgaccgatacgatccaaaacgcgacgcataaccgccaacgtacgaaaacgcaaacgcatcctaaactacaacgaaaccttcaacgcgctacgccgaacgctacgacacgacctaaacgacaaaaaactctccaaaatcgccacgctacgcaaaaccatccaccgcatcgccgcgctctccctaatcctacgcgccaaccccgcgccccgcgaaccctacgaacacctaaaataccacgacccgaccgcgcgcgaaaacaccgaaaacacaaacgccaaccccccgccgcctacaaaacccaacctcgcgcgcccaaacgccgcccgcccctcgataccgtccgcgccccgctacgcctcgtaccccccgcacgcgcccctaacacgacccaatacgataaccgaaaaaccgaacctaacacaaacctccgaaaaaaactaacgccgctatccgaaaacttcctctaccgaaccgcctccctaaccgcgaaactacctacgatccgcccccgaaataaaccatccgcgctcct

SEQ ID NO: 39243 - DNA, 766 bp, Artificial Sequence
  chemically treated genomic DNA (Homo sapiens) CpG-island No: 39243
ggtagagggtagagggtagagggtcggggttggggtagagggcgagtgttcgggaaggttatgttgcggggcgcgttaggattaggttttacggcgcggaagggggtcgaggattttgcggaggatttggggggtttttgtttcgagttcgggggcgattcgggggtgttgggggcgaacggcgttttttgtagtcggggcgaggcggaggagtcggcgggtaggaggcgcgcgcggtcggtgcggtttaaggcgcggcgtatggtcgttaacgtgcgggagcgtaagcgtattttagattataacgaggtttttaacgcgttgcgtcgggcgttgcggtacgatttgggcggtaagaggttttttaagatcgttacgttgcgtagggttatttatcgtatcgtcgcgttttttttggttttgcgcgttagtttcgcgtttcgcgggttttgcggatatttggagtgttacggttcggtcgcgcgcggggatatcggggatataggcgttagtttttcgtcgtttgtagggtttagtttcgcgcgtttagacgtcgttcgtttttcggtgtcgttcgcgtttcgttgcgtttcgtgtttttcgtacgcgtttttggtacggtttagtgcggtggtcgaggggtcgggtttagtataggttttcgggggaagttggcgtcgttgttcgggggttttttttgtcgggtcgtttttttggtcgcggggttatttgcgattcgttttcgggatgggttattcgcgttttt

SEQ ID NO: 39244 - DNA, 766 bp, Artificial Sequence
  chemically treated genomic DNA (Homo sapiens) CpG-island No: 39244
aaaaacgcgaataacccatcccgaaaacgaatcgcaaataaccccgcgaccaaaaaaacgacccgacaaaaaaaacccccgaacaacgacgccaacttcccccgaaaacctatactaaacccgacccctcgaccaccgcactaaaccgtaccaaaaacgcgtacgaaaaacacgaaacgcaacgaaacgcgaacgacaccgaaaaacgaacgacgtctaaacgcgcgaaactaaaccctacaaacgacgaaaaactaacgcctatatccccgatatccccgcgcgcgaccgaaccgtaacactccaaatatccgcaaaacccgcgaaacgcgaaactaacgcgcaaaaccaaaaaaaacgcgacgatacgataaataaccctacgcaacgtaacgatcttaaaaaacctcttaccgcccaaatcgtaccgcaacgcccgacgcaacgcgttaaaaacctcgttataatctaaaatacgcttacgctcccgcacgttaacgaccatacgccgcgccttaaaccgcaccgaccgcgcgcgcctcctacccgccgactcctccgcctcgccccgactacaaaaaacgccgttcgcccccaacacccccgaatcgcccccgaactcgaaacaaaaaccccccaaatcctccgcaaaatcctcgacccccttccgcgccgtaaaacctaatcctaacgcgccccgcaacataaccttcccgaacactcgccctctaccccaaccccgaccctctaccctctaccctctacc

SEQ ID NO: 39245 - DNA, 544 bp, Artificial Sequence
  chemically treated genomic DNA (Homo sapiens) CpG-island No: 39245
tttcgcgtacgttaggaaacggttttacgcgaagaatttcgaggattcgggagaggcgtttttttttggaattcgggattttcgggcgttgcggggcgcggtcgattttaaagcgagcggcgggttcggtattttcgcggtatttgttcgtgttcgggagcgcgagttttcggttcgggcgggggcgggcgggggcgggcggggcgtcgtgatttagggtttggcggtttcgtcggcggtcgcgtaggtgtttattagcgtcgggcggggtttgggttttaaaagtttcggtttttttttcggaagtttcggcgtcgtttttcgagggaggacggaacgttcgttcgggagagaaagttcgggagtcgtttacgggggtttcgattttatttttttcggagagcgggtttcgggaagttttgagttttttttttttttaggcgagattttggcgttttaatttatacgttcggtgtggaagacgtaggggcgtaattgtagtttttgtttttttatgcgtttatttaataaaaatttttttttt

SEQ ID NO: 39246 - DNA, 544 bp, Artificial Sequence
  chemically treated genomic DNA (Homo sapiens) CpG-island No: 39246
aaaaaaaaaatttttattaaataaacgcataaaaaaacaaaaactacaattacgcccctacgtcttccacaccgaacgtataaattaaaacgccaaaatctcgcctaaaaaaaaaaaaaactcaaaacttcccgaaacccgctctccgaaaaaaataaaatcgaaacccccgtaaacgactcccgaactttctctcccgaacgaacgttccgtcctccctcgaaaaacgacgccgaaacttccgaaaaaaaaaccgaaacttttaaaacccaaaccccgcccgacgctaataaacacctacgcgaccgccgacgaaaccgccaaaccctaaatcacgacgccccgcccgcccccgcccgcccccgcccgaaccgaaaactcgcgctcccgaacacgaacaaataccgcgaaaataccgaacccgccgctcgctttaaaatcgaccgcgccccgcaacgcccgaaaatcccgaattccaaaaaaaaacgcctctcccgaatcctcgaaattcttcgcgtaaaaccgtttcctaacgtacgcgaaa

SEQ ID NO: 39247 - DNA, 544 bp, Artificial Sequence
  chemically treated genomic DNA (Homo sapiens) CpG-island No: 39247
aaaaaaaaagtttttgttgaatgagcgtatgaaggggtagaggttgtaattgcgtttttacgttttttatatcgggcgtgtgggttgaaacgttagggtttcgtttgggagagaaggaggtttagggtttttcgggattcgtttttcggagggggtggggtcgaggttttcgtgagcggttttcggattttttttttcgggcgggcgtttcgttttttttcggggagcggcgtcggaattttcggaggaagagtcggaatttttgaagtttaggtttcgttcggcgttaataggtatttacgcggtcgtcggcggaatcgttagattttaaattacggcgtttcgttcgttttcgttcgttttcgttcgggtcgagaattcgcgttttcgggtacgggtaggtgtcgcggaaatgtcgggttcgtcgttcgttttgaagtcggtcgcgtttcgtagcgttcgggagtttcgggttttaggagggggcgtttttttcgggttttcggggtttttcgcgtggggtcgttttttgacgtgcgcgggg

SEQ ID NO: 39248 - DNA, 544 bp, Artificial Sequence
  chemically treated genomic DNA (Homo sapiens) CpG-island No: 39248
ccccgcgcacgtcaaaaaacgaccccacgcgaaaaaccccgaaaacccgaaaaaaacgccccctcctaaaacccgaaactcccgaacgctacgaaacgcgaccgacttcaaaacgaacgacgaacccgacatttccgcgacacctacccgtacccgaaaacgcgaattctcgacccgaacgaaaacgaacgaaaacgaacgaaacgccgtaatttaaaatctaacgattccgccgacgaccgcgtaaatacctattaacgccgaacgaaacctaaacttcaaaaattccgactcttcctccgaaaattccgacgccgctccccgaaaaaaaacgaaacgcccgcccgaaaaaaaaaatccgaaaaccgctcacgaaaacctcgaccccaccccctccgaaaaacgaatcccgaaaaaccctaaacctccttctctcccaaacgaaaccctaacgtttcaacccacacgcccgatataaaaaacgtaaaaacgcaattacaacctctaccccttcatacgctcattcaacaaaaacttttttttt

SEQ ID NO: 39249 - DNA, 531 bp, Artificial Sequence
  chemically treated genomic DNA (Homo sapiens) CpG-island No: 39249
cgtaggtcgggtttcgggtttcggtttgatttaggtttttcgttggttttttttaggagtagtttcggtcggtttcgttttagtttttttcgtttttcgggggtcgttttttttcggtagtcgtagttttcgtttttgggtttcggcgttcgttgagtcgatagaggagaggcgtttcgtgcgttcgttttagtcgtttcgggcgtcgagttttaggattcgtttttcgcgttagttgttagggagcggttgttatagagttgagtagttgttcgcgtgcgtaggcggaagtttcggattgaggcgtcgttatttttgttgttcggacgcggagcgagaggttgagagagtcggagatattattcgtttttattcgtcgcgtagattttgtcggagtcgttgtcgttatggatgatcgagaggatttggtgtattaggcgaagttggtcgagtaggttgagcgatacgacggtgagttgggggggtaacggggggttggaattttcggattttttgtcgtcgtttatagag

SEQ ID NO: 39250 - DNA, 531 bp, Artificial Sequence
  chemically treated genomic DNA (Homo sapiens) CpG-island No: 39250
ctctataaacgacgacaaaaaatccgaaaattccaaccccccgttacccccccaactcaccgtcgtatcgctcaacctactcgaccaacttcgcctaatacaccaaatcctctcgatcatccataacgacaacgactccgacaaaatctacgcgacgaataaaaacgaataatatctccgactctctcaacctctcgctccgcgtccgaacaacaaaaataacgacgcctcaatccgaaacttccgcctacgcacgcgaacaactactcaactctataacaaccgctccctaacaactaacgcgaaaaacgaatcctaaaactcgacgcccgaaacgactaaaacgaacgcacgaaacgcctctcctctatcgactcaacgaacgccgaaacccaaaaacgaaaactacgactaccgaaaaaaaacgacccccgaaaaacgaaaaaaactaaaacgaaaccgaccgaaactactcctaaaaaaaaccaacgaaaaacctaaatcaaaccgaaacccgaaacccgacctacg

SEQ ID NO: 39251 - DNA, 531 bp, Artificial Sequence
  chemically treated genomic DNA (Homo sapiens) CpG-island No: 39251
ttttgtgggcggcggtagagggttcgagaattttagtttttcgttgtttttttaatttatcgtcgtatcgtttagtttgttcggttagtttcgtttggtatattagattttttcgattatttatagcggtagcggtttcggtagggtttgcgcgacggatggaagcggatagtgttttcgatttttttagtttttcgtttcgcgttcgggtagtaaaaatggcggcgttttaattcgggattttcgtttgcgtacgcggataattgtttagttttatggtaatcgttttttggtaattggcgcggggggcgggttttggaattcggcgttcgaagcggttggaacgagcgtacgagacgttttttttttgtcggtttagcgggcgtcggagtttagaggcgggaattgcgattgtcgaaagggagcggttttcggggaacgagaagggttgaggcggggtcggtcgggattgtttttgaaaaaagttagcgagagatttgggttagatcggggttcgaggttcgatttgcg

SEQ ID NO: 39252 - DNA, 531 bp, Artificial Sequence
  chemically treated genomic DNA (Homo sapiens) CpG-island No: 39252
cgcaaatcgaacctcgaaccccgatctaacccaaatctctcgctaacttttttcaaaaacaatcccgaccgaccccgcctcaacccttctcgttccccgaaaaccgctccctttcgacaatcgcaattcccgcctctaaactccgacgcccgctaaaccgacaaaaaaaaaacgtctcgtacgctcgttccaaccgcttcgaacgccgaattccaaaacccgccccccgcgccaattaccaaaaaacgattaccataaaactaaacaattatccgcgtacgcaaacgaaaatcccgaattaaaacgccgccatttttactacccgaacgcgaaacgaaaaactaaaaaaatcgaaaacactatccgcttccatccgtcgcgcaaaccctaccgaaaccgctaccgctataaataatcgaaaaaatctaatataccaaacgaaactaaccgaacaaactaaacgatacgacgataaattaaaaaaacaacgaaaaactaaaattctcgaaccctctaccgccgcccacaaaa

SEQ ID NO: 39253 - DNA, 860 bp, Artificial Sequence
  chemically treated genomic DNA (Homo sapiens) CpG-island No: 39253
gacgcggggcgcgtcgcggtttttcgtttaatcggcgggggttttaggttttgttcggtaaggtttgcgtgttttggggcggatttttttttcgggcggttcgtcgggcggacgcgcgtggtttcgcgtagggcggggagaggcggtggtttgtgggcgttcggtttcgaatttgttagatttgcggagtcggtttttagtagcgggcgcggcgggcgcgagtacgattttatttttttgcggtcgcgggtggagtagcggagttcgtttcgttgagtcggtcgtgggcggggatatgagttgcggtttcgcggtaggttttaggtattaaatagatgtgtcgttttttcgcggagtttcggcggagcgtcggggtcggttttgcgattcgtcgttagcggtttcggaatttgaggatagggttgggcgtttttaatttataacgtgtttcgttttttataggatggggagggacgcgcggtattgttttcgagaattggcgtttcggtgaagtaggcgtcgtcggtcgttcgttttttttaagtcgtttcgtatcgcggtcgtttagtttttgttatggtcggttttggcgcgtggaagcgttttaaatttatgttaaggaaggatgatgcgtcgttgtttttaaatgatattagcgtttttgatttttcggatgaggcgggggacgaggggttttttcggtttaataaatttcgagttgtggtggtcgatgacggtttcgaagtttcggaaaggtttgttaacggggcgtattcgattttttaggtcgacgatgattttttattggattaagatttatttttgattaatagttagttgagtttgaaggtggatttttg

SEQ ID NO: 39254 - DNA, 860 bp, Artificial Sequence
  chemically treated genomic DNA (Homo sapiens) CpG-island No: 39254
caaaaatccaccttcaaactcaactaactattaatcaaaaataaatcttaatccaataaaaaatcatcgtcgacctaaaaaatcgaatacgccccgttaacaaacctttccgaaacttcgaaaccgtcatcgaccaccacaactcgaaatttattaaaccgaaaaaacccctcgtcccccgcctcatccgaaaaatcaaaaacgctaatatcatttaaaaacaacgacgcatcatccttccttaacataaatttaaaacgcttccacgcgccaaaaccgaccataacaaaaactaaacgaccgcgatacgaaacgacttaaaaaaaacgaacgaccgacgacgcctacttcaccgaaacgccaattctcgaaaacaataccgcgcgtccctccccatcctataaaaaacgaaacacgttataaattaaaaacgcccaaccctatcctcaaattccgaaaccgctaacgacgaatcgcaaaaccgaccccgacgctccgccgaaactccgcgaaaaaacgacacatctatttaatacctaaaacctaccgcgaaaccgcaactcatatccccgcccacgaccgactcaacgaaacgaactccgctactccacccgcgaccgcaaaaaaataaaatcgtactcgcgcccgccgcgcccgctactaaaaaccgactccgcaaatctaacaaattcgaaaccgaacgcccacaaaccaccgcctctccccgccctacgcgaaaccacgcgcgtccgcccgacgaaccgcccgaaaaaaaaatccgccccaaaacacgcaaaccttaccgaacaaaacctaaaacccccgccgattaaacgaaaaaccgcgacgcgccccgcgtc

SEQ ID NO: 39255 - DNA, 860 bp, Artificial Sequence
  chemically treated genomic DNA (Homo sapiens) CpG-island No: 39255
taggagtttatttttaaatttagttgattgttggttaaaggtaagttttggtttagtaaggaattatcgtcggtttggagggtcgggtgcgtttcgttaataggttttttcggggtttcggaatcgttatcggttattataattcgaagtttgttgaatcgagaaagtttttcgtttttcgttttattcgagaagttaaaggcgttggtgttatttaaaaatagcggcgtattatttttttttagtatagatttgaggcgtttttacgcgttagagtcggttatggtagaggttgagcggtcgcggtgcggaacggtttgggggaggcggacggtcggcggcgtttattttatcggagcgttagttttcgagggtagtgtcgcgcgtttttttttattttgtggaaaacgaaatacgttataaattaaaggcgtttaattttgtttttaagtttcgaagtcgttggcggcgggtcgtagggtcgatttcgacgtttcgtcggggtttcgcgagggggcggtatatttatttaatatttggggtttgtcgcggggtcgtaatttatattttcgtttacggtcggtttagcgaggcgggtttcgttgttttattcgcggtcgtaggagagtggggtcgtgttcgcgttcgtcgcgttcgttgttggaggtcggtttcgtaggtttgataggttcgggatcggacgtttataagttatcgttttttttcgttttgcgcgaggttacgcgcgttcgttcggcgagtcgttcgaagggagggttcgttttaagatacgtaggttttgtcgggtaaggtttggggttttcgtcgattgggcgaggggtcgcggcgcgtttcgcgtt

SEQ ID NO: 39256 - DNA, 860 bp, Artificial Sequence
  chemically treated genomic DNA (Homo sapiens) CpG-island No: 39256
aacgcgaaacgcgccgcgacccctcgcccaatcgacgaaaaccccaaaccttacccgacaaaacctacgtatcttaaaacgaaccctcccttcgaacgactcgccgaacgaacgcgcgtaacctcgcgcaaaacgaaaaaaaacgataacttataaacgtccgatcccgaacctatcaaacctacgaaaccgacctccaacaacgaacgcgacgaacgcgaacacgaccccactctcctacgaccgcgaataaaacaacgaaacccgcctcgctaaaccgaccgtaaacgaaaatataaattacgaccccgcgacaaaccccaaatattaaataaatataccgccccctcgcgaaaccccgacgaaacgtcgaaatcgaccctacgacccgccgccaacgacttcgaaacttaaaaacaaaattaaacgcctttaatttataacgtatttcgttttccacaaaataaaaaaaaacgcgcgacactaccctcgaaaactaacgctccgataaaataaacgccgccgaccgtccgcctcccccaaaccgttccgcaccgcgaccgctcaacctctaccataaccgactctaacgcgtaaaaacgcctcaaatctatactaaaaaaaaataatacgccgctatttttaaataacaccaacgcctttaacttctcgaataaaacgaaaaacgaaaaactttctcgattcaacaaacttcgaattataataaccgataacgattccgaaaccccgaaaaaacctattaacgaaacgcacccgaccctccaaaccgacgataattccttactaaaccaaaacttacctttaaccaacaatcaactaaatttaaaaataaactccta

SEQ ID NO: 39257 - DNA, 790 bp, Artificial Sequence
  chemically treated genomic DNA (Homo sapiens) CpG-island No: 39257
gtttcgtttcggtcgcgcgtattttgggcgtgagtacgagcgcggcgtcgtcgtgtacggttacgatgggtagcgaggtttgcgtcgataggaagtcgaggatgggcgcgacggcgggcgcgcgcgagtcgttttcgaagattacgtcgtgtacgcgtaatttcgatagtaggtcgtagagttgtagtacgaggttgcgcgggttcgagtcgttgagtattagcgttacgggtcgtacgtttaggttcgggttgcgtatcgtcgtcgttacggtcgggtttaggcgtgtcgtttcggtcgcgtacgcgggtttcgagaatacgagcgttacgttgagcggtcgcgtttcgtcgaggtcgtcgtcgggtttatcggtttcgttcggtttcggcgtttttttcgggaacgggttggcgtaggttagcgttagtagtagtagtattttagcggggtttcgagggtcgcgggggttatcggcgtcgcgtatcgtttgcgggtttcgtcgggcggtttttgagcgttcgggtcgggagagacggggaggagagggaggtatagacgggagacgtagggatagggagacgagataaagagacgtatagaggaggagatgtagcgagggataggcgtcgagatggggaggatagggagcggtcggggtgatggaatagagggagagataggaacggaggacgagagagatggaagggagagagatagagggagagagaaatggaggagagatagagggagagacgggtagaggtagagagagatggaggggagagag

SEQ ID NO: 39258 - DNA, 790 bp, Artificial Sequence
  chemically treated genomic DNA (Homo sapiens) CpG-island No: 39258
ctctctcccctccatctctctctacctctacccgtctctccctctatctctcctccatttctctctccctctatctctctcccttccatctctctcgtcctccgttcctatctctccctctattccatcaccccgaccgctccctatcctccccatctcgacgcctatccctcgctacatctcctcctctatacgtctctttatctcgtctccctatccctacgtctcccgtctatacctccctctcctccccgtctctcccgacccgaacgctcaaaaaccgcccgacgaaacccgcaaacgatacgcgacgccgataacccccgcgaccctcgaaaccccgctaaaatactactactactaacgctaacctacgccaacccgttcccgaaaaaaacgccgaaaccgaacgaaaccgataaacccgacgacgacctcgacgaaacgcgaccgctcaacgtaacgctcgtattctcgaaacccgcgtacgcgaccgaaacgacacgcctaaacccgaccgtaacgacgacgatacgcaacccgaacctaaacgtacgacccgtaacgctaatactcaacgactcgaacccgcgcaacctcgtactacaactctacgacctactatcgaaattacgcgtacacgacgtaatcttcgaaaacgactcgcgcgcgcccgccgtcgcgcccatcctcgacttcctatcgacgcaaacctcgctacccatcgtaaccgtacacgacgacgccgcgctcgtactcacgcccaaaatacgcgcgaccgaaacgaaac

SEQ ID NO: 39259 - DNA, 790 bp, Artificial Sequence
  chemically treated genomic DNA (Homo sapiens) CpG-island No: 39259
tttttttttttttatttttttttatttttgttcgtttttttttttgttttttttttatttttttttttttttgttttttttttttttatttttttcgtttttcgtttttgtttttttttttgttttattatttcgatcgttttttgttttttttatttcggcgtttgtttttcgttgtatttttttttttgtgcgtttttttatttcgtttttttgtttttgcgtttttcgtttgtgtttttttttttttttcgtttttttcggttcgggcgtttagaggtcgttcggcggggttcgtaggcgatgcgcggcgtcggtggttttcgcggttttcggggtttcgttaagatgttgttgttgttggcgttggtttgcgttagttcgttttcggaggaggcgtcggggtcgggcggggtcggtgggttcggcggcggtttcggcggggcgcggtcgtttaacgtggcgttcgtgttttcggggttcgcgtacgcggtcgaggcggtacgtttgggttcggtcgtggcggcggcggtgcgtagttcgggtttagacgtgcggttcgtggcgttggtgtttaacggttcggattcgcgtagtttcgtgttgtagttttgcgatttgttgtcggggttgcgcgtgtacggcgtggttttcgaagacgattcgcgcgcgttcgtcgtcgcgtttattttcgattttttgtcggcgtagatttcgttgtttatcgtggtcgtgtacggcggcgtcgcgttcgtgtttacgtttaaggtgcgcgcgatcggggcggggt

SEQ ID NO: 39260 - DNA, 790 bp, Artificial Sequence
  chemically treated genomic DNA (Homo sapiens) CpG-island No: 39260
accccgccccgatcgcgcgcaccttaaacgtaaacacgaacgcgacgccgccgtacacgaccacgataaacaacgaaatctacgccgacaaaaaatcgaaaataaacgcgacgacgaacgcgcgcgaatcgtcttcgaaaaccacgccgtacacgcgcaaccccgacaacaaatcgcaaaactacaacacgaaactacgcgaatccgaaccgttaaacaccaacgccacgaaccgcacgtctaaacccgaactacgcaccgccgccgccacgaccgaacccaaacgtaccgcctcgaccgcgtacgcgaaccccgaaaacacgaacgccacgttaaacgaccgcgccccgccgaaaccgccgccgaacccaccgaccccgcccgaccccgacgcctcctccgaaaacgaactaacgcaaaccaacgccaacaacaacaacatcttaacgaaaccccgaaaaccgcgaaaaccaccgacgccgcgcatcgcctacgaaccccgccgaacgacctctaaacgcccgaaccgaaaaaaacgaaaaaaaaaaaaaaacacaaacgaaaaacgcaaaaacaaaaaaacgaaataaaaaaacgcacaaaaaaaaaaatacaacgaaaaacaaacgccgaaataaaaaaaacaaaaaacgatcgaaataataaaacaaaaaaaaaaacaaaaacgaaaaacgaaaaaaataaaaaaaaaaaaaacaaaaaaaaaaaaaaataaaaaaaaaacaaaaaaaaaaacgaacaaaaataaaaaaaaataaaaaaaaaaaaa

SEQ ID NO: 39261 - DNA, 611 bp, Artificial Sequence
  chemically treated genomic DNA (Homo sapiens) CpG-island No: 39261
gcggttgcggcgttgcgttttaggggtcgataaggacgaggtttgggattcggagggcgtggattcgtttcgtaggcggggattttacgtggcgcggggttggcggaggggttattgaagggttttaagtaggaaaacggcgcgaaagtagttgtttacgcggttttacggtagaacgatcggagatagaattagttttaaggcgattttaatattttgacgggatatatgaatttattcggggtggagagagcggtgcggggattttaaggtttgtatcgttttttatatttcgggtatagaagcgtgagggtatcgttaagcgaatatttaatttaaataaaggaaaatttacgcgtcgtagttgcgttatatttttacgttatttattttcgggtttgtaggcggttgcgcgcgaacggagaggtcgggtcggggcgtggttagcgacgtggcgggcggggtttgaatgtttattggacggggtttgtatttttttttttttatttttgggcgtgtttcggtttttcgcgttttgtaagttatatttgttagttaggttggagtcgttttacggtttgtgatttgggattttattaggagggttaacg

SEQ ID NO: 39262 - DNA, 611 bp, Artificial Sequence
  chemically treated genomic DNA (Homo sapiens) CpG-island No: 39262
cgttaaccctcctaataaaatcccaaatcacaaaccgtaaaacgactccaacctaactaacaaatataacttacaaaacgcgaaaaaccgaaacacgcccaaaaataaaaaaaaaaaaatacaaaccccgtccaataaacattcaaaccccgcccgccacgtcgctaaccacgccccgacccgacctctccgttcgcgcgcaaccgcctacaaacccgaaaataaataacgtaaaaatataacgcaactacgacgcgtaaattttcctttatttaaattaaatattcgcttaacgataccctcacgcttctatacccgaaatataaaaaacgatacaaaccttaaaatccccgcaccgctctctccaccccgaataaattcatatatcccgtcaaaatattaaaatcgccttaaaactaattctatctccgatcgttctaccgtaaaaccgcgtaaacaactactttcgcgccgttttcctacttaaaacccttcaataacccctccgccaaccccgcgccacgtaaaatccccgcctacgaaacgaatccacgccctccgaatcccaaacctcgtccttatcgacccctaaaacgcaacgccgcaaccgc

SEQ ID NO: 39263 - DNA, 611 bp, Artificial Sequence
  chemically treated genomic DNA (Homo sapiens) CpG-island No: 39263
cgttgatttttttagtgagattttaggttataaatcgtggagcggttttagtttgattggtaagtgtggtttgtaaaacgcggaaaatcgagatacgtttagagataggaggagggaagtgtaggtttcgtttaataagtatttaggtttcgttcgttacgtcgttggttacgtttcggttcggttttttcgttcgcgcgtagtcgtttgtagattcggaagtggatggcgtggagatatggcgtaattgcggcgcgtgagtttttttttgtttagattaagtgttcgtttagcggtgtttttacgtttttgtattcgggatgtggggggcggtatagattttgaaattttcgtatcgttttttttatttcgagtaaatttatgtgtttcgttagagtgttaaaatcgttttagggttggttttgttttcggtcgttttgtcgtagggtcgcgtaggtagttgttttcgcgtcgtttttttgtttaaaattttttagtgattttttcgttagtttcgcgttacgtaaagttttcgtttgcgaggcggatttacgtttttcgggttttaagtttcgtttttgtcggtttttggggcgtagcgtcgtagtcgt

SEQ ID NO: 39264 - DNA, 611 bp, Artificial Sequence
  chemically treated genomic DNA (Homo sapiens) CpG-island No: 39264
acgactacgacgctacgccccaaaaaccgacaaaaacgaaacttaaaacccgaaaaacgtaaatccgcctcgcaaacgaaaactttacgtaacgcgaaactaacgaaaaaatcactaaaaaattttaaacaaaaaaacgacgcgaaaacaactacctacgcgaccctacgacaaaacgaccgaaaacaaaaccaaccctaaaacgattttaacactctaacgaaacacataaatttactcgaaataaaaaaaacgatacgaaaatttcaaaatctataccgccccccacatcccgaatacaaaaacgtaaaaacaccgctaaacgaacacttaatctaaacaaaaaaaaactcacgcgccgcaattacgccatatctccacgccatccacttccgaatctacaaacgactacgcgcgaacgaaaaaaccgaaccgaaacgtaaccaacgacgtaacgaacgaaacctaaatacttattaaacgaaacctacacttccctcctcctatctctaaacgtatctcgattttccgcgttttacaaaccacacttaccaatcaaactaaaaccgctccacgatttataacctaaaatctcactaaaaaaatcaacg

SEQ ID NO: 39265 - DNA, 1220 bp, Artificial Sequence
  chemically treated genomic DNA (Homo sapiens) CpG-island No: 39265
ggtaaaaagttaaggcggcgagtgtgtaaaaagttgtgtcggcggtggggtaaaaagtcgcggcggcgggtgtgtggtagaaagtcgcggcgggtaaaaagtcgcggcggcgaggggggtaaaaattcgcggcgggtaaaaagtcgcggcggcgcggggtaaaaagtcgcggtgggtaagaagtcgaggcggggtggaggtaaaaagtcgcggcggcgggtggtaaaaagttgcggcgggtaaaaggtcgcgggggtaggggggaaaagttacggcggggaaaaagtcgcggcggcggggtgcgaaaagcggcggggggtaaaacgtttcggcgggtaaaaagtcgaggtagggtgggggtaaaaagttgcggcggcgggtgggtggtagaaagtcgcggcggtgaggggggtataaagtcgcggcgggtaaaaagtcgaggaggggtgggggtaaaaagtcgcggcgggtaaaaagtcgaggaggggtgggggtaaaaagttgcggcgggtgaaaagtcgcgggggtaggggggaaaaatttacggcgggaaaaagcggcggcggcgagggggtaaaaagtcgcggggtgttaaaagcggcggggtgtaaaaggcggcggggggtaaaaagtcgtagcggcggggggcgggtaaaaagtcgcggcgataaaattcgtaacggcgaggggttaaaaagtcggggcggattaaaagttttggcgtcggggcggcgggggcgtaaaaagtcgtagcggcgggtgggggtagaaagtcgtagcggcgatggggtaaaaagttacggcggcgggggtaaaaagtcgttgcgggtaaaaagtcgcggcggcggggataaaaaggcgcggcgggtaaaaagtcgtggcgtaggggggataaaaagtcgcggcgggggggtgggggaagttacggcgggtaaaaagtcgcggcggcgaggggtataaagtttcggcgggtaaaaattcgaggcggggtggggtttaaaagtcgcggcggttgggggtaaaaagtcgaggcgggtaaaaagtcgtgggggtaggggggaaaaagttacggcggcgggggggtaaaaagcggaggggggtaaaatgtcgtagtagcgggggataaaaagtcgcggcggtaaaattcgtagcggcgaggggttaaaaagtcgcgggcgggttaaaagttttggcgtcggggggtataaagtagcggcggg

SEQ ID NO: 39266 - DNA, 1220 bp, Artificial Sequence
  chemically treated genomic DNA (Homo sapiens) CpG-island No: 39266
cccgccgctactttataccccccgacgccaaaacttttaacccgcccgcgactttttaacccctcgccgctacgaattttaccgccgcgactttttatcccccgctactacgacattttacccccctccgctttttacccccccgccgccgtaactttttcccccctacccccacgactttttacccgcctcgactttttacccccaaccgccgcgacttttaaaccccaccccgcctcgaatttttacccgccgaaactttatacccctcgccgccgcgactttttacccgccgtaacttcccccacccccccgccgcgactttttatcccccctacgccacgactttttacccgccgcgcctttttatccccgccgccgcgactttttacccgcaacgactttttacccccgccgccgtaactttttaccccatcgccgctacgactttctacccccacccgccgctacgactttttacgcccccgccgccccgacgccaaaacttttaatccgccccgactttttaacccctcgccgttacgaattttatcgccgcgactttttacccgccccccgccgctacgactttttaccccccgccgccttttacaccccgccgcttttaacaccccgcgactttttaccccctcgccgccgccgctttttcccgccgtaaatttttcccccctacccccgcgacttttcacccgccgcaactttttacccccacccctcctcgactttttacccgccgcgactttttacccccacccctcctcgactttttacccgccgcgactttatacccccctcaccgccgcgactttctaccacccacccgccgccgcaactttttacccccaccctacctcgactttttacccgccgaaacgttttaccccccgccgcttttcgcaccccgccgccgcgactttttccccgccgtaacttttcccccctacccccgcgaccttttacccgccgcaactttttaccacccgccgccgcgactttttacctccaccccgcctcgacttcttacccaccgcgactttttaccccgcgccgccgcgactttttacccgccgcgaatttttacccccctcgccgccgcgactttttacccgccgcgactttctaccacacacccgccgccgcgactttttaccccaccgccgacacaactttttacacactcgccgccttaactttttacc

SEQ ID NO: 39267 - DNA, 1220 bp, Artificial Sequence
  chemically treated genomic DNA (Homo sapiens) CpG-island No: 39267
ttcgtcgttgttttgtgtttttcggcgttagggtttttagttcgttcgcggttttttgatttttcgtcgttgcgaattttgtcgtcgcggttttttgtttttcgttgttgcggtattttgttttttttcgttttttgttttttcgtcgtcgtggtttttttttttttgtttttacggttttttattcgtttcggttttttatttttagtcgtcgcggtttttagattttatttcgtttcgggtttttgttcgtcggggttttgtgtttttcgtcgtcgcggttttttgttcgtcgtggttttttttattttttcgtcgcggttttttgttttttttgcgttacggttttttgttcgtcgcgtttttttgttttcgtcgtcgcgattttttgttcgtagcgattttttattttcgtcgtcgtggttttttgttttatcgtcgttgcggttttttgtttttattcgtcgttgcggttttttgcgttttcgtcgtttcggcgttagggtttttagttcgtttcggttttttgatttttcgtcgttgcgagttttgtcgtcgcggttttttgttcgtttttcgtcgttgcggttttttgtttttcgtcgttttttgtatttcgtcgtttttggtatttcgcggttttttgttttttcgtcgtcgtcgttttttttcgtcgtggattttttttttttgttttcgcgattttttattcgtcgtagttttttgtttttattttttttcggttttttgttcgtcgcggttttttgtttttattttttttcggttttttgttcgtcgcggttttgtgttttttttatcgtcgcggttttttgttatttattcgtcgtcgtagttttttgtttttattttgtttcggttttttgttcgtcgaggcgttttgtttttcgtcgtttttcgtatttcgtcgtcgcggtttttttttcgtcgtggttttttttttttgttttcgcggttttttattcgtcgtagttttttgttattcgtcgtcgcggttttttgtttttatttcgtttcggttttttgtttatcgcggttttttatttcgcgtcgtcgcggttttttgttcgtcgcggatttttgtttttttcgtcgtcgcggttttttgttcgtcgcggttttttgttatatattcgtcgtcgcggttttttgttttatcgtcgatatagttttttgtatattcgtcgttttggttttttgtt

SEQ ID NO: 39268 - DNA, 1220 bp, Artificial Sequence
  chemically treated genomic DNA (Homo sapiens) CpG-island No: 39268
aacaaaaaaccaaaacgacgaatatacaaaaaactatatcgacgataaaacaaaaaaccgcgacgacgaatatataacaaaaaaccgcgacgaacaaaaaaccgcgacgacgaaaaaaacaaaaatccgcgacgaacaaaaaaccgcgacgacgcgaaataaaaaaccgcgataaacaaaaaaccgaaacgaaataaaaacaaaaaaccgcgacgacgaataacaaaaaactacgacgaataaaaaaccgcgaaaacaaaaaaaaaaaaccacgacgaaaaaaaaaccgcgacgacgaaatacgaaaaacgacgaaaaacaaaacgcctcgacgaacaaaaaaccgaaacaaaataaaaacaaaaaactacgacgacgaataaataacaaaaaaccgcgacgataaaaaaaacacaaaaccgcgacgaacaaaaaaccgaaaaaaaataaaaacaaaaaaccgcgacgaacaaaaaaccgaaaaaaaataaaaacaaaaaactacgacgaataaaaaatcgcgaaaacaaaaaaaaaaaatccacgacgaaaaaaaacgacgacgacgaaaaaacaaaaaaccgcgaaataccaaaaacgacgaaatacaaaaaacgacgaaaaacaaaaaaccgcaacgacgaaaaacgaacaaaaaaccgcgacgacaaaactcgcaacgacgaaaaatcaaaaaaccgaaacgaactaaaaaccctaacgccgaaacgacgaaaacgcaaaaaaccgcaacgacgaataaaaacaaaaaaccgcaacgacgataaaacaaaaaaccacgacgacgaaaataaaaaatcgctacgaacaaaaaatcgcgacgacgaaaacaaaaaaacgcgacgaacaaaaaaccgtaacgcaaaaaaaacaaaaaaccgcgacgaaaaaataaaaaaaaccacgacgaacaaaaaaccgcgacgacgaaaaacacaaaaccccgacgaacaaaaacccgaaacgaaataaaatctaaaaaccgcgacgactaaaaataaaaaaccgaaacgaataaaaaaccgtaaaaacaaaaaaaaaaaaaccacgacgacgaaaaaacaaaaaacgaaaaaaaacaaaataccgcaacaacgaaaaacaaaaaaccgcgacgacaaaattcgcaacgacgaaaaatcaaaaaaccgcgaacgaactaaaaaccctaacgccgaaaaacacaaaacaacgacgaa

SEQ ID NO: 39269 - DNA, 649 bp, Artificial Sequence
  chemically treated genomic DNA (Homo sapiens) CpG-island No: 39269
tattcgcgttttttgtcgtttcgggacgcgtatggttcggcggttatggcgaggaggtcggagaaagcggtcggtcggtcgcgggttgtaaaaggtttggcggcgtggtttgatttagtggtcggggttgtagtataggttgttttcggtagtcggcggagttagcgcgtttacgtgacggtttcggtttttcggtgagttttttaaatagacgtatatttagttatacgcgcgcgttcgcgcgcgcgtatatataatatatatatatatatatatacgtacgtattttcgcgcgtatacgttcgttcgttcgcgttgtttttgcgtttttatttcggttcgtttattatttcgttttttcgttttttttgcggtttttcgttttgcgcgtatatattatatatacgtatacgtatatatacgcgcgtatatacgtagtcggtataggcggcggcggcggttgtttaagttaggacgaatttatttaggtatcgttttgagaaggcggtagcggcggcggcggcggcggcggcggtagttcgagtattttttttttttcggagagggagtatcgtcgagagttttcgttttttttgttattttttttttttttttttttttttattttcgagagaatttttttttggtt

SEQ ID NO: 39270 - DNA, 649 bp, Artificial Sequence
  chemically treated genomic DNA (Homo sapiens) CpG-island No: 39270
aaccaaaaaaaaattctctcgaaaataaaaaaaaaaaaaaaaaaaaaaaataacaaaaaaaacgaaaactctcgacgatactccctctccgaaaaaaaaaaaatactcgaactaccgccgccgccgccgccgccgccgctaccgccttctcaaaacgatacctaaataaattcgtcctaacttaaacaaccgccgccgccgcctataccgactacgtatatacgcgcgtatatatacgtatacgtatatataatatatacgcgcaaaacgaaaaaccgcaaaaaaaacgaaaaaacgaaataataaacgaaccgaaataaaaacgcaaaaacaacgcgaacgaacgaacgtatacgcgcgaaaatacgtacgtatatatatatatatatatattatatatacgcgcgcgcgaacgcgcgcgtataactaaatatacgtctatttaaaaaactcaccgaaaaaccgaaaccgtcacgtaaacgcgctaactccgccgactaccgaaaacaacctatactacaaccccgaccactaaatcaaaccacgccgccaaaccttttacaacccgcgaccgaccgaccgctttctccgacctcctcgccataaccgccgaaccatacgcgtcccgaaacgacaaaaaacgcgaata

SEQ ID NO: 39271 - DNA, 649 bp, Artificial Sequence
  chemically treated genomic DNA (Homo sapiens) CpG-island No: 39271
agttaagaagaaattttttcgaaaataaaagaaaaggagggggaagggaatggtaaagggaacggaaattttcggcggtgtttttttttcgggagaggagggatgttcgggttgtcgtcgtcgtcgtcgtcgtcgtcgttgtcgtttttttaagacggtatttagataggttcgttttgatttgggtagtcgtcgtcgtcgtttgtgtcggttgcgtgtgtgcgcgcgtgtgtgtgcgtgtgcgtgtgtgtggtgtgtgcgcgtagagcgagagatcgtaggggaagcgagagggcgagataatgagcgagtcgggatggaggcgtagaggtagcgcgagcgggcgggcgtgtgcgcgcgggggtgcgtgcgtgtgtgtgtgtgtgtgtgtgttgtgtgtgcgcgcgcgcgagcgcgcgcgtgtggttgggtgtgcgtttgtttggggagtttatcggagagtcggggtcgttacgtgggcgcgttgatttcgtcggttgtcggggatagtttgtattatagtttcggttattaaattagattacgtcgttagattttttgtagttcgcggtcggtcggtcgtttttttcgattttttcgttatagtcgtcgggttatgcgcgtttcgggacggtagggggcgcgggtg

SEQ ID NO: 39272 - DNA, 649 bp, Artificial Sequence
  chemically treated genomic DNA (Homo sapiens) CpG-island No: 39272
cacccgcgccccctaccgtcccgaaacgcgcataacccgacgactataacgaaaaaatcgaaaaaaacgaccgaccgaccgcgaactacaaaaaatctaacgacgtaatctaatttaataaccgaaactataatacaaactatccccgacaaccgacgaaatcaacgcgcccacgtaacgaccccgactctccgataaactccccaaacaaacgcacacccaaccacacgcgcgcgctcgcgcgcgcgcacacacaacacacacacacacacacacacgcacgcacccccgcgcgcacacgcccgcccgctcgcgctacctctacgcctccatcccgactcgctcattatctcgccctctcgcttcccctacgatctctcgctctacgcgcacacaccacacacacgcacacgcacacacacgcgcgcacacacgcaaccgacacaaacgacgacgacgactacccaaatcaaaacgaacctatctaaataccgtcttaaaaaaacgacaacgacgacgacgacgacgacgacgacaacccgaacatccctcctctcccgaaaaaaaaacaccgccgaaaatttccgttccctttaccattcccttccccctccttttcttttattttcgaaaaaatttcttcttaact

SEQ ID NO: 39273 - DNA, 1088 bp, Artificial Sequence
  chemically treated genomic DNA (Homo sapiens) CpG-island No: 39273
tacgtgtatgcgtgtgtgtgtgtgtgtacgcgggtgtgtgtttgtgtgtgggtgtgcgcgcgcgttcgcgtgtttgggttggggaaagttggggttagaggagcggtggaggagtaatggtgaaaggtattagttattcggtgggcggtttagggcgtcggggattttcgggtttcgcggagcgcgtatcgcggggggagttggttcgttaggggtggggggtgtcgaggaaaagagtttcgtttagttcggttcgtttggttttcgcggcgtttttttttcggagttcgttagttagtttcggtcgtttgcggggttgttcgtcgcgttcgtcggcgttggcgcgttttttttcgggttcggggcgtagcgcgtttttgcgagttttcggtagagaagataaatttcgaaagtaatcgaaaaatgttcgtcgtcgtcgttttcgtattattttaagtttttaagaaataaatcgttaaattattagttgttaggtgaagattttttcggcgtgggttttttagaaagcgttgcggttattcgagtgaataatatataagggtcgttcggagttttggagaggttttcgtcgtcgcggtagtagtagcgggaggcggcggcgagttttgggtagatcgtcgggtcgtcgtcgcgggtgggggcgtttgggttgttttcgggaagtacgtcggtcgttcgggcggggcgggagggtagtttaggcgcgcggagtgaggattcgcggtgaggtagtcgggagatacgaggtttcgttgcgagtagaaatttgtaggagttattgaggtggtcgggtcggcgttggagttgggggtttggagaagtacgatcggggttcggagggtgttcggttgttcgtggtcggcgtcggtggttttttttaggttattttgtttcgtttggcgggttttgggtgttttttacgtttttttgtattcgtttaggattgtcgagagttaacgattttttcggtttcgtaaattttagttttttaggagcgggcgttcgcgtgtttgtttgtgtgagagtgtgtgtgtgtgtgtgtgtgtgtgtgtgtgtgtgtgtgtgtg

SEQ ID NO: 39274 - DNA, 1088 bp, Artificial Sequence
  chemically treated genomic DNA (Homo sapiens) CpG-island No: 39274
cacacacacacacacacacacacacacacacacacacacacactctcacacaaacaaacacgcgaacgcccgctcctaaaaaactaaaatttacgaaaccgaaaaaatcgttaactctcgacaatcctaaacgaatacaaaaaaacgtaaaaaacacccaaaacccgccaaacgaaacaaaataacctaaaaaaaaccaccgacgccgaccacgaacaaccgaacaccctccgaaccccgatcgtacttctccaaacccccaactccaacgccgacccgaccacctcaataactcctacaaatttctactcgcaacgaaacctcgtatctcccgactacctcaccgcgaatcctcactccgcgcgcctaaactaccctcccgccccgcccgaacgaccgacgtacttcccgaaaacaacccaaacgcccccacccgcgacgacgacccgacgatctacccaaaactcgccgccgcctcccgctactactaccgcgacgacgaaaacctctccaaaactccgaacgacccttatatattattcactcgaataaccgcaacgctttctaaaaaacccacgccgaaaaaatcttcacctaacaactaataatttaacgatttatttcttaaaaacttaaaataatacgaaaacgacgacgacgaacatttttcgattactttcgaaatttatcttctctaccgaaaactcgcaaaaacgcgctacgccccgaacccgaaaaaaaacgcgccaacgccgacgaacgcgacgaacaaccccgcaaacgaccgaaactaactaacgaactccgaaaaaaaaacgccgcgaaaaccaaacgaaccgaactaaacgaaactcttttcctcgacaccccccacccctaacgaaccaactccccccgcgatacgcgctccgcgaaacccgaaaatccccgacgccctaaaccgcccaccgaataactaatacctttcaccattactcctccaccgctcctctaaccccaactttccccaacccaaacacgcgaacgcgcgcgcacacccacacacaaacacacacccgcgtacacacacacacacacgcatacacgta

SEQ ID NO: 39275 - DNA, 1088 bp, Artificial Sequence
  chemically treated genomic DNA (Homo sapiens) CpG-island No: 39275
tatatatatatatatatatatatatatatatatatatatatatttttatataggtaggtacgcggacgttcgtttttggagagttggagtttgcggagtcggaggggtcgttggttttcggtaattttgggcggatgtaaggaagcgtggagagtatttaaggttcgttaggcggggtaggatagtttgaaggaagttatcggcgtcggttacgggtagtcgggtatttttcgggtttcgatcgtgtttttttaggtttttagttttagcgtcggttcgattattttagtagtttttgtaagtttttattcgtagcgaggtttcgtgtttttcggttgttttatcgcgaatttttatttcgcgcgtttgggttgttttttcgtttcgttcgaacggtcggcgtatttttcgggggtagtttagacgtttttattcgcggcggcggttcgacggtttgtttagagttcgtcgtcgtttttcgttgttgttgtcgcggcggcgggagtttttttaaggtttcgggcggtttttatgtattatttattcggatggtcgtagcgttttttggagagtttacgtcggagaggtttttatttggtagttagtagtttggcgatttgttttttggaaatttggggtgatgcggaggcggcggcggcgaatatttttcggttgttttcggggtttgttttttttgtcgggagttcgtaggaacgcgttgcgtttcgggttcgggagggagcgcgttagcgtcggcgagcgcggcgggtagtttcgtaagcggtcgaggttggttggcgggtttcggaggagaggcgtcgcggaggttaggcgagtcgggttgaacggagttttttttttcgatattttttatttttagcgggttagtttttttcgcggtgcgcgtttcgcggggttcgggaattttcggcgttttggatcgtttatcgagtagttaatgttttttattattgtttttttatcgtttttttggttttaattttttttagtttagatacgcgagcgcgcgcgtatatttatatatagatatatattcgcgtgtatatatatatatacgtatatacgta

SEQ ID NO: 39276 - DNA, 1088 bp, Artificial Sequence
  chemically treated genomic DNA (Homo sapiens) CpG-island No: 39276
tacgtatatacgtatatatatatatacacgcgaatatatatctatatataaatatacgcgcgcgctcgcgtatctaaactaaaaaaaattaaaaccaaaaaaacgataaaaaaacaataataaaaaacattaactactcgataaacgatccaaaacgccgaaaattcccgaaccccgcgaaacgcgcaccgcgaaaaaaactaacccgctaaaaataaaaaatatcgaaaaaaaaaactccgttcaacccgactcgcctaacctccgcgacgcctctcctccgaaacccgccaaccaacctcgaccgcttacgaaactacccgccgcgctcgccgacgctaacgcgctccctcccgaacccgaaacgcaacgcgttcctacgaactcccgacaaaaaaaacaaaccccgaaaacaaccgaaaaatattcgccgccgccgcctccgcatcaccccaaatttccaaaaaacaaatcgccaaactactaactaccaaataaaaacctctccgacgtaaactctccaaaaaacgctacgaccatccgaataaataatacataaaaaccgcccgaaaccttaaaaaaactcccgccgccgcgacaacaacaacgaaaaacgacgacgaactctaaacaaaccgtcgaaccgccgccgcgaataaaaacgtctaaactacccccgaaaaatacgccgaccgttcgaacgaaacgaaaaaacaacccaaacgcgcgaaataaaaattcgcgataaaacaaccgaaaaacacgaaacctcgctacgaataaaaacttacaaaaactactaaaataatcgaaccgacgctaaaactaaaaacctaaaaaaacacgatcgaaacccgaaaaatacccgactacccgtaaccgacgccgataacttccttcaaactatcctaccccgcctaacgaaccttaaatactctccacgcttccttacatccgcccaaaattaccgaaaaccaacgacccctccgactccgcaaactccaactctccaaaaacgaacgtccgcgtacctacctatataaaaatatatatatatatatatatatatatatatatatatatatata

SEQ ID NO: 39277 - DNA, 572 bp, Artificial Sequence
  chemically treated genomic DNA (Homo sapiens) CpG-island No: 39277
atttttgttacggtcgtcgcgtttcgtcgcgtttcgcgttcgtttttattttagtcggtaggcgagcgttcgttcgtagcggtcgcggcgtcgataattttttttcggtcgtcgaaatttcgtatttagcgttaattataatatcgagcgggttgtcggtcgcggggagggggtgtcgggtagttgcgtttgcgcgggttgcgcgttattgtgacgttagcgttggggcggggtcgcgggaagggtagggcggggcggcgcgtatttgcggtcggcgcgcgggttgttggagggtattttggcggttttttgatttcggcgagtcggggttgaggcggttggcgggataaagcgggtaaggcgtttaaggaggatggaggacgggggaggaggaagtattagggatacggaataatggtcgggaaaaagtagcgcgagttgttaggggaaatcggagggaagggatcgcgtttgtataggattgcgttttggcggtagggggtagggagtcgtacgcgttttattttttggttttcgtttaggtttaaataaggataaaaaaattgtaaaaa

SEQ ID NO: 39278 - DNA, 572 bp, Artificial Sequence
  chemically treated genomic DNA (Homo sapiens) CpG-island No: 39278
tttttacaatttttttatccttatttaaacctaaacgaaaaccaaaaaataaaacgcgtacgactccctaccccctaccgccaaaacgcaatcctatacaaacgcgatcccttccctccgatttcccctaacaactcgcgctactttttcccgaccattattccgtatccctaatacttcctcctcccccgtcctccatcctccttaaacgccttacccgctttatcccgccaaccgcctcaaccccgactcgccgaaatcaaaaaaccgccaaaataccctccaacaacccgcgcgccgaccgcaaatacgcgccgccccgccctacccttcccgcgaccccgccccaacgctaacgtcacaataacgcgcaacccgcgcaaacgcaactacccgacaccccctccccgcgaccgacaacccgctcgatattataattaacgctaaatacgaaatttcgacgaccgaaaaaaaattatcgacgccgcgaccgctacgaacgaacgctcgcctaccgactaaaataaaaacgaacgcgaaacgcgacgaaacgcgacgaccgtaacaaaaat

SEQ ID NO: 39279 - DNA, 572 bp, Artificial Sequence
  chemically treated genomic DNA (Homo sapiens) CpG-island No: 39279
tttttataatttttttatttttgtttaaatttgggcgggaattaaagagtaaagcgcgtgcggttttttgttttttgtcgttaagacgtagttttgtatagacgcggtttttttttttcgattttttttgatagttcgcgttattttttttcggttattgtttcgtgtttttggtgtttttttttttttcgttttttattttttttgggcgttttgttcgttttgtttcgttagtcgttttagtttcgattcgtcggggttagaaagtcgttaggatgttttttagtagttcgcgcgtcggtcgtaggtgcgcgtcgtttcgttttgtttttttcgcggtttcgttttagcgttgacgttatagtgacgcgtagttcgcgtaggcgtagttattcggtatttttttttcgcggtcggtagttcgttcggtattatgattagcgttgggtgcggggtttcggcggtcgggagggagttgtcggcgtcgcggtcgttgcggacggacgttcgtttgtcggttgaggtaggggcgagcgcggagcgcggcggggcgcggcggtcgtagtaggggt

SEQ ID NO: 39280 - DNA, 572 bp, Artificial Sequence
  chemically treated genomic DNA (Homo sapiens) CpG-island No: 39280
acccctactacgaccgccgcgccccgccgcgctccgcgctcgcccctacctcaaccgacaaacgaacgtccgtccgcaacgaccgcgacgccgacaactccctcccgaccgccgaaaccccgcacccaacgctaatcataataccgaacgaactaccgaccgcgaaaaaaaaataccgaataactacgcctacgcgaactacgcgtcactataacgtcaacgctaaaacgaaaccgcgaaaaaaacaaaacgaaacgacgcgcacctacgaccgacgcgcgaactactaaaaaacatcctaacgactttctaaccccgacgaatcgaaactaaaacgactaacgaaacaaaacgaacaaaacgcccaaaaaaaataaaaaacgaaaaaaaaaaaaacaccaaaaacacgaaacaataaccgaaaaaaaataacgcgaactatcaaaaaaaatcgaaaaaaaaaaaccgcgtctatacaaaactacgtcttaacgacaaaaaacaaaaaaccgcacgcgctttactctttaattcccgcccaaatttaaacaaaaataaaaaaattataaaaa

SEQ ID NO: 39281 - DNA, 666 bp, Artificial Sequence
  chemically treated genomic DNA (Homo sapiens) CpG-island No: 39281
agtgcgcgtgcgttttcgaaaatgtcgttattgcggcggtcgtcgtcgcgattgagcgcgaggcgatttgtaaacgagtagagggagcgggatgggcgagcgcgcgtgcgcggggggttgttagtcggcgtagttgttggcgtagggcggagggagtggttcgtaggagttgcgcgcgcgttttaagtagtcgatttattgtttcgcgttggtttttggagaaagtcgaaggagagaggtatggttcggttttgggggtggggggcgaagggcgcgatttcgttcgcgcgggatttgattagttaatgggaagtaatgggaggtgggtttgtcgcgcgagtcgtagtcgtcgggttaacggaggaggttagaaggagcgacgtaacgtggggcggtggggcggggttgagaaggagggagcgtattagagagggagttgattggaggatatgaggaggcgtggttcgttttagtttaattcgagtttcgtaattcgtcgtttcggaagaagaggcggggttggagagcgcgtgttttttttttcggttgtgaagaaaatttgtagttaacgcgcgcgtttatgtaatttgtttttggttttgtgaacgattgatttttaggagagggaagacggtttggttttgtgtgtagtttaagtttgttatt

SEQ ID NO: 39282 - DNA, 666 bp, Artificial Sequence
  chemically treated genomic DNA (Homo sapiens) CpG-island No: 39282
aataacaaacttaaactacacacaaaaccaaaccgtcttccctctcctaaaaatcaatcgttcacaaaaccaaaaacaaattacataaacgcgcgcgttaactacaaattttcttcacaaccgaaaaaaaaaacacgcgctctccaaccccgcctcttcttccgaaacgacgaattacgaaactcgaattaaactaaaacgaaccacgcctcctcatatcctccaatcaactccctctctaatacgctccctccttctcaaccccgccccaccgccccacgttacgtcgctccttctaacctcctccgttaacccgacgactacgactcgcgcgacaaacccacctcccattacttcccattaactaatcaaatcccgcgcgaacgaaatcgcgcccttcgccccccacccccaaaaccgaaccatacctctctccttcgactttctccaaaaaccaacgcgaaacaataaatcgactacttaaaacgcgcgcgcaactcctacgaaccactccctccgccctacgccaacaactacgccgactaacaaccccccgcgcacgcgcgctcgcccatcccgctccctctactcgtttacaaatcgcctcgcgctcaatcgcgacgacgaccgccgcaataacgacattttcgaaaacgcacgcgcact

SEQ ID NO: 39283 - DNA, 666 bp, Artificial Sequence
  chemically treated genomic DNA (Homo sapiens) CpG-island No: 39283
agtgataggtttgggttgtatataggattaggtcgtttttttttttttggggattagtcgtttatagaattaaaaataagttgtatggacgcgcgcgttggttgtagattttttttatagtcgggagaaagagtacgcgttttttagtttcgttttttttttcgggacgacgaattgcggggttcggattgggttgaggcgggttacgtttttttatattttttaattaattttttttttggtgcgtttttttttttttagtttcgttttatcgttttacgttacgtcgttttttttggtttttttcgttaattcggcggttgcggttcgcgcggtaaatttattttttattgttttttattggttggttaggtttcgcgcgagcgggatcgcgtttttcgttttttatttttaaaatcgggttatgtttttttttttcggttttttttaggagttagcgcgaggtagtagatcggttgtttgagacgcgcgcgtagtttttgcggattatttttttcgttttgcgttagtagttgcgtcggttggtagtttttcgcgtacgcgcgttcgtttatttcgttttttttgttcgtttgtaagtcgtttcgcgtttagtcgcgacggcggtcgtcgtaatagcggtattttcgggggcgtacgcgtatt

SEQ ID NO: 39284 - DNA, 666 bp, Artificial Sequence
  chemically treated genomic DNA (Homo sapiens) CpG-island No: 39284
aatacgcgtacgcccccgaaaataccgctattacgacgaccgccgtcgcgactaaacgcgaaacgacttacaaacgaacaaaaaaaacgaaataaacgaacgcgcgtacgcgaaaaactaccaaccgacgcaactactaacgcaaaacgaaaaaaataatccgcaaaaactacgcgcgcgtctcaaacaaccgatctactacctcgcgctaactcctaaaaaaaaccgaaaaaaaaaaacataacccgattttaaaaataaaaaacgaaaaacgcgatcccgctcgcgcgaaacctaaccaaccaataaaaaacaataaaaaataaatttaccgcgcgaaccgcaaccgccgaattaacgaaaaaaaccaaaaaaaacgacgtaacgtaaaacgataaaacgaaactaaaaaaaaaaaaacgcaccaaaaaaaaaattaattaaaaaatataaaaaaacgtaacccgcctcaacccaatccgaaccccgcaattcgtcgtcccgaaaaaaaaaacgaaactaaaaaacgcgtactctttctcccgactataaaaaaaatctacaaccaacgcgcgcgtccatacaacttatttttaattctataaacgactaatccccaaaaaaaaaaaaacgacctaatcctatatacaacccaaacctatcact

SEQ ID NO: 39285 - DNA, 643 bp, Artificial Sequence
  chemically treated genomic DNA (Homo sapiens) CpG-island No: 39285
aagcggcgttatgttaagtttttcggtagttttttttttatttaatatagttaatttttttttttttgtaaattttttaagtgacgcggagtaaaatttaatcggtttagggaatttagatacgtttttcgcgtcgtacggattttttagaaggagtttggaggtaggcgttggatttttttaggtattttcgttttcgtcggtttttttttttcgcgttcgttgggttatttattcgcgtggggtatggtgatggtttcgttggtgttggagtttacgttgaagatgattacggttgaggcgttttgtaggaacgcgtttcggattttatttttgtacgtgtagttgtttttggggatgagggttatttagtttttgtcgcgggtcggggcggcgaatttggtgttggggtcgtaggttaggcggtcgtgggtcgagttggttatgattattttttcgcgggcgttttgtttgggcgagtgtttttcgtagcgttcgtatttcgtttttttcgtgtgtagtttcgcgtcgtcgtcgttcgtcgtttcggtttcggggttcggcgcgggttcggcgtaggtgatgtttacgaaggcggtgtattatttttttttttcggttacggtaaagtttaggtagagta

SEQ ID NO: 39286 - DNA, 643 bp, Artificial Sequence
  chemically treated genomic DNA (Homo sapiens) CpG-island No: 39286
tactctacctaaactttaccgtaaccgaaaaaaaaaaataatacaccgccttcgtaaacatcacctacgccgaacccgcgccgaaccccgaaaccgaaacgacgaacgacgacgacgcgaaactacacacgaaaaaaacgaaatacgaacgctacgaaaaacactcgcccaaacaaaacgcccgcgaaaaaataatcataaccaactcgacccacgaccgcctaacctacgaccccaacaccaaattcgccgccccgacccgcgacaaaaactaaataaccctcatccccaaaaacaactacacgtacaaaaataaaatccgaaacgcgttcctacaaaacgcctcaaccgtaatcatcttcaacgtaaactccaacaccaacgaaaccatcaccataccccacgcgaataaataacccaacgaacgcgaaaaaaaaaaaccgacgaaaacgaaaatacctaaaaaaatccaacgcctacctccaaactccttctaaaaaatccgtacgacgcgaaaaacgtatctaaattccctaaaccgattaaattttactccgcgtcacttaaaaaatttacaaaaaaaaaaaaattaactatattaaataaaaaaaaaactaccgaaaaacttaacataacgccgctt

SEQ ID NO: 39287 - DNA, 643 bp, Artificial Sequence
  chemically treated genomic DNA (Homo sapiens) CpG-island No: 39287
tgttttgtttggattttatcgtggtcgagaaggaggaatggtatatcgttttcgtgaatattatttacgtcgagttcgcgtcggatttcggggtcggggcggcgggcggcggcggcgcggagttgtatacggagaagacggagtgcgggcgttacggagagtattcgtttaagtaggacgttcgcggggaggtggttatggttagttcggtttacgatcgtttggtttgcgattttaatattaagttcgtcgtttcgattcgcggtaagaattggatagtttttatttttaagggtaattgtacgtatagggataagattcggaacgcgtttttgtagaacgttttagtcgtggttatttttaacgtgggttttaatattaacgagattattattatgttttacgcgggtgagtggtttagcgggcgcgggggaggggagtcggcggggacggaggtgtttagagggatttagcgtttgtttttaggttttttttgggaagttcgtgcggcgcggaagacgtgtttgggttttttggatcgattaagttttgtttcgcgttatttggggggtttataaagaggagaagattaattgtattgggtaggggagaggttgtcggagagtttggtatagcgtcgttt

SEQ ID NO: 39288 - DNA, 643 bp, Artificial Sequence
  chemically treated genomic DNA (Homo sapiens) CpG-island No: 39288
aaacgacgctataccaaactctccgacaacctctcccctacccaatacaattaatcttctcctctttataaaccccccaaataacgcgaaacaaaacttaatcgatccaaaaaacccaaacacgtcttccgcgccgcacgaacttcccaaaaaaaacctaaaaacaaacgctaaatccctctaaacacctccgtccccgccgactcccctcccccgcgcccgctaaaccactcacccgcgtaaaacataataataatctcgttaatattaaaacccacgttaaaaataaccacgactaaaacgttctacaaaaacgcgttccgaatcttatccctatacgtacaattacccttaaaaataaaaactatccaattcttaccgcgaatcgaaacgacgaacttaatattaaaatcgcaaaccaaacgatcgtaaaccgaactaaccataaccacctccccgcgaacgtcctacttaaacgaatactctccgtaacgcccgcactccgtcttctccgtatacaactccgcgccgccgccgcccgccgccccgaccccgaaatccgacgcgaactcgacgtaaataatattcacgaaaacgatataccattcctccttctcgaccacgataaaatccaaacaaaaca

SEQ ID NO: 39289 - DNA, 690 bp, Artificial Sequence
  chemically treated genomic DNA (Homo sapiens) CpG-island No: 39289
gttcgttttcgtcgatttgtttaagtcgtaatttagtcgttagtttgtagggtattttttcgattacgaggggataatgtaaagtttcgcgttttttatattaaggcgagtatcgttttttgcgttttggaagcgtttgtgcgtgcgtggggcgtagtaagggacggaagttttgtttgtgcgatcgtcgtttattcgagtttatttgggttgcgttttttcgtcgttgtttttcgtggtttaacgttttaatttttgcgtgtgtttgtagttttattttatatttagttttgtgtttttcgatttagttttcgatttttattttttattttaaatcgtttattcggtgtttgtttttcgttcggttgttttcgttttgttgcgttgagtgttttttgttagtttcgattttatggcgttgtagacgttgtagagttcgtgggtgatttttcgtaagattttgttttattttttcgaggagttgagtttggttttcgtttacggtttcggggtgtatcgttaggtagggtcgagtttagattagaaggtgagttcgggtagttttacgacggggaattgtttgtttttacgagtttcgttttgttttcgatttttttagagtcggagagttgtttgttcgttttgtatattttacgtgtttattagtagagtgaattataggtttgtttt

SEQ ID NO: 39290 - DNA, 690 bp, Artificial Sequence
  chemically treated genomic DNA (Homo sapiens) CpG-island No: 39290
aaaacaaacctataattcactctactaataaacacgtaaaatatacaaaacgaacaaacaactctccgactctaaaaaaatcgaaaacaaaacgaaactcgtaaaaacaaacaattccccgtcgtaaaactacccgaactcaccttctaatctaaactcgaccctacctaacgatacaccccgaaaccgtaaacgaaaaccaaactcaactcctcgaaaaaataaaacaaaatcttacgaaaaatcacccacgaactctacaacgtctacaacgccataaaatcgaaactaacaaaaaacactcaacgcaacaaaacgaaaacaaccgaacgaaaaacaaacaccgaataaacgatttaaaataaaaaataaaaatcgaaaactaaatcgaaaaacacaaaactaaatataaaataaaactacaaacacacgcaaaaattaaaacgttaaaccacgaaaaacaacgacgaaaaaacgcaacccaaataaactcgaataaacgacgatcgcacaaacaaaacttccgtcccttactacgccccacgcacgcacaaacgcttccaaaacgcaaaaaacgatactcgccttaatataaaaaacgcgaaactttacattatcccctcgtaatcgaaaaaataccctacaaactaacgactaaattacgacttaaacaaatcgacgaaaacgaac

SEQ ID NO: 39291 - DNA, 690 bp, Artificial Sequence
  chemically treated genomic DNA (Homo sapiens) CpG-island No: 39291
aaggtaggtttatggtttattttgttagtggatacgtggagtgtgtagagcggataggtagtttttcgattttgaaggaatcgagggtaaaacgggattcgtgagaatagatagtttttcgtcgtggggttgttcgggtttattttttggtttgaattcggttttgtttggcggtatatttcggagtcgtagacgaaagttagatttagtttttcggggaagtgagataggattttgcggaaggttatttacgagttttgtagcgtttgtagcgttatggggtcgaggttaataggggatatttagcgtagtagggcgaggataatcgggcggggaatagatatcgggtaggcggtttagggtgggaaatggaagtcggagattggatcgagggatataaggttgagtgtggggtgggattgtaagtatacgtaaggattggggcgttgggttacgaagagtagcggcgagaagacgtagtttagataggttcgggtgggcggcggtcgtataggtagagttttcgttttttgttacgttttacgtacgtataggcgtttttaagacgtaagaggcggtgttcgttttagtgtggggaacgcgaggttttgtattgttttttcgtggtcggaggagtgttttataggttggcggttaggttgcgatttggataaatcggcggaggcgagt

SEQ ID NO: 39292 - DNA, 690 bp, Artificial Sequence
  chemically treated genomic DNA (Homo sapiens) CpG-island No: 39292
actcgcctccgccgatttatccaaatcgcaacctaaccgccaacctataaaacactcctccgaccacgaaaaaacaatacaaaacctcgcgttccccacactaaaacgaacaccgcctcttacgtcttaaaaacgcctatacgtacgtaaaacgtaacaaaaaacgaaaactctacctatacgaccgccgcccacccgaacctatctaaactacgtcttctcgccgctactcttcgtaacccaacgccccaatccttacgtatacttacaatcccaccccacactcaaccttatatccctcgatccaatctccgacttccatttcccaccctaaaccgcctacccgatatctattccccgcccgattatcctcgccctactacgctaaatatcccctattaacctcgaccccataacgctacaaacgctacaaaactcgtaaataaccttccgcaaaatcctatctcacttccccgaaaaactaaatctaactttcgtctacgactccgaaatataccgccaaacaaaaccgaattcaaaccaaaaaataaacccgaacaaccccacgacgaaaaactatctattctcacgaatcccgttttaccctcgattccttcaaaatcgaaaaactacctatccgctctacacactccacgtatccactaacaaaataaaccataaacctacctt

SEQ ID NO: 39293 - DNA, 578 bp, Artificial Sequence
  chemically treated genomic DNA (Homo sapiens) CpG-island No: 39293
ggacgatgtatagagaatgaatatatttatacgtttattcgagtgtgtatatatagaatttatacgttcgttagagtgtgtatatatatagagaatttatacgtttattcgagtgtgtatatatagagaatttatacgttcgttagagtgtgtatatagagaatttatacgttcgttagagtgtgtatatatatagagaatttatacgtttattcgagtgtgtatatatagaatttatacgtttattcgagtgtgtatatatagagaatttatacgtttattcgagtgtgtatatatagaatttatacgtttattcgagtgtgtatatatagagaatttatacgtttattcgagtgtgtatatatagaatttatacgtttattcgagtgtgtatatatagagaatttatacgtttattcgagtgtgtatatatagaatttatacgtttattcgagtgtgtatatatagagaatttatacgttcgttagagtgtgtatatatatagagaatttatacgtttattcgagtgtgtatatatagagaatttatacgttcgttagagtgtgtatatatataga

SEQ ID NO: 39294 - DNA, 578 bp, Artificial Sequence
  chemically treated genomic DNA (Homo sapiens) CpG-island No: 39294
tctatatatatacacactctaacgaacgtataaattctctatatatacacactcgaataaacgtataaattctctatatatatacacactctaacgaacgtataaattctctatatatacacactcgaataaacgtataaattctatatatacacactcgaataaacgtataaattctctatatatacacactcgaataaacgtataaattctatatatacacactcgaataaacgtataaattctctatatatacacactcgaataaacgtataaattctatatatacacactcgaataaacgtataaattctctatatatacacactcgaataaacgtataaattctatatatacacactcgaataaacgtataaattctctatatatatacacactctaacgaacgtataaattctctatatacacactctaacgaacgtataaattctctatatatacacactcgaataaacgtataaattctctatatatatacacactctaacgaacgtataaattctatatatacacactcgaataaacgtataaatatattcattctctatacatcgtcc

SEQ ID NO: 39295 - DNA, 578 bp, Artificial Sequence
  chemically treated genomic DNA (Homo sapiens) CpG-island No: 39295
tttgtgtgtgtgtatattttggcgagcgtgtgggttttttgtgtgtgtatattcgggtgagcgtgtgggttttttgtgtgtgtgtatattttggcgagcgtgtgggttttttgtgtgtgtatattcgggtgagcgtgtgggttttgtgtgtgtatattcgggtgagcgtgtgggttttttgtgtgtgtatattcgggtgagcgtgtgggttttgtgtgtgtatattcgggtgagcgtgtgggttttttgtgtgtgtatattcgggtgagcgtgtgggttttgtgtgtgtatattcgggtgagcgtgtgggttttttgtgtgtgtatattcgggtgagcgtgtgggttttgtgtgtgtatattcgggtgagcgtgtgggttttttgtgtgtgtgtatattttggcgagcgtgtgggttttttgtgtgtatattttggcgagcgtgtgggttttttgtgtgtgtatattcgggtgagcgtgtgggttttttgtgtgtgtgtatattttggcgagcgtgtgggttttgtgtgtgtatattcgggtgagcgtgtgggtgtgtttattttttatgtatcgttt

SEQ ID NO: 39296 - DNA, 578 bp, Artificial Sequence
  chemically treated genomic DNA (Homo sapiens) CpG-island No: 39296
aaacgatacataaaaaataaacacacccacacgctcacccgaatatacacacacaaaacccacacgctcgccaaaatatacacacacacaaaaaacccacacgctcacccgaatatacacacacaaaaaacccacacgctcgccaaaatatacacacaaaaaacccacacgctcgccaaaatatacacacacacaaaaaacccacacgctcacccgaatatacacacacaaaacccacacgctcacccgaatatacacacacaaaaaacccacacgctcacccgaatatacacacacaaaacccacacgctcacccgaatatacacacacaaaaaacccacacgctcacccgaatatacacacacaaaacccacacgctcacccgaatatacacacacaaaaaacccacacgctcacccgaatatacacacacaaaacccacacgctcacccgaatatacacacacaaaaaacccacacgctcgccaaaatatacacacacacaaaaaacccacacgctcacccgaatatacacacacaaaaaacccacacgctcgccaaaatatacacacacacaaa

SEQ ID NO: 39297 - DNA, 647 bp, Artificial Sequence
  chemically treated genomic DNA (Homo sapiens) CpG-island No: 39297
cgatgcgtatttggtcgtacgtagttttattaggtagggtgtatttgttaagtttttaggttcgagtgttcgcggttttatttgttttggtatcgtcgttcgtatttcggttagtgcgttttcggtaggtgcgtgtatttgatttagttcgtgtttattttgcgtatacgggtcgtttagtgtttcgttcggagttcgtcgtcgtcgtagttttgaggtttcgattttcgtttgggtttcgttcggcgcgtagcggtcgcgggggcgggggtcgcgacgcgaggagcggagtaggaaggggcgaggtagtttcgttttcgggggcggtttttcgggacggtttcgttttttgttcgttttcgcgttagtgttttattattatttgttcgcgcgtcgttttatataaaggcgtcgtcgtttttgtttttaggattcggttttatggagacgtcgtcggtcgtcgttggcgtatggcggggtgaggcgcggcggggagggtgcgggtttcggcggggaagcggtagggagcgtttcggcggggttcgagtcgagtcgaggggaggggacgggaggggacgggaggggtggagaggggaggggacgggagggtcggggttttgtttttcggttcgtcgggtttttaggat

SEQ ID NO: 39298 - DNA, 647 bp, Artificial Sequence
  chemically treated genomic DNA (Homo sapiens) CpG-island No: 39298
atcctaaaaacccgacgaaccgaaaaacaaaaccccgaccctcccgtcccctcccctctccacccctcccgtcccctcccgtcccctcccctcgactcgactcgaaccccgccgaaacgctccctaccgcttccccgccgaaacccgcaccctccccgccgcgcctcaccccgccatacgccaacgacgaccgacgacgtctccataaaaccgaatcctaaaaacaaaaacgacgacgcctttatataaaacgacgcgcgaacaaataataataaaacactaacgcgaaaacgaacaaaaaacgaaaccgtcccgaaaaaccgcccccgaaaacgaaactacctcgccccttcctactccgctcctcgcgtcgcgacccccgcccccgcgaccgctacgcgccgaacgaaacccaaacgaaaatcgaaacctcaaaactacgacgacgacgaactccgaacgaaacactaaacgacccgtatacgcaaaataaacacgaactaaatcaaatacacgcacctaccgaaaacgcactaaccgaaatacgaacgacgataccaaaacaaataaaaccgcgaacactcgaacctaaaaacttaacaaatacaccctacctaataaaactacgtacgaccaaatacgcatcg

SEQ ID NO: 39299 - DNA, 647 bp, Artificial Sequence
  chemically treated genomic DNA (Homo sapiens) CpG-island No: 39299
gttttgagggttcggcgggtcggggaataggatttcgattttttcgtttttttttttttttatttttttcgttttttttcgtttttttttttcggttcggttcggatttcgtcggagcgttttttgtcgttttttcgtcgaggttcgtatttttttcgtcgcgttttatttcgttatgcgttagcggcggtcggcggcgtttttatggggtcgagttttgggggtaaggacggcggcgtttttatatggggcggcgcgcgggtaggtggtggtgaggtattgacgcggaagcgggtaaggggcggggtcgtttcgggagatcgttttcgggggcggggttgtttcgtttttttttgtttcgtttttcgcgtcgcggttttcgttttcgcggtcgttgcgcgtcggacggggtttaagcgggggtcggagttttaaggttgcggcggcgacgagtttcgagcgggatattgaacggttcgtatgcgtaagataagtacggattgaattaggtatacgtatttgtcggggacgtattgatcgaggtgcggacggcggtattaggataggtaaagtcgcgaatattcggatttaagaatttgataggtatattttgtttgatgaagttacgtacggttaggtgcgtatcg

SEQ ID NO: 39300 - DNA, 647 bp, Artificial Sequence
  chemically treated genomic DNA (Homo sapiens) CpG-island No: 39300
cgatacgcacctaaccgtacgtaacttcatcaaacaaaatatacctatcaaattcttaaatccgaatattcgcgactttacctatcctaataccgccgtccgcacctcgatcaatacgtccccgacaaatacgtatacctaattcaatccgtacttatcttacgcatacgaaccgttcaatatcccgctcgaaactcgtcgccgccgcaaccttaaaactccgacccccgcttaaaccccgtccgacgcgcaacgaccgcgaaaacgaaaaccgcgacgcgaaaaacgaaacaaaaaaaaacgaaacaaccccgcccccgaaaacgatctcccgaaacgaccccgccccttacccgcttccgcgtcaatacctcaccaccacctacccgcgcgccgccccatataaaaacgccgccgtccttacccccaaaactcgaccccataaaaacgccgccgaccgccgctaacgcataacgaaataaaacgcgacgaaaaaaatacgaacctcgacgaaaaaacgacaaaaaacgctccgacgaaatccgaaccgaaccgaaaaaaaaaaacgaaaaaaaacgaaaaaaataaaaaaaaaaaaaaacgaaaaaatcgaaatcctattccccgacccgccgaaccctcaaaac

SEQ ID NO: 39301 - DNA, 849 bp, Artificial Sequence
  chemically treated genomic DNA (Homo sapiens) CpG-island No: 39301
ttttttcgaagtaacgggattaatcgtatcgtcggtaggatattttgtgcggggcgcgaagtgataaaagttaggatttgtagaagtttttattcggtaacgatttttatttcggtaaggagtatagtaggcgtttcggaaacgttttttacgaggagggtcgggttattttttgttttcgagcgggtttttttcggcggaggtttttatcgtcgttatgggtaggttatgtagtatttttgagggcggggtgggcgtaagaagaaggtgttcgcgggttcgttttttttcgggcgcgttgggcggggcgaagtttttcggcgtcgacggttcgtttcgcggggggtgggcgtagttcgtcgcgtttcgtataaagtttgtttttttttttcgggcgggtgggggagggcgtagagggcgcgggggaaggagaggggatttgacgttaggtcgcgaggtgttttttagtcgcgagttgttaggtcgagtgttaggtcgggtaggtacgcggcgcgcgttttcggcgtttttcgtttttcgtcgggacgtttcgcgtcgagtcggaggtcgcgtggattcgaaagtcgttgggaaaagttagtgtagggagtagtagagggttagatgggggtgggggcgcgcggataatttggaaagtttttttttttcggtcggacggggagggggcgtcgttttggcgcgtgcggtagggggtgtgtgagttcgggggtgtttgtgagtttcgacggttttcggggggtgtttgtgagtttcgacggcgttgcgtttcgggggtcggtgggggatttgttttagtttttcgggaggaagttcgtttggggttttggt

SEQ ID NO: 39302 - DNA, 849 bp, Artificial Sequence
  chemically treated genomic DNA (Homo sapiens) CpG-island No: 39302
accaaaaccccaaacgaacttcctcccgaaaaactaaaacaaatcccccaccgacccccgaaacgcaacgccgtcgaaactcacaaacaccccccgaaaaccgtcgaaactcacaaacacccccgaactcacacaccccctaccgcacgcgccaaaacgacgccccctccccgtccgaccgaaaaaaaaaaactttccaaattatccgcgcgcccccacccccatctaaccctctactactccctacactaacttttcccaacgactttcgaatccacgcgacctccgactcgacgcgaaacgtcccgacgaaaaacgaaaaacgccgaaaacgcgcgccgcgtacctacccgacctaacactcgacctaacaactcgcgactaaaaaacacctcgcgacctaacgtcaaatcccctctccttcccccgcgccctctacgccctcccccacccgcccgaaaaaaaaaaacaaactttatacgaaacgcgacgaactacgcccaccccccgcgaaacgaaccgtcgacgccgaaaaacttcgccccgcccaacgcgcccgaaaaaaaacgaacccgcgaacaccttcttcttacgcccaccccgccctcaaaaatactacataacctacccataacgacgataaaaacctccgccgaaaaaaacccgctcgaaaacaaaaaataacccgaccctcctcgtaaaaaacgtttccgaaacgcctactatactccttaccgaaataaaaatcgttaccgaataaaaacttctacaaatcctaacttttatcacttcgcgccccgcacaaaatatcctaccgacgatacgattaatcccgttacttcgaaaaaa

SEQ ID NO: 39303 - DNA, 849 bp, Artificial Sequence
  chemically treated genomic DNA (Homo sapiens) CpG-island No: 39303
attagggttttaagcgggttttttttcggggggttggaataggttttttatcggttttcggagcgtagcgtcgtcgggatttataaatatttttcgggggtcgtcgggatttataaatattttcgagtttatatattttttatcgtacgcgttaggacgacgtttttttttcgttcggtcgagaaaaagaaattttttaagttgttcgcgcgtttttatttttatttggttttttgttgttttttgtattgattttttttagcggttttcgggtttacgcggttttcggttcggcgcggggcgtttcggcggggagcggggggcgtcgggggcgcgcgtcgcgtatttgttcggtttgatattcggtttgatagttcgcggttggaaagtatttcgcggtttgacgttagattttttttttttttttcgcgttttttgcgtttttttttattcgttcggagggagaaaataaattttgtgcggagcgcgacgagttgcgtttatttttcgcggggcgggtcgtcggcgtcgaggggtttcgtttcgtttagcgcgttcggaggggggcgggttcgcgggtattttttttttgcgtttatttcgtttttaggaatgttgtatggtttatttatagcggcggtgggagttttcgtcggggagagttcgttcgggggtaggaagtggttcggtttttttcgtggagggcgttttcggagcgtttattgtgttttttgtcggggtgggggtcgttatcgagtgggaatttttgtaaattttgatttttgttatttcgcgtttcgtataagatgttttgtcggcggtgcgattggtttcgttgtttcgagggga

SEQ ID NO: 39304 - DNA, 849 bp, Artificial Sequence
  chemically treated genomic DNA (Homo sapiens) CpG-island No: 39304
tcccctcgaaacaacgaaaccaatcgcaccgccgacaaaacatcttatacgaaacgcgaaataacaaaaatcaaaatttacaaaaattcccactcgataacgacccccaccccgacaaaaaacacaataaacgctccgaaaacgccctccacgaaaaaaaccgaaccacttcctacccccgaacgaactctccccgacgaaaactcccaccgccgctataaataaaccatacaacattcctaaaaacgaaataaacgcaaaaaaaaaatacccgcgaacccgcccccctccgaacgcgctaaacgaaacgaaacccctcgacgccgacgacccgccccgcgaaaaataaacgcaactcgtcgcgctccgcacaaaatttattttctccctccgaacgaataaaaaaaaacgcaaaaaacgcgaaaaaaaaaaaaaaaatctaacgtcaaaccgcgaaatactttccaaccgcgaactatcaaaccgaatatcaaaccgaacaaatacgcgacgcgcgcccccgacgccccccgctccccgccgaaacgccccgcgccgaaccgaaaaccgcgtaaacccgaaaaccgctaaaaaaaatcaatacaaaaaacaacaaaaaaccaaataaaaataaaaacgcgcgaacaacttaaaaaatttctttttctcgaccgaacgaaaaaaaaacgtcgtcctaacgcgtacgataaaaaatatataaactcgaaaatatttataaatcccgacgacccccgaaaaatatttataaatcccgacgacgctacgctccgaaaaccgataaaaaacctattccaaccccccgaaaaaaaacccgcttaaaaccctaat

SEQ ID NO: 39305 - DNA, 673 bp, Artificial Sequence
  chemically treated genomic DNA (Homo sapiens) CpG-island No: 39305
tttcgcgttattttttatttttgtttcggcgcgtatttatttggcggcggcgaatatcggtcgggtttttgtatttacgtcgttttattttttgaatttttcgatttgatcgaggcggtttcgaagggttttattagcggttcggggttgtgcgtttttcgagcgtcgtgtttcgatagtagtagtggtcgtagggtggtttcggtcgaggcgttttcggtcggtagcggggacgtttttttgggcggttttttgtcggatatgagcgtttttacgttgaagggtaggttggagattttgacgcggcgttttttcgcggttttttcggcgtttttaggtttcgggtttggttcggttattattgttgggtttttttcgtcgggcgaaaataagttattgtttttggacggagaagttatgatttttttgttttacgtagttttcgacgcgcgatttcgttggtaattcggtagcggcgatttaaatttttttgttgcggaaacgggaggggcgcgttgggagttgagtttttttttcgaggggaagtgggagacgcgcgtcgttaattcgcgtcgggtttggcgttgacgttaaaaacgttcgtttttgattggtttttttcgaaggggttgttttttttttttttttttttttttttttttttttttgtttg

SEQ ID NO: 39306 - DNA, 673 bp, Artificial Sequence
  chemically treated genomic DNA (Homo sapiens) CpG-island No: 39306
caaacaaaaaaaaaaaaaaaaaaaaaaaaaaaaaaaaaaaacaaccccttcgaaaaaaaccaatcaaaaacgaacgtttttaacgtcaacgccaaacccgacgcgaattaacgacgcgcgtctcccacttcccctcgaaaaaaaaactcaactcccaacgcgcccctcccgtttccgcaacaaaaaaatttaaatcgccgctaccgaattaccaacgaaatcgcgcgtcgaaaactacgtaaaacaaaaaaatcataacttctccgtccaaaaacaataacttattttcgcccgacgaaaaaaacccaacaataataaccgaaccaaacccgaaacctaaaaacgccgaaaaaaccgcgaaaaaacgccgcgtcaaaatctccaacctacccttcaacgtaaaaacgctcatatccgacaaaaaaccgcccaaaaaaacgtccccgctaccgaccgaaaacgcctcgaccgaaaccaccctacgaccactactactatcgaaacacgacgctcgaaaaacgcacaaccccgaaccgctaataaaacccttcgaaaccgcctcgatcaaatcgaaaaattcaaaaaataaaacgacgtaaatacaaaaacccgaccgatattcgccgccgccaaataaatacgcgccgaaacaaaaataaaaaataacgcgaaa

SEQ ID NO: 39307 - DNA, 673 bp, Artificial Sequence
  chemically treated genomic DNA (Homo sapiens) CpG-island No: 39307
taaataggaaaaaaaaaaaaaaaaaaaaaagggggggggggtagttttttcgggaaaagttaattaggggcgagcgtttttggcgttagcgttaggttcggcgcggattggcggcgcgcgttttttattttttttcggaggaaaggtttagtttttagcgcgtttttttcgttttcgtagtaaaaaagtttgagtcgtcgttgtcgggttgttagcggagtcgcgcgtcgggagttacgtagggtagagaagttatggttttttcgtttaaaggtaatgatttgttttcgttcgacgaggagggtttagtagtggtggtcggattaggttcggggtttgggggcgtcgagggggtcgcggaggagcgtcgcgttaaggtttttagtttgttttttagcgtggaggcgtttatgttcgataagaagtcgtttaaggaggcgttttcgttgtcggtcgaaagcgtttcggtcggggttattttgcggttattgttgttgtcggggtacggcgttcgggaagcgtatagtttcgggtcgttggtgaagtttttcgagatcgtttcggttaagtcggaaaatttagaagatggagcggcgtggatgtaggaattcggtcgatattcgtcgtcgttaagtgagtgcgcgtcggggtaggagtaggaggtagcgcgggg

SEQ ID NO: 39308 - DNA, 673 bp, Artificial Sequence
  chemically treated genomic DNA (Homo sapiens) CpG-island No: 39308
ccccgcgctacctcctactcctaccccgacgcgcactcacttaacgacgacgaatatcgaccgaattcctacatccacgccgctccatcttctaaattttccgacttaaccgaaacgatctcgaaaaacttcaccaacgacccgaaactatacgcttcccgaacgccgtaccccgacaacaacaataaccgcaaaataaccccgaccgaaacgctttcgaccgacaacgaaaacgcctccttaaacgacttcttatcgaacataaacgcctccacgctaaaaaacaaactaaaaaccttaacgcgacgctcctccgcgaccccctcgacgcccccaaaccccgaacctaatccgaccaccactactaaaccctcctcgtcgaacgaaaacaaatcattacctttaaacgaaaaaaccataacttctctaccctacgtaactcccgacgcgcgactccgctaacaacccgacaacgacgactcaaacttttttactacgaaaacgaaaaaaacgcgctaaaaactaaacctttcctccgaaaaaaaataaaaaacgcgcgccgccaatccgcgccgaacctaacgctaacgccaaaaacgctcgcccctaattaacttttcccgaaaaaactacccccccccccttttttttttttttttttttttcctattta

SEQ ID NO: 39309 - DNA, 649 bp, Artificial Sequence
  chemically treated genomic DNA (Homo sapiens) CpG-island No: 39309
gcgcgttatattcgttaggtttttttttgaagtaatcgcgtacgcgcgttgcgagttttaaggagaaaatattttttgtaaattgtggagtattgcgcgtagaacgtagcgtttgtaatttcgagggtcgaaggttagtttgtaattttagcggttagaagggggcgggggagggggtagcgaagggggttgtagacgggtttgggtttcgggtaggcgttaggcgcggggagatgaaaggcgggtttcgggggaaggggttgcgtcgggtgatcggttttagtcgcgtcgggcgtttcgttttcgttttgtttcgttttcgttgttcggggtagaggcggttgttcgcgtcggagtcgcgttaattgttttcggttttagtatttagtttgcgcggagtcgggataatttcgttttaggaggaatgataattcgttttaatgggataagttcgtttttagaggagtgataattttttttaatgggagttcgttagcggtttattttatcgagttcgggtattagaagtaggtagattcgcgggcgttaatattcgttaggaattttataatatcgtttatttattttttaaaatattggttgtgtgatttcgggtaaaaggttattcgtttttgagtttatttttttt

SEQ ID NO: 39310 - DNA, 649 bp, Artificial Sequence
  chemically treated genomic DNA (Homo sapiens) CpG-island No: 39310
aaaaaaaataaactcaaaaacgaataaccttttacccgaaatcacacaaccaatattttaaaaaataaataaacgatattataaaattcctaacgaatattaacgcccgcgaatctacctacttctaatacccgaactcgataaaataaaccgctaacgaactcccattaaaaaaaattatcactcctctaaaaacgaacttatcccattaaaacgaattatcattcctcctaaaacgaaattatcccgactccgcgcaaactaaatactaaaaccgaaaacaattaacgcgactccgacgcgaacaaccgcctctaccccgaacaacgaaaacgaaacaaaacgaaaacgaaacgcccgacgcgactaaaaccgatcacccgacgcaaccccttcccccgaaacccgcctttcatctccccgcgcctaacgcctacccgaaacccaaacccgtctacaacccccttcgctaccccctcccccgcccccttctaaccgctaaaattacaaactaaccttcgaccctcgaaattacaaacgctacgttctacgcgcaatactccacaatttacaaaaaatattttctccttaaaactcgcaacgcgcgtacgcgattacttcaaaaaaaaacctaacgaatataacgcgc

SEQ ID NO: 39311 - DNA, 649 bp, Artificial Sequence
  chemically treated genomic DNA (Homo sapiens) CpG-island No: 39311
aagaaaaatgagtttagagacgagtagttttttgttcgaagttatatagttaatgttttggggggtgggtgagcggtgttgtggaatttttggcggatgttggcgttcgcgggtttgtttgtttttgatattcgggttcggtagaataggtcgttaacgagtttttattaggaggaattgttatttttttgggagcgagtttgttttattagggcgaattgttattttttttggagcgaggttgtttcggtttcgcgtaggttgagtgttggggtcgagagtaattaacgcggtttcggcgcgggtagtcgtttttgtttcgggtagcgggggcggggtagggcgggggcggggcgttcggcgcggttggagtcggttattcggcgtagttttttttttcggagttcgttttttattttttcgcgtttggcgtttgttcgaagtttaggttcgtttatagtttttttcgttgttttttttttcgtttttttttagtcgttggggttataaattagttttcggttttcggggttataaacgttgcgttttgcgcgtagtgttttatagtttgtaaggagtgttttttttttgggattcgtagcgcgcgtacgcggttgttttaagaaggggtttggcgggtgtaacgcgt

SEQ ID NO: 39312 - DNA, 649 bp, Artificial Sequence
  chemically treated genomic DNA (Homo sapiens) CpG-island No: 39312
acgcgttacacccgccaaaccccttcttaaaacaaccgcgtacgcgcgctacgaatcccaaaaaaaaaacactccttacaaactataaaacactacgcgcaaaacgcaacgtttataaccccgaaaaccgaaaactaatttataaccccaacgactaaaaaaaaacgaaaaaaaaaacaacgaaaaaaactataaacgaacctaaacttcgaacaaacgccaaacgcgaaaaaataaaaaacgaactccgaaaaaaaaaactacgccgaataaccgactccaaccgcgccgaacgccccgcccccgccctaccccgcccccgctacccgaaacaaaaacgactacccgcgccgaaaccgcgttaattactctcgaccccaacactcaacctacgcgaaaccgaaacaacctcgctccaaaaaaaataacaattcgccctaataaaacaaactcgctcccaaaaaaataacaattcctcctaataaaaactcgttaacgacctattctaccgaacccgaatatcaaaaacaaacaaacccgcgaacgccaacatccgccaaaaattccacaacaccgctcacccaccccccaaaacattaactatataacttcgaacaaaaaactactcgtctctaaactcatttttctt

SEQ ID NO: 39313 - DNA, 820 bp, Artificial Sequence
  chemically treated genomic DNA (Homo sapiens) CpG-island No: 39313
tcgtttagacgtagggagcgtagcgcgggtagcgcggttagggcggttacgttgaggttgcgtaggttgttgtcgttgagttttagtatttgtagcgattttagggtttcgaaggcgttttcgtgtacgtttattaggttgttgttagttaggttaagttttattagtttttcggtcgagcggaaggcgtcggcgtttagttgggttaagttgttgtagttgaggtcgaggaatacgagtttggtcgagtcgttgaacgtgtttttttttagcgagcgtagcgagttgtttttgaagtttaggtagattaggtcgtcgtagaagatgaagaagttttcggggattcgttggatgcggttgtcggttattagtagtttgcgtacgtttagggggaaagggtttggtacgttgggtagttcgcggtcgcggtagtttacggtgtgcgggtcggtgtaggcgtagttcgcggggtacgcgtgttcgggcgcgagtagtagtagaaggttgtagagttcgagcgtcgcggcggcgtaggttggggttcgggggcgtatggtcggggggttcgcgtcggtcgcggcgagaaggaagcggttttcggagcgagttttggcgcgggacggcgcggtgaggtattggttgtcgggcgcggggagttagagggcggttcgggcggggagggcgtgcgttcgggcgtgcgggggcgatggagcgcggcgcggacggattggggagtcgggatagtagggatggagaggggaggggcggggagggaggggcgagggatttattaaagggtttattcggataggaaattaat

SEQ ID NO: 39314 - DNA, 820 bp, Artificial Sequence
  chemically treated genomic DNA (Homo sapiens) CpG-island No: 39314
attaatttcctatccgaataaaccctttaataaatccctcgcccctccctccccgcccctcccctctccatccctactatcccgactccccaatccgtccgcgccgcgctccatcgcccccgcacgcccgaacgcacgccctccccgcccgaaccgccctctaactccccgcgcccgacaaccaatacctcaccgcgccgtcccgcgccaaaactcgctccgaaaaccgcttccttctcgccgcgaccgacgcgaaccccccgaccatacgcccccgaaccccaacctacgccgccgcgacgctcgaactctacaaccttctactactactcgcgcccgaacacgcgtaccccgcgaactacgcctacaccgacccgcacaccgtaaactaccgcgaccgcgaactacccaacgtaccaaaccctttccccctaaacgtacgcaaactactaataaccgacaaccgcatccaacgaatccccgaaaacttcttcatcttctacgacgacctaatctacctaaacttcaaaaacaactcgctacgctcgctaaaaaaaaacacgttcaacgactcgaccaaactcgtattcctcgacctcaactacaacaacttaacccaactaaacgccgacgccttccgctcgaccgaaaaactaataaaacttaacctaactaacaacaacctaataaacgtacacgaaaacgccttcgaaaccctaaaatcgctacaaatactaaaactcaacgacaacaacctacgcaacctcaacgtaaccgccctaaccgcgctacccgcgctacgctccctacgtctaaacga

SEQ ID NO: 39315 - DNA, 820 bp, Artificial Sequence
  chemically treated genomic DNA (Homo sapiens) CpG-island No: 39315
gttaattttttgttcgggtaaattttttggtgagtttttcgttttttttttttcgttttttttttttttatttttgttgtttcggttttttagttcgttcgcgtcgcgttttatcgttttcgtacgttcgggcgtacgtttttttcgttcgggtcgttttttggtttttcgcgttcggtagttagtgttttatcgcgtcgtttcgcgttagggttcgtttcgagagtcgtttttttttcgtcgcggtcggcgcgggtttttcggttatgcgttttcgagttttagtttgcgtcgtcgcggcgttcgggttttgtagttttttgttgttgttcgcgttcgggtacgcgtgtttcgcgggttgcgtttgtatcgattcgtatatcgtggattgtcgcgatcgcgggttgtttagcgtgttagattttttttttttggacgtgcgtaagttgttggtggtcggtaatcgtatttagcggattttcgaggatttttttattttttacggcgatttggtttatttggattttaggaataattcgttgcgttcgttggaggagggtacgtttagcggttcggttaagttcgtgtttttcgattttagttataataatttgatttagttgggcgtcggcgtttttcgttcggtcgggaggttggtgaagtttagtttggttaataataatttggtgggcgtgtacgaggacgttttcgagattttggagtcgttgtaggtgttggagtttaacgataataatttgcgtagttttagcgtggtcgttttggtcgcgttgttcgcgttgcgttttttgcgtttggacgg

SEQ ID NO: 39316 - DNA, 820 bp, Artificial Sequence
  chemically treated genomic DNA (Homo sapiens) CpG-island No: 39316
ccgtccaaacgcaaaaaacgcaacgcgaacaacgcgaccaaaacgaccacgctaaaactacgcaaattattatcgttaaactccaacacctacaacgactccaaaatctcgaaaacgtcctcgtacacgcccaccaaattattattaaccaaactaaacttcaccaacctcccgaccgaacgaaaaacgccgacgcccaactaaatcaaattattataactaaaatcgaaaaacacgaacttaaccgaaccgctaaacgtaccctcctccaacgaacgcaacgaattattcctaaaatccaaataaaccaaatcgccgtaaaaaataaaaaaatcctcgaaaatccgctaaatacgattaccgaccaccaacaacttacgcacgtccaaaaaaaaaaaatctaacacgctaaacaacccgcgatcgcgacaatccacgatatacgaatcgatacaaacgcaacccgcgaaacacgcgtacccgaacgcgaacaacaacaaaaaactacaaaacccgaacgccgcgacgacgcaaactaaaactcgaaaacgcataaccgaaaaacccgcgccgaccgcgacgaaaaaaaaacgactctcgaaacgaaccctaacgcgaaacgacgcgataaaacactaactaccgaacgcgaaaaaccaaaaaacgacccgaacgaaaaaaacgtacgcccgaacgtacgaaaacgataaaacgcgacgcgaacgaactaaaaaaccgaaacaacaaaaataaaaaaaaaaaaaacgaaaaaaaaaaaacgaaaaactcaccaaaaaatttacccgaacaaaaaattaac

SEQ ID NO: 39317 - DNA, 508 bp, Artificial Sequence
  chemically treated genomic DNA (Homo sapiens) CpG-island No: 39317
tatcgtacgagtaagggtttgtatagtttttttcggggttcgatatatagtgatagagtatgttgttcgcgtattatatgtagtttattcggcggatgtaagtttttacggagtcgggcgcgttttggtagtggtttcggcggtttttttcgtggttgaatatgtttttgtagtatacgtatcgcgagcgtttttcgtttttttttcgtcgtcgcgatttgtttcgggagggttgcgttttgattacgttgttttcgcggtttttggggttttcgtttaggttaaagtttgaggagtttacgtaggggtagttgtagttatgtttggggatttcgtttttggcgaagcgtacgtaggaggagttcgcgtttttcgaggggttcgggtatttgtttttgacgggtgcgtgtcggtaattttcgtatttcgttatttagattttttttcggggggttgatgcgtacgattttttcgtcgtcgttcgggaagtttatttggcggtagggtt

SEQ ID NO: 39318 - DNA, 508 bp, Artificial Sequence
  chemically treated genomic DNA (Homo sapiens) CpG-island No: 39318
aaccctaccgccaaataaacttcccgaacgacgacgaaaaaatcgtacgcatcaaccccccgaaaaaaaatctaaataacgaaatacgaaaattaccgacacgcacccgtcaaaaacaaatacccgaacccctcgaaaaacgcgaactcctcctacgtacgcttcgccaaaaacgaaatccccaaacataactacaactacccctacgtaaactcctcaaactttaacctaaacgaaaaccccaaaaaccgcgaaaacaacgtaatcaaaacgcaaccctcccgaaacaaatcgcgacgacgaaaaaaaaacgaaaaacgctcgcgatacgtatactacaaaaacatattcaaccacgaaaaaaaccgccgaaaccactaccaaaacgcgcccgactccgtaaaaacttacatccgccgaataaactacatataatacgcgaacaacatactctatcactatatatcgaaccccgaaaaaaactatacaaacccttactcgtacgata

SEQ ID NO: 39319 - DNA, 508 bp, Artificial Sequence
  chemically treated genomic DNA (Homo sapiens) CpG-island No: 39319
ggttttatcgttaggtgagtttttcggacgacgacgaggagatcgtgcgtattaatttttcgggagaagatttggatgacggggtacgaggattatcggtacgtattcgttaggggtaagtattcggatttttcggaggacgcggattttttttacgtgcgtttcgttaagggcgaggtttttaagtatgattataattatttttacgtggattttttagattttggtttaggcgaggattttaaaggtcgcgggggtagcgtgattaagacgtagttttttcggggtaagtcgcggcggcggaaggaggacggagagcgttcgcggtgcgtgtattgtagggatatgtttaattacgaggagaatcgtcggggttattgttaggacgcgttcgatttcgtgagaatttgtattcgtcgggtgagttgtatgtggtgcgcggatagtatgttttattattgtatgtcggatttcgagggagattatatagatttttgttcgtgcgata

SEQ ID NO: 39320 - DNA, 508 bp, Artificial Sequence
  chemically treated genomic DNA (Homo sapiens) CpG-island No: 39320
tatcgcacgaacaaaaatctatataatctccctcgaaatccgacatacaataataaaacatactatccgcgcaccacatacaactcacccgacgaatacaaattctcacgaaatcgaacgcgtcctaacaataaccccgacgattctcctcgtaattaaacatatccctacaatacacgcaccgcgaacgctctccgtcctccttccgccgccgcgacttaccccgaaaaaactacgtcttaatcacgctacccccgcgacctttaaaatcctcgcctaaaccaaaatctaaaaaatccacgtaaaaataattataatcatacttaaaaacctcgcccttaacgaaacgcacgtaaaaaaaatccgcgtcctccgaaaaatccgaatacttacccctaacgaatacgtaccgataatcctcgtaccccgtcatccaaatcttctcccgaaaaattaatacgcacgatctcctcgtcgtcgtccgaaaaactcacctaacgataaaacc

SEQ ID NO: 39321 - DNA, 550 bp, Artificial Sequence
  chemically treated genomic DNA (Homo sapiens) CpG-island No: 39321
ggatgaacgttttatattcggcgtttagtttcgggacgtcgtttagcgtacggtttcggttgagtattcgggtaggcggtagttgcggggaagaggggtttgttttttgagtttcggagttttaaggtcgggtttaggcgggatagaggaaggcgtaagtttagtacgttgttcgtgacggcggttttcgtttttaaacgtttcggttggcgtggcgacggttgtagttcgcgcgttttgcggggatagtagtcgtgcgcgttttgtgcggttttttgcgtttgtttcggcgcgtaaattttttcggcgataatcgattaggttttttcgattggggcgcggggtttttttcgggatttagaaattgttcgttttttttttttcgtagttaagatttattgaaaatatggcgttttcgaaagtcgtttttcggttttttagggatttcgaaatattcgtttttaggtttttttagtttttaatgggcgtaaaattttagttcgtgggatcgaggaaggagagggagtcgttgagtttgtgtgaggttagt

SEQ ID NO: 39322 - DNA, 550 bp, Artificial Sequence
  chemically treated genomic DNA (Homo sapiens) CpG-island No: 39322
actaacctcacacaaactcaacgactccctctccttcctcgatcccacgaactaaaattttacgcccattaaaaactaaaaaaacctaaaaacgaatatttcgaaatccctaaaaaaccgaaaaacgactttcgaaaacgccatattttcaataaatcttaactacgaaaaaaaaaaaacgaacaatttctaaatcccgaaaaaaaccccgcgccccaatcgaaaaaacctaatcgattatcgccgaaaaaatttacgcgccgaaacaaacgcaaaaaaccgcacaaaacgcgcacgactactatccccgcaaaacgcgcgaactacaaccgtcgccacgccaaccgaaacgtttaaaaacgaaaaccgccgtcacgaacaacgtactaaacttacgccttcctctatcccgcctaaacccgaccttaaaactccgaaactcaaaaaacaaacccctcttccccgcaactaccgcctacccgaatactcaaccgaaaccgtacgctaaacgacgtcccgaaactaaacgccgaatataaaacgttcatcc

SEQ ID NO: 39323 - DNA, 550 bp, Artificial Sequence
  chemically treated genomic DNA (Homo sapiens) CpG-island No: 39323
gttggttttatatagatttagcggtttttttttttttttcggttttacgagttgaaattttgcgtttattggaagttggagggatttggagacgagtatttcgggatttttgagggatcgaggaacgattttcgagggcgttatatttttagtgggttttgattgcggaggggagggggcgagtagtttttgggtttcggggagagtttcgcgttttagtcggagaggtttgatcggttgtcgtcgggaaagtttgcgcgtcgaggtaggcgtaaggggtcgtataaggcgcgtacgattgttgttttcgtaaggcgcgcggattatagtcgtcgttacgttagtcggggcgtttgggaacgagagtcgtcgttacggatagcgtgttgggtttgcgtttttttttgtttcgtttggattcggttttggggtttcgaagtttaaggaataagtttttttttttcgtagttatcgtttgttcgggtgtttagtcggagtcgtgcgttgggcggcgtttcggggttgggcgtcgaatgtagagcgtttattt

SEQ ID NO: 39324 - DNA, 550 bp, Artificial Sequence
  chemically treated genomic DNA (Homo sapiens) CpG-island No: 39324
aaataaacgctctacattcgacgcccaaccccgaaacgccgcccaacgcacgactccgactaaacacccgaacaaacgataactacgaaaaaaaaaaacttattccttaaacttcgaaaccccaaaaccgaatccaaacgaaacaaaaaaaaacgcaaacccaacacgctatccgtaacgacgactctcgttcccaaacgccccgactaacgtaacgacgactataatccgcgcgccttacgaaaacaacaatcgtacgcgccttatacgaccccttacgcctacctcgacgcgcaaactttcccgacgacaaccgatcaaacctctccgactaaaacgcgaaactctccccgaaacccaaaaactactcgccccctcccctccgcaatcaaaacccactaaaaatataacgccctcgaaaatcgttcctcgatccctcaaaaatcccgaaatactcgtctccaaatccctccaacttccaataaacgcaaaatttcaactcgtaaaaccgaaaaaaaaaaaaaaaccgctaaatctatataaaaccaac

SEQ ID NO: 39325 - DNA, 628 bp, Artificial Sequence
  chemically treated genomic DNA (Homo sapiens) CpG-island No: 39325
  misc_feature (8)..(8): n is either a, c, g or t
  misc_feature (87)..(87): n is either a, c, g or t
  misc_feature (131)..(131): n is either a, c, g or t
  misc_feature (170)..(170): n is either a, c, g or t
  misc_feature (190)..(190): n is either a, c, g or t
  misc_feature (207)..(207): n is either a, c, g or t
  misc_feature (221)..(221): n is either a, c, g or t
  misc_feature (311)..(311): n is either a, c, g or t
  misc_feature (402)..(402): n is either a, c, g or t
  misc_feature (451)..(451): n is either a, c, g or t
  misc_feature (460)..(460): n is either a, c, g or t
  misc_feature (480)..(481): n is either a, c, g or t
  misc_feature (508)..(508): n is either a, c, g or t
  misc_feature (512)..(512): n is either a, c, g or t
  misc_feature (519)..(519): n is either a, c, g or t
  misc_feature (540)..(540): n is either a, c, g or t
cggcgttnttttttcgcgcgtgttttttgtggttttggcgtcgcgcgtgggtcgttcgtgtgtggcggtgggttttgcgtttggtgntttcgcgtggtcggtggtagttggcggttgcgcgcggggttttngtggtgggcgttttttgcggtttcgcgcgtcgggtgttntcgatgtttgtgtggttttncgtttttttgattgttngttcgacgttgtgnagagagcgtgtcgcgcgcgtggatagttcggatattggttagattggtttcggttatttgtaatatattatgttattgttttttcgtttnacggggttttcgttggtatattatgtattgtcgtgagatgtggtgaggtagtcgttgtagtgagcgttagcgtagttggacggaggtatgntgcgaggtacgagacgtcgcggcgtcgtgcgaacgtacgcgattcgggntacgtggtntagacgtcgcgcgttttttnntttgtcgagtttgttcgttttatcgtnatgnaagattntttcgcgggtgtatgcgtcgngcgttgcgtggttggtttagagagacgtgtatcgagttttttttcgtattgagtttttattagttttgttgaattttttttttgtatg

SEQ ID NO: 39326 - DNA, 628 bp, Artificial Sequence
  chemically treated genomic DNA (Homo sapiens) CpG-island No: 39326
  misc_feature (89)..(89): n is either a, c, g or t
  misc_feature (110)..(110): n is either a, c, g or t
  misc_feature (117)..(117): n is either a, c, g or t
  misc_feature (121)..(121): n is either a, c, g or t
  misc_feature (148)..(149): n is either a, c, g or t
  misc_feature (169)..(169): n is either a, c, g or t
  misc_feature (178)..(178): n is either a, c, g or t
  misc_feature (227)..(227): n is either a, c, g or t
  misc_feature (318)..(318): n is either a, c, g or t
  misc_feature (408)..(408): n is either a, c, g or t
  misc_feature (422)..(422): n is either a, c, g or t
  misc_feature (439)..(439): n is either a, c, g or t
  misc_feature (459)..(459): n is either a, c, g or t
  misc_feature (498)..(498): n is either a, c, g or t
  misc_feature (542)..(542): n is either a, c, g or t
  misc_feature (621)..(621): n is either a, c, g or t
catacaaaaaaaaaattcaacaaaactaataaaaactcaatacgaaaaaaaactcgatacacgtctctctaaaccaaccacgcaacgcncgacgcatacacccgcgaaanaatcttncatnacgataaaacgaacaaactcgacaaannaaaaaacgcgcgacgtctanaccacgtancccgaatcgcgtacgttcgcacgacgccgcgacgtctcgtacctcgcancatacctccgtccaactacgctaacgctcactacaacgactacctcaccacatctcacgacaatacataatataccaacgaaaaccccgtnaaacgaaaaaacaataacataatatattacaaataaccgaaaccaatctaaccaatatccgaactatccacgcgcgcgacacgctctctncacaacgtcgaacnaacaatcaaaaaaacgnaaaaccacacaaacatcganaacacccgacgcgcgaaaccgcaaaaaacgcccaccacnaaaaccccgcgcgcaaccgccaactaccaccgaccacgcgaaancaccaaacgcaaaacccaccgccacacacgaacgacccacgcgcgacgccaaaaccacaaaaaacacgcgcgaaaaaanaacgccg

SEQ ID NO: 39327 - DNA, 628 bp, Artificial Sequence
  chemically treated genomic DNA (Homo sapiens) CpG-island No: 39327
  misc_feature (89)..(89): n is either a, c, g or t
  misc_feature (110)..(110): n is either a, c, g or t
  misc_feature (117)..(117): n is either a, c, g or t
  misc_feature (121)..(121): n is either a, c, g or t
  misc_feature (148)..(149): n is either a, c, g or t
  misc_feature (169)..(169): n is either a, c, g or t
  misc_feature (178)..(178): n is either a, c, g or t
  misc_feature (227)..(227): n is either a, c, g or t
  misc_feature (318)..(318): n is either a, c, g or t
  misc_feature (408)..(408): n is either a, c, g or t
  misc_feature (422)..(422): n is either a, c, g or t
  misc_feature (439)..(439): n is either a, c, g or t
  misc_feature (459)..(459): n is either a, c, g or t
  misc_feature (498)..(498): n is either a, c, g or t
  misc_feature (542)..(542): n is either a, c, g or t
  misc_feature (621)..(621): n is either a, c, g or t
tatataaagaaggaatttaatagaattaatgagaatttagtacggagaaaggttcgatatacgtttttttgagttagttacgtagcgtncggcgtatgtattcgcgaagngattttntatnacggtggagcgagtagattcgatagannggagggcgcgcgacgtttgnattacgtgnttcgagtcgcgtacgttcgtacgacgtcgcggcgtttcgtatttcgtantatgttttcgtttagttacgttagcgtttattataacggttattttattatattttacggtaatatatggtgtattagcggagatttcgtngagcggagaggtaatgatatgatgtattataagtggtcgagattaatttaattaatgttcggattatttacgcgcgcgatacgttttttntataacgtcgaatnaatagttaaggggacgngagattatataaatatcgangatattcgacgcgcggggtcgtagaagacgtttattatnaaagtttcgcgcgtagtcgttagttgttatcggttacgcggagntattaggcgtaagatttatcgttatatacgggcgatttacgcgcggcgttagaattataaaaaatacgcgcgggggganggcgtcg

SEQ ID NO: 39328 - DNA, 628 bp, Artificial Sequence
  chemically treated genomic DNA (Homo sapiens) CpG-island No: 39328
  misc_feature (8)..(8): n is either a, c, g or t
  misc_feature (87)..(87): n is either a, c, g or t
  misc_feature (131)..(131): n is either a, c, g or t
  misc_feature (170)..(170): n is either a, c, g or t
  misc_feature (190)..(190): n is either a, c, g or t
  misc_feature (207)..(207): n is either a, c, g or t
  misc_feature (221)..(221): n is either a, c, g or t
  misc_feature (311)..(311): n is either a, c, g or t
  misc_feature (402)..(402): n is either a, c, g or t
  misc_feature (451)..(451): n is either a, c, g or t
  misc_feature (460)..(460): n is either a, c, g or t
  misc_feature (480)..(481): n is either a, c, g or t
  misc_feature (508)..(508): n is either a, c, g or t
  misc_feature (512)..(512): n is either a, c, g or t
  misc_feature (519)..(519): n is either a, c, g or t
  misc_feature (540)..(540): n is either a, c, g or t
cgacgccntccccccgcgcgtattttttataattctaacgccgcgcgtaaatcgcccgtatataacgataaatcttacgcctaatanctccgcgtaaccgataacaactaacgactacgcgcgaaactttnataataaacgtcttctacgaccccgcgcgtcgaatatcntcgatatttatataatctcncgtccccttaactattnattcgacgttatanaaaaaacgtatcgcgcgcgtaaataatccgaacattaattaaattaatctcgaccacttataatacatcatatcattacctctccgctcnacgaaatctccgctaatacaccatatattaccgtaaaatataataaaataaccgttataataaacgctaacgtaactaaacgaaaacatantacgaaatacgaaacgccgcgacgtcgtacgaacgtacgcgactcgaancacgtaatncaaacgtcgcgcgccctccnntctatcgaatctactcgctccaccgtnatanaaaatcncttcgcgaatacatacgccgnacgctacgtaactaactcaaaaaaacgtatatcgaacctttctccgtactaaattctcattaattctattaaattccttctttatata

SEQ ID NO: 39329 - DNA, 639 bp, Artificial Sequence
  chemically treated genomic DNA (Homo sapiens) CpG-island No: 39329
tttagtcgtatcgggtcggtgttgtcggggtttttttttatgtcgttcgatcgttttttcgagcgttgcgagttcgtattggaaggcgagattttttcgtgtttcgtggtgggaggcgagaagcgttttgtgtttgtcgtagatttttaattcggtgttgcgcgatttttcgttgtagtagattaacgcggtgtgcgacgagttttatatttattgttcgcgttgtacggtcgattagttggagatttttaaagttatgggtattttgtttttttcggcgttttcgtgcgggtttattattaagacggacgtcgagcgtttgtgtaacgcgttgttttacggcggcgtttattcgtcgttttgtaagaaggagttggtcgttagtttggcgttgggtttggagtttagcgagcgtagcgttcgcgtgtattacgagtgtttcggtaagtgtaaggggttgttggtgttcgagttttatagtagttcgagcgtcgtttgtatttagtgtttggattgtcgttttatgtattcgtcgtataagttcgtggtgtattcgtataaggttttggagaatcggatttgttattggggtttcgattcggttaattggcgggtttatattttgttgagttaggatta

SEQ ID NO: 39330 - DNA, 639 bp, Artificial Sequence
  chemically treated genomic DNA (Homo sapiens) CpG-island No: 39330
taatcctaactcaacaaaatataaacccgccaattaaccgaatcgaaaccccaataacaaatccgattctccaaaaccttatacgaatacaccacgaacttatacgacgaatacataaaacgacaatccaaacactaaatacaaacgacgctcgaactactataaaactcgaacaccaacaaccccttacacttaccgaaacactcgtaatacacgcgaacgctacgctcgctaaactccaaacccaacgccaaactaacgaccaactccttcttacaaaacgacgaataaacgccgccgtaaaacaacgcgttacacaaacgctcgacgtccgtcttaataataaacccgcacgaaaacgccgaaaaaaacaaaatacccataactttaaaaatctccaactaatcgaccgtacaacgcgaacaataaatataaaactcgtcgcacaccgcgttaatctactacaacgaaaaatcgcgcaacaccgaattaaaaatctacgacaaacacaaaacgcttctcgcctcccaccacgaaacacgaaaaaatctcgccttccaatacgaactcgcaacgctcgaaaaaacgatcgaacgacataaaaaaaaaccccgacaacaccgacccgatacgactaaa

SEQ ID NO: 39331 - DNA, 639 bp, Artificial Sequence
  chemically treated genomic DNA (Homo sapiens) CpG-island No: 39331
taattttggtttagtaggatgtaggttcgttagttggtcgagtcgaagttttagtggtaggttcggttttttagggttttgtgcgagtgtattacgaatttgtgcggcgggtatatgaggcggtagtttaggtattggatgtaggcggcgttcgggttgttgtagagttcgggtattagtagttttttatatttgtcgaagtattcgtggtatacgcggacgttgcgttcgttgagttttaggtttagcgttaggttggcggttagtttttttttgtagggcggcgggtaggcgtcgtcgtagagtagcgcgttgtataggcgttcggcgttcgttttggtgatgagttcgtacgagggcgtcgagaagggtaggatgtttatgattttgaggatttttagttggtcggtcgtgtagcgcgagtagtagatgtggagttcgtcgtatatcgcgttgatttgttgtagcgagaagtcgcgtagtatcgagttgagaatttgcggtagatatagggcgtttttcgttttttattacgaagtacgagaaggtttcgttttttagtacgggttcgtagcgttcgggggagcggtcggacggtatgaagaagggtttcggtagtatcggttcggtgcggttgga

SEQ ID NO: 39332 - DNA, 639 bp, Artificial Sequence
  chemically treated genomic DNA (Homo sapiens) CpG-island No: 39332
tccaaccgcaccgaaccgatactaccgaaacccttcttcataccgtccgaccgctcccccgaacgctacgaacccgtactaaaaaacgaaaccttctcgtacttcgtaataaaaaacgaaaaacgccctatatctaccgcaaattctcaactcgatactacgcgacttctcgctacaacaaatcaacgcgatatacgacgaactccacatctactactcgcgctacacgaccgaccaactaaaaatcctcaaaatcataaacatcctacccttctcgacgccctcgtacgaactcatcaccaaaacgaacgccgaacgcctatacaacgcgctactctacgacgacgcctacccgccgccctacaaaaaaaaactaaccgccaacctaacgctaaacctaaaactcaacgaacgcaacgtccgcgtataccacgaatacttcgacaaatataaaaaactactaatacccgaactctacaacaacccgaacgccgcctacatccaatacctaaactaccgcctcatatacccgccgcacaaattcgtaatacactcgcacaaaaccctaaaaaaccgaacctaccactaaaacttcgactcgaccaactaacgaacctacatcctactaaaccaaaatta

SEQ ID NO: 39333 - DNA, 685 bp, Artificial Sequence
  chemically treated genomic DNA (Homo sapiens) CpG-island No: 39333
ataagcggtgaggtagggtttttttcgatgcgtcgtttttgttttttttttttgttagagttcgagcgttaggattttgttcgtagttcgttcgttagtcggggtcgtggttcggggttgtttcgcggttgcggcggaggggttgggtcgggcggggagagttcggcggtcgttcgtttcgcggcgtttagcggtgcgagtgcgcgtagtttcgttcgtagttcgagttttcgttttgcgggagtcggggcgtcgtcgtcgcgttagtttttttttttgaatgttattattattatagtaaagggaagggtttcgtcgagggggtggcgggagggttaacggcgttttaggatgggcgttaagcgtgagtaagggtagtcggcgggcgtagcgttttggcgtagatatcggttcgatttacgtttgggtagggttatttttgtaatattgtcgggcgggagtagacgttttaagtttcgagggagagcgggcggtcggggcgggggagggtttgtggatggaagtcgtcgggttgatttatttttttagtttttttttcggtagtatttacggaggtggaaaggcgggcgtttcgttttgttgattgattcgggagagtcgttgttgttagatgttagtggttcgtaggagtttttgtattggtcggcgtcgttttatttttttt

SEQ ID NO: 39334 - DNA, 685 bp, Artificial Sequence
  chemically treated genomic DNA (Homo sapiens) CpG-island No: 39334
aaaaaaaataaaacgacgccgaccaatacaaaaactcctacgaaccactaacatctaacaacaacgactctcccgaatcaatcaacaaaacgaaacgcccgcctttccacctccgtaaatactaccgaaaaaaaaactaaaaaaataaatcaacccgacgacttccatccacaaaccctcccccgccccgaccgcccgctctccctcgaaacttaaaacgtctactcccgcccgacaatattacaaaaataaccctacccaaacgtaaatcgaaccgatatctacgccaaaacgctacgcccgccgactacccttactcacgcttaacgcccatcctaaaacgccgttaaccctcccgccaccccctcgacgaaacccttccctttactataataataataacattcaaaaaaaaaaactaacgcgacgacgacgccccgactcccgcaaaacgaaaactcgaactacgaacgaaactacgcgcactcgcaccgctaaacgccgcgaaacgaacgaccgccgaactctccccgcccgacccaacccctccgccgcaaccgcgaaacaaccccgaaccacgaccccgactaacgaacgaactacgaacaaaatcctaacgctcgaactctaacaaaaaaaaaaaacaaaaacgacgcatcgaaaaaaaccctacctcaccgcttat

SEQ ID NO: 39335 - DNA, 685 bp, Artificial Sequence
  chemically treated genomic DNA (Homo sapiens) CpG-island No: 39335
aggaagggtggggcggcgtcggttagtgtaggagtttttgcgggttattggtatttggtagtagcgattttttcgggttagttagtagagcgaggcgttcgtttttttattttcgtgagtgttgtcgaggggaaaattggggaagtgggttagttcggcggtttttatttatagattttttttcgtttcggtcgttcgttttttttcggagtttaaggcgtttgttttcgttcggtagtgttgtaagagtggttttgtttaggcgtgggtcgggtcggtgtttgcgttaaggcgttgcgttcgtcggttgtttttgtttacgtttggcgtttattttgaggcgtcgttggttttttcgttattttttcggcggggtttttttttttattatggtaatagtgatatttagaggaaaaggttagcgcggcgacggcgtttcggttttcgtagagcggaggttcgggttgcggacggggttgcgcgtattcgtatcgttggacgtcgcggggcgggcggtcgtcgagtttttttcgttcggtttagttttttcgtcgtagtcgcggggtagtttcgagttacggtttcggttggcgggcgggttgcgggtaggattttggcgttcgggttttggtaaggggaaaggatagaaacggcgtatcgggagggattttgttttatcgtttgt

SEQ ID NO: 39336 - DNA, 685 bp, Artificial Sequence
  chemically treated genomic DNA (Homo sapiens) CpG-island No: 39336
acaaacgataaaacaaaatccctcccgatacgccgtttctatcctttccccttaccaaaacccgaacgccaaaatcctacccgcaacccgcccgccaaccgaaaccgtaactcgaaactaccccgcgactacgacgaaaaaactaaaccgaacgaaaaaaactcgacgaccgcccgccccgcgacgtccaacgatacgaatacgcgcaaccccgtccgcaacccgaacctccgctctacgaaaaccgaaacgccgtcgccgcgctaaccttttcctctaaatatcactattaccataataaaaaaaaaaaccccgccgaaaaaataacgaaaaaaccaacgacgcctcaaaataaacgccaaacgtaaacaaaaacaaccgacgaacgcaacgccttaacgcaaacaccgacccgacccacgcctaaacaaaaccactcttacaacactaccgaacgaaaacaaacgccttaaactccgaaaaaaaacgaacgaccgaaacgaaaaaaaatctataaataaaaaccgccgaactaacccacttccccaattttcccctcgacaacactcacgaaaataaaaaaacgaacgcctcgctctactaactaacccgaaaaaatcgctactaccaaataccaataacccgcaaaaactcctacactaaccgacgccgccccacccttcct

SEQ ID NO: 39337 - DNA, 597 bp, Artificial Sequence
  chemically treated genomic DNA (Homo sapiens) CpG-island No: 39337
acgcggattttagttcgtttgggaaacggtttttattagtagaagggagattgcggtttagtttcgaggtcgttttagtagttcggttttacgcgatttattattttcgtcgtttttttacggtgttcgtcgttttcgtcgttcggttttttaatcgggtttttagtttttcgtttcgtgttttttggagatttgtagtttttgtcgttttgcgttcgtttttagggttcgtcgtttcgtcgttttatttttttttaaggggtttttagttgttttttcgcgatttttttcggattcggtttgtttatttttgttcgttaattcgtttggttttcgggcgagagttttcgcgcggttttggtttttgtttttttaacgtcgtcggggttgcgggatgtcgatttcgcggatcgtttagattcggaattgttgaggtagtagcgggttcgcggcgtttggtttatttcgggattttttagttttcgcgttgggttcgtcgcgttcgtattaagtacgttaggcggttttggtttatttttttttcgtttttcggtagttggtacgagggaatttggtcgttaggttttttttgggatt

SEQ ID NO: 39338 - DNA, 597 bp, Artificial Sequence
  chemically treated genomic DNA (Homo sapiens) CpG-island No: 39338
aatcccaaaaaaaacctaacgaccaaattccctcgtaccaactaccgaaaaacgaaaaaaaaataaaccaaaaccgcctaacgtacttaatacgaacgcgacgaacccaacgcgaaaactaaaaaatcccgaaataaaccaaacgccgcgaacccgctactacctcaacaattccgaatctaaacgatccgcgaaatcgacatcccgcaaccccgacgacgttaaaaaaacaaaaaccaaaaccgcgcgaaaactctcgcccgaaaaccaaacgaattaacgaacaaaaataaacaaaccgaatccgaaaaaaatcgcgaaaaaacaactaaaaaccccttaaaaaaaaataaaacgacgaaacgacgaaccctaaaaacgaacgcaaaacgacaaaaactacaaatctccaaaaaacacgaaacgaaaaactaaaaacccgattaaaaaaccgaacgacgaaaacgacgaacaccgtaaaaaaacgacgaaaataataaatcgcgtaaaaccgaactactaaaacgacctcgaaactaaaccgcaatctcccttctactaataaaaaccgtttcccaaacgaactaaaatccgcgt

SEQ ID NO: 39339 - DNA, 597 bp, Artificial Sequence
  chemically treated genomic DNA (Homo sapiens) CpG-island No: 39339
gattttaggggaaatttgacggttaggttttttcgtgttagttgtcgggaggcgggagggaggtaggttagggtcgtttggcgtgtttggtgcgaacgcggcgggtttagcgcgagagttggggaatttcgggatgagttaagcgtcgcgagttcgttgttgttttagtagtttcgggtttgggcggttcgcggagtcggtatttcgtagtttcggcggcgttagaggaataggaattagagtcgcgcgagggttttcgttcgggagttaggcgggttagcgggtaggagtgggtaggtcgagttcggaaagggtcgcgaggaggtagttaggggttttttgaggagggatagggcggcggaacgacgggttttgggagcgggcgtagggcggtaggagttgtaggtttttagagggtacggggcggggaattaggggttcggttagaaagtcgggcggcgggaacggcgggtatcgtgagggggcggcgggaatggtgggtcgcgtgaggtcgggttgttggagcgatttcgggattaaatcgtagttttttttttgttaatggaagtcgttttttaagcgagttgaagttcgcgt

SEQ ID NO: 39340 - DNA, 597 bp, Artificial Sequence
  chemically treated genomic DNA (Homo sapiens) CpG-island No: 39340
acgcgaacttcaactcgcttaaaaaacgacttccattaacaaaaaaaaaactacgatttaatcccgaaatcgctccaacaacccgacctcacgcgacccaccattcccgccgccccctcacgatacccgccgttcccgccgcccgactttctaaccgaacccctaattccccgccccgtaccctctaaaaacctacaactcctaccgccctacgcccgctcccaaaacccgtcgttccgccgccctatccctcctcaaaaaacccctaactacctcctcgcgaccctttccgaactcgacctacccactcctacccgctaacccgcctaactcccgaacgaaaaccctcgcgcgactctaattcctattcctctaacgccgccgaaactacgaaataccgactccgcgaaccgcccaaacccgaaactactaaaacaacaacgaactcgcgacgcttaactcatcccgaaattccccaactctcgcgctaaacccgccgcgttcgcaccaaacacgccaaacgaccctaacctacctccctcccgcctcccgacaactaacacgaaaaaacctaaccgtcaaatttcccctaaaatc

SEQ ID NO: 39341 - DNA, 520 bp, Artificial Sequence
  chemically treated genomic DNA (Homo sapiens) CpG-island No: 39341
gcggtcgcggcgaggtaggtgaggtgaggcggggcgaggtgggcgaggggggcgaggtgaggcggggcgaggcggggcgaggcgaggcggggcgaggtgggcgaggtgggcgaggtgaggcggggcgggtgtcgtcgcgttgggtcgagtttacgattttagttgattcgttcgcggttgtttaatttcgttgaggtttaggacgagggacggggcggtaaattgttatagaggtcgtcgtagatcggtgtgtaatcgaaggtgaagagcgggaaggcgaggatcgaatcgtttttggtgtgcgttgttcgataggaagtttcgaatgggttgtgagtcgtcggtggaggtgttcgggtaggtgtagagttatagtttgcgtttcgtgagtcgaggcgggtaggaggaatagggatttggcggcgatatacgttgggcggaaatttataatgaatagggaaggggggacggttatttatttaaaattggttaaatgaattttagagggagtttcgagaga

SEQ ID NO: 39342 - DNA, 520 bp, Artificial Sequence
  chemically treated genomic DNA (Homo sapiens) CpG-island No: 39342
tctctcgaaactccctctaaaattcatttaaccaattttaaataaataaccgtccccccttccctattcattataaatttccgcccaacgtatatcgccgccaaatccctattcctcctacccgcctcgactcacgaaacgcaaactataactctacacctacccgaacacctccaccgacgactcacaacccattcgaaacttcctatcgaacaacgcacaccaaaaacgattcgatcctcgccttcccgctcttcaccttcgattacacaccgatctacgacgacctctataacaatttaccgccccgtccctcgtcctaaacctcaacgaaattaaacaaccgcgaacgaatcaactaaaatcgtaaactcgacccaacgcgacgacacccgccccgcctcacctcgcccacctcgcccacctcgccccgcctcgcctcgccccgcctcgccccgcctcacctcgcccccctcgcccacctcgccccgcctcacctcacctacctcgccgcgaccgc

SEQ ID NO: 39343 - DNA, 520 bp, Artificial Sequence
  chemically treated genomic DNA (Homo sapiens) CpG-island No: 39343
tttttcggggttttttttgaggtttatttagttagttttgagtgggtgatcgtttttttttttttgtttattgtgaattttcgtttaacgtgtgtcgtcgttaggtttttgttttttttattcgtttcggtttacggggcgtaggttgtggttttgtatttgttcgggtatttttatcggcggtttatagtttattcgggattttttgtcggataacgtatattagaggcgattcggttttcgttttttcgttttttattttcggttgtatatcggtttacggcgatttttgtgataatttgtcgtttcgtttttcgttttgagttttaacgaaattgggtagtcgcgagcgggttagttggagtcgtaagttcggtttagcgcgacgatattcgtttcgttttatttcgtttatttcgtttatttcgtttcgtttcgtttcgtttcgtttcgtttcgttttatttcgtttttttcgtttatttcgtttcgttttattttatttatttcgtcgcggtcgt

SEQ ID NO: 39344 - DNA, 520 bp, Artificial Sequence
  chemically treated genomic DNA (Homo sapiens) CpG-island No: 39344
acgaccgcgacgaaataaataaaataaaacgaaacgaaataaacgaaaaaaacgaaataaaacgaaacgaaacgaaacgaaacgaaacgaaacgaaataaacgaaataaacgaaataaaacgaaacgaatatcgtcgcgctaaaccgaacttacgactccaactaacccgctcgcgactacccaatttcgttaaaactcaaaacgaaaaacgaaacgacaaattatcacaaaaatcgccgtaaaccgatatacaaccgaaaataaaaaacgaaaaaacgaaaaccgaatcgcctctaatatacgttatccgacaaaaaatcccgaataaactataaaccgccgataaaaatacccgaacaaatacaaaaccacaacctacgccccgtaaaccgaaacgaataaaaaaaacaaaaacctaacgacgacacacgttaaacgaaaattcacaataaacaaaaaaaaaaaaacgatcacccactcaaaactaactaaataaacctcaaaaaaaaccccgaaaaa

SEQ ID NO: 39345 - DNA, 525 bp, Artificial Sequence
  chemically treated genomic DNA (Homo sapiens) CpG-island No: 39345
tggttatatgttagagcgtttcgggcgaatgttgaagttcgtattttcgaagacggttttttgagtgttagttggggtagttatcgttttcgagttgataatggcgtagaaaatcgttttaaatagttcggcggtcggttcgaaatcggtagttcggtatgtttagtcgaagatattgattcgaattagggcggaagggttgagttggggaaattcgacgtcgaaaagatgaagtattttcggtaatagggaggtgtacggaaaacgaagttttgcgtcgaaaaaggtaataaagattacggtttgatttttgtcgggtttcggtataatagttttggtagatgcgaagatttgatcgttcgttataattttggtcgaggtaagttttgttaaattcgttttattaatgagcgaggtatttaggtattcggagtggtttttatcgatttttttcgggttagggtcgttggttgaagaagagttatgaaaggatagcgtaggagtttagagtaatttaagggttgg

SEQ ID NO: 39346 - DNA, 525 bp, Artificial Sequence
  chemically treated genomic DNA (Homo sapiens) CpG-island No: 39346
ccaacccttaaattactctaaactcctacgctatcctttcataactcttcttcaaccaacgaccctaacccgaaaaaaatcgataaaaaccactccgaatacctaaatacctcgctcattaataaaacgaatttaacaaaacttacctcgaccaaaattataacgaacgatcaaatcttcgcatctaccaaaactattataccgaaacccgacaaaaatcaaaccgtaatctttattacctttttcgacgcaaaacttcgttttccgtacacctccctattaccgaaaatacttcatcttttcgacgtcgaatttccccaactcaacccttccgccctaattcgaatcaatatcttcgactaaacataccgaactaccgatttcgaaccgaccgccgaactatttaaaacgattttctacgccattatcaactcgaaaacgataactaccccaactaacactcaaaaaaccgtcttcgaaaatacgaacttcaacattcgcccgaaacgctctaacatataacca

SEQ ID NO: 39347 - DNA, 525 bp, Artificial Sequence
  chemically treated genomic DNA (Homo sapiens) CpG-island No: 39347
ttaatttttaggttattttaggtttttgcgttatttttttatggtttttttttaattaacggttttgattcgggaaaggtcggtgaagattatttcggatatttaggtgtttcgtttattgatgaggcggatttgataaagtttgtttcggttagggttgtggcgagcggttaggttttcgtatttgttaaggttgttgtgtcgaagttcggtaagaattagatcgtggtttttgttgtttttttcgacgtagggtttcgtttttcgtgtatttttttgttgtcggaaatattttattttttcgacgtcgagtttttttaatttagttttttcgttttggttcggattaatattttcgattgggtatgtcgaattgtcggtttcgagtcgatcgtcgagttgtttggggcgattttttacgttattgttaattcgaagacggtgattattttagttggtatttagaaaatcgttttcggaagtgcgaattttaatattcgttcggagcgttttgatatatggtta

SEQ ID NO: 39348 - DNA, 525 bp, Artificial Sequence
  chemically treated genomic DNA (Homo sapiens) CpG-island No: 39348
taaccatatatcaaaacgctccgaacgaatattaaaattcgcacttccgaaaacgattttctaaataccaactaaaataatcaccgtcttcgaattaacaataacgtaaaaaatcgccccaaacaactcgacgatcgactcgaaaccgacaattcgacatacccaatcgaaaatattaatccgaaccaaaacgaaaaaactaaattaaaaaaactcgacgtcgaaaaaataaaatatttccgacaacaaaaaaatacacgaaaaacgaaaccctacgtcgaaaaaaacaacaaaaaccacgatctaattcttaccgaacttcgacacaacaaccttaacaaatacgaaaacctaaccgctcgccacaaccctaaccgaaacaaactttatcaaatccgcctcatcaataaacgaaacacctaaatatccgaaataatcttcaccgacctttcccgaatcaaaaccgttaattaaaaaaaaaccataaaaaaataacgcaaaaacctaaaataacctaaaaattaa

SEQ ID NO: 39349 - DNA, 542 bp, Artificial Sequence
  chemically treated genomic DNA (Homo sapiens) CpG-island No: 39349
gtcgatagcggtaatcgtcgttttaatcgtcgcgtttacgacgttcgtttttttcgtttttttcgcgtttatttcgcgtttcgtattcggttttacgttatcgtttattattttgtttttttgttcgcgcgtatatgttcgtatggggcgggatttaatttgaattttttttattttttttttttattttttttacgtcgttatcgtcgagatagggtcgttttttttttatttataaaaatattttttcgagttttttgttttttttttttattttatcgttttttttagtgttttttatcgttatcgttatattgtgtaattattttcgttagtttcgtcgtcgtaagagttattttggttattatttcgcgtcgtcggaattttattaaaatattatttttttggtttttcggtgagtatttttatttttttttatttttagtcggttacgatagtcgtcgtggttgttttttttatttttaattttttttttttatttttttatgtgttatcgtttattatattttaaaaattttaaa

SEQ ID NO: 39350 - DNA, 542 bp, Artificial Sequence
  chemically treated genomic DNA (Homo sapiens) CpG-island No: 39350
tttaaaatttttaaaatataataaacgataacacataaaaaaataaaaaaaaaaaattaaaaataaaaaaaacaaccacgacgactatcgtaaccgactaaaaataaaaaaaaataaaaatactcaccgaaaaaccaaaaaaataatattttaataaaattccgacgacgcgaaataataaccaaaataactcttacgacgacgaaactaacgaaaataattacacaatataacgataacgataaaaaacactaaaaaaaacgataaaataaaaaaaaaaaacaaaaaactcgaaaaaatatttttataaataaaaaaaaaacgaccctatctcgacgataacgacgtaaaaaaaataaaaaaaaaaaataaaaaaaattcaaattaaatcccgccccatacgaacatatacgcgcgaacaaaaaaacaaaataataaacgataacgtaaaaccgaatacgaaacgcgaaataaacgcgaaaaaaacgaaaaaaacgaacgtcgtaaacgcgacgattaaaacgacgattaccgctatcgac

SEQ ID NO: 39351 - DNA, 542 bp, Artificial Sequence
  chemically treated genomic DNA (Homo sapiens) CpG-island No: 39351
tttaggatttttagggtgtgataggcggtgatatatagaggaatagaggagagggattaggggtggagaggataattacgacggttatcgtggtcggttggagatggagaaaaatggagatgtttatcggaggattaagggaatggtgttttggtgggatttcggcgacgcgaggtggtggttaaggtagtttttgcggcggcgaagttaacggaggtggttgtatagtgtggcggtggcggtagagggtattggaggaggcggtgaggtaggaaaaagagataggaggttcgggggagtgtttttataggtgagggggaggcggttttatttcggcggtgacgacgtgggggaggtggagagagagagtgagagggatttaaattaaatttcgttttatgcgggtatgtgcgcgcgggtaggaaggtagagtagtgggcggtgacgtggggtcgggtgcggggcgcgaagtgggcgcgggaggagcggggaaagcgggcgtcgtggacgcggcggttgggacggcggttgtcgttatcggt

SEQ ID NO: 39352 - DNA, 542 bp, Artificial Sequence
  chemically treated genomic DNA (Homo sapiens) CpG-island No: 39352
accgataacgacaaccgccgtcccaaccgccgcgtccacgacgcccgctttccccgctcctcccgcgcccacttcgcgccccgcacccgaccccacgtcaccgcccactactctaccttcctacccgcgcgcacatacccgcataaaacgaaatttaatttaaatccctctcactctctctctccacctcccccacgtcgtcaccgccgaaataaaaccgcctccccctcacctataaaaacactcccccgaacctcctatctctttttcctacctcaccgcctcctccaataccctctaccgccaccgccacactatacaaccacctccgttaacttcgccgccgcaaaaactaccttaaccaccacctcgcgtcgccgaaatcccaccaaaacaccattcccttaatcctccgataaacatctccatttttctccatctccaaccgaccacgataaccgtcgtaattatcctctccacccctaatccctctcctctattcctctatatatcaccgcctatcacaccctaaaaatcctaaa

SEQ ID NO: 39353 - DNA, 680 bp, Artificial Sequence
  chemically treated genomic DNA (Homo sapiens) CpG-island No: 39353
gtcgtcggtcgtcgtgggtttttgtcgtcgttttttagtttttttaaaaggattttcggtgttttttttattcgttcgtcgttattttcgttttcgtttttcgtcgtcggaagcgttttagcgttgtgtgatttagcgtcgtcgtcgtcgtcgtcgttttagtcgtgcgtcgtcgtcgttttagtcgtcgtcgtcgttcgggaaggacgttatcgtggtcgttaagtcgtcgtcgttttcgttcgttttttcgtagtcgttgttgatcgtcggagtatcgtcgtcgtcgtcgattcgatttttttcgtagttttaatttcgacgtcgtcgtcgttcgttgatttttcgtcgtcgttttggttatcggtgagttcgtcgcgtcgttttttattcgttggtgtttttcgttcgcgttttcgcgtcgtcgttcgtcgacgagtaagtgttttcgagtcgtcgagtcgtcgtcggtgttgacgttatcgttgacgttatcgttgacgttattgtcgttgttttcgtagattcgtcgtggattcgattgatttcggtcgttcgttttggataggatcgatttcggtcgttcgttttcgtgaatcgtcgtcgtgcgttcggtttatcgtaaattttagtcgttgacgtaataaattttttttttttttttaaaaataatttattat

SEQ ID NO: 39354 - DNA, 680 bp, Artificial Sequence
  chemically treated genomic DNA (Homo sapiens) CpG-island No: 39354
ataataaattatttttaaaaaaaaaaaaaaaatttattacgtcaacgactaaaatttacgataaaccgaacgcacgacgacgattcacgaaaacgaacgaccgaaatcgatcctatccaaaacgaacgaccgaaatcaatcgaatccacgacgaatctacgaaaacaacgacaataacgtcaacgataacgtcaacgataacgtcaacaccgacgacgactcgacgactcgaaaacacttactcgtcgacgaacgacgacgcgaaaacgcgaacgaaaaacaccaacgaataaaaaacgacgcgacgaactcaccgataaccaaaacgacgacgaaaaatcaacgaacgacgacgacgtcgaaattaaaactacgaaaaaaatcgaatcgacgacgacgacgatactccgacgatcaacaacgactacgaaaaaacgaacgaaaacgacgacgacttaacgaccacgataacgtccttcccgaacgacgacgacgactaaaacgacgacgacgcacgactaaaacgacgacgacgacgacgacgctaaatcacacaacgctaaaacgcttccgacgacgaaaaacgaaaacgaaaataacgacgaacgaataaaaaaaacaccgaaaatccttttaaaaaaactaaaaaacgacgacaaaaacccacgacgaccgacgac

SEQ ID NO: 39355 - DNA, 680 bp, Artificial Sequence
  chemically treated genomic DNA (Homo sapiens) CpG-island No: 39355
ataatgaattatttttgaaaaggaaaaagagatttattgcgttagcggttagggtttgcggtagatcgggcgtacggcggcggtttacgggaacggacggtcgagatcgattttatttaaaacggacggtcgagattaatcgggtttacggcgagtttacgggaatagcgataatgacgttagcgatgacgttagcgatgacgttagtatcggcggcggttcggcggttcgggagtatttgttcgtcggcgaacgacggcgcgaaggcgcgaacggagaatattaacgggtagaggacgacgcggcgaatttatcggtgattaaaacggcggcggaagattaacggacggcgacggcgtcgaagttgaagttgcggagaagatcgggtcgacggcggcgacggtgtttcggcggttaatagcgattgcgaaggggcggacgaggacggcgacgatttggcgattacgatgacgtttttttcgagcgacggcgacgattggaacggcggcggcgtacggttggagcggcggcgacgacggcggcgttaggttatatagcgttaggacgttttcggcgacgagaggcgaagacgagggtggcggcgggcgggtagaggagatatcggggatttttttaaaggggttaggaggcggcggtaaaggtttacggcgatcggcgat

SEQ ID NO: 39356 - DNA, 680 bp, Artificial Sequence
  chemically treated genomic DNA (Homo sapiens) CpG-island No: 39356
atcgccgatcgccgtaaacctttaccgccgcctcctaacccctttaaaaaaatccccgatatctcctctacccgcccgccgccaccctcgtcttcgcctctcgtcgccgaaaacgtcctaacgctatataacctaacgccgccgtcgtcgccgccgctccaaccgtacgccgccgccgttccaatcgtcgccgtcgctcgaaaaaaacgtcatcgtaatcgccaaatcgtcgccgtcctcgtccgccccttcgcaatcgctattaaccgccgaaacaccgtcgccgccgtcgacccgatcttctccgcaacttcaacttcgacgccgtcgccgtccgttaatcttccgccgccgttttaatcaccgataaattcgccgcgtcgtcctctacccgttaatattctccgttcgcgccttcgcgccgtcgttcgccgacgaacaaatactcccgaaccgccgaaccgccgccgatactaacgtcatcgctaacgtcatcgctaacgtcattatcgctattcccgtaaactcgccgtaaacccgattaatctcgaccgtccgttttaaataaaatcgatctcgaccgtccgttcccgtaaaccgccgccgtacgcccgatctaccgcaaaccctaaccgctaacgcaataaatctctttttccttttcaaaaataattcattat

SEQ ID NO: 39357 - DNA, 501 bp, Artificial Sequence
  chemically treated genomic DNA (Homo sapiens) CpG-island No: 39357
attagcgagtcgtgttttttaatcgtaaagagtatcggcgagtagttagtttatatttttttagtatcgtgcgtgggcgagtcgttgttttttttttttattatgaagaacgtcggcgagtcgttggttttttattttttagtattgtatcgattgcgcggtatagcggcgaattatatttttttttttagcgttacgagacgagcgagtcgttgttattttgtttttatttttagcgcgtgttgtcgcgatgatcgtcgttgtttttttttcgcgcgttgtaaacgttattttcgtttttcgagcgcgtcgtcgttttcgtttttcgtgcgcgttattatcgtcgtttttatttttcgttcgcgtcgtcgtggtcgtttttttttacgtacgttatagtcgtcgttatttttttcgcgtatgtagtaggtatcgtttttttcgtgtgtgtggtagtcgtttagataaggttggggataatgttgtagaattagggggtat

SEQ ID NO: 39358 - DNA, 501 bp, Artificial Sequence
  chemically treated genomic DNA (Homo sapiens) CpG-island No: 39358
ataccccctaattctacaacattatccccaaccttatctaaacgactaccacacacacgaaaaaaacgatacctactacatacgcgaaaaaaataacgacgactataacgtacgtaaaaaaaaacgaccacgacgacgcgaacgaaaaataaaaacgacgataataacgcgcacgaaaaacgaaaacgacgacgcgctcgaaaaacgaaaataacgtttacaacgcgcgaaaaaaaaacaacgacgatcatcgcgacaacacgcgctaaaaataaaaacaaaataacaacgactcgctcgtctcgtaacgctaaaaaaaaaaatataattcgccgctataccgcgcaatcgatacaatactaaaaaataaaaaaccaacgactcgccgacgttcttcataataaaaaaaaaaaacaacgactcgcccacgcacgatactaaaaaaatataaactaactactcgccgatactctttacgattaaaaaacacgactcgctaat

SEQ ID NO: 39359 - DNA, 501 bp, Artificial Sequence
  chemically treated genomic DNA (Homo sapiens) CpG-island No: 39359
atgttttttgattttataatattgtttttaattttatttaggcggttgttatatatacggagggggcgatgtttgttgtatgcgcgaagggggtggcggcggttgtggcgtgcgtgggagggagcggttacggcggcgcgagcggaaggtgggagcggcggtggtggcgcgtacgaaggacgggagcggcggcgcgttcggagggcgggagtggcgtttgtagcgcgcggagagagagtaacggcggttatcgcggtagtacgcgttgagggtgggagtagggtggtagcggttcgttcgtttcgtggcgttgagaagggaggtgtggttcgtcgttgtgtcgcgtagtcgatgtagtgttgagaagtgagaggttagcggttcgtcggcgttttttatgatggggaggagaggtagcggttcgtttacgtacggtgttgagaaagtataggttagttgttcgtcggtgttttttgcgattgaggagtacggttcgttggt

SEQ ID NO: 39360 - DNA, 501 bp, Artificial Sequence
  chemically treated genomic DNA (Homo sapiens) CpG-island No: 39360
accaacgaaccgtactcctcaatcgcaaaaaacaccgacgaacaactaacctatactttctcaacaccgtacgtaaacgaaccgctacctctcctccccatcataaaaaacgccgacgaaccgctaacctctcacttctcaacactacatcgactacgcgacacaacgacgaaccacacctcccttctcaacgccacgaaacgaacgaaccgctaccaccctactcccaccctcaacgcgtactaccgcgataaccgccgttactctctctccgcgcgctacaaacgccactcccgccctccgaacgcgccgccgctcccgtccttcgtacgcgccaccaccgccgctcccaccttccgctcgcgccgccgtaaccgctccctcccacgcacgccacaaccgccgccacccccttcgcgcatacaacaaacatcgccccctccgtatatataacaaccgcctaaataaaattaaaaacaatattataaaatcaaaaaacat

SEQ ID NO: 39361 - DNA, 950 bp, Artificial Sequence
  chemically treated genomic DNA (Homo sapiens) CpG-island No: 39361
gcggcgaacggcggtacgcggcggcgacggcggtacggtttcgaagcgaggcggtgcggtaataacggcggtggtagtatgggagagagaaagggatgggaggggagttttttatcgacggcgaacggcgcgacggacggcggttgtagacggcgagagtcggacgggtttcgagaggatttaaggaataaaatgggggaagttagagagggagagagagattatcgagggtaggaacgtcggtcgaaggaggtaattatggtcgaatttatcggcgtatgggacggacggggtttcggcgacggacggcgacgatcgggcgatggttagggtgttttacgcgatggcgaatgcggtggtgtagacggcgaggtttggcgtggcggttagcgatggttagcggcggttggagagcggaaaagttgtggcggtggtgggtgtacggtgttagagtaaaagagggttcgggcggagttcggtgaaatggggaaaaagagagagggagtggcggtggtgtttgaagaggggttcggacgtggttaagagcggttcgatttcgtcggtcgatatggggaggtggaggtgtagagagaggcgggatttaaaaattgaatttcggttatttcgaacgcgggcgcggcgggagagagaggggagtgggcgcggtagatgcggcgtacgcgcgggcgtggtcgatatggttcggaggaggcggaggtatgggcgcggcggcggttgcgggcgcggcggcgtcggttggaggaaggggacgggttcgataggtggggtttatttgtcggcgtttcgaggagagagggaggggcggtttgggtcggtttataaggaggagggcgcgcgcggcggggtggattgggtcgatggtttaagaagaggaaaaggaggggaaaggaaaaaaagaaaaagaaaaggaagaaaagaattttttggga

SEQ ID NO: 39362 - DNA, 950 bp, Artificial Sequence
  chemically treated genomic DNA (Homo sapiens) CpG-island No: 39362
tcccaaaaaattcttttcttccttttctttttctttttttcctttcccctccttttcctcttcttaaaccatcgacccaatccaccccgccgcgcgcgccctcctccttataaaccgacccaaaccgcccctccctctctcctcgaaacgccgacaaataaaccccacctatcgaacccgtccccttcctccaaccgacgccgccgcgcccgcaaccgccgccgcgcccatacctccgcctcctccgaaccatatcgaccacgcccgcgcgtacgccgcatctaccgcgcccactcccctctctctcccgccgcgcccgcgttcgaaataaccgaaattcaatttttaaatcccgcctctctctacacctccacctccccatatcgaccgacgaaatcgaaccgctcttaaccacgtccgaacccctcttcaaacaccaccgccactccctctctctttttccccatttcaccgaactccgcccgaaccctcttttactctaacaccgtacacccaccaccgccacaacttttccgctctccaaccgccgctaaccatcgctaaccgccacgccaaacctcgccgtctacaccaccgcattcgccatcgcgtaaaacaccctaaccatcgcccgatcgtcgccgtccgtcgccgaaaccccgtccgtcccatacgccgataaattcgaccataattacctccttcgaccgacgttcctaccctcgataatctctctctccctctctaacttcccccattttattccttaaatcctctcgaaacccgtccgactctcgccgtctacaaccgccgtccgtcgcgccgttcgccgtcgataaaaaactcccctcccatccctttctctctcccatactaccaccgccgttattaccgcaccgcctcgcttcgaaaccgtaccgccgtcgccgccgcgtaccgccgttcgccgc

SEQ ID NO: 39363 - DNA, 950 bp, Artificial Sequence
  chemically treated genomic DNA (Homo sapiens) CpG-island No: 39363
ttttagggaatttttttttttttttttttttttttttttttttttttttttttttttttttttttgggttatcggtttagtttatttcgtcgcgcgcgtttttttttttgtgggtcggtttaagtcgttttttttttttttttcgggacgtcgataggtgggttttatttgtcggattcgttttttttttttagtcggcgtcgtcgcgttcgtaatcgtcgtcgcgtttatgttttcgtttttttcgggttatgtcggttacgttcgcgcgtgcgtcgtatttatcgcgtttatttttttttttttttcgtcgcgttcgcgttcgagatggtcgggatttaatttttgaatttcgtttttttttgtatttttatttttttatgtcggtcggcgaaatcgggtcgtttttggttacgttcgaatttttttttaagtattatcgttattttttttttttttttttttattttatcgagtttcgttcgagtttttttttgttttagtatcgtgtatttattatcgttataattttttcgttttttagtcgtcgttagttatcgttagtcgttacgttaaatttcgtcgtttatattatcgtattcgttatcgcgtgaagtattttggttatcgttcgatcgtcgtcgttcgtcgtcggaatttcgttcgttttatgcgtcggtgagttcggttatggttgtttttttcggtcggcgtttttattttcgatgatttttttttttttttttaattttttttattttgttttttaggttttttcgaagttcgttcgattttcgtcgtttgtaatcgtcgttcgtcgcgtcgttcgtcgtcggtgaggaattttttttttattttttttttttttttatattgttatcgtcgttattgtcgtatcgtttcgtttcggggtcgtgtcgtcgtcgtcgtcgcgtatcgtcgttcgtcgt

SEQ ID NO: 39364 - DNA, 950 bp, Artificial Sequence
  chemically treated genomic DNA (Homo sapiens) CpG-island No: 39364
acgacgaacgacgatacgcgacgacgacgacgacacgaccccgaaacgaaacgatacgacaataacgacgataacaatataaaaaaaaaaaaaaaataaaaaaaaaattcctcaccgacgacgaacgacgcgacgaacgacgattacaaacgacgaaaatcgaacgaacttcgaaaaaacctaaaaaacaaaataaaaaaaattaaaaaaaaaaaaaaaaatcatcgaaaataaaaacgccgaccgaaaaaaacaaccataaccgaactcaccgacgcataaaacgaacgaaattccgacgacgaacgacgacgatcgaacgataaccaaaatacttcacgcgataacgaatacgataatataaacgacgaaatttaacgtaacgactaacgataactaacgacgactaaaaaacgaaaaaattataacgataataaatacacgatactaaaacaaaaaaaaactcgaacgaaactcgataaaataaaaaaaaaaaaaaaaaaaataacgataatacttaaaaaaaaattcgaacgtaaccaaaaacgacccgatttcgccgaccgacataaaaaaataaaaatacaaaaaaaaacgaaattcaaaaattaaatcccgaccatctcgaacgcgaacgcgacgaaaaaaaaaaaaaaataaacgcgataaatacgacgcacgcgcgaacgtaaccgacataacccgaaaaaaacgaaaacataaacgcgacgacgattacgaacgcgacgacgccgactaaaaaaaaaaaacgaatccgacaaataaaacccacctatcgacgtcccgaaaaaaaaaaaaaaaacgacttaaaccgacccacaaaaaaaaaaacgcgcgcgacgaaataaactaaaccgataacccaaaaaaaaaaaaaaaaaaaaaaaaaaaaaaaaaaaaaaaaaaaaaaaaaaaaaaattccctaaaa

SEQ ID NO: 39365 - DNA, 515 bp, Artificial Sequence
  chemically treated genomic DNA (Homo sapiens) CpG-island No: 39365
  misc_feature (210)..(210): n is either a, c, g or t
ggttagcggttcgggagaggggggaaaagggcgtcggtacgcgaggtttatcggttagcgatttaagggggagggcggtttattcgcggatcgggattacgcgggtggtttatcgtcggtttacgggacgacggtttagatcgttttcggggtcgatcggacgggcgacgacgattcggttcggtttggtttaaggtcggtttatcggtngagcgaatgacgacggcgcgcgtcgaacgcgttgtcggcgacggtattcggcggcggaggcgacggcgtaaaggcgacgcgaaggcggttgtattaagcggcggttaggaaggagagggaggggaatggatgggagaggaaattttatcgaggatggtcggcgcggaggaaaacgacggcgaacggcgacggtaagttatgggaggacgacggtaatcggcggacgggtttcggggtgttttaaggaaggaagagagagagattagagagagggagatgaattacggcgatcggtatttatgggt

SEQ ID NO: 39366 - DNA, 515 bp, Artificial Sequence
  chemically treated genomic DNA (Homo sapiens) CpG-island No: 39366
  misc_feature (306)..(306): n is either a, c, g or t
acccataaataccgatcgccgtaattcatctccctctctctaatctctctctcttccttccttaaaacaccccgaaacccgtccgccgattaccgtcgtcctcccataacttaccgtcgccgttcgccgtcgttttcctccgcgccgaccatcctcgataaaatttcctctcccatccattcccctccctctccttcctaaccgccgcttaatacaaccgccttcgcgtcgcctttacgccgtcgcctccgccgccgaataccgtcgccgacaacgcgttcgacgcgcgccgtcgtcattcgctcnaccgataaaccgaccttaaaccaaaccgaaccgaatcgtcgtcgcccgtccgatcgaccccgaaaacgatctaaaccgtcgtcccgtaaaccgacgataaaccacccgcgtaatcccgatccgcgaataaaccgccctcccccttaaatcgctaaccgataaacctcgcgtaccgacgcccttttcccccctctcccgaaccgctaacc

SEQ ID NO: 39367 - DNA, 515 bp, Artificial Sequence
  chemically treated genomic DNA (Homo sapiens) CpG-island No: 39367
  misc_feature (306)..(306): n is either a, c, g or t
gtttatgaatgtcggtcgtcgtggtttatttttttttttttaattttttttttttttttttttaggatatttcgaaattcgttcgtcggttgtcgtcgtttttttatggtttgtcgtcgtcgttcgtcgtcgttttttttcgcgtcggttattttcggtgaggtttttttttttatttattttttttttttttttttttagtcgtcgtttagtgtagtcgttttcgcgtcgtttttgcgtcgtcgttttcgtcgtcggatgtcgtcgtcggtaacgcgttcggcgcgcgtcgtcgttattcgtttnatcggtaggtcggttttgagttaagtcgagtcgggtcgtcgtcgttcgttcgatcgatttcgagggcgatttgggtcgtcgtttcgtggatcggcggtggattattcgcgtggtttcggttcgcgggtgaatcgtttttttttttgagtcgttgatcggtgggtttcgcgtgtcggcgttttttttttttttttttcgagtcgttgatt

SEQ ID NO: 39368 - DNA, 515 bp, Artificial Sequence
  chemically treated genomic DNA (Homo sapiens) CpG-island No: 39368
  misc_feature (210)..(210): n is either a, c, g or t
aatcaacgactcgaaaaaaaaaaaaaaaaaacgccgacacgcgaaacccaccgatcaacgactcaaaaaaaaaaacgattcacccgcgaaccgaaaccacgcgaataatccaccgccgatccacgaaacgacgacccaaatcgccctcgaaatcgatcgaacgaacgacgacgacccgactcgacttaactcaaaaccgacctaccgatnaaacgaataacgacgacgcgcgccgaacgcgttaccgacgacgacatccgacgacgaaaacgacgacgcaaaaacgacgcgaaaacgactacactaaacgacgactaaaaaaaaaaaaaaaaaaaataaataaaaaaaaaaacctcaccgaaaataaccgacgcgaaaaaaaacgacgacgaacgacgacgacaaaccataaaaaaacgacgacaaccgacgaacgaatttcgaaatatcctaaaaaaaaaaaaaaaaaaaattaaaaaaaaaaaaataaaccacgacgaccgacattcataaac

SEQ ID NO: 39369 - DNA, 1192 bp, Artificial Sequence
  chemically treated genomic DNA (Homo sapiens) CpG-island No: 39369
acgcgttagtttttcggtttacggtggatcgggagtacgtagttggcggcggtcggcgtcgtgggttttacgcgttagtcgtattcgcgggcgcgggcggttgacggtcgggttttatatggtagtcgcgagggcgcgttcgaaggcggtttcgtcggtacggtcgacgggaggcggtacgatcgcgtttcgatggttatcgtcggcgattatcggcgcggcggagcggcgttcgagagagcggagaggagagggaagcgaaagggacggtttacggtttatttcgggataacgacgacgacgagaacggcggtcggagcggaggaaacgcggcggcgcggttcgggatgacgatgacgacggtgtttcggcggtcggcgagcgaaacggaggcgcgggcgaggtcggcggtaatacggcgaagtcgagggaggtgtcgtcgagtcgggaggaagatcggagcgacgacggcggcgaatcggagcggaggaaggcgacggcgcggttcgggatgtcgagggcgacggtgtttcggtagtcggcggacgaagcggagcggcggacggggtcggcggtaatacggcgaagcggatggaggtgtcgtcgagtcgggcggaggatcggagcgacgtcggcggcgaatcgaaggtcggcggcgacggcggagagagaggagtacggcgcgagtacggattcgacggcgagagcgagcggcgagcggtggaaacggaagagcggagttcggggagtaattatatagtatcgagagggggagaacgcggtcggagaggaaggaaacgggcgcggggatttcgggttttatagatgtcgtcggcgaggattacgggatgaattcggacggattcgagggagagagagaggggaaatcgggggaaacgggggagggaaacgcggggaataatttttttttttttaaggcgcgcggggaaggcgggatgcggcgagattcgcggcggcggcggcgttagggtacgggcgagcggcgggagcggcgggaggaaggcgatgataggtgggttttattcgttagcgagggtggcgggcgggttcgtttgttagcggcgcgcgtgcgaggaggaggtcgatgggtcgtgggggaagagagagagagggagggattgggtcgagtcggtttaagaggggaaggggggggaaaagaattttttttaag

SEQ ID NO: 39370 - DNA, 1192 bp, Artificial Sequence
  chemically treated genomic DNA (Homo sapiens) CpG-island No: 39370
cttaaaaaaaattcttttccccccccttcccctcttaaaccgactcgacccaatccctccctctctctctcttcccccacgacccatcgacctcctcctcgcacgcgcgccgctaacaaacgaacccgcccgccaccctcgctaacgaataaaacccacctatcatcgccttcctcccgccgctcccgccgctcgcccgtaccctaacgccgccgccgccgcgaatctcgccgcatcccgccttccccgcgcgccttaaaaaaaaaaaaattattccccgcgtttccctcccccgtttcccccgatttcccctctctctctccctcgaatccgtccgaattcatcccgtaatcctcgccgacgacatctataaaacccgaaatccccgcgcccgtttccttcctctccgaccgcgttctccccctctcgatactatataattactccccgaactccgctcttccgtttccaccgctcgccgctcgctctcgccgtcgaatccgtactcgcgccgtactcctctctctccgccgtcgccgccgaccttcgattcgccgccgacgtcgctccgatcctccgcccgactcgacgacacctccatccgcttcgccgtattaccgccgaccccgtccgccgctccgcttcgtccgccgactaccgaaacaccgtcgccctcgacatcccgaaccgcgccgtcgccttcctccgctccgattcgccgccgtcgtcgctccgatcttcctcccgactcgacgacacctccctcgacttcgccgtattaccgccgacctcgcccgcgcctccgtttcgctcgccgaccgccgaaacaccgtcgtcatcgtcatcccgaaccgcgccgccgcgtttcctccgctccgaccgccgttctcgtcgtcgtcgttatcccgaaataaaccgtaaaccgtccctttcgcttccctctcctctccgctctctcgaacgccgctccgccgcgccgataatcgccgacgataaccatcgaaacgcgatcgtaccgcctcccgtcgaccgtaccgacgaaaccgccttcgaacgcgccctcgcgactaccatataaaacccgaccgtcaaccgcccgcgcccgcgaatacgactaacgcgtaaaacccacgacgccgaccgccgccaactacgtactcccgatccaccgtaaaccgaaaaactaacgcgt

SEQ ID NO: 39371 - DNA, 1192 bp, Artificial Sequence
  chemically treated genomic DNA (Homo sapiens) CpG-island No: 39371
tttaaaagaagtttttttttttttttttttttttttgggtcggttcggtttagtttttttttttttttttttttttttacggtttatcggtttttttttcgtacgcgcgtcgttgataggcgggttcgttcgttattttcgttgacgggtggggtttatttgttatcgtttttttttcgtcgttttcgtcgttcgttcgtgttttagcgtcgtcgtcgtcgcgaatttcgtcgtatttcgtttttttcgcgcgttttaaagagggggaaattatttttcgcgtttttttttttcgtttttttcgattttttttttttttttttttcggattcgttcggatttatttcgtaattttcgtcggcgatatttatggagttcgagattttcgcgttcgtttttttttttttcggtcgcgttttttttttttcggtgttatataattgtttttcgagtttcgttttttcgtttttatcgttcgtcgttcgttttcgtcgtcggattcgtgttcgcgtcgtgttttttttttttcgtcgtcgtcgtcgattttcggttcgtcgtcgacgtcgtttcggtttttcgttcgattcggcgatatttttattcgtttcgtcgtgttgtcgtcgatttcgttcgtcgtttcgtttcgttcgtcggttgtcggagtatcgtcgttttcggtatttcgaatcgcgtcgtcgttttttttcgtttcggttcgtcgtcgtcgtcgtttcggtttttttttcgattcggcgatatttttttcggtttcgtcgtgttgtcgtcgatttcgttcgcgttttcgtttcgttcgtcgatcgtcggagtatcgtcgttatcgttatttcgaatcgcgtcgtcgcgtttttttcgtttcggtcgtcgttttcgtcgtcgtcgttgtttcggggtgagtcgtggatcgtttttttcgtttttttttttttttcgttttttcgggcgtcgtttcgtcgcgtcgatggtcgtcggcggtgattatcggggcgcggtcgtgtcgtttttcgtcggtcgtgtcggcgaggtcgttttcgggcgcgttttcgcggttgttatgtggggttcggtcgttagtcgttcgcgttcgcgggtgcggttgacgcgtgggatttacggcgtcgatcgtcgttagttgcgtgttttcggtttatcgtggatcgagaggttgacgcgt

SEQ ID NO: 39372 - DNA, 1192 bp, Artificial Sequence
  chemically treated genomic DNA (Homo sapiens) CpG-island No: 39372
acgcgtcaacctctcgatccacgataaaccgaaaacacgcaactaacgacgatcgacgccgtaaatcccacgcgtcaaccgcacccgcgaacgcgaacgactaacgaccgaaccccacataacaaccgcgaaaacgcgcccgaaaacgacctcgccgacacgaccgacgaaaaacgacacgaccgcgccccgataatcaccgccgacgaccatcgacgcgacgaaacgacgcccgaaaaaacgaaaaaaaaaaaaaaacgaaaaaaacgatccacgactcaccccgaaacaacgacgacgacgaaaacgacgaccgaaacgaaaaaaacgcgacgacgcgattcgaaataacgataacgacgatactccgacgatcgacgaacgaaacgaaaacgcgaacgaaatcgacgacaacacgacgaaaccgaaaaaaatatcgccgaatcgaaaaaaaaaccgaaacgacgacgacgacgaaccgaaacgaaaaaaaacgacgacgcgattcgaaataccgaaaacgacgatactccgacaaccgacgaacgaaacgaaacgacgaacgaaatcgacgacaacacgacgaaacgaataaaaatatcgccgaatcgaacgaaaaaccgaaacgacgtcgacgacgaaccgaaaatcgacgacgacgacgaaaaaaaaaaaacacgacgcgaacacgaatccgacgacgaaaacgaacgacgaacgataaaaacgaaaaaacgaaactcgaaaaacaattatataacaccgaaaaaaaaaaaacgcgaccgaaaaaaaaaaaaacgaacgcgaaaatctcgaactccataaatatcgccgacgaaaattacgaaataaatccgaacgaatccgaaaaaaaaaaaaaaaaaaaatcgaaaaaaacgaaaaaaaaaaacgcgaaaaataatttccccctctttaaaacgcgcgaaaaaaacgaaatacgacgaaattcgcgacgacgacgacgctaaaacacgaacgaacgacgaaaacgacgaaaaaaaaacgataacaaataaaccccacccgtcaacgaaaataacgaacgaacccgcctatcaacgacgcgcgtacgaaaaaaaaaccgataaaccgtaaaaaaaaaaaaaaaaaaaaaaaaactaaaccgaaccgacccaaaaaaaaaaaaaaaaaaaaaaaaacttcttttaaa

SEQ ID NO: 39373 - DNA, 1213 bp, Artificial Sequence
  chemically treated genomic DNA (Homo sapiens) CpG-island No: 39373
cgtcgttgttcgtttaggttttaaaggagagtcgagattgagtttttattcggtaaaatttttagaggtgatgggacgttacgataatatttttaagagggaatgtaacgttcgaaagcgatgttgttgttggtttaattaagattaggttgggtttttatttatcgttcgttatttgtttatttattaatgtcgtcgtaatgtttcgttacgatcgaaatttttattagtttatgggtattgaatcggtattaattattggttagttttatcggtttttttgtcgttagttttttgtagttatagcgtcggcgtttcgtattaacggtcgggacgatttttgtcgtcgttcgtatcgaaagttttcggtattattcgtatcgtcgtcgtcgtcggttatgttattacgtcgtttttttttttatgtatcgtaacggtttgttatcgttattagtcgtgtttttaaggtatttacgtttttatgttattagcgttgtgttttttgtaatcgatgacgttattatgtcgatttttcgttgttattacgtgttttttgtataagtagtttagttcgtcgttagttttttttttttatatttattttcggttgttggtattgttcgcgtgttagtacgtgcgttcgtcgtttttgtcgttagtcgttagatttggttaagggggtttaaatttggcggtgtttattacggtcgtcgttgtttcgtcgttatcgttgttgtaattttgtcgtcggtcgtttttttttcgtttgtttttatcggtgtttcgcgtttacggatgcggtgaaagtttattatcgtcgtcgttttaattttcgtttttatttttggttttcgttatttatcgtgtatcgggttgtttgtattatttttttttatgcgtttttcgtttatagtatttttattcgtgcgtcggtttcgatattagcgtcgttttggtcggttttcgtttttgtgtttgtcgcgagtttcgtcgtcgtcgttttcgtgagtcgtcgttttgttagtcgtttatttaggtggtagcgaggtagaggaagggggcgaagatgggtggcggcggtggttagggttttattgttcgagtcgtttaacgcgggggtcgacgcgggggttcgatcgtgtggatgtaatagttaattaatttttaagtttggttagtttttaagttttgagatgagatgtgatggtcggtt

SEQ ID NO: 39374 - DNA, 1213 bp, Artificial Sequence
  chemically treated genomic DNA (Homo sapiens) CpG-island No: 39374
aaccgaccatcacatctcatctcaaaacttaaaaactaaccaaacttaaaaattaattaactattacatccacacgatcgaacccccgcgtcgacccccgcgttaaacgactcgaacaataaaaccctaaccaccgccgccacccatcttcgcccccttcctctacctcgctaccacctaaataaacgactaacaaaacgacgactcacgaaaacgacgacgacgaaactcgcgacaaacacaaaaacgaaaaccgaccaaaacgacgctaatatcgaaaccgacgcacgaataaaaatactataaacgaaaaacgcataaaaaaaaataatacaaacaacccgatacacgataaataacgaaaaccaaaaataaaaacgaaaattaaaacgacgacgataataaactttcaccgcatccgtaaacgcgaaacaccgataaaaacaaacgaaaaaaaaacgaccgacgacaaaattacaacaacgataacgacgaaacaacgacgaccgtaataaacaccgccaaatttaaacccccttaaccaaatctaacgactaacgacaaaaacgacgaacgcacgtactaacacgcgaacaataccaacaaccgaaaataaatataaaaaaaaaaaactaacgacgaactaaactacttatacaaaaaacacgtaataacaacgaaaaatcgacataataacgtcatcgattacaaaaaacacaacgctaataacataaaaacgtaaataccttaaaaacacgactaataacgataacaaaccgttacgatacataaaaaaaaaaacgacgtaataacataaccgacgacgacgacgatacgaataataccgaaaactttcgatacgaacgacgacaaaaatcgtcccgaccgttaatacgaaacgccgacgctataactacaaaaaactaacgacaaaaaaaccgataaaactaaccaataattaataccgattcaatacccataaactaataaaaatttcgatcgtaacgaaacattacgacgacattaataaataaacaaataacgaacgataaataaaaacccaacctaatcttaattaaaccaacaacaacatcgctttcgaacgttacattccctcttaaaaatattatcgtaacgtcccatcacctctaaaaattttaccgaataaaaactcaatctcgactctcctttaaaacctaaacgaacaacgacg

SEQ ID NO: 39375 - DNA, 1213 bp, Artificial Sequence
  chemically treated genomic DNA (Homo sapiens) CpG-island No: 39375
aatcggttattatattttattttaagatttgagaattaattagatttgagaattaattaattgttgtatttatacgatcgggttttcgcgtcggttttcgcgttgggcgattcgggtagtggaattttagttatcgtcgttatttattttcgttttttttttttgtttcgttgttatttgagtgagcggttggtaaagcggcggtttacgagaacggcggcggcggggttcgcggtaggtataaaggcggaggtcggttagagcggcgttgatgtcgaggtcggcgtacgggtggaggtgttgtggacggagagcgtatgggagaaggtggtgtagatagttcgatgtacggtggatgacgggggttagagatggaggcggggattggggcggcggcggtggtgggtttttatcgtattcgtgagcgcgaagtatcggtggaggtaggcgaggagaaggcggtcggcggtagggttgtagtagcggtggcggcgaggtagcggcggtcgtggtgggtatcgttagatttggatttttttggttagatttggcggttgacggtagggacggcgggcgtacgtgttggtacgcgagtaatgttagtagtcggaggtggatgtggggagaggaaattggcgacgggttgggttgtttgtgtagagggtacgtgatggtaacgggaggtcggtatggtgacgttatcggttgtaaggagtatagcgttggtggtatggaggcgtggatgttttggaggtacggttggtgacggtgataggtcgttgcggtgtatggaggagaggacggcgtggtgatatggtcggcgacggcggcggtgcgggtagtgtcgagagttttcggtacgagcgacggtagaagtcgtttcgatcgttggtgcggagcgtcgacgttgtgattatagggagttggcggtagggaggtcggtgaagttggttagtggttggtgtcggtttagtgtttatgagttgatggaggtttcgatcgtggcggagtattgcggcgatattggtggatagataggtggcggacgatgggtgaaaatttagtttggttttggttgggttagtaataatatcgttttcgagcgttgtatttttttttgagggtgttgtcgtgacgttttattatttttaggggttttgtcgggtaaaaatttagtttcggtttttttttgaggtttggacggataacggcg

SEQ ID NO: 39376 - DNA, 1213 bp, Artificial Sequence
  chemically treated genomic DNA (Homo sapiens) CpG-island No: 39376
cgccgttatccgtccaaacctcaaaaaaaaaccgaaactaaatttttacccgacaaaacccctaaaaataataaaacgtcacgacaacaccctcaaaaaaaaatacaacgctcgaaaacgatattattactaacccaaccaaaaccaaactaaattttcacccatcgtccgccacctatctatccaccaatatcgccgcaatactccgccacgatcgaaacctccatcaactcataaacactaaaccgacaccaaccactaaccaacttcaccgacctccctaccgccaactccctataatcacaacgtcgacgctccgcaccaacgatcgaaacgacttctaccgtcgctcgtaccgaaaactctcgacactacccgcaccgccgccgtcgccgaccatatcaccacgccgtcctctcctccatacaccgcaacgacctatcaccgtcaccaaccgtacctccaaaacatccacgcctccataccaccaacgctatactccttacaaccgataacgtcaccataccgacctcccgttaccatcacgtaccctctacacaaacaacccaacccgtcgccaatttcctctccccacatccacctccgactactaacattactcgcgtaccaacacgtacgcccgccgtccctaccgtcaaccgccaaatctaaccaaaaaaatccaaatctaacgatacccaccacgaccgccgctacctcgccgccaccgctactacaaccctaccgccgaccgccttctcctcgcctacctccaccgatacttcgcgctcacgaatacgataaaaacccaccaccgccgccgccccaatccccgcctccatctctaacccccgtcatccaccgtacatcgaactatctacaccaccttctcccatacgctctccgtccacaacacctccacccgtacgccgacctcgacatcaacgccgctctaaccgacctccgcctttatacctaccgcgaaccccgccgccgccgttctcgtaaaccgccgctttaccaaccgctcactcaaataacaacgaaacaaaaaaaaaaaacgaaaataaataacgacgataactaaaattccactacccgaatcgcccaacgcgaaaaccgacgcgaaaacccgatcgtataaatacaacaattaattaattctcaaatctaattaattctcaaatcttaaaataaaatataataaccgatt

SEQ ID NO: 39377 - DNA, 850 bp, Artificial Sequence
  chemically treated genomic DNA (Homo sapiens) CpG-island No: 39377
cgtcgcgatattattttttgtcgttttttttttttttacgttcgtttaagcggttcgatggaaattacgcggtcgtaaggacgacggcggcgcggggttttttttttcgaggtcgcgacgtttggagtcgataatttcgatttagttttaaggcgacgataattatagtagtgacgtggtgaggaggcggagttaatgacgattgaaggcggtagcggcggtgcggattcggcgtttttttggtgtggatttagcgtgggtgtcgtttcgagcgttggcggtggtgaagtacgtggaggcggtagggtgttcgagtttcgatttttaggcgataaggcggtaaggtgcggtcgtgtggtgttggtggtagtatggtcgtatggaggcggaagcggtggcgcggtcgtgtggaggtagaggttcgattatatggaggtggtcgtacggtcgtgcgaaggtggaggcggtgaagtaatttggttgatgttacgttggtaggaggaggagtaacggttggttggaggtagttcgcgtatagtggagcgattggcgatagtagaggtcggtgaggcgcggttggtggcggaggaggtggtcgcggtgcgtggaggcgtaattaaattgtaagtgcggcgcgatgtggtttgtaggcgtggaggcggtggtcggcgtagcgggaagagagaggtttttgttggtggtcgatggtttagtgaggcgtaattggtggaagcgcgcggatattagtcggcggggggcgtcggtgtaatggtgtttatatattagcggaggtttagatggcggtggagaaatggtgtttttgtgatagatcggtaggtgaaaatttagt

SEQ ID NO: 39378 - DNA, 850 bp, Artificial Sequence
  chemically treated genomic DNA (Homo sapiens) CpG-island No: 39378
actaaattttcacctaccgatctatcacaaaaacaccatttctccaccgccatctaaacctccgctaatatataaacaccattacaccgacgccccccgccgactaatatccgcgcgcttccaccaattacgcctcactaaaccatcgaccaccaacaaaaacctctctcttcccgctacgccgaccaccgcctccacgcctacaaaccacatcgcgccgcacttacaatttaattacgcctccacgcaccgcgaccacctcctccgccaccaaccgcgcctcaccgacctctactatcgccaatcgctccactatacgcgaactacctccaaccaaccgttactcctcctcctaccaacgtaacatcaaccaaattacttcaccgcctccaccttcgcacgaccgtacgaccacctccatataatcgaacctctacctccacacgaccgcgccaccgcttccgcctccatacgaccatactaccaccaacaccacacgaccgcaccttaccgccttatcgcctaaaaatcgaaactcgaacaccctaccgcctccacgtacttcaccaccgccaacgctcgaaacgacacccacgctaaatccacaccaaaaaaacgccgaatccgcaccgccgctaccgccttcaatcgtcattaactccgcctcctcaccacgtcactactataattatcgtcgccttaaaactaaatcgaaattatcgactccaaacgtcgcgacctcgaaaaaaaaaaccccgcgccgccgtcgtccttacgaccgcgtaatttccatcgaaccgcttaaacgaacgtaaaaaaaaaaaaaacgacaaaaaataatatcgcgacg

SEQ ID NO: 39379 - DNA, 850 bp, Artificial Sequence
  chemically treated genomic DNA (Homo sapiens) CpG-island No: 39379
gttgggtttttatttgtcgatttattatagaagtattatttttttatcgttatttaaattttcgttggtgtgtgggtattattgtatcggcgtttttcgtcggttagtgttcgcgcgtttttattagttgcgttttattaggttatcggttattagtagaggttttttttttttcgttgcgtcggttatcgtttttacgtttgtaagttatatcgcgtcgtatttgtaatttggttgcgtttttacgtatcgcggttatttttttcgttattagtcgcgttttatcggtttttgttgtcgttagtcgttttattatgcgcgagttgtttttagttagtcgttgtttttttttttgttagcgtggtattagttagattgttttatcgtttttattttcgtacggtcgtgcgattatttttatatggtcgagtttttgtttttatacggtcgcgttatcgttttcgtttttatacgattatgttgttattagtattatacggtcgtattttgtcgttttgtcgtttgggggtcggagttcggatattttgtcgtttttacgtgttttattatcgttagcgttcgggacggtatttacgttagatttatattaggagagcgtcggattcgtatcgtcgttgtcgtttttagtcgttattggtttcgtttttttattacgttattgttgtggttgtcgtcgttttggaattaggtcggggttgtcggttttaagcgtcgcgatttcgggggagaaggtttcgcgtcgtcgtcgtttttgcggtcgcgtggtttttatcgggtcgtttgggcgagcgtaggaggaaggagggcggtaaggggtggtgtcgcggcg

SEQ ID NO: 39380 - DNA, 850 bp, Artificial Sequence
  chemically treated genomic DNA (Homo sapiens) CpG-island No: 39380
cgccgcgacaccaccccttaccgccctccttcctcctacgctcgcccaaacgacccgataaaaaccacgcgaccgcaaaaacgacgacgacgcgaaaccttctcccccgaaatcgcgacgcttaaaaccgacaaccccgacctaattccaaaacgacgacaaccacaacaataacgtaataaaaaaacgaaaccaataacgactaaaaacgacaacgacgatacgaatccgacgctctcctaatataaatctaacgtaaataccgtcccgaacgctaacgataataaaacacgtaaaaacgacaaaatatccgaactccgacccccaaacgacaaaacgacaaaatacgaccgtataatactaataacaacataatcgtataaaaacgaaaacgataacgcgaccgtataaaaacaaaaactcgaccatataaaaataatcgcacgaccgtacgaaaataaaaacgataaaacaatctaactaataccacgctaacaaaaaaaaaaacaacgactaactaaaaacaactcgcgcataataaaacgactaacgacaacaaaaaccgataaaacgcgactaataacgaaaaaaataaccgcgatacgtaaaaacgcaaccaaattacaaatacgacgcgatataacttacaaacgtaaaaacgataaccgacgcaacgaaaaaaaaaaaacctctactaataaccgataacctaataaaacgcaactaataaaaacgcgcgaacactaaccgacgaaaaacgccgatacaataatacccacacaccaacgaaaatttaaataacgataaaaaaataatacttctataataaatcgacaaataaaaacccaac

SEQ ID NO: 39381 - DNA, 571 bp, Artificial Sequence
  chemically treated genomic DNA (Homo sapiens) CpG-island No: 39381
gattagtgtaatgggttttattttcggtatcgacgatttcgtttttttattcgggtagacgtttcggttcggtagtttcgatttcgttattaataatttcggtaagattttttttttcgattcggaattagattagtcgggagagaatcggatttcggtttcgtttggattttcgaacgcggttgaaagttattttaagattatttcgatcgagtcggttttaaattattcggtcgagatcgtattttttttaacgatattagattaagatgatggggtttatttattagttttgatgaagtttttcgacgatttagcggtcgtttttattacgatagcgtttttatttcgtaggtttaggcggaagtcggttttaatatcgatttcgtttagttttagggaagtcggcgttattttttaattattcggtacggtttcgacggattagttggatgattataatagtttttttatcgtcgatttacgttttattgatattgtggagtacgacgaatttagttttcgttataacgatttcgacgatttcgacgatttcgacggaagtttagat

SEQ ID NO: 39382 - DNA, 571 bp, Artificial Sequence
  chemically treated genomic DNA (Homo sapiens) CpG-island No: 39382
atctaaacttccgtcgaaatcgtcgaaatcgtcgaaatcgttataacgaaaactaaattcgtcgtactccacaatatcaataaaacgtaaatcgacgataaaaaaactattataatcatccaactaatccgtcgaaaccgtaccgaataattaaaaaataacgccgacttccctaaaactaaacgaaatcgatattaaaaccgacttccgcctaaacctacgaaataaaaacgctatcgtaataaaaacgaccgctaaatcgtcgaaaaacttcatcaaaactaataaataaaccccatcatcttaatctaatatcgttaaaaaaaatacgatctcgaccgaataatttaaaaccgactcgatcgaaataatcttaaaataactttcaaccgcgttcgaaaatccaaacgaaaccgaaatccgattctctcccgactaatctaattccgaatcgaaaaaaaaaatcttaccgaaattattaataacgaaatcgaaactaccgaaccgaaacgtctacccgaataaaaaaacgaaatcgtcgataccgaaaataaaacccattacactaatc

SEQ ID NO: 39383 - DNA, 571 bp, Artificial Sequence
  chemically treated genomic DNA (Homo sapiens) CpG-island No: 39383
atttaggttttcgtcgaagtcgtcgaagtcgtcgaagtcgttgtagcgagaattaaattcgtcgtattttataatgttagtaggacgtgagtcgacggtgggagagttgttgtagttatttagttgattcgtcgaaatcgtgtcgagtggttggaggatgacgtcgatttttttgaagttaggcgaaatcggtgttgaagtcgattttcgtttaggtttacgggatgaagacgttgtcgtggtggagacggtcgttaaatcgtcggggagttttattaggattggtgggtaagttttattattttgatttggtgtcgttggagaagatgcgatttcggtcgagtggtttgaagtcgattcggtcgagatggttttgaagtagtttttagtcgcgttcgggaatttaaacgggatcgaaattcggttttttttcgattggtttgatttcgagtcgaggagagaaattttgtcgaagttgttggtgacgaagtcgaggttgtcgaatcgaaacgtttgttcgggtgggaagacgaggtcgtcgatgtcggagatggaatttattgtattgatt

SEQ ID NO: 39384 - DNA, 571 bp, Artificial Sequence
  chemically treated genomic DNA (Homo sapiens) CpG-island No: 39384
aatcaatacaataaattccatctccgacatcgacgacctcgtcttcccacccgaacaaacgtttcgattcgacaacctcgacttcgtcaccaacaacttcgacaaaatttctctcctcgactcgaaatcaaaccaatcgaaaaaaaaccgaatttcgatcccgtttaaattcccgaacgcgactaaaaactacttcaaaaccatctcgaccgaatcgacttcaaaccactcgaccgaaatcgcatcttctccaacgacaccaaatcaaaataataaaacttacccaccaatcctaataaaactccccgacgatttaacgaccgtctccaccacgacaacgtcttcatcccgtaaacctaaacgaaaatcgacttcaacaccgatttcgcctaacttcaaaaaaatcgacgtcatcctccaaccactcgacacgatttcgacgaatcaactaaataactacaacaactctcccaccgtcgactcacgtcctactaacattataaaatacgacgaatttaattctcgctacaacgacttcgacgacttcgacgacttcgacgaaaacctaaat

SEQ ID NO: 39385 - DNA, 1003 bp, Artificial Sequence
  chemically treated genomic DNA (Homo sapiens) CpG-island No: 39385
cggaggagtaacgttaagttcgggagatcgaagaacgtcgtcgattagaggaggagtattaagtataagaataagaacggttacggcgtgagtagtaggatcgtgagcggatcgcgaaggaggttgaggatcgacgttagcgagttttggaagtagggcgtcgagcgcgtgattttatcggttagtaagatgtcgaagggatatcggtttttcgtattttttaatagaatgcggttgtcgcgattatttttttcgatattttttttaattaaaacgagtttaattaattcgattacgtcgttaatattttgaattagacgaagattatgattgcggtttcggttttagttaatttcgaaagcgtttatacgtcgattggtagtcgagttttttattttcgattttatgattatcgttatttaagttttagtattatcggcgtaggatttaatcgtaggagtaggggttacgacgagcggtttgtttatttatttttcgatttttatagggagcgtcgagtggaacggtttcgtttattatttcgtcgtcgttttatcgattttcgcgatataattatatagcgtcgagtagttcgaggttattattattcgtcggatagttacgacgacgattttgacggagtagtagtttttatcgacgatttgcgtcgagtggattggttagtcggttttaagtcgattggaatagagaagtacgacggtattattaatttcgaatcgtggtttatcgtttacggtttcgcgattcgcgtagtaggaggagatagtaaggttatggcgaattatttattagtggttttagcggatttcgttcgattttggttttatggattgtttcgtggtataattggattttgggtcgaattacgcgattattttatcgttaatttttaaggtattttcgagcgtttcggtatataatatgatttttataacgttatttagaagttcggagaattttttcgagattatattcggcgatt

SEQ ID NO: 39386 - DNA, 1003 bp, Artificial Sequence
  chemically treated genomic DNA (Homo sapiens) CpG-island No: 39386
aatcgccgaatataatctcgaaaaaattctccgaacttctaaataacgttataaaaatcatattatataccgaaacgctcgaaaataccttaaaaattaacgataaaataatcgcgtaattcgacccaaaatccaattataccacgaaacaatccataaaaccaaaatcgaacgaaatccgctaaaaccactaataaataattcgccataaccttactatctcctcctactacgcgaatcgcgaaaccgtaaacgataaaccacgattcgaaattaataataccgtcgtacttctctattccaatcgacttaaaaccgactaaccaatccactcgacgcaaatcgtcgataaaaactactactccgtcaaaatcgtcgtcgtaactatccgacgaataataataacctcgaactactcgacgctatataattatatcgcgaaaatcgataaaacgacgacgaaataataaacgaaaccgttccactcgacgctccctataaaaatcgaaaaataaataaacaaaccgctcgtcgtaacccctactcctacgattaaatcctacgccgataatactaaaacttaaataacgataatcataaaatcgaaaataaaaaactcgactaccaatcgacgtataaacgctttcgaaattaactaaaaccgaaaccgcaatcataatcttcgtctaattcaaaatattaacgacgtaatcgaattaattaaactcgttttaattaaaaaaaatatcgaaaaaaataatcgcgacaaccgcattctattaaaaaatacgaaaaaccgatatcccttcgacatcttactaaccgataaaatcacgcgctcgacgccctacttccaaaactcgctaacgtcgatcctcaacctccttcgcgatccgctcacgatcctactactcacgccgtaaccgttcttattcttatacttaatactcctcctctaatcgacgacgttcttcgatctcccgaacttaacgttactcctccg

SEQ ID NO: 39387 - DNA, 1003 bp, Artificial Sequence
  chemically treated genomic DNA (Homo sapiens) CpG-island No: 39387
aatcgtcggatgtaatttcgaagggatttttcggatttttgaatgacgttgtagagattatattgtgtgtcgggacgttcgaaggtgttttggaagttggcgatgaagtggtcgcgtagttcggtttaagatttaattgtattacggggtaatttatggagttaagatcgggcggaattcgttaaagttattggtaaatagttcgttatggttttgttgtttttttttgttgcgcggatcgcgagatcgtagacggtaagttacgattcggggttagtggtgtcgtcgtatttttttattttagtcggtttgaagtcggttggttaatttattcgacgtaggtcgtcggtgaaggttgttatttcgttaaggtcgtcgtcgtggttgttcggcgagtgatggtagtttcgagttgttcggcgttgtatgattgtgtcgcgaagatcgatggggcggcgacgaggtggtgagcgaggtcgttttattcggcgttttttatgaaggtcgggaggtgagtgaatagatcgttcgtcgtgatttttgtttttgcggttggattttgcgtcggtgatgttgaggtttggatgacggtagttatgagatcggaagtggggaattcggttgttagtcggcgtgtggacgttttcggagttaattgggatcgaagtcgtaattatggttttcgtttggtttaagatgttgacgacgtggtcggattgattgagttcgttttggttgaggagggtgtcgagaagggtgatcgcggtaatcgtattttgttgaggggtgcggaaaatcggtgttttttcgatattttgttggtcgatgagattacgcgttcggcgttttgtttttaaagttcgttgacgtcgatttttagtttttttcgcggttcgtttacggttttgttgtttacgtcgtagtcgtttttgtttttgtgtttgatgttttttttttagtcggcgacgtttttcggtttttcgggtttggcgttgttttttcg

SEQ ID NO: 39388 - DNA, 1003 bp, Artificial Sequence
  chemically treated genomic DNA (Homo sapiens) CpG-island No: 39388
cgaaaaaacaacgccaaacccgaaaaaccgaaaaacgtcgccgactaaaaaaaaaacatcaaacacaaaaacaaaaacgactacgacgtaaacaacaaaaccgtaaacgaaccgcgaaaaaaactaaaaatcgacgtcaacgaactttaaaaacaaaacgccgaacgcgtaatctcatcgaccaacaaaatatcgaaaaaacaccgattttccgcacccctcaacaaaatacgattaccgcgatcacccttctcgacaccctcctcaaccaaaacgaactcaatcaatccgaccacgtcgtcaacatcttaaaccaaacgaaaaccataattacgacttcgatcccaattaactccgaaaacgtccacacgccgactaacaaccgaattccccacttccgatctcataactaccgtcatccaaacctcaacatcaccgacgcaaaatccaaccgcaaaaacaaaaatcacgacgaacgatctattcactcacctcccgaccttcataaaaaacgccgaataaaacgacctcgctcaccacctcgtcgccgccccatcgatcttcgcgacacaatcatacaacgccgaacaactcgaaactaccatcactcgccgaacaaccacgacgacgaccttaacgaaataacaaccttcaccgacgacctacgtcgaataaattaaccaaccgacttcaaaccgactaaaataaaaaaatacgacgacaccactaaccccgaatcgtaacttaccgtctacgatctcgcgatccgcgcaacaaaaaaaaacaacaaaaccataacgaactatttaccaataactttaacgaattccgcccgatcttaactccataaattaccccgtaatacaattaaatcttaaaccgaactacgcgaccacttcatcgccaacttccaaaacaccttcgaacgtcccgacacacaatataatctctacaacgtcattcaaaaatccgaaaaatcccttcgaaattacatccgacgatt

SEQ ID NO: 39389 - DNA, 758 bp, Artificial Sequence
  chemically treated genomic DNA (Homo sapiens) CpG-island No: 39389
cggcggagttcgtaatcgtataggtaaaaatattagttagtggcggtagaggtaagtcggtcggtgaagacgtagacgtttatgaacggtggtgtgattaattaatcgtataggcgaggatattagtcggcggtaatggaggtaagtcggtcggtgaagacgtagacgtttaataacggcggtataataggttagtcgtgtaggcggaaatattagtcggtggcggcgaaggtaagtcggtcggtgaagacgtagacgtttaataacggcggtataataggttagtcgtgtaggcggaaatattagtcggcggcgacggaggtaagtcggtcggtgaagacgtagacgtttaataacggcggtataataggttagtcgtgtaggcggaaatattagtcggtggcggcgaaggtaagtcggtcggtgaagatgacgatgtttattaacggtggtgtgattaatcgatcgtataggcggggatattagtcggcggcgacggaggtaggtcggtggtgaagtcgtagacgtttaatagcggcggtataataggttagtcgtgtaggcggaggtattagtcggcggcgacggaggtaggtcggcggtgaagtcgttgttgttattagtaatggcggtggcgaagataagtcggtagagtggattcgcggtcgatcgatcggaaagttgagacgtttcgagtttatgattagtattaatcgttttaatagtgtcgcgtaattatatgcgaataataataaaaa

SEQ ID NO: 39390 - DNA, 758 bp, Artificial Sequence
  chemically treated genomic DNA (Homo sapiens) CpG-island No: 39390
tttttattattattcgcatataattacgcgacactattaaaacgattaatactaatcataaactcgaaacgtctcaactttccgatcgatcgaccgcgaatccactctaccgacttatcttcgccaccgccattactaataacaacaacgacttcaccgccgacctacctccgtcgccgccgactaatacctccgcctacacgactaacctattataccgccgctattaaacgtctacgacttcaccaccgacctacctccgtcgccgccgactaatatccccgcctatacgatcgattaatcacaccaccgttaataaacatcgtcatcttcaccgaccgacttaccttcgccgccaccgactaatatttccgcctacacgactaacctattataccgccgttattaaacgtctacgtcttcaccgaccgacttacctccgtcgccgccgactaatatttccgcctacacgactaacctattataccgccgttattaaacgtctacgtcttcaccgaccgacttaccttcgccgccaccgactaatatttccgcctacacgactaacctattataccgccgttattaaacgtctacgtcttcaccgaccgacttacctccattaccgccgactaatatcctcgcctatacgattaattaatcacaccaccgttcataaacgtctacgtcttcaccgaccgacttacctctaccgccactaactaatatttttacctatacgattacgaactccgccg

SEQ ID NO: 39391 - DNA, 758 bp, Artificial Sequence
  chemically treated genomic DNA (Homo sapiens) CpG-island No: 39391
tttttgttgttgttcgtatataattacgcggtattattgaggcgattgatgttggttatggattcgaggcgttttagtttttcggtcgatcggtcgcgagtttattttgtcggtttgttttcgttatcgttattgttgataataataacgattttatcgtcggtttgttttcgtcgtcgtcgattggtgttttcgtttatacggttggtttattatgtcgtcgttgttgggcgtttacgattttattatcggtttgttttcgtcgtcgtcgattggtgttttcgtttatacggtcggttggttatattatcgttgatgggtatcgttatttttatcgatcggtttgttttcgtcgttatcgattggtgttttcgtttgtacggttggtttattatgtcgtcgttgttgggcgtttacgtttttatcgatcggtttgttttcgtcgtcgtcgattggtgttttcgtttgtacggttggtttattatgtcgtcgttgttgggcgtttacgtttttatcgatcggtttgttttcgtcgttatcgattggtgttttcgtttgtacggttggtttattatgtcgtcgttgttgggcgtttacgtttttatcgatcggtttgtttttattgtcgtcgattggtgttttcgtttatacggttggttggttatattatcgtttatgggcgtttacgtttttatcgatcggtttgtttttgtcgttattgattggtgtttttgtttatacggttgcggatttcgtcg

SEQ ID NO: 39392 - DNA, 758 bp, Artificial Sequence
  chemically treated genomic DNA (Homo sapiens) CpG-island No: 39392
cgacgaaatccgcaaccgtataaacaaaaacaccaatcaataacgacaaaaacaaaccgatcgataaaaacgtaaacgcccataaacgataatataaccaaccaaccgtataaacgaaaacaccaatcgacgacaataaaaacaaaccgatcgataaaaacgtaaacgcccaacaacgacgacataataaaccaaccgtacaaacgaaaacaccaatcgataacgacgaaaacaaaccgatcgataaaaacgtaaacgcccaacaacgacgacataataaaccaaccgtacaaacgaaaacaccaatcgacgacgacgaaaacaaaccgatcgataaaaacgtaaacgcccaacaacgacgacataataaaccaaccgtacaaacgaaaacaccaatcgataacgacgaaaacaaaccgatcgataaaaataacgatacccatcaacgataatataaccaaccgaccgtataaacgaaaacaccaatcgacgacgacgaaaacaaaccgataataaaatcgtaaacgcccaacaacgacgacataataaaccaaccgtataaacgaaaacaccaatcgacgacgacgaaaacaaaccgacgataaaatcgttattattatcaacaataacgataacgaaaacaaaccgacaaaataaactcgcgaccgatcgaccgaaaaactaaaacgcctcgaatccataaccaacatcaatcgcctcaataataccgcgtaattatatacgaacaacaacaaaaa

SEQ ID NO: 39393 - DNA, 590 bp, Artificial Sequence
  chemically treated genomic DNA (Homo sapiens) CpG-island No: 39393
gcgttagttgcgtggaggttgtaatcgtatcgtatatgaggggagttttttttgtttttttattttggattggaaaaagttgatggcgtatataagatcgtttttgagttatggtttcgtcgtttattttttaagtacgttttagggagagggagggtagcgtttaggttattacgttggcggtcgagtagtgagtaggcgatagcgatggatatggtggaggggaaggatgcggcggcgtgatggtgattttgattgtcgttttttttttagatttgacgaggtcgaggacggcgagggtaggacgaggatgtttttgggcgtgggatgcgggtttatggttggagtcgtgtgtttttggttttttgatttttgatattgacgataatggtgcggattaggtcggttagcggcgtagataatcgtagcgattagcgagtacggcgtacggttgatggttcgggttcgttattacgtagtttggatgcgtcgttcgtttttcggaggagtagtcggcgttgggggaggaataacgattatgagtagttagttataggattttacgaggtagcgggtaagtattttttttt

SEQ ID NO: 39394 - DNA, 590 bp, Artificial Sequence
  chemically treated genomic DNA (Homo sapiens) CpG-island No: 39394
aaaaaaaaatacttacccgctacctcgtaaaatcctataactaactactcataatcgttattcctcccccaacgccgactactcctccgaaaaacgaacgacgcatccaaactacgtaataacgaacccgaaccatcaaccgtacgccgtactcgctaatcgctacgattatctacgccgctaaccgacctaatccgcaccattatcgtcaatatcaaaaatcaaaaaaccaaaaacacacgactccaaccataaacccgcatcccacgcccaaaaacatcctcgtcctaccctcgccgtcctcgacctcgtcaaatctaaaaaaaaaacgacaatcaaaatcaccatcacgccgccgcatccttcccctccaccatatccatcgctatcgcctactcactactcgaccgccaacgtaataacctaaacgctaccctccctctccctaaaacgtacttaaaaaataaacgacgaaaccataactcaaaaacgatcttatatacgccatcaactttttccaatccaaaataaaaaaacaaaaaaaactcccctcatatacgatacgattacaacctccacgcaactaacgc

SEQ ID NO: 39395 - DNA, 590 bp, Artificial Sequence
  chemically treated genomic DNA (Homo sapiens) CpG-island No: 39395
aaggggaggtgtttgttcgttatttcgtggagttttgtggttagttgtttatggtcgttgttttttttttagcgtcgattattttttcgggaggcgggcgacgtatttaggttgcgtggtgacgagttcgggttattaatcgtgcgtcgtgttcgttgatcgttgcggttgtttgcgtcgttggtcgatttaattcgtattattatcgttagtgttaggggttaggagattaagagtatacggttttagttatggattcgtattttacgtttaagggtattttcgttttgttttcgtcgttttcggtttcgttagatttggggaggagacgataattaggattattattacgtcgtcgtattttttttttttattatgtttatcgttgtcgtttgtttattgttcgatcgttagcgtggtggtttaggcgttgttttttttttttttaaggcgtgtttaggaggtagacggcggagttatgatttaggaacgattttgtgtgcgttattagttttttttaatttaaagtaggaggataaagaagattttttttatgtacggtgcggttgtaatttttacgtagttgacgt

SEQ ID NO: 39396 - DNA, 590 bp, Artificial Sequence
  chemically treated genomic DNA (Homo sapiens) CpG-island No: 39396
acgtcaactacgtaaaaattacaaccgcaccgtacataaaaaaaatcttctttatcctcctactttaaattaaaaaaaactaataacgcacacaaaatcgttcctaaatcataactccgccgtctacctcctaaacacgccttaaaaaaaaaaaaaacaacgcctaaaccaccacgctaacgatcgaacaataaacaaacgacaacgataaacataataaaaaaaaaaaatacgacgacgtaataataatcctaattatcgtctcctccccaaatctaacgaaaccgaaaacgacgaaaacaaaacgaaaatacccttaaacgtaaaatacgaatccataactaaaaccgtatactcttaatctcctaacccctaacactaacgataataatacgaattaaatcgaccaacgacgcaaacaaccgcaacgatcaacgaacacgacgcacgattaataacccgaactcgtcaccacgcaacctaaatacgtcgcccgcctcccgaaaaaataatcgacgctaaaaaaaaaacaacgaccataaacaactaaccacaaaactccacgaaataacgaacaaacacctcccctt

SEQ ID NO: 39397 - DNA, 888 bp, Artificial Sequence
  chemically treated genomic DNA (Homo sapiens) CpG-island No: 39397
gtggacggcggtacgatgaatcgtggaggagttagatttcggcgacggtaatgtatttatgacgattttggagtagtattttttatcgcgacgtagttgacgaagaagaggcggatcggggaatatgttgttattacgaagtaatcgttttcgttgtcgttttattttgaatttggcgataattgagttttatagtgtagcgtagaggacggttgcgattaacgagtattgtgtatagaggatggttagggtcgtcgttttaaattcggttttagtgggatttagtttcggtgatttagtgtaggtaatttataacgtgatatattatgtatttcggtcgtttaaaataaatttaacggagatggtatttgggttcgtttgtaggtcgaaatatcgtcgttcgtcgtttatttagttatttcgcgttcgagatagcgttcgtttttaatttttttcgtacgtttgtatcgttgttgtgtttcgttcgcgttcggtcgtcgttcgagcgcgagttagttaggaggttcgttatcgttacgtttgttttaggtcgtcgtgttcgttacgattggggaggggttcgggcggttatcgcgcgaggttaattttttgttttgttttgtcgcgatttatggagaggtattaggtcgttaaggttttgttttgtcgtcgcgatcgggggcgcgtggaggcggtcggttattagcgtaacggcgcggtggtgtaggcgggcggtcgcgtagttcgagttcgacgcgtggaggaggggacgttatggaaaagtcgtttaggattaggatgtatatggaattatgaatttgatggggcggttaatgggcgggtgatcgttttaggcgatttttttgtgtatgaaatgagaatgttaga

SEQ ID NO: 39398 - DNA, 888 bp, Artificial Sequence
  chemically treated genomic DNA (Homo sapiens) CpG-island No: 39398
tctaacattctcatttcatacacaaaaaaatcgcctaaaacgatcacccgcccattaaccgccccatcaaattcataattccatatacatcctaatcctaaacgacttttccataacgtcccctcctccacgcgtcgaactcgaactacgcgaccgcccgcctacaccaccgcgccgttacgctaataaccgaccgcctccacgcgcccccgatcgcgacgacaaaacaaaaccttaacgacctaatacctctccataaatcgcgacaaaacaaaacaaaaaattaacctcgcgcgataaccgcccgaacccctccccaatcgtaacgaacacgacgacctaaaacaaacgtaacgataacgaacctcctaactaactcgcgctcgaacgacgaccgaacgcgaacgaaacacaacaacgatacaaacgtacgaaaaaaattaaaaacgaacgctatctcgaacgcgaaataactaaataaacgacgaacgacgatatttcgacctacaaacgaacccaaataccatctccgttaaatttattttaaacgaccgaaatacataatatatcacgttataaattacctacactaaatcaccgaaactaaatcccactaaaaccgaatttaaaacgacgaccctaaccatcctctatacacaatactcgttaatcgcaaccgtcctctacgctacactataaaactcaattatcgccaaattcaaaataaaacgacaacgaaaacgattacttcgtaataacaacatattccccgatccgcctcttcttcgtcaactacgtcgcgataaaaaatactactccaaaatcgtcataaatacattaccgtcgccgaaatctaactcctccacgattcatcgtaccgccgtccac

SEQ ID NO: 39399 - DNA, 888 bp, Artificial Sequence
  chemically treated genomic DNA (Homo sapiens) CpG-island No: 39399
tttggtatttttattttatgtataaagaggtcgtttggagcgattattcgtttattagtcgttttattagatttataattttatatatattttggttttgggcgatttttttatgacgtttttttttttacgcgtcgggttcgggttgcgcggtcgttcgtttgtattatcgcgtcgttacgttagtggtcggtcgtttttacgcgttttcggtcgcggcggtagggtagggttttggcggtttagtgtttttttatgggtcgcggtagggtagggtagggagttggtttcgcgcggtggtcgttcggatttttttttagtcgtggcgagtacgacggtttagggtaggcgtagcggtggcgagttttttagttggttcgcgttcgggcgacggtcggacgcgggcgaggtataatagcgatgtaagcgtgcgggaaagattgggggcgggcgttgtttcggacgcgggatggttggatgggcggcgggcggcgatatttcgatttataggcgggtttaagtgttattttcgttggatttattttggacggtcgagatgtatggtatgttacgttgtgaattgtttatattaagttatcgaagttgagttttattggagtcggatttggagcggcgattttggttattttttgtgtatagtgttcgttggtcgtagtcgttttttacgttgtattatagagtttagttgtcgttagatttagagtggagcgatagcgaggacgattgtttcgtggtggtaatatgtttttcgattcgtttttttttcgttaattacgtcgcgatggagggtgttgttttaaagtcgttatgaatgtattgtcgtcgtcggaatttggtttttttacggtttatcgtgtcgtcgtttat

SEQ ID NO: 39400 - DNA, 888 bp, Artificial Sequence
  chemically treated genomic DNA (Homo sapiens) CpG-island No: 39400
ataaacgacgacacgataaaccgtaaaaaaaccaaattccgacgacgacaatacattcataacgactttaaaacaacaccctccatcgcgacgtaattaacgaaaaaaaaacgaatcgaaaaacatattaccaccacgaaacaatcgtcctcgctatcgctccactctaaatctaacgacaactaaactctataatacaacgtaaaaaacgactacgaccaacgaacactatacacaaaaaataaccaaaatcgccgctccaaatccgactccaataaaactcaacttcgataacttaatataaacaattcacaacgtaacataccatacatctcgaccgtccaaaataaatccaacgaaaataacacttaaacccgcctataaatcgaaatatcgccgcccgccgcccatccaaccatcccgcgtccgaaacaacgcccgcccccaatctttcccgcacgcttacatcgctattatacctcgcccgcgtccgaccgtcgcccgaacgcgaaccaactaaaaaactcgccaccgctacgcctaccctaaaccgtcgtactcgccacgactaaaaaaaaatccgaacgaccaccgcgcgaaaccaactccctaccctaccctaccgcgacccataaaaaaacactaaaccgccaaaaccctaccctaccgccgcgaccgaaaacgcgtaaaaacgaccgaccactaacgtaacgacgcgataatacaaacgaacgaccgcgcaacccgaacccgacgcgtaaaaaaaaaaacgtcataaaaaaatcgcccaaaaccaaaatatatataaaattataaatctaataaaacgactaataaacgaataatcgctccaaacgacctctttatacataaaataaaaataccaaa

SEQ ID NO: 39401 - DNA, 583 bp, Artificial Sequence
  chemically treated genomic DNA (Homo sapiens) CpG-island No: 39401
gcgaaatgaacgagtcgagtacgggggtgttttttatgagttcgggaatgcgtgatcgacgtcggacgtggcggaatcggtcgtcgaagtgaggcgtcgacgtggggtggtggaggggttaatcggcgtcgattttcgtgcggagagtgcgggaaaacggcgtcgacgtggggtacgatcgcgtttattacgcgcggtagagggagtcgcgcgggagaggcggcgacgtgggaggatttggcggttatggcggcggttggggcgacgggaggtaagggatgaagatgataggtggggtttcgggttttatttgtcggggagagagagaggggaaaacgggcgagtgaggtaaagtagatttgagggagagagagagtcgagtgggtcgagggaggaggtcggtttaggaaggaggaggggaggaaaatcggggaacgtaaagaagattttcgtaaggcgcgggtcggtcgagagagggaggaggcgcgcggtttacgggagtggaggggaaggttttgttaagtttaaaagggaggaaggggaagattatttaaaattattttttgagtttcgaaaatttgcg

SEQ ID NO: 39402 - DNA, 583 bp, Artificial Sequence
  chemically treated genomic DNA (Homo sapiens) CpG-island No: 39402
cgcaaattttcgaaactcaaaaaataattttaaataatcttccccttcctcccttttaaacttaacaaaaccttcccctccactcccgtaaaccgcgcgcctcctccctctctcgaccgacccgcgccttacgaaaatcttctttacgttccccgattttcctcccctcctccttcctaaaccgacctcctccctcgacccactcgactctctctctccctcaaatctactttacctcactcgcccgttttcccctctctctctccccgacaaataaaacccgaaaccccacctatcatcttcatcccttacctcccgtcgccccaaccgccgccataaccgccaaatcctcccacgtcgccgcctctcccgcgcgactccctctaccgcgcgtaataaacgcgatcgtaccccacgtcgacgccgttttcccgcactctccgcacgaaaatcgacgccgattaacccctccaccaccccacgtcgacgcctcacttcgacgaccgattccgccacgtccgacgtcgatcacgcattcccgaactcataaaaaacacccccgtactcgactcgttcatttcgc

SEQ ID NO: 39403 - DNA, 583 bp, Artificial Sequence
  chemically treated genomic DNA (Homo sapiens) CpG-island No: 39403
cgtaaattttcggagtttaagaaataattttaaataattttttttttttttttttttgggtttggtaaggtttttttttttattttcgtgggtcgcgcgttttttttttttttcggtcggttcgcgttttgcgaaagttttttttacgtttttcggttttttttttttttttttttttaggtcggttttttttttcggtttattcggtttttttttttttttaagtttgttttattttattcgttcgttttttttttttttttttttcgataggtgggattcgaggttttatttgttatttttattttttatttttcgtcgttttaatcgtcgttatggtcgttaaatttttttacgtcgtcgtttttttcgcgcgattttttttatcgcgcgtggtggacgcggtcgtgttttacgtcggcgtcgttttttcgtatttttcgtacgaaaatcggcgtcggttaatttttttattattttacgtcggcgttttatttcgacggtcgatttcgttacgttcggcgtcgattacgtattttcgagtttataaaaagtattttcgtgttcgattcgtttatttcgt

SEQ ID NO: 39404 - DNA, 583 bp, Artificial Sequence
  chemically treated genomic DNA (Homo sapiens) CpG-island No: 39404
acgaaataaacgaatcgaacacgaaaatactttttataaactcgaaaatacgtaatcgacgccgaacgtaacgaaatcgaccgtcgaaataaaacgccgacgtaaaataataaaaaaattaaccgacgccgattttcgtacgaaaaatacgaaaaaacgacgccgacgtaaaacacgaccgcgtccaccacgcgcgataaaaaaaatcgcgcgaaaaaaacgacgacgtaaaaaaatttaacgaccataacgacgattaaaacgacgaaaaataaaaaataaaaataacaaataaaacctcgaatcccacctatcgaaaaaaaaaaaaaaaaaaaacgaacgaataaaataaaacaaacttaaaaaaaaaaaaaaaccgaataaaccgaaaaaaaaaaccgacctaaaaaaaaaaaaaaaaaaaaaaccgaaaaacgtaaaaaaaactttcgcaaaacgcgaaccgaccgaaaaaaaaaaaaaacgcgcgacccacgaaaataaaaaaaaaaaccttaccaaacccaaaaaaaaaaaaaaaaaaaattatttaaaattatttcttaaactccgaaaatttacg

SEQ ID NO: 39405 - DNA, 696 bp, Artificial Sequence
  chemically treated genomic DNA (Homo sapiens) CpG-island No: 39405
cgttgcgacgggttaggacggaaggtgagtaatagcgtatttttcgagttattaacgtcggaggttttttttttttggggaattacgggcgtaggttcggtacgaggggtttcgacgaagtaggtttacgttagggattgacgaataagttcgggtttggaggtgtttttgcgggcggtgattttttggttgcggtagacgcggcgacgtttggggcggttgttttttttttgggcgattttgagttgatgtagttgcgtttttaacgcgtcgaggttttttttgagttgtagatttttttgacgtagttttaggatttttaggttgttttttattatgttacggcgtattatttgatggaagtcgatacgagtcgcgtcgtacgtttttattatgcgtgttaggtgtacgacggtggcgttatttttcgagttggcgtttcggaaggtggcgtagtcgcgggttttttcgcgacgagggtggtagcggtagggcgagtgttgtaattcgttcgggtagcgttggtgaagggtgtcgatggcgaggagagcggcgttttggtaagcggcggggaaggaatttttattcgcggtgattgttagcgaagttcgttcgggagagtcggagaggattattgtagtgattttttaattagcgtgaggttttgtatttttatttttttgtttcgggagcggt

SEQ ID NO: 39406 - DNA, 696 bp, Artificial Sequence
  chemically treated genomic DNA (Homo sapiens) CpG-island No: 39406
accgctcccgaaacaaaaaaataaaaatacaaaacctcacgctaattaaaaaatcactacaataatcctctccgactctcccgaacgaacttcgctaacaatcaccgcgaataaaaattccttccccgccgcttaccaaaacgccgctctcctcgccatcgacacccttcaccaacgctacccgaacgaattacaacactcgccctaccgctaccaccctcgtcgcgaaaaaacccgcgactacgccaccttccgaaacgccaactcgaaaaataacgccaccgtcgtacacctaacacgcataataaaaacgtacgacgcgactcgtatcgacttccatcaaataatacgccgtaacataataaaaaacaacctaaaaatcctaaaactacgtcaaaaaaatctacaactcaaaaaaaacctcgacgcgttaaaaacgcaactacatcaactcaaaatcgcccaaaaaaaaaacaaccgccccaaacgtcgccgcgtctaccgcaaccaaaaaatcaccgcccgcaaaaacacctccaaacccgaacttattcgtcaatccctaacgtaaacctacttcgtcgaaacccctcgtaccgaacctacgcccgtaattccccaaaaaaaaaaaacctccgacgttaataactcgaaaaatacgctattactcaccttccgtcctaacccgtcgcaacg

SEQ ID NO: 39407 - DNA, 696 bp, Artificial Sequence
  chemically treated genomic DNA (Homo sapiens) CpG-island No: 39407
gtcgttttcggagtaggagggtgaggatgtagagttttacgttggttgggaggttattgtagtgatttttttcggttttttcgagcggatttcgttggtagttatcgcgggtggagatttttttttcgtcgtttgttagaacgtcgtttttttcgttatcggtattttttattagcgttattcggacgagttgtagtattcgttttatcgttattattttcgtcgcggaggagttcgcgattacgttatttttcgagacgttagttcggaggatgacgttatcgtcgtgtatttggtacgtatggtggaggcgtacgacgcggttcgtatcgatttttattagatggtgcgtcgtggtatggtggagaataatttgaagattttggagttgcgttaggagaatttgtagtttaagaaggatttcgacgcgttggaggcgtagttgtattagtttaagatcgtttagggagaggatagtcgttttaagcgtcgtcgcgtttgtcgtagttagaagattatcgttcgtaagagtatttttaggttcgagtttgttcgttagtttttggcgtggatttgtttcgtcgagatttttcgtgtcgagtttgcgttcgtggttttttaggagggggaagttttcggcgttggtagttcggagggtgcgttgttgtttatttttcgttttggttcgtcgtagcg

SEQ ID NO: 39408 - DNA, 696 bp, Artificial Sequence
  chemically treated genomic DNA (Homo sapiens) CpG-island No: 39408
cgctacgacgaaccaaaacgaaaaataaacaacaacgcaccctccgaactaccaacgccgaaaacttccccctcctaaaaaaccacgaacgcaaactcgacacgaaaaatctcgacgaaacaaatccacgccaaaaactaacgaacaaactcgaacctaaaaatactcttacgaacgataatcttctaactacgacaaacgcgacgacgcttaaaacgactatcctctccctaaacgatcttaaactaatacaactacgcctccaacgcgtcgaaatccttcttaaactacaaattctcctaacgcaactccaaaatcttcaaattattctccaccataccacgacgcaccatctaataaaaatcgatacgaaccgcgtcgtacgcctccaccatacgtaccaaatacacgacgataacgtcatcctccgaactaacgtctcgaaaaataacgtaatcgcgaactcctccgcgacgaaaataataacgataaaacgaatactacaactcgtccgaataacgctaataaaaaataccgataacgaaaaaaacgacgttctaacaaacgacgaaaaaaaaatctccacccgcgataactaccaacgaaatccgctcgaaaaaaccgaaaaaaatcactacaataacctcccaaccaacgtaaaactctacatcctcaccctcctactccgaaaacgac

SEQ ID NO: 39409 - DNA, 746 bp, Artificial Sequence
  chemically treated genomic DNA (Homo sapiens) CpG-island No: 39409
gttcgaagttggttggttgttcgtcgtcgggcgtttcgttggtttttagttttttgcgcgggtacgatgttaatttttagtaatcggttttttaaattcgggcgtcgagtacgtcgcgtataattattaggatttcgttttcgcgtttacggttgttttggcgcgtttgcggaagttgtgcgcgttttattttttttcggttaaggcgttcgacgattttcgagtagttcgggagggcgaggtcgcgtttatggtgaggaatttcgttcggtagtaggcggcgttagtggcgttggggtaggaagcgaacgtttgcgttacgaatacgttggttcgcgttattatcggttatcgggtgttcgtcgtcgacggcggggaaggcgtaagggagtttaaggagatggttgtggagttgatgtagttcgtcggcgtttttaacgtcggggatttcgtgtcggcgtttcggtggttcgattcgtagggcgtcgtggtaaagatgaagaggttgtatcgtcggtacgataatatgatgaacggatttattaacgaaaggaaggtcggggcgtagttcgacggggtcgtcgttggcgagtacggtaacgattttttaagcgtgttgttggcgaggatgtaggaggagtagaagttggacggcgacggcgaaaagattatcgaaattgatattaaagttttgtttttggtaagtttttgatgatcgtgtttttttagattatcgtaatattatt

SEQ ID NO: 39410 - DNA, 746 bp, Artificial Sequence
  chemically treated genomic DNA (Homo sapiens) CpG-island No: 39410
aataatattacgataatctaaaaaaacacgatcatcaaaaacttaccaaaaacaaaactttaatatcaatttcgataatcttttcgccgtcgccgtccaacttctactcctcctacatcctcgccaacaacacgcttaaaaaatcgttaccgtactcgccaacgacgaccccgtcgaactacgccccgaccttcctttcgttaataaatccgttcatcatattatcgtaccgacgatacaacctcttcatctttaccacgacgccctacgaatcgaaccaccgaaacgccgacacgaaatccccgacgttaaaaacgccgacgaactacatcaactccacaaccatctccttaaactcccttacgccttccccgccgtcgacgacgaacacccgataaccgataataacgcgaaccaacgtattcgtaacgcaaacgttcgcttcctaccccaacgccactaacgccgcctactaccgaacgaaattcctcaccataaacgcgacctcgccctcccgaactactcgaaaatcgtcgaacgccttaaccgaaaaaaaataaaacgcgcacaacttccgcaaacgcgccaaaacaaccgtaaacgcgaaaacgaaatcctaataattatacgcgacgtactcgacgcccgaatttaaaaaaccgattactaaaaattaacatcgtacccgcgcaaaaaactaaaaaccaacgaaacgcccgacgacgaacaaccaaccaacttcgaac

SEQ ID NO: 39411 - DNA, 746 bp, Artificial Sequence
  chemically treated genomic DNA (Homo sapiens) CpG-island No: 39411
agtggtgttgcgataatttgaaaaggtacggttattaggaatttattaggagtagagttttgatgttagtttcggtgattttttcgtcgtcgtcgtttagtttttgttttttttgtattttcgttagtagtacgtttagaaggtcgttgtcgtgttcgttagcggcgatttcgtcgggttgcgtttcggtttttttttcgttgatgaattcgtttattatgttgtcgtatcgacggtgtagtttttttatttttgttacgacgttttgcgggtcgagttatcggagcgtcggtacgaagttttcgacgttgaaaacgtcggcgagttgtattagttttataattatttttttgaatttttttgcgtttttttcgtcgtcgacggcgaatattcggtgatcgatggtggcgcgggttagcgtgttcgtggcgtagacgttcgttttttgttttagcgttattgacgtcgtttgttgtcgagcgaggttttttattatgagcgcgatttcgttttttcggattgttcggaggtcgtcgagcgttttggtcgagaagaggtggagcgcgtatagttttcgtaggcgcgttagagtaatcgtaggcgcgaagacgaggttttggtagttgtacgcgacgtgttcggcgttcgagtttggggggtcggttgttgaaagttggtatcgtgttcgcgtaggaaattaggggttaacggggcgttcgacggcgggtaattaattaatttcgggt

SEQ ID NO: 39412 - DNA, 746 bp, Artificial Sequence
  chemically treated genomic DNA (Homo sapiens) CpG-island No: 39412
acccgaaattaattaattacccgccgtcgaacgccccgttaacccctaatttcctacgcgaacacgataccaactttcaacaaccgaccccccaaactcgaacgccgaacacgtcgcgtacaactaccaaaacctcgtcttcgcgcctacgattactctaacgcgcctacgaaaactatacgcgctccacctcttctcgaccaaaacgctcgacgacctccgaacaatccgaaaaaacgaaatcgcgctcataataaaaaacctcgctcgacaacaaacgacgtcaataacgctaaaacaaaaaacgaacgtctacgccacgaacacgctaacccgcgccaccatcgatcaccgaatattcgccgtcgacgacgaaaaaaacgcaaaaaaattcaaaaaaataattataaaactaatacaactcgccgacgttttcaacgtcgaaaacttcgtaccgacgctccgataactcgacccgcaaaacgtcgtaacaaaaataaaaaaactacaccgtcgatacgacaacataataaacgaattcatcaacgaaaaaaaaaccgaaacgcaacccgacgaaatcgccgctaacgaacacgacaacgaccttctaaacgtactactaacgaaaatacaaaaaaaacaaaaactaaacgacgacgacgaaaaaatcaccgaaactaacatcaaaactctactcctaataaattcctaataaccgtaccttttcaaattatcgcaacaccact

SEQ ID NO: 39413 - DNA, 569 bp, Artificial Sequence
  chemically treated genomic DNA (Homo sapiens) CpG-island No: 39413
gcggagttgattcggtattcggacgtttttaaggaggtttagtatgagtttgatatcgtcgtcggtaggggtcgtttcgtgttcgagtttgattttttacgttttttttattttatcgcggtgattaaggagacgtttcggttttattcgttaacgtcgtttttattgtttcgggaggttgtagaggagtgtgaggtggacggttatcgtatttttaagggcgttatttttttagttaacgtttgggttatagttcgtgattcgatttaatggttcgattcgttatagtattagttttttcggttttttttcggtaggatgtatgtagacgtggatgttaagggtgttgatttcggtttgatattattcggagtaggacggagaatatgcgttggttttagttggggtttgcggatggttatattgatgattgttacgttagtgtacgggttcgattggattttggttaacggcgcgatttcggataagtttaatatggaggaggtttatgggtttattttgtagagggtcgtgtcgttgatggtttagttcgtgttaaggttgttttt

SEQ ID NO: 39414 - DNA, 569 bp, Artificial Sequence
  chemically treated genomic DNA (Homo sapiens) CpG-island No: 39414
aaaaacaaccttaacacgaactaaaccatcaacgacacgaccctctacaaaataaacccataaacctcctccatattaaacttatccgaaatcgcgccgttaaccaaaatccaatcgaacccgtacactaacgtaacaatcatcaatataaccatccgcaaaccccaactaaaaccaacgcatattctccgtcctactccgaataatatcaaaccgaaatcaacacccttaacatccacgtctacatacatcctaccgaaaaaaaaccgaaaaaactaatactataacgaatcgaaccattaaatcgaatcacgaactataacccaaacgttaactaaaaaaataacgcccttaaaaatacgataaccgtccacctcacactcctctacaacctcccgaaacaataaaaacgacgttaacgaataaaaccgaaacgtctccttaatcaccgcgataaaataaaaaaaacgtaaaaaatcaaactcgaacacgaaacgacccctaccgacgacgatatcaaactcatactaaacctccttaaaaacgtccgaataccgaatcaactccgc

SEQ ID NO: 39415 - DNA, 569 bp, Artificial Sequence
  chemically treated genomic DNA (Homo sapiens) CpG-island No: 39415
ggaagtagttttggtacgggttggattattaacggtacggttttttgtaaggtgagtttataggttttttttatgttgagtttgttcggagtcgcgtcgttagttaaggtttagtcgaattcgtgtattagcgtggtagttattagtgtgattattcgtaagttttaattaaggttagcgtatatttttcgttttgtttcgaatggtattaggtcgaaattagtatttttgatatttacgtttgtatgtattttgtcggggagaaatcgagaaggttggtattgtagcgggtcgggttattgggtcgggttacgggttatagtttagacgttgattaggagggtagcgtttttggggatacggtagtcgtttattttatatttttttgtagtttttcgaggtagtgagagcggcgttgacgggtgaagtcgaaacgtttttttgattatcgcggtgaggtaggggaggcgtggaaggttagattcggatacgagacgatttttatcgacgacggtgttaagtttatgttgggtttttttgaggacgttcgggtgtcggattagtttcgt

SEQ ID NO: 39416 - DNA, 569 bp, Artificial Sequence
  chemically treated genomic DNA (Homo sapiens) CpG-island No: 39416
acgaaactaatccgacacccgaacgtcctcaaaaaaacccaacataaacttaacaccgtcgtcgataaaaatcgtctcgtatccgaatctaaccttccacgcctcccctacctcaccgcgataatcaaaaaaacgtttcgacttcacccgtcaacgccgctctcactacctcgaaaaactacaaaaaaatataaaataaacgactaccgtatccccaaaaacgctaccctcctaatcaacgtctaaactataacccgtaacccgacccaataacccgacccgctacaataccaaccttctcgatttctccccgacaaaatacatacaaacgtaaatatcaaaaatactaatttcgacctaataccattcgaaacaaaacgaaaaatatacgctaaccttaattaaaacttacgaataatcacactaataactaccacgctaatacacgaattcgactaaaccttaactaacgacgcgactccgaacaaactcaacataaaaaaaacctataaactcaccttacaaaaaaccgtaccgttaataatccaacccgtaccaaaactacttcc

SEQ ID NO: 39417 - DNA, 895 bp, Artificial Sequence
  chemically treated genomic DNA (Homo sapiens) CpG-island No: 39417
atacgggatagttttttgtgttatagtcgatgtagttaaagcgaagggtgcgagagagtcgtggtcgatgaagtcgtgcgtagagtagttgtggtcgatatagttaaagtcgggaagttgatgtcgaggtagtagagtcgtagagtacgtatggggagtcgtagagtggttatggatatacgggagtgcgttgtggattaatgtgcgcgaggacgcgttggatatgaagatagtgatataattgcggtagtcgttgaggaagatggtgtcgaagagttgatgtagtcgaatcgtgaaggacgagatgttacgttaggtttgttagatttggggataattcgggacgaacgagcgcgtcggtgttgttaatattatacgggcgaggtaggggattattatgaattatacgttaatgtcggaagagattagtagagtaggttttcgagacggtcgcggtacgagaacggcgtagagggagaattgtcggagtagtacgtagttgtcgaagaagagcgaagtgtagtcgaggaagatacggcgatgttagcgatgaattatgttggatgaagttgaaggcgaagtagtaggattaacggtttagacggcgttatcggtagttatgtaaaggtagttggattatcggtttagattcgcgatagtggtaatttggagatgcggcggcgatgttcgaagtagataaagaagattcgagtggttgacgatgattagtggggatgatgagggtgtcgaagcgtgaacgacgatgaagacgatgaaagcggtgaaattgcggttcgagaggataatatatttgtagttttatgttaatgaatcggcgagaagtttatcggtgatgaagttatgttaaggaggacgttttttgttggtatttttt

SEQ ID NO: 39418 - DNA, 895 bp, Artificial Sequence
  chemically treated genomic DNA (Homo sapiens) CpG-island No: 39418
aaaaaataccaacaaaaaacgtcctccttaacataacttcatcaccgataaacttctcgccgattcattaacataaaactacaaatatattatcctctcgaaccgcaatttcaccgctttcatcgtcttcatcgtcgttcacgcttcgacaccctcatcatccccactaatcatcgtcaaccactcgaatcttctttatctacttcgaacatcgccgccgcatctccaaattaccactatcgcgaatctaaaccgataatccaactacctttacataactaccgataacgccgtctaaaccgttaatcctactacttcgccttcaacttcatccaacataattcatcgctaacatcgccgtatcttcctcgactacacttcgctcttcttcgacaactacgtactactccgacaattctccctctacgccgttctcgtaccgcgaccgtctcgaaaacctactctactaatctcttccgacattaacgtataattcataataatcccctacctcgcccgtataatattaacaacaccgacgcgctcgttcgtcccgaattatccccaaatctaacaaacctaacgtaacatctcgtccttcacgattcgactacatcaactcttcgacaccatcttcctcaacgactaccgcaattatatcactatcttcatatccaacgcgtcctcgcgcacattaatccacaacgcactcccgtatatccataaccactctacgactccccatacgtactctacgactctactacctcgacatcaacttcccgactttaactatatcgaccacaactactctacgcacgacttcatcgaccacgactctctcgcacccttcgctttaactacatcgactataacacaaaaaactatcccgtat

SEQ ID NO: 39419 - DNA, 895 bp, Artificial Sequence
  chemically treated genomic DNA (Homo sapiens) CpG-island No: 39419
aagaaatattaataagaggcgttttttttagtatggttttattatcggtggatttttcgtcggtttattgatatggaattgtaggtgtgttgttttttcggatcgtagttttatcgtttttatcgtttttatcgtcgtttacgtttcgatatttttattatttttattggttatcgttagttattcgggttttttttatttatttcgagtatcgtcgtcgtatttttaagttgttattgtcgcggatttaggtcggtggtttaattatttttatatggttatcgatgacgtcgtttagatcgttggttttattatttcgtttttaattttatttagtatgatttatcgttagtatcgtcgtatttttttcgattatatttcgttttttttcggtaattgcgtgttgtttcggtaattttttttttacgtcgttttcgtgtcgcgatcgtttcggaggtttattttgttagtttttttcgatattggcgtatgatttatggtggttttttgtttcgttcgtatggtattggtaatatcggcgcgttcgttcgtttcgagttgtttttaagtttggtaaatttagcgtgatatttcgttttttacggttcgattatattagtttttcggtattattttttttaacgattgtcgtaattgtgttattatttttatatttagcgcgttttcgcgtatattggtttataacgtattttcgtgtgtttatgattattttacgattttttatgcgtgttttgcggttttgttatttcgatattaatttttcgattttggttatatcgattatagttattttacgtacgattttatcgattacggttttttcgtatttttcgttttggttatatcgattatggtataaagggttatttcgtgt

SEQ ID NO: 39420 - DNA, 895 bp, Artificial Sequence
  chemically treated genomic DNA (Homo sapiens) CpG-island No: 39420
acacgaaataaccctttataccataatcgatataaccaaaacgaaaaatacgaaaaaaccgtaatcgataaaatcgtacgtaaaataactataatcgatataaccaaaatcgaaaaattaatatcgaaataacaaaaccgcaaaacacgcataaaaaatcgtaaaataatcataaacacacgaaaatacgttataaaccaatatacgcgaaaacgcgctaaatataaaaataataacacaattacgacaatcgttaaaaaaaataataccgaaaaactaatataatcgaaccgtaaaaaacgaaatatcacgctaaatttaccaaacttaaaaacaactcgaaacgaacgaacgcgccgatattaccaataccatacgaacgaaacaaaaaaccaccataaatcatacgccaatatcgaaaaaaactaacaaaataaacctccgaaacgatcgcgacacgaaaacgacgtaaaaaaaaaattaccgaaacaacacgcaattaccgaaaaaaaacgaaatataatcgaaaaaaatacgacgatactaacgataaatcatactaaataaaattaaaaacgaaataataaaaccaacgatctaaacgacgtcatcgataaccatataaaaataattaaaccaccgacctaaatccgcgacaataacaacttaaaaatacgacgacgatactcgaaataaataaaaaaaacccgaataactaacgataaccaataaaaataataaaaatatcgaaacgtaaacgacgataaaaacgataaaaacgataaaactacgatccgaaaaaacaacacacctacaattccatatcaataaaccgacgaaaaatccaccgataataaaaccatactaaaaaaaacgcctcttattaatatttctt

SEQ ID NO: 39421 - DNA, 524 bp, Artificial Sequence
  chemically treated genomic DNA (Homo sapiens) CpG-island No: 39421
ggttttggaaaatatcgagttacgtttttttttgtaatatttttattttttttgttattgttatttcgtatttcgttatttaaacggtttttattagtatatggtttcgttatatcggcgttttattatcgattaattgtaattttatttttcgtagcgtataattttttttgtcgattttcgtttatgggttgtttttttgttttagtttacggtcgcgttatcgatattttgagttatcggtttatatcgttattgtgatttttttcgtcgttaattatatgcggatgtagttatagattcgttattatgttagatttaggtcgtcgatcgtcgtcgcgtttttataggttttattgtttcgttttttaattaacgtaagtttatttcgttatttagttttcgttatcgtcggatagtcgtcggattcggttgcgggatattcggatttagttatggagcgttagattcgatagtcgttaatattgtttgtttttttgttattaatttttattgtagttttg

SEQ ID NO: 39422 - DNA, 524 bp, Artificial Sequence
  chemically treated genomic DNA (Homo sapiens) CpG-island No: 39422
caaaactacaataaaaattaataacaaaaaaacaaacaatattaacgactatcgaatctaacgctccataactaaatccgaatatcccgcaaccgaatccgacgactatccgacgataacgaaaactaaataacgaaataaacttacgttaattaaaaaacgaaacaataaaacctataaaaacgcgacgacgatcgacgacctaaatctaacataataacgaatctataactacatccgcatataattaacgacgaaaaaaatcacaataacgatataaaccgataactcaaaatatcgataacgcgaccgtaaactaaaacaaaaaaacaacccataaacgaaaatcgacaaaaaaaattatacgctacgaaaaataaaattacaattaatcgataataaaacgccgatataacgaaaccatatactaataaaaaccgtttaaataacgaaatacgaaataacaataacaaaaaaaataaaaatattacaaaaaaaaacgtaactcgatattttccaaaacc

SEQ ID NO: 39423 - DNA, 524 bp, Artificial Sequence
  chemically treated genomic DNA (Homo sapiens) CpG-island No: 39423
tagagttgtagtggaggttggtagtaggggagtaagtagtgttggcggttgtcggatttagcgttttatggttagattcgggtgtttcgtaatcggattcggcgattgttcggcgatggcggaggttaggtgacggggtagatttgcgttggttaggggacgaagtagtggagtttatggaggcgcggcgacgatcggcggtttagatttagtatagtggcgggtttgtggttatattcgtatgtagttggcggcggagagggttatagtggcgatgtaggtcgatgatttaaggtgtcggtggcgcggtcgtgggttggagtagagaagtagtttatggacgaaggtcggtagaggaggttgtgcgttgcggaaggtggggttgtagttggtcggtgatggggcgtcgatgtggcgaggttatatgttagtgaaggtcgtttgggtggcggagtgcgggatgataatgatagggggggtgagggtgttgtaagagaaagcgtggttcggtgttttttagggtt

SEQ ID NO: 39424 - DNA, 524 bp, Artificial Sequence
  chemically treated genomic DNA (Homo sapiens) CpG-island No: 39424
aaccctaaaaaacaccgaaccacgctttctcttacaacaccctcaccccccctatcattatcatcccgcactccgccacccaaacgaccttcactaacatataacctcgccacatcgacgccccatcaccgaccaactacaaccccaccttccgcaacgcacaacctcctctaccgaccttcgtccataaactacttctctactccaacccacgaccgcgccaccgacaccttaaatcatcgacctacatcgccactataaccctctccgccgccaactacatacgaatataaccacaaacccgccactatactaaatctaaaccgccgatcgtcgccgcgcctccataaactccactacttcgtcccctaaccaacgcaaatctaccccgtcacctaacctccgccatcgccgaacaatcgccgaatccgattacgaaacacccgaatctaaccataaaacgctaaatccgacaaccgccaacactacttactcccctactaccaacctccactacaactcta

SEQ ID NO: 39425 - DNA, 755 bp, Artificial Sequence
  chemically treated genomic DNA (Homo sapiens) CpG-island No: 39425
gtcgttacgacgcggttattcgacgtcgcgttatggtcggcgatggtatcggagacgacgacgacgtgtatgtacgggtgaagtataagggcgtggcgaggacggcggacgggcggtggcgagggtttattattaataagttcgggaggcggtacggcgtcggcgattacggtacgtcggaggaggcggcgttggcgtacgatcgcgttattttcgttattttgggcgcgtacgtttcgtcggcggcgtttaattttcgcgtcgcgtttagcgatacggagtttcggttttttcgcgggtcgtacgcgtcgtcgcgtcgcgtcgcgggcgtcgtcgtcgcggttatgcgcggcgtcgcgttcgacgtcgcgttcgagcggttcgcggcgcgcgtttacgacgcgtatatcgattcggagttcgcgttcgacgtcgtcgcgtttcgtttcgttattcgcgacgtcggtacgtcgttggcgtagtcggacgtcgagagggcggcgttcgtggcggcggcgaggaataaggtgtacgacgcggcgtggttgaggagttatttgcggcggcggcggttggtcggcgcgacgttcgaggacgagaataggtggtcgttcgtggtgtcgtcggcggtggtcgacgtcggcgacggtttcgtcggtaacgagttggtgtattttttttatggtagttgttatgtggacgagatgatgatttgatcgtcgttttaagattatttggaaatgttttataatttt

SEQ ID NO: 39426 - DNA, 755 bp, Artificial Sequence
  chemically treated genomic DNA (Homo sapiens) CpG-island No: 39426
aaaattataaaacatttccaaataatcttaaaacgacgatcaaatcatcatctcgtccacataacaactaccataaaaaaaatacaccaactcgttaccgacgaaaccgtcgccgacgtcgaccaccgccgacgacaccacgaacgaccacctattctcgtcctcgaacgtcgcgccgaccaaccgccgccgccgcaaataactcctcaaccacgccgcgtcgtacaccttattcctcgccgccgccacgaacgccgccctctcgacgtccgactacgccaacgacgtaccgacgtcgcgaataacgaaacgaaacgcgacgacgtcgaacgcgaactccgaatcgatatacgcgtcgtaaacgcgcgccgcgaaccgctcgaacgcgacgtcgaacgcgacgccgcgcataaccgcgacgacgacgcccgcgacgcgacgcgacgacgcgtacgacccgcgaaaaaaccgaaactccgtatcgctaaacgcgacgcgaaaattaaacgccgccgacgaaacgtacgcgcccaaaataacgaaaataacgcgatcgtacgccaacgccgcctcctccgacgtaccgtaatcgccgacgccgtaccgcctcccgaacttattaataataaaccctcgccaccgcccgtccgccgtcctcgccacgcccttatacttcacccgtacatacacgtcgtcgtcgtctccgataccatcgccgaccataacgcgacgtcgaataaccgcgtcgtaacgac

SEQ ID NO: 39427 - DNA, 755 bp, Artificial Sequence
  chemically treated genomic DNA (Homo sapiens) CpG-island No: 39427
gaaattatggagtatttttaggtaattttgaggcggcgattagattattatttcgtttatatggtagttgttataggggaggtatattagttcgttgtcggcgaagtcgtcgtcgacgtcggttatcgtcggcggtattacgggcggttatttgttttcgttttcgaacgtcgcgtcgattagtcgtcgtcgtcgtaggtagttttttagttacgtcgcgtcgtgtattttgtttttcgtcgtcgttacgaacgtcgttttttcggcgttcggttgcgttagcggcgtgtcggcgtcgcgggtggcgaggcggaacgcggcgacgtcgagcgcgagtttcgggtcggtgtgcgcgtcgtaggcgcgcgtcgcgaatcgttcgagcgcggcgtcgaacgcggcgtcgcgtatgatcgcggcgacgacgttcgcggcgcggcgcgacggcgcgtgcggttcgcggaggaatcggagtttcgtgtcgttgaacgcggcgcggaagttgagcgtcgtcggcgaagcgtgcgcgtttaggatggcgaggatggcgcggtcgtgcgttagcgtcgtttttttcggcgtgtcgtggtcgtcgacgtcgtatcgtttttcgaatttgttggtgatgaattttcgttatcgttcgttcgtcgttttcgttacgtttttgtattttattcgtgtatgtacgtcgtcgtcgttttcggtgttatcgtcggttatggcgcggcgtcgggtggtcgcgtcgtggcggt

SEQ ID NO: 39428 - DNA, 755 bp, Artificial Sequence
  chemically treated genomic DNA (Homo sapiens) CpG-island No: 39428
accgccacgacgcgaccacccgacgccgcgccataaccgacgataacaccgaaaacgacgacgacgtacatacacgaataaaatacaaaaacgtaacgaaaacgacgaacgaacgataacgaaaattcatcaccaacaaattcgaaaaacgatacgacgtcgacgaccacgacacgccgaaaaaaacgacgctaacgcacgaccgcgccatcctcgccatcctaaacgcgcacgcttcgccgacgacgctcaacttccgcgccgcgttcaacgacacgaaactccgattcctccgcgaaccgcacgcgccgtcgcgccgcgccgcgaacgtcgtcgccgcgatcatacgcgacgccgcgttcgacgccgcgctcgaacgattcgcgacgcgcgcctacgacgcgcacaccgacccgaaactcgcgctcgacgtcgccgcgttccgcctcgccacccgcgacgccgacacgccgctaacgcaaccgaacgccgaaaaaacgacgttcgtaacgacgacgaaaaacaaaatacacgacgcgacgtaactaaaaaactacctacgacgacgacgactaatcgacgcgacgttcgaaaacgaaaacaaataaccgcccgtaataccgccgacgataaccgacgtcgacgacgacttcgccgacaacgaactaatatacctcccctataacaactaccatataaacgaaataataatctaatcgccgcctcaaaattacctaaaaatactccataatttc

SEQ ID NO: 39429 - DNA, 1215 bp, Artificial Sequence
  chemically treated genomic DNA (Homo sapiens) CpG-island No: 39429
tgttttcgcgtagttgaatcgcgtttttttttatgtcggtgtgcgtcgtcgtcgcgttatgtcgtgtcgtgttaacgtcgttcgcgtacgttagttcgaaattatacgtcgcggtcgtcgttggattcgtcgcgatttttttttaaaattagtagatcgagtattatcgcgttataagagtagcgacgttttttcgttttttttttttcgtttcgatttaagaagtagagaggagagggatttttgtttttttgattatttatggcgcggttgcggcgtggtttcgaatatttggagcggcggtacgcgttttacgcggcgtattattttaattcggcgaacgtgttcgtttacgtcgtgtgcgtgtggtttattttttttatcgcgatgttttcgtttcggtacgcgtcgtcgttgtcgttgtttcgattttattgttcgttttgtcgttagtattttttcgtgtagttcggttttttcgtcgtcgtcgcgttgggcgcgtattacgcgtttatggatcgtcgcgcgggcgtcgtcgtcgcggcgttttgcgtcgtcgggtgggtcgtcgggacgtttttcgtcgacgtcgcggggttttggacgtttcgcgacgcgtggaggtcgttgtttatcgcgtaggtcgtgttttggttcgtttagttttttttttacgtttttttcgaggtaatttttcgtcgtttcgtttcgtcgtcgtcgtcgcgacggcgcgtcgtttatttttgcgtgtttttgttgtattgtgtcgattttatggtgaggtgattgtagaagcggcggtcggcgttggtggatggttcggtgtaggcggtggtgacggcgtcgttgttcgtttttatcgaggtaattggtcgtgttcgttcgagttggtcgtcgtgcggcgatggcgatcgttaagtgttcgatttaatgcgagtgcggttgtttcgtgtttttgtaggtgttgtataggttgttcgggtacgagtcgacgtcggggttttataagcgcgtttaggcgagggtggcggcgatgtataacgggtcgtcggtatcggcgtcggcgtcggagaagaaggaggaggaggagaaggagaacgtgagtaaggcgacgtaggaggagagcgtcgagaaggattcgtaggtgttttcgagggagagtgtgatagataggagaggtagagttcgggatgttatgaatttgtaatagtttgt

SEQ ID NO: 39430 - DNA, 1215 bp, Artificial Sequence
  chemically treated genomic DNA (Homo sapiens) CpG-island No: 39430
acaaactattacaaattcataacatcccgaactctacctctcctatctatcacactctccctcgaaaacacctacgaatccttctcgacgctctcctcctacgtcgccttactcacgttctccttctcctcctcctccttcttctccgacgccgacgccgataccgacgacccgttatacatcgccgccaccctcgcctaaacgcgcttataaaaccccgacgtcgactcgtacccgaacaacctatacaacacctacaaaaacacgaaacaaccgcactcgcattaaatcgaacacttaacgatcgccatcgccgcacgacgaccaactcgaacgaacacgaccaattacctcgataaaaacgaacaacgacgccgtcaccaccgcctacaccgaaccatccaccaacgccgaccgccgcttctacaatcacctcaccataaaatcgacacaatacaacaaaaacacgcaaaaataaacgacgcgccgtcgcgacgacgacgacgaaacgaaacgacgaaaaattacctcgaaaaaaacgtaaaaaaaaaactaaacgaaccaaaacacgacctacgcgataaacaacgacctccacgcgtcgcgaaacgtccaaaaccccgcgacgtcgacgaaaaacgtcccgacgacccacccgacgacgcaaaacgccgcgacgacgacgcccgcgcgacgatccataaacgcgtaatacgcgcccaacgcgacgacgacgaaaaaaccgaactacacgaaaaaatactaacgacaaaacgaacaataaaatcgaaacaacgacaacgacgacgcgtaccgaaacgaaaacatcgcgataaaaaaaataaaccacacgcacacgacgtaaacgaacacgttcgccgaattaaaataatacgccgcgtaaaacgcgtaccgccgctccaaatattcgaaaccacgccgcaaccgcgccataaataatcaaaaaaacaaaaatccctctcctctctacttcttaaatcgaaacgaaaaaaaaaaaacgaaaaaacgtcgctactcttataacgcgataatactcgatctactaattttaaaaaaaaatcgcgacgaatccaacgacgaccgcgacgtataatttcgaactaacgtacgcgaacgacgttaacacgacacgacataacgcgacgacgacgcacaccgacataaaaaaaaacgcgattcaactacgcgaaaaca

SEQ ID NO: 39431 - DNA, 1215 bp, Artificial Sequence
  chemically treated genomic DNA (Homo sapiens) CpG-island No: 39431
ataagttattataagtttataatatttcgagttttgttttttttgtttgttatattttttttcgaaaatatttacgaatttttttcggcgttttttttttgcgtcgttttgtttacgtttttttttttttttttttttttttttttcggcgtcggcgtcggtgtcggcggttcgttgtgtatcgtcgttattttcgtttggacgcgtttgtagaatttcggcgtcggttcgtattcgaataatttatgtagtatttgtaaaaatacggagtaatcgtattcgtattaaatcgaatatttggcggtcgttatcgtcgtacggcgattaattcgaacgaatacggttaattatttcgatgaagacgaatagcggcgtcgttattatcgtttgtatcgggttatttattagcgtcggtcgtcgtttttgtaattattttattataagatcggtataatgtaataaaaatacgtaaagatgggcggcgcgtcgtcgcggcggcggcggcgaggcgaggcgacgagaggttatttcgaagaaggcgtgggagaagaattgggcggattagagtacggtttgcgcggtgagtagcggtttttacgcgtcgcggaacgtttagagtttcgcggcgtcggcgaggagcgtttcggcggtttattcggcgacgtagagcgtcgcggcggcggcgttcgcgcggcggtttatgagcgcgtagtacgcgtttagcgcgacggcgacggggaagtcgagttgtacggggaggtattggcggtagagcgggtagtagaatcggagtagcggtagcggcggcgcgtatcggagcgggagtatcgcggtgaggaggatgggttatacgtatacggcgtggacgagtacgttcgtcgggttggagtggtacgtcgcgtagaacgcgtatcgtcgttttaggtgttcgagattacgtcgtagtcgcgttatggatgattaagaaaataagaattttttttttttttgttttttggatcgagacgaggaagaagaggcgggggggcgtcgttgtttttatggcgcggtggtgttcgatttgttggttttggaggagggtcgcggcgaatttagcggcggtcgcggcgtgtggtttcgagttggcgtgcgcgggcggcgttgatacggtacggtatggcgcggcggcggcgtatatcggtatgggggagagcgcggtttagttgcgcgggggta

SEQ ID NO: 39432 - DNA, 1215 bp, Artificial Sequence
  chemically treated genomic DNA (Homo sapiens) CpG-island No: 39432
tacccccgcgcaactaaaccgcgctctcccccataccgatatacgccgccgccgcgccataccgtaccgtatcaacgccgcccgcgcacgccaactcgaaaccacacgccgcgaccgccgctaaattcgccgcgaccctcctccaaaaccaacaaatcgaacaccaccgcgccataaaaacaacgacgcccccccgcctcttcttcctcgtctcgatccaaaaaacaaaaaaaaaaaaaattcttattttcttaatcatccataacgcgactacgacgtaatctcgaacacctaaaacgacgatacgcgttctacgcgacgtaccactccaacccgacgaacgtactcgtccacgccgtatacgtataacccatcctcctcaccgcgatactcccgctccgatacgcgccgccgctaccgctactccgattctactacccgctctaccgccaatacctccccgtacaactcgacttccccgtcgccgtcgcgctaaacgcgtactacgcgctcataaaccgccgcgcgaacgccgccgccgcgacgctctacgtcgccgaataaaccgccgaaacgctcctcgccgacgccgcgaaactctaaacgttccgcgacgcgtaaaaaccgctactcaccgcgcaaaccgtactctaatccgcccaattcttctcccacgccttcttcgaaataacctctcgtcgcctcgcctcgccgccgccgccgcgacgacgcgccgcccatctttacgtatttttattacattataccgatcttataataaaataattacaaaaacgacgaccgacgctaataaataacccgatacaaacgataataacgacgccgctattcgtcttcatcgaaataattaaccgtattcgttcgaattaatcgccgtacgacgataacgaccgccaaatattcgatttaatacgaatacgattactccgtatttttacaaatactacataaattattcgaatacgaaccgacgccgaaattctacaaacgcgtccaaacgaaaataacgacgatacacaacgaaccgccgacaccgacgccgacgccgaaaaaaaaaaaaaaaaaaaaaaaaaaaaacgtaaacaaaacgacgcaaaaaaaaaacgccgaaaaaaattcgtaaatattttcgaaaaaaaatataacaaacaaaaaaaacaaaactcgaaatattataaacttataataacttat

SEQ ID NO: 39433 - DNA, 1234 bp, Artificial Sequence
  chemically treated genomic DNA (Homo sapiens) CpG-island No: 39433
cgaatcgggataaatcgttgcgtcgtcgcgtcgtcgtcgtcggcgtattaggcggcggcggtgggcggtatatcgcggttatcgtcgatacgtcgacggttttgtggttgacgtatttcgttagtagttcgatcggtcggtttgtttgtcgtcggtgttgttgttgttttacggttatcgtcgtcgtcggtttttttttgtcgtcgtcgtcgtcgtcgcgtttcgacgcggcgacggatacgtcggcggcgttcgtcgtgattacgttttattggacgttcgtttcgttgggttcgtagtttcggtagtcgtcgattattaggtttttgatttcgaataggtcggagttcgattcgttttcgacgtcgtcgtcgtcgtcgtcgtcgtcggacgtcggtatggtgatttttatcggagcgaggagagtgaagttgtttcggaaattcgagttcgaatatttcgacgtcgtcgtcgtgttttttttttttttaatggtcgttattttcgtcgcgttaatattatttaaatttggcgggagattagcggcgattacgtcgttatggttgacgttattttcggttttgtttagttttaggtttttgtattattcgattttattcgtcgtcgtcggtggtagttcgtttttcggatcgtcggtcggtttcgtcgtcgttatcgcggcgtcgtcgacgtgtatcgatcgtttttcggagtacgagcgtaggatgtcgtcgatatgggcgtagtatttgtcgcggcggcgttgttttcggagtagtacggtttggttgttggcggtggagttcgatgattcggcgttcgttatcgacgcgcgcgtcgtttacggcgtcggtcggtttatcgttacggtcggtttcgtcgtcgtcgtcgttattatcggcgacgcgaggtttattttgttgtagtcgtcggcgtcgtttattgcgtttttgaagtattttttagcggcgaagacgtcgagttcgtcgtcggcgtacgtgcgtcgttagttcgttacgttatgcggcggtggcgtcggtaatggtcgtcgcggcggtattttttcggcgtcgtttttttttcggacgaggtcgaggtaggtggcgaagtcgtcgtcgtcgtcggcgacgtttcggcgtcggtcgaatagttggtgtttataggtgatcgtgacgttattattttttgagttttttattggtgtattgatatttttaagtatttgttatatagt

SEQ ID NO: 39434 - DNA, 1234 bp, Artificial Sequence
  chemically treated genomic DNA (Homo sapiens) CpG-island No: 39434
actatataacaaatacttaaaaatatcaatacaccaataaaaaactcaaaaaataataacgtcacgatcacctataaacaccaactattcgaccgacgccgaaacgtcgccgacgacgacgacgacttcgccacctacctcgacctcgtccgaaaaaaaaacgacgccgaaaaaataccgccgcgacgaccattaccgacgccaccgccgcataacgtaacgaactaacgacgcacgtacgccgacgacgaactcgacgtcttcgccgctaaaaaatacttcaaaaacgcaataaacgacgccgacgactacaacaaaataaacctcgcgtcgccgataataacgacgacgacgacgaaaccgaccgtaacgataaaccgaccgacgccgtaaacgacgcgcgcgtcgataacgaacgccgaatcatcgaactccaccgccaacaaccaaaccgtactactccgaaaacaacgccgccgcgacaaatactacgcccatatcgacgacatcctacgctcgtactccgaaaaacgatcgatacacgtcgacgacgccgcgataacgacgacgaaaccgaccgacgatccgaaaaacgaactaccaccgacgacgacgaataaaatcgaataatacaaaaacctaaaactaaacaaaaccgaaaataacgtcaaccataacgacgtaatcgccgctaatctcccgccaaatttaaataatattaacgcgacgaaaataacgaccattaaaaaaaaaaaaaacacgacgacgacgtcgaaatattcgaactcgaatttccgaaacaacttcactctcctcgctccgataaaaatcaccataccgacgtccgacgacgacgacgacgacgacgacgtcgaaaacgaatcgaactccgacctattcgaaatcaaaaacctaataatcgacgactaccgaaactacgaacccaacgaaacgaacgtccaataaaacgtaatcacgacgaacgccgccgacgtatccgtcgccgcgtcgaaacgcgacgacgacgacgacgacaaaaaaaaaccgacgacgacgataaccgtaaaacaacaacaacaccgacgacaaacaaaccgaccgatcgaactactaacgaaatacgtcaaccacaaaaccgtcgacgtatcgacgataaccgcgatataccgcccaccgccgccgcctaatacgccgacgacgacgacgcgacgacgcaacgatttatcccgattcg

SEQ ID NO: 39435 - DNA, 1234 bp, Artificial Sequence
  chemically treated genomic DNA (Homo sapiens) CpG-island No: 39435
gttatgtggtagatatttgagaatattagtgtattaatggagagtttaagaaatggtgacgttacggttatttatgagtattagttgttcggtcggcgtcggaacgtcgtcggcggcggcggcggtttcgttatttatttcgatttcgttcgggaggaaggcgacgtcggaaagatgtcgtcgcggcggttattgtcggcgttatcgtcgtatggcgtggcgagttggcggcgtacgtacgtcgacggcgagttcgacgttttcgtcgttgagaggtattttaagggcgtaatggacggcgtcgacggttataataaggtggatttcgcgtcgtcggtgatggcggcggcggcggcgaggtcggtcgtggcggtgagtcggtcggcgtcgtggacgacgcgcgcgtcggtggcgagcgtcgggttatcgggttttatcgttaatagttaggtcgtgttgtttcgggagtagcgtcgtcgcgataagtgttgcgtttatgtcggcggtattttgcgttcgtgtttcgggaagcggtcggtgtacgtcggcggcgtcgcggtggcggcgacggagtcggtcggcgattcgggggacgagttgttatcggcgacggcgagtaggatcgagtggtatagagatttgaggttggataaggtcggagatggcgttagttatggcggcgtggtcgtcgttggtttttcgttaaatttgaatagtattggcgcggcgagagtggcggttattgggagggaggagggtacggcggcgacgtcggagtattcgagttcgagttttcggagtaattttatttttttcgtttcggtgaaggttattatatcggcgttcggcggcgacgacgacgacgacgacgtcgggagcgagtcgagtttcgatttgttcgagattaagagtttgatgatcgacgattgtcggggttacgagtttagcgaggcgagcgtttaatggagcgtggttacggcgagcgtcgtcgacgtgttcgtcgtcgcgtcggggcgcggcggcggcggcggcggtaaggggaggtcggcggcggcggtggtcgtgaggtagtagtagtatcggcggtaggtagatcggtcggtcgggttgttggcgggatgcgttagttatagggtcgtcgacgtgtcggcggtggtcgcggtgtgtcgtttatcgtcgtcgtttggtgcgtcggcgacggcgacgcggcggcgtagcgatttgtttcggttcg

SEQ ID NO: 39436 - DNA, 1234 bp, Artificial Sequence
  chemically treated genomic DNA (Homo sapiens) CpG-island No: 39436
cgaaccgaaacaaatcgctacgccgccgcgtcgccgtcgccgacgcaccaaacgacgacgataaacgacacaccgcgaccaccgccgacacgtcgacgaccctataactaacgcatcccgccaacaacccgaccgaccgatctacctaccgccgatactactactacctcacgaccaccgccgccgccgacctccccttaccgccgccgccgccgccgcgccccgacgcgacgacgaacacgtcgacgacgctcgccgtaaccacgctccattaaacgctcgcctcgctaaactcgtaaccccgacaatcgtcgatcatcaaactcttaatctcgaacaaatcgaaactcgactcgctcccgacgtcgtcgtcgtcgtcgtcgccgccgaacgccgatataataaccttcaccgaaacgaaaaaaataaaattactccgaaaactcgaactcgaatactccgacgtcgccgccgtaccctcctccctcccaataaccgccactctcgccgcgccaatactattcaaatttaacgaaaaaccaacgacgaccacgccgccataactaacgccatctccgaccttatccaacctcaaatctctataccactcgatcctactcgccgtcgccgataacaactcgtcccccgaatcgccgaccgactccgtcgccgccaccgcgacgccgccgacgtacaccgaccgcttcccgaaacacgaacgcaaaataccgccgacataaacgcaacacttatcgcgacgacgctactcccgaaacaacacgacctaactattaacgataaaacccgataacccgacgctcgccaccgacgcgcgcgtcgtccacgacgccgaccgactcaccgccacgaccgacctcgccgccgccgccgccatcaccgacgacgcgaaatccaccttattataaccgtcgacgccgtccattacgcccttaaaatacctctcaacgacgaaaacgtcgaactcgccgtcgacgtacgtacgccgccaactcgccacgccatacgacgataacgccgacaataaccgccgcgacgacatctttccgacgtcgccttcctcccgaacgaaatcgaaataaataacgaaaccgccgccgccgccgacgacgttccgacgccgaccgaacaactaatactcataaataaccgtaacgtcaccatttcttaaactctccattaatacactaatattctcaaatatctaccacataac

SEQ ID NO: 39437 - DNA, 631 bp, Artificial Sequence
  chemically treated genomic DNA (Homo sapiens) CpG-island No: 39437
agtcgatttgggtgaggttggcgagtagtatgacgaggttgcgcgcgaggttcggttgtttttcgtcgcgtttggttacgacgtttatggcggttacgacggcgtcgagcgatacgaggcgggtcgagagcgcgtcgttttggttgaggttgacgagcgagttcgtcgtcgtttttttcgtgtttagttcgtttttcgcggacgttagtagtcggagtagcgtcggtagcgcgcggtcggcgcgcgtcgagagggcgcgtaggtcgttcgcgtcgttcgttagttttcgtacgatgttcgtcgtcgcgtcgcgtatttgatagaaaaatagacggcgaacgagaacgagaatacgggttagagagaagtagaatagttattaagttatggggaattaaggggggattagagcgtacgtttggttggggagaggagaggaagtcgaggagttcgtcgagttcgtcggttatggcggcggcggcggcggcgaggggggaggaggttttgtggggttcggtttttttttaagttcgaaagtacgcgacgtgacggatttacgtaaattcgaggtgaaaacgtattgtacggaaatacgtaagttagcggtgaagacgtatttttttcgtaaaaa

SEQ ID NO: 39438 - DNA, 631 bp, Artificial Sequence
  chemically treated genomic DNA (Homo sapiens) CpG-island No: 39438
tttttacgaaaaaaatacgtcttcaccgctaacttacgtatttccgtacaatacgttttcacctcgaatttacgtaaatccgtcacgtcgcgtactttcgaacttaaaaaaaaaccgaaccccacaaaacctcctcccccctcgccgccgccgccgccgccataaccgacgaactcgacgaactcctcgacttcctctcctctccccaaccaaacgtacgctctaatccccccttaattccccataacttaataactattctacttctctctaacccgtattctcgttctcgttcgccgtctatttttctatcaaatacgcgacgcgacgacgaacatcgtacgaaaactaacgaacgacgcgaacgacctacgcgccctctcgacgcgcgccgaccgcgcgctaccgacgctactccgactactaacgtccgcgaaaaacgaactaaacacgaaaaaaacgacgacgaactcgctcgtcaacctcaaccaaaacgacgcgctctcgacccgcctcgtatcgctcgacgccgtcgtaaccgccataaacgtcgtaaccaaacgcgacgaaaaacaaccgaacctcgcgcgcaacctcgtcatactactcgccaacctcacccaaatcgact

SEQ ID NO: 39439 - DNA, 631 bp, Artificial Sequence
  chemically treated genomic DNA (Homo sapiens) CpG-island No: 39439
tttttacggagggagtacgtttttatcgttggtttacgtattttcgtgtaatacgtttttatttcgggtttgcgtaaattcgttacgtcgcgtgttttcggatttggagagaagtcgaattttataaaatttttttttttttcgtcgtcgtcgtcgtcgttatggtcgacgagttcgacgaatttttcggtttttttttttttttttagttaaacgtacgttttgatttttttttgattttttatggtttagtagttgttttgtttttttttgattcgtgttttcgttttcgttcgtcgtttgtttttttattaggtgcgcggcgcggcggcgggtatcgtgcgggggttgacgggcgacgcggacggtttgcgcgttttttcggcgcgcgtcgatcgcgcgttgtcggcgttgtttcggttgttggcgttcgcggggggcgagttgggtacggggggagcggcggcggattcgttcgttaattttagttaggacggcgcgttttcggttcgtttcgtgtcgttcggcgtcgtcgtggtcgttatggacgtcgtggttaagcgcggcggggagtagtcgggtttcgcgcgtagtttcgttatgttgttcgttaattttatttaggtcgatt

SEQ ID NO: 39440 - DNA, 631 bp, Artificial Sequence
  chemically treated genomic DNA (Homo sapiens) CpG-island No: 39440
aatcgacctaaataaaattaacgaacaacataacgaaactacgcgcgaaacccgactactccccgccgcgcttaaccacgacgtccataacgaccacgacgacgccgaacgacacgaaacgaaccgaaaacgcgccgtcctaactaaaattaacgaacgaatccgccgccgctccccccgtacccaactcgccccccgcgaacgccaacaaccgaaacaacgccgacaacgcgcgatcgacgcgcgccgaaaaaacgcgcaaaccgtccgcgtcgcccgtcaacccccgcacgatacccgccgccgcgccgcgcacctaataaaaaaacaaacgacgaacgaaaacgaaaacacgaatcaaaaaaaaacaaaacaactactaaaccataaaaaatcaaaaaaaaatcaaaacgtacgtttaactaaaaaaaaaaaaaaaaaccgaaaaattcgtcgaactcgtcgaccataacgacgacgacgacgacgaaaaaaaaaaaaattttataaaattcgacttctctccaaatccgaaaacacgcgacgtaacgaatttacgcaaacccgaaataaaaacgtattacacgaaaatacgtaaaccaacgataaaaacgtactccctccgtaaaaa

SEQ ID NO: 39441 - DNA, 602 bp, Artificial Sequence
  chemically treated genomic DNA (Homo sapiens) CpG-island No: 39441
ggagttcggtagcggtcgcgaaggtggcggtaatcgtggaggcggcggcggtcgtggacgaggcggaggaggcggcgggtgtggcgatagtgttcgcgatggtggcggcgttcgcggaggtggtggttgtggtgttcgcggaggtggcgacgttcgtggaggcggcggcgggtgtggaggcgaggcggttttcggatttgagaggagcgcggcggtgttcgcggaggtggcggcgttcgcggaggtggcggtcgcggtgttcgcggaggtggcggcgttcgtggaggcggcggcggtgttcgcggaggtggcggcgtttgtggataagcggcgattttatggaggtgacggtggtcgtggaggaggaggaggcggcggcgttcgtggacgcgtagaggtggtagtgggcgtggacgaggtagcggcgtttagggaggcggcgatatttgcggatgtacggcggagttcgcggaggtggcggatggtacggtgacgtcgttcgttcgttttaggtgggacgagttcgttcgttagttttttgcggattagttggttttggatttaaaaggaatatttttttttagggattaatttattttatt

SEQ ID NO: 39442 - DNA, 602 bp, Artificial Sequence
  chemically treated genomic DNA (Homo sapiens) CpG-island No: 39442
aataaaataaattaatccctaaaaaaaaatattccttttaaatccaaaaccaactaatccgcaaaaaactaacgaacgaactcgtcccacctaaaacgaacgaacgacgtcaccgtaccatccgccacctccgcgaactccgccgtacatccgcaaatatcgccgcctccctaaacgccgctacctcgtccacgcccactaccacctctacgcgtccacgaacgccgccgcctcctcctcctccacgaccaccgtcacctccataaaatcgccgcttatccacaaacgccgccacctccgcgaacaccgccgccgcctccacgaacgccgccacctccgcgaacaccgcgaccgccacctccgcgaacgccgccacctccgcgaacaccgccgcgctcctctcaaatccgaaaaccgcctcgcctccacacccgccgccgcctccacgaacgtcgccacctccgcgaacaccacaaccaccacctccgcgaacgccgccaccatcgcgaacactatcgccacacccgccgcctcctccgcctcgtccacgaccgccgccgcctccacgattaccgccaccttcgcgaccgctaccgaactcc

SEQ ID NO: 39443 - DNA, 602 bp, Artificial Sequence
  chemically treated genomic DNA (Homo sapiens) CpG-island No: 39443
ggtgggatgggttggtttttggagaggaatattttttttagatttaggattaattgattcgtaaaaaattggcggacgaattcgttttatttaggacgagcgaacggcgttatcgtgttattcgttattttcgcgaatttcgtcgtgtattcgtaagtgtcgtcgtttttttgagcgtcgttgtttcgtttacgtttattgttatttttgcgcgtttacgagcgtcgtcgttttttttttttttacgattatcgttatttttatgaggtcgtcgtttgtttataagcgtcgttattttcgcgagtatcgtcgtcgtttttacgagcgtcgttattttcgcgagtatcgcgatcgttattttcgcgagcgtcgttattttcgcgagtatcgtcgcgttttttttagattcgggagtcgtttcgtttttatattcgtcgtcgtttttacgagcgtcgttattttcgcgagtattataattattattttcgcgagcgtcgttattatcgcgagtattgtcgttatattcgtcgtttttttcgtttcgtttacgatcgtcgtcgtttttacgattgtcgttattttcgcgatcgttgtcgagtttt

SEQ ID NO: 39444 - DNA, 602 bp, Artificial Sequence
  chemically treated genomic DNA (Homo sapiens) CpG-island No: 39444
aaaactcgacaacgatcgcgaaaataacgacaatcgtaaaaacgacgacgatcgtaaacgaaacgaaaaaaacgacgaatataacgacaatactcgcgataataacgacgctcgcgaaaataataattataatactcgcgaaaataacgacgctcgtaaaaacgacgacgaatataaaaacgaaacgactcccgaatctaaaaaaaacgcgacgatactcgcgaaaataacgacgctcgcgaaaataacgatcgcgatactcgcgaaaataacgacgctcgtaaaaacgacgacgatactcgcgaaaataacgacgcttataaacaaacgacgacctcataaaaataacgataatcgtaaaaaaaaaaaaaacgacgacgctcgtaaacgcgcaaaaataacaataaacgtaaacgaaacaacgacgctcaaaaaaacgacgacacttacgaatacacgacgaaattcgcgaaaataacgaataacacgataacgccgttcgctcgtcctaaataaaacgaattcgtccgccaattttttacgaatcaattaatcctaaatctaaaaaaaatattcctctccaaaaaccaacccatcccacc

SEQ ID NO: 39445 - DNA, 1287 bp, Artificial Sequence
  chemically treated genomic DNA (Homo sapiens) CpG-island No: 39445
ggcgggtaggtcggataaggcgtttacgtcgtattcgataattacgtttaagtcgggttgtttgatgcgacgttggcgcgttttattaggttatatcgttgtgaagtgttttatttcgtaggtcggataaggcggttacgtcgtattcgatatttaacgttcgagtcgggttgtttgatgcgacgttgtcgcgttttattatgtttatatcgttgtgaagtgttttatttcgtaggtcggataaggcgtttacgtcgtattcgattatttaacgtttaagtcggttgtttgatgcgacgttggcgcgttttattaggtttataaattttcgtatttttcgtaggtcggataaggcgttcgcgtcgtattcggtaacggtgtcgattgtttgatgcgacgtttgcgcgttttattaggtttataaattttcgtatttttcgtaggtcggataaggcgtttacgtcgtattcggtaatagtgttaattgtttgatgcgacgtttgcgcgttttattaggtttataaattttcgtattattcgtaggtcggataaggcgtttacgtcgtattcggtaacggtgtcgattgtttgatgcgacgtttgcgcgttttattaggtttataaattttcgtatttttcgtaggtcggataaggcgtttacgtcgtattcggtaatggtgtcgattgtttgatgcgacgtttatcgcgttttattaggtttatacgttatacgtaggtcggataaggcgtttacgtcgtattcggtaaatattgcgagagtagattatttcgttttaatcgttttattttttaataattttcgtatttataatcgattcgggtttaacgtcgttagcgtattggtatttatcggaatcggttcgtcgtttatttgcgtcgttagaatttcggtatatagcggggtagaatataaatcgcgagaatttaaagtcgtaaatataaagagatcgttaaaaatcggcgcgtttatcgttttatttttttgtttcgttaacgacgtatattttacgagtgttgttttataatcgggaatattgtttattattggtagatgatcgcgggtggtataacgtatatcgtagcgcgtttttttattattgatattaattttttttgtttattgtgtttgcgggaaataattaattaatcgttggcgattttgttgttgatcgtttttattgtacgtcgtattttcgttgtcgcgatgataattggtattaatataatgatgttgattcgtcggattttgtggcgtgagataatcgt

SEQ ID NO: 39446 - DNA, 1287 bp, Artificial Sequence
  chemically treated genomic DNA (Homo sapiens) CpG-island No: 39446
acgattatctcacgccacaaaatccgacgaatcaacatcattatattaataccaattatcatcgcgacaacgaaaatacgacgtacaataaaaacgatcaacaacaaaatcgccaacgattaattaattatttcccgcaaacacaataaacaaaaaaaattaatatcaataataaaaaaacgcgctacgatatacgttataccacccgcgatcatctaccaataataaacaatattcccgattataaaacaacactcgtaaaatatacgtcgttaacgaaacaaaaaaataaaacgataaacgcgccgatttttaacgatctctttatatttacgactttaaattctcgcgatttatattctaccccgctatataccgaaattctaacgacgcaaataaacgacgaaccgattccgataaataccaatacgctaacgacgttaaacccgaatcgattataaatacgaaaattattaaaaaataaaacgattaaaacgaaataatctactctcgcaatatttaccgaatacgacgtaaacgccttatccgacctacgtataacgtataaacctaataaaacgcgataaacgtcgcatcaaacaatcgacaccattaccgaatacgacgtaaacgccttatccgacctacgaaaaatacgaaaatttataaacctaataaaacgcgcaaacgtcgcatcaaacaatcgacaccgttaccgaatacgacgtaaacgccttatccgacctacgaataatacgaaaatttataaacctaataaaacgcgcaaacgtcgcatcaaacaattaacactattaccgaatacgacgtaaacgccttatccgacctacgaaaaatacgaaaatttataaacctaataaaacgcgcaaacgtcgcatcaaacaatcgacaccgttaccgaatacgacgcgaacgccttatccgacctacgaaaaatacgaaaatttataaacctaataaaacgcgccaacgtcgcatcaaacaaccgacttaaacgttaaataatcgaatacgacgtaaacgccttatccgacctacgaaataaaacacttcacaacgatataaacataataaaacgcgacaacgtcgcatcaaacaacccgactcgaacgttaaatatcgaatacgacgtaaccgccttatccgacctacgaaataaaacacttcacaacgatataacctaataaaacgcgccaacgtcgcatcaaacaacccgacttaaacgtaattatcgaatacgacgtaaacgccttatccgacctacccgcc

SEQ ID NO: 39447 - DNA, 1287 bp, Artificial Sequence
  chemically treated genomic DNA (Homo sapiens) CpG-island No: 39447
acggttattttacgttataaaattcggcgaattaatattattgtattggtgttagttattatcgcggtagcgaagatacggcgtatagtgaggacgattagtagtagaatcgttagcggttgattgattgtttttcgtaggtatagtgggtaaaagaggttgatgttagtgataaagaggcgcgttgcggtgtgcgttgtgttattcgcgattatttgttaatggtaggtaatgttttcgattatgaggtaatattcgtggaatatgcgtcgttggcggagtagaaagatgaggcggtaagcgcgtcggtttttgacgatttttttatgtttgcggttttaggttttcgcggtttgtgttttgtttcgttgtgtgtcgagattttggcggcgtagatgagcgacgaatcgatttcgatggatgttagtacgttggcggcgttaaattcgaatcggttatgggtgcggaaattgttgaagggtaaagcggttaaggcggggtaatttgttttcgtagtgtttgtcggatgcggcgtgaacgttttattcgatttacgtgtgacgtgtaggtttgataagacgcgataagcgtcgtattaggtagtcggtattattgtcggatgcggcgtaaacgttttattcggtttacggagggtgcgggaatttgtaggtttgataagacgcgtaagcgtcgtattaggtagtcggtatcgttgtcggatgcggcgtaaacgttttattcggtttacggatggtgcgggaatttgtaggtttgataagacgcgtaagcgtcgtattaggtagttggtattgttgtcggatgcggcgtaaacgttttattcggtttacggagggtgcgggaatttgtaggtttgataagacgcgtaagcgtcgtattaggtagtcggtatcgttgtcggatgcggcgcgagcgttttattcggtttacggagggtgcgggaatttgtaggtttgataagacgcgttagcgtcgtattaggtaatcggtttgggcgttagatggtcggatgcggcgtgaacgttttattcggtttacggggtggagtattttatagcggtgtaggtatgataagacgcggtagcgtcgtattaggtaattcggttcggacgttggatgtcggatgcggcgtaatcgttttattcgatttacggggtggagtattttatagcggtgtagtttgataagacgcgttagcgtcgtattaggtaattcggtttgggcgtggttgtcggatgcggcgtgaacgttttattcgatttattcgtt

SEQ ID NO: 39448 - DNA, 1287 bp, Artificial Sequence
  chemically treated genomic DNA (Homo sapiens) CpG-island No: 39448
aacgaataaatcgaataaaacgttcacgccgcatccgacaaccacgcccaaaccgaattacctaatacgacgctaacgcgtcttatcaaactacaccgctataaaatactccaccccgtaaatcgaataaaacgattacgccgcatccgacatccaacgtccgaaccgaattacctaatacgacgctaccgcgtcttatcatacctacaccgctataaaatactccaccccgtaaaccgaataaaacgttcacgccgcatccgaccatctaacgcccaaaccgattacctaatacgacgctaacgcgtcttatcaaacctacaaattcccgcaccctccgtaaaccgaataaaacgctcgcgccgcatccgacaacgataccgactacctaatacgacgcttacgcgtcttatcaaacctacaaattcccgcaccctccgtaaaccgaataaaacgtttacgccgcatccgacaacaataccaactacctaatacgacgcttacgcgtcttatcaaacctacaaattcccgcaccatccgtaaaccgaataaaacgtttacgccgcatccgacaacgataccgactacctaatacgacgcttacgcgtcttatcaaacctacaaattcccgcaccctccgtaaaccgaataaaacgtttacgccgcatccgacaataataccgactacctaatacgacgcttatcgcgtcttatcaaacctacacgtcacacgtaaatcgaataaaacgttcacgccgcatccgacaaacactacgaaaacaaattaccccgccttaaccgctttacccttcaacaatttccgcacccataaccgattcgaatttaacgccgccaacgtactaacatccatcgaaatcgattcgtcgctcatctacgccgccaaaatctcgacacacaacgaaacaaaacacaaaccgcgaaaacctaaaaccgcaaacataaaaaaatcgtcaaaaaccgacgcgcttaccgcctcatctttctactccgccaacgacgcatattccacgaatattacctcataatcgaaaacattacctaccattaacaaataatcgcgaataacacaacgcacaccgcaacgcgcctctttatcactaacatcaacctcttttacccactatacctacgaaaaacaatcaatcaaccgctaacgattctactactaatcgtcctcactatacgccgtatcttcgctaccgcgataataactaacaccaatacaataatattaattcgccgaattttataacgtaaaataaccgt

SEQ ID NO: 39449 - DNA, 533 bp, Artificial Sequence
  chemically treated genomic DNA (Homo sapiens) CpG-island No: 39449
gcggggcgcggggtttttggcgtttttgcgttcggaacggttgttttcgggttgggtggttgttgtcgtttaatacgcggttttcgtagaatagtgggttgaggtcggtttagtacggcggttttagttttaggatcggcgtatagtagagggttcggtaaaggtttcggtttagcggggaaggcgcgtttttttgcggcgttgacggggatagtagggttttcgggtcgttttttggttgtgtttcgtttcgggggacgttgggcggattgcggggcgtgttcgggggcgttgtagtgtgtgcggattcgtagtgggtgtttattgtcggttagagttaaggcgttcggtcgtttcggtttgaggaatgaaggcgttttgtgtcgttttagtaggtagtagtgattcgtggcgcgttttcggggattcgattgcgggtttagtggtgcgaagttagttttgtgttcgggtttggtttttttagtttttaggaaagcggatttcgttttcggtgagatgaaacggtttaggag

SEQ ID NO: 39450 - DNA, 533 bp, Artificial Sequence
  chemically treated genomic DNA (Homo sapiens) CpG-island No: 39450
ctcctaaaccgtttcatctcaccgaaaacgaaatccgctttcctaaaaactaaaaaaaccaaacccgaacacaaaactaacttcgcaccactaaacccgcaatcgaatccccgaaaacgcgccacgaatcactactacctactaaaacgacacaaaacgccttcattcctcaaaccgaaacgaccgaacgccttaactctaaccgacaataaacacccactacgaatccgcacacactacaacgcccccgaacacgccccgcaatccgcccaacgtcccccgaaacgaaacacaaccaaaaaacgacccgaaaaccctactatccccgtcaacgccgcaaaaaaacgcgccttccccgctaaaccgaaacctttaccgaaccctctactatacgccgatcctaaaactaaaaccgccgtactaaaccgacctcaacccactattctacgaaaaccgcgtattaaacgacaacaaccacccaacccgaaaacaaccgttccgaacgcaaaaacgccaaaaaccccgcgccccgc

SEQ ID NO: 39451 - DNA, 533 bp, Artificial Sequence
  chemically treated genomic DNA (Homo sapiens) CpG-island No: 39451
tttttgggtcgttttattttatcgagagcgagattcgtttttttagaggttgggaggattaggttcgggtataggattggtttcgtattattggattcgtagtcgggttttcggggacgcgttacgggttattgttgtttgttaaagcgatataaggcgtttttattttttaggtcgaggcggtcgaacgttttggttttggtcgatagtgagtatttattgcgagttcgtatatattgtagcgttttcgggtacgtttcgtagttcgtttagcgtttttcggggcggggtatagttagaggacggttcgagagttttgttgttttcgttagcgtcgtaggagggcgcgtttttttcgttgggtcgaggtttttgtcgggttttttattgtacgtcggttttagggttgggatcgtcgtgttggatcgattttagtttattgttttgcggaggtcgcgtgttgggcgatagtagttatttagttcggaagtagtcgtttcgagcgtaggggcgttaagagtttcgcgtttcgt

SEQ ID NO: 39452 - DNA, 533 bp, Artificial Sequence
  chemically treated genomic DNA (Homo sapiens) CpG-island No: 39452
acgaaacgcgaaactcttaacgcccctacgctcgaaacgactacttccgaactaaataactactatcgcccaacacgcgacctccgcaaaacaataaactaaaatcgatccaacacgacgatcccaaccctaaaaccgacgtacaataaaaaacccgacaaaaacctcgacccaacgaaaaaaacgcgccctcctacgacgctaacgaaaacaacaaaactctcgaaccgtcctctaactataccccgccccgaaaaacgctaaacgaactacgaaacgtacccgaaaacgctacaatatatacgaactcgcaataaatactcactatcgaccaaaaccaaaacgttcgaccgcctcgacctaaaaaataaaaacgccttatatcgctttaacaaacaacaataacccgtaacgcgtccccgaaaacccgactacgaatccaataatacgaaaccaatcctatacccgaacctaatcctcccaacctctaaaaaaacgaatctcgctctcgataaaataaaacgacccaaaaa

SEQ ID NO: 39453 - DNA, 624 bp, Artificial Sequence
  chemically treated genomic DNA (Homo sapiens) CpG-island No: 39453
gttcgggtgagggcgcgggggcggattttagggcggggcgcggggtggcgtcggtggagtcggttcggcggcgcggttcgtagtgttgcggtcgggtttcgggcgtttcggcggttattatgtttagcgtcgtgtatttttttcggagtttttttaaggtgagagtcggcgttcgggatttgcggtcgggttttcggcgttttgcgcgggtggggaggagtatagttcgcgttggttgttgcgtttcgggtcgttttttgggtattcggtgggtggggatattttcgtggtttttcgtcgtttttaatttttcgacgtgtagatcggaggcggcgttttgtaaagtggggtcgtttcgagcgcggggaaggacggggtttcgttgggggcggtagggacggcggttcggggcgagtttttgagagggtaagggcgagcgtttgagtcggttttttcgtatttggatcgttttgggcgcgcggggtattcggagtcgttgtttggatcggtttgggcgcgtagggtattcggagtttttgtcgtttggcgtagtattagttgttttgggaaggagggttggtgtcggttcggtgggtacgggagaagtggttgttgttgttattt

SEQ ID NO: 39454 - DNA, 624 bp, Artificial Sequence
  chemically treated genomic DNA (Homo sapiens) CpG-island No: 39454
aaataacaacaacaaccacttctcccgtacccaccgaaccgacaccaaccctccttcccaaaacaactaatactacgccaaacgacaaaaactccgaataccctacgcgcccaaaccgatccaaacaacgactccgaataccccgcgcgcccaaaacgatccaaatacgaaaaaaccgactcaaacgctcgcccttaccctctcaaaaactcgccccgaaccgccgtccctaccgcccccaacgaaaccccgtccttccccgcgctcgaaacgaccccactttacaaaacgccgcctccgatctacacgtcgaaaaattaaaaacgacgaaaaaccacgaaaatatccccacccaccgaatacccaaaaaacgacccgaaacgcaacaaccaacgcgaactatactcctccccacccgcgcaaaacgccgaaaacccgaccgcaaatcccgaacgccgactctcaccttaaaaaaactccgaaaaaaatacacgacgctaaacataataaccgccgaaacgcccgaaacccgaccgcaacactacgaaccgcgccgccgaaccgactccaccgacgccaccccgcgccccgccctaaaatccgcccccgcgccctcacccgaac

SEQ ID NO: 39455 - DNA, 624 bp, Artificial Sequence
  chemically treated genomic DNA (Homo sapiens) CpG-island No: 39455
gaataataatagtaattatttttttcgtatttatcgggtcggtattagtttttttttttaaaatagttggtattgcgttaagcggtagaggtttcgagtgttttgcgcgtttaggtcggtttaggtagcggtttcgagtgtttcgcgcgtttaggacggtttaggtgcggggaggtcggtttaggcgttcgtttttgtttttttaggggttcgtttcgggtcgtcgtttttatcgtttttaacggagtttcgttttttttcgcgttcgagacggttttattttgtaggacgtcgttttcggtttgtacgtcggaaagttgggagcggcggggagttacgagggtgtttttatttatcgggtgtttaggggacggttcggggcgtagtagttagcgcgggttgtgtttttttttattcgcgtagggcgtcgggagttcgatcgtaagtttcggacgtcggtttttattttgaagaagtttcggaggaagtgtacgacgttgagtatggtggtcgtcgggacgttcggagttcggtcgtagtattacgagtcgcgtcgtcgagtcggttttatcgacgttatttcgcgtttcgttttagggttcgttttcgcgtttttattcggat

SEQ ID NO: 39456 - DNA, 624 bp, Artificial Sequence
  chemically treated genomic DNA (Homo sapiens) CpG-island No: 39456
atccgaataaaaacgcgaaaacgaaccctaaaacgaaacgcgaaataacgtcgataaaaccgactcgacgacgcgactcgtaatactacgaccgaactccgaacgtcccgacgaccaccatactcaacgtcgtacacttcctccgaaacttcttcaaaataaaaaccgacgtccgaaacttacgatcgaactcccgacgccctacgcgaataaaaaaaaacacaacccgcgctaactactacgccccgaaccgtcccctaaacacccgataaataaaaacaccctcgtaactccccgccgctcccaactttccgacgtacaaaccgaaaacgacgtcctacaaaataaaaccgtctcgaacgcgaaaaaaaacgaaactccgttaaaaacgataaaaacgacgacccgaaacgaacccctaaaaaaacaaaaacgaacgcctaaaccgacctccccgcacctaaaccgtcctaaacgcgcgaaacactcgaaaccgctacctaaaccgacctaaacgcgcaaaacactcgaaacctctaccgcttaacgcaataccaactattttaaaaaaaaaaactaataccgacccgataaatacgaaaaaaataattactattattattc

SEQ ID NO: 39457 - DNA, 574 bp, Artificial Sequence
  chemically treated genomic DNA (Homo sapiens) CpG-island No: 39457
attcgcggggtaggattaacgtagtttttcggggttttggcgatttatcgttgggggttcgtagtgtagtagggcgcggtcgcgataggttcgggtatcgcgtcggagcgcgagtcgcgtttagtattacggttagttttcggcgtcgcgcgtcgcggtcgggagggggaggttcggcgttcgtatttatttatcgcggttttaggggtttcgcggggtcgggtaggcgagggttaagtcgttagaggttagcgggaggggcgggtcggcgttggcgcgtaggggtggcgagggggcgcgtcggtcgcggtgggggttgtttcgttaggttgtcgtttttttgcgtcgtcgttcgggtcgcgttcgagtcggttttgtttgttcgtatcgtttcgtttttgtttttgggtgtttttgttttttattcggttgcggttgcgttttttttaggtgtagtcgttttttttcgttttcgtgcgtacggcgttttcgtcgttgttttttttttcgggagcgtataggtgtgggagttttttttttttagtttagagagttagtttagttttgtcgatcg

SEQ ID NO: 39458 - DNA, 574 bp, Artificial Sequence
  chemically treated genomic DNA (Homo sapiens) CpG-island No: 39458
cgatcgacaaaactaaactaactctctaaactaaaaaaaaaaaactcccacacctatacgctcccgaaaaaaaaaacaacgacgaaaacgccgtacgcacgaaaacgaaaaaaaacgactacacctaaaaaaaacgcaaccgcaaccgaataaaaaacaaaaacacccaaaaacaaaaacgaaacgatacgaacaaacaaaaccgactcgaacgcgacccgaacgacgacgcaaaaaaacgacaacctaacgaaacaacccccaccgcgaccgacgcgccccctcgccacccctacgcgccaacgccgacccgcccctcccgctaacctctaacgacttaaccctcgcctacccgaccccgcgaaacccctaaaaccgcgataaataaatacgaacgccgaacctccccctcccgaccgcgacgcgcgacgccgaaaactaaccgtaatactaaacgcgactcgcgctccgacgcgatacccgaacctatcgcgaccgcgccctactacactacgaacccccaacgataaatcgccaaaaccccgaaaaactacgttaatcctaccccgcgaat

SEQ ID NO: 39459 - DNA, 574 bp, Artificial Sequence
  chemically treated genomic DNA (Homo sapiens) CpG-island No: 39459
cggtcggtagggttgggttggttttttgggttgagggggaggggtttttatatttgtgcgttttcggaagaggggatagcggcgggggcgtcgtgcgtacgggggcgaggggagacgattgtatttgagggaggcgtagtcgtaatcgggtgggaggtagagatatttagaaatagagacggggcgatacgaatagataaagtcggttcgagcgcggttcgagcggcggcgtagggaggcggtagtttggcggagtagtttttatcgcggtcggcgcgttttttcgttatttttgcgcgttagcgtcggttcgtttttttcgttggtttttggcggtttaattttcgtttgttcgatttcgcggggtttttggagtcgcggtgggtgggtgcgggcgtcgggtttttttttttcggtcgcggcgcgcggcgtcgggagttgatcgtggtgttgagcgcggttcgcgtttcgacgcggtgttcgagtttgtcgcggtcgcgttttgttgtattgcgggtttttagcggtaagtcgttaaggtttcgagaggttgcgttggttttgtttcgcggat

SEQ ID NO: 39460 - DNA, 574 bp, Artificial Sequence
  chemically treated genomic DNA (Homo sapiens) CpG-island No: 39460
atccgcgaaacaaaaccaacgcaacctctcgaaaccttaacgacttaccgctaaaaacccgcaatacaacaaaacgcgaccgcgacaaactcgaacaccgcgtcgaaacgcgaaccgcgctcaacaccacgatcaactcccgacgccgcgcgccgcgaccgaaaaaaaaaaacccgacgcccgcacccacccaccgcgactccaaaaaccccgcgaaatcgaacaaacgaaaattaaaccgccaaaaaccaacgaaaaaaacgaaccgacgctaacgcgcaaaaataacgaaaaaacgcgccgaccgcgataaaaactactccgccaaactaccgcctccctacgccgccgctcgaaccgcgctcgaaccgactttatctattcgtatcgccccgtctctatttctaaatatctctacctcccacccgattacgactacgcctccctcaaatacaatcgtctcccctcgcccccgtacgcacgacgcccccgccgctatcccctcttccgaaaacgcacaaatataaaaacccctccccctcaacccaaaaaaccaacccaaccctaccgaccg

SEQ ID NO: 39461 - DNA, 1074 bp, Artificial Sequence
  chemically treated genomic DNA (Homo sapiens) CpG-island No: 39461
  misc_feature (124)..(126): n is either a, c, g or t
  misc_feature (135)..(136): n is either a, c, g or t
  misc_feature (141)..(144): n is either a, c, g or t
  misc_feature (150)..(153): n is either a, c, g or t
  misc_feature (163)..(163): n is either a, c, g or t
  misc_feature (165)..(165): n is either a, c, g or t
  misc_feature (192)..(192): n is either a, c, g or t
ttttcgggcgatattagggttttgggagattcgggaggttattgcgtttaggttttttacggttagttaggcgagaggcgggacgcgaagtcgcggtttttttttttttttttgaggcggtggnnngggtaaaannttttnnnntttttnnnncgggggtcgntngcggaggggcggggtttgttatagcgncgtcggttgacgcgaatgacgttgcgttagttaggtcgtagtttcgttgtttggttcgtcgggttcgttttggtcggttcggttcgttttcggttttttttgtacggtttttcgtgcgtttttgttagattgtggcggtcggtcgcgcggtgcgttttttttttttgttcgtagtttggagaggcgtttcgtgttgtatattttcgcgtttttgtcggtatcgcgtttgttttttgtcgcgtttcgttttgtcgtcgatcgtacgttcgtcgcgggatatggtatacgtatcggtacgttgttttagcgttcggggtttcggggacggcgagatgggtaagtttaggaacgtggcgtttattatcggtattataggttaggtgagtgcgggggcgggggcgcgtcggtcgaggtagtttgggtacgcgtgttttttttacgcgtcgttattcgtgggttgcggtttttttaggaatagttttttcggcgtttcggaaggggtttgttgtcgggaggtgggacggaaggtacggtgtagttagtgtgttgcgtgtggggtgtgcgggatatatcgagcgtttttggtttttttttgggggttgtgagcgtgtgtgtcgcgcgggatgtcgcgtttatattcgggtaggatcgttcgtttttatttgttttttaggtgatcgtagcgtttttttttttaagtttatgtcgtgtttcgtagtttttagtgtcggaaagggaaaagaatcggtgattaatgaatttgcgggtgaggtttttttgatgtgtttcggtttaaggggcgtttatttgttaacgtttgggaagtaagaaaaagggtgttttgttggtttcgttttttattatcggatttttagatagaaa

SEQ ID NO: 39462 - DNA, 1074 bp, Artificial Sequence
  chemically treated genomic DNA (Homo sapiens) CpG-island No: 39462
  misc_feature (883)..(883): n is either a, c, g or t
  misc_feature (910)..(910): n is either a, c, g or t
  misc_feature (912)..(912): n is either a, c, g or t
  misc_feature (922)..(925): n is either a, c, g or t
  misc_feature (931)..(934): n is either a, c, g or t
  misc_feature (939)..(940): n is either a, c, g or t
  misc_feature (949)..(951): n is either a, c, g or t
tttctatctaaaaatccgataataaaaaacgaaaccaacaaaacaccctttttcttacttcccaaacgttaacaaataaacgccccttaaaccgaaacacatcaaaaaaacctcacccgcaaattcattaatcaccgattcttttccctttccgacactaaaaactacgaaacacgacataaacttaaaaaaaaaaacgctacgatcacctaaaaaacaaataaaaacgaacgatcctacccgaatataaacgcgacatcccgcgcgacacacacgctcacaacccccaaaaaaaaaccaaaaacgctcgatatatcccgcacaccccacacgcaacacactaactacaccgtaccttccgtcccacctcccgacaacaaaccccttccgaaacgccgaaaaaactattcctaaaaaaaccgcaacccacgaataacgacgcgtaaaaaaaacacgcgtacccaaactacctcgaccgacgcgcccccgcccccgcactcacctaacctataataccgataataaacgccacgttcctaaacttacccatctcgccgtccccgaaaccccgaacgctaaaacaacgtaccgatacgtataccatatcccgcgacgaacgtacgatcgacgacaaaacgaaacgcgacaaaaaacaaacgcgataccgacaaaaacgcgaaaatatacaacacgaaacgcctctccaaactacgaacaaaaaaaaaaaacgcaccgcgcgaccgaccgccacaatctaacaaaaacgcacgaaaaaccgtacaaaaaaaaccgaaaacgaaccgaaccgaccaaaacgaacccgacgaaccaaacaacgaaactacgacctaactaacgcaacgtcattcgcgtcaaccgacgncgctataacaaaccccgcccctccgcnancgacccccgnnnnaaaaannnnaaaannttttacccnnnccaccgcctcaaaaaaaaaaaaaaaaaccgcgacttcgcgtcccgcctctcgcctaactaaccgtaaaaaacctaaacgcaataacctcccgaatctcccaaaaccctaatatcgcccgaaaa

SEQ ID NO: 39463 - DNA, 1074 bp, Artificial Sequence
  chemically treated genomic DNA (Homo sapiens) CpG-island No: 39463
  misc_feature (883)..(883): n is either a, c, g or t
  misc_feature (910)..(910): n is either a, c, g or t
  misc_feature (912)..(912): n is either a, c, g or t
  misc_feature (922)..(925): n is either a, c, g or t
  misc_feature (931)..(934): n is either a, c, g or t
  misc_feature (939)..(940): n is either a, c, g or t
  misc_feature (949)..(951): n is either a, c, g or t
tttttatttggaaattcggtgataggggacgaaattagtaaagtatttttttttttgttttttaaacgttagtaggtaagcgttttttgagtcgagatatattaagaagattttattcgtaagtttattgattatcggttttttttttttttcggtattaggagttgcgaagtacgatatgggtttggaggaagagacgttgcggttatttgaggggtaggtgagagcgggcggttttgttcgggtgtgagcgcgatatttcgcgcggtatatacgtttatagtttttagaggaagattagaggcgttcgatgtatttcgtatattttatacgtaatatattaattgtatcgtatttttcgttttatttttcggtagtagatttttttcgggacgtcgagagggttgtttttggagagatcgtagtttacgagtagcggcgcgtagggagagtacgcgtgtttaggttgtttcggtcggcgcgttttcgttttcgtatttatttggtttgtgatatcggtgatgagcgttacgtttttgggtttgtttatttcgtcgttttcggagtttcgggcgttggggtagcgtgtcggtgcgtgtgttatgtttcgcggcgggcgtgcggtcggcggtagggcggagcgcggtagagggtaggcgcggtgtcggtaggaacgcgggggtgtgtagtacgaagcgtttttttaggttgcgggtagggagggagagcgtatcgcgcgatcggtcgttatagtttgataggggcgtacgggaggtcgtgtagggagggtcgggggcgggtcgagtcggttaaggcgggttcgacgggttaagtagcggggttgcggtttgattggcgtagcgttattcgcgttagtcggcgncgttgtagtaggtttcgttttttcgtngncggttttcgnnnnggaggnnnnggggnnttttgtttnnnttatcgttttagggaagaggaaggaggtcgcggtttcgcgtttcgtttttcgtttggttggtcgtggggggtttggacgtagtggtttttcgaattttttaggattttaatatcgttcgagga

SEQ ID NO: 39464 - DNA, 1074 bp, Artificial Sequence
  chemically treated genomic DNA (Homo sapiens) CpG-island No: 39464
  misc_feature (124)..(126): n is either a, c, g or t
  misc_feature (135)..(136): n is either a, c, g or t
  misc_feature (141)..(144): n is either a, c, g or t
  misc_feature (150)..(153): n is either a, c, g or t
  misc_feature (163)..(163): n is either a, c, g or t
  misc_feature (165)..(165): n is either a, c, g or t
  misc_feature (192)..(192): n is either a, c, g or t
tcctcgaacgatattaaaatcctaaaaaattcgaaaaaccactacgtccaaaccccccacgaccaaccaaacgaaaaacgaaacgcgaaaccgcgacctccttcctcttccctaaaacgataannnaaacaaaannccccnnnncctccnnnncgaaaaccgncnacgaaaaaacgaaacctactacaacgncgccgactaacgcgaataacgctacgccaatcaaaccgcaaccccgctacttaacccgtcgaacccgccttaaccgactcgacccgcccccgaccctccctacacgacctcccgtacgcccctatcaaactataacgaccgatcgcgcgatacgctctccctccctacccgcaacctaaaaaaacgcttcgtactacacacccccgcgttcctaccgacaccgcgcctaccctctaccgcgctccgccctaccgccgaccgcacgcccgccgcgaaacataacacacgcaccgacacgctaccccaacgcccgaaactccgaaaacgacgaaataaacaaacccaaaaacgtaacgctcatcaccgatatcacaaaccaaataaatacgaaaacgaaaacgcgccgaccgaaacaacctaaacacgcgtactctccctacgcgccgctactcgtaaactacgatctctccaaaaacaaccctctcgacgtcccgaaaaaaatctactaccgaaaaataaaacgaaaaatacgatacaattaatatattacgtataaaatatacgaaatacatcgaacgcctctaatcttcctctaaaaactataaacgtatataccgcgcgaaatatcgcgctcacacccgaacaaaaccgcccgctctcacctacccctcaaataaccgcaacgtctcttcctccaaacccatatcgtacttcgcaactcctaataccgaaaaaaaaaaaaaaccgataatcaataaacttacgaataaaatcttcttaatatatctcgactcaaaaaacgcttacctactaacgtttaaaaaacaaaaaaaaaaatactttactaatttcgtcccctatcaccgaatttccaaataaaaa

SEQ ID NO: 39465 - DNA, 629 bp, Artificial Sequence
  chemically treated genomic DNA (Homo sapiens) CpG-island No: 39465
tcgtcgcgcggaaggagttagaaagcgagtcgcgttagttcgggagttgtcgttcgttggggttgttcgaggcgtagcggcggcggcggtcgcgggggcggagggcggagggcggagggcggtgggtgtttggtgggtgtgtgtttgtggcggagtagggtagaggttgcgcgcgggaggttaggcggggcgttttggggcgtcgttttttcgtttcgtagttagtcggttcggcgcgtatatagggttgcggttattttagtttttcgtttcgttttttttcgcgtttcgcgtattcgcgggttggagcggtcgtcgtttttttttttttttttttttttttttttttttttttagcgttttcggttgttaaggtgggcggcggggcgggatggttgggttgcgcgagtcggtagcgtatcgtcggggacgtcggggttttgtttcgcggcgtcggagttgtgcgttcggtcggggatagcgttttggtgtttagggcgcggttggggcgcgggtaggtatcgtttatatttcggcggggtgttttttttagttttcgcgcgttagttatttttgttgtttcgggtttggttttatatttatttgtttcgttttgtagtttttattcg

SEQ ID NO: 39466 - DNA, 629 bp, Artificial Sequence
  chemically treated genomic DNA (Homo sapiens) CpG-island No: 39466
cgaataaaaactacaaaacgaaacaaataaatataaaaccaaacccgaaacaacaaaaataactaacgcgcgaaaactaaaaaaaacaccccgccgaaatataaacgatacctacccgcgccccaaccgcgccctaaacaccaaaacgctatccccgaccgaacgcacaactccgacgccgcgaaacaaaaccccgacgtccccgacgatacgctaccgactcgcgcaacccaaccatcccgccccgccgcccaccttaacaaccgaaaacgctaaaaaaaaaaaaaaaaaaaaaaaaaaaaaaaaaaaaacgacgaccgctccaacccgcgaatacgcgaaacgcgaaaaaaaacgaaacgaaaaactaaaataaccgcaaccctatatacgcgccgaaccgactaactacgaaacgaaaaaacgacgccccaaaacgccccgcctaacctcccgcgcgcaacctctaccctactccgccacaaacacacacccaccaaacacccaccgccctccgccctccgccctccgcccccgcgaccgccgccgccgctacgcctcgaacaaccccaacgaacgacaactcccgaactaacgcgactcgctttctaactccttccgcgcgacga

SEQ ID NO: 39467 - DNA, 629 bp, Artificial Sequence
  chemically treated genomic DNA (Homo sapiens) CpG-island No: 39467
cgggtgggagttgtagagcgaagtaggtgggtgtggagttaggttcggggtagtaggagtggttggcgcgcggaagttgagggaggtatttcgtcgaggtgtgggcggtgtttgttcgcgttttagtcgcgttttgggtattagagcgttgttttcggtcgagcgtatagtttcggcgtcgcgaggtagagtttcggcgttttcggcggtgcgttgtcggttcgcgtagtttagttatttcgtttcgtcgtttattttgatagtcgggagcgttgaggaggaagagggggagggggaggaggaagagaaggcggcggtcgttttagttcgcgggtgcgcggagcgcgggaggaggcggagcgggaggttggggtggtcgtagttttgtgtgcgcgtcgggtcggttagttgcggggcgggggagcggcgttttagagcgtttcgtttagtttttcgcgcgtagtttttattttgtttcgttatagatatatatttattaagtatttatcgtttttcgtttttcgtttttcgttttcgcggtcgtcgtcgtcgttgcgtttcgggtagttttagcgagcggtaattttcgggttggcgcggttcgttttttggtttttttcgcgcggcga

SEQ ID NO: 39468 - DNA, 629 bp, Artificial Sequence
  chemically treated genomic DNA (Homo sapiens) CpG-island No: 39468
tcgccgcgcgaaaaaaaccaaaaaacgaaccgcgccaacccgaaaattaccgctcgctaaaactacccgaaacgcaacgacgacgacgaccgcgaaaacgaaaaacgaaaaacgaaaaacgataaatacttaataaatatatatctataacgaaacaaaataaaaactacgcgcgaaaaactaaacgaaacgctctaaaacgccgctcccccgccccgcaactaaccgacccgacgcgcacacaaaactacgaccaccccaacctcccgctccgcctcctcccgcgctccgcgcacccgcgaactaaaacgaccgccgccttctcttcctcctccccctccccctcttcctcctcaacgctcccgactatcaaaataaacgacgaaacgaaataactaaactacgcgaaccgacaacgcaccgccgaaaacgccgaaactctacctcgcgacgccgaaactatacgctcgaccgaaaacaacgctctaatacccaaaacgcgactaaaacgcgaacaaacaccgcccacacctcgacgaaatacctccctcaacttccgcgcgccaaccactcctactaccccgaacctaactccacacccacctacttcgctctacaactcccacccg

SEQ ID NO: 39469 - DNA, 586 bp, Artificial Sequence
  chemically treated genomic DNA (Homo sapiens) CpG-island No: 39469
gttgttatgtgtaggacgtttacggtttttcggcgtttcgcgcgttcgcggggttggaaggggcgggaaggggcgggtcggggtagagataggggttcgcgtttatcgtcgcgtcgggagtttggcgtggaggcggcgggacggcggcgtaggtttttgaggtgtgcgcggggcgtcgggcgtttttggtcggggtattggttgagttacgtttgttcgtttttttttggcgtcgttcgcgtggcgcgtttcgattttgttttttcgcgagggtcgggagggtttcgggattttgtagattttacgcgttttacggtttttttagtttttcggatttttttttttgcgtcgtcgtcgagttttttggggcggtttcgttttcggtcgtttttttagagattttttttggggggcgttttttttttagcgttttttttcgggtttcgagttagcggttgtcgtaggagttggtttcggggcgaggagtttcggatttaggtttttagtcggtttcggtaaggagattggaaggatttttcgcgaatgtttatttttatttttggagtggcgtcggagttattaatta

SEQ ID NO: 39470 - DNA, 586 bp, Artificial Sequence
  chemically treated genomic DNA (Homo sapiens) CpG-island No: 39470
taattaataactccgacgccactccaaaaataaaaataaacattcgcgaaaaatccttccaatctccttaccgaaaccgactaaaaacctaaatccgaaactcctcgccccgaaaccaactcctacgacaaccgctaactcgaaacccgaaaaaaaacgctaaaaaaaaaacgccccccaaaaaaaatctctaaaaaaacgaccgaaaacgaaaccgccccaaaaaactcgacgacgacgcaaaaaaaaaaatccgaaaaactaaaaaaaccgtaaaacgcgtaaaatctacaaaatcccgaaaccctcccgaccctcgcgaaaaaacaaaatcgaaacgcgccacgcgaacgacgccaaaaaaaaacgaacaaacgtaactcaaccaataccccgaccaaaaacgcccgacgccccgcgcacacctcaaaaacctacgccgccgtcccgccgcctccacgccaaactcccgacgcgacgataaacgcgaacccctatctctaccccgacccgccccttcccgccccttccaaccccgcgaacgcgcgaaacgccgaaaaaccgtaaacgtcctacacataacaac

SEQ ID NO: 39471 - DNA, 586 bp, Artificial Sequence
  chemically treated genomic DNA (Homo sapiens) CpG-island No: 39471
taattggtaatttcgacgttattttagaaataaaaatgagtattcgcggagaatttttttagtttttttatcgaggtcggttagggatttgaattcgaagtttttcgtttcggagttagtttttgcggtagtcgttggttcgaggttcgggaaggggcgttgaggggaaggcgttttttagggaaggtttttgaggagacggtcggaggcggggtcgttttaggggattcggcggcgacgtaaggagaaagattcgaggagttggaggagtcgtgaggcgcgtggagtttgtaaggtttcggagttttttcggttttcgcgggagagtagggtcgaggcgcgttacgcgggcggcgttagggaggggcgggtaggcgtggtttagttagtgtttcggttagaggcgttcggcgtttcgcgtatattttagaggtttgcgtcgtcgtttcgtcgtttttacgttaggttttcggcgcggcgatgggcgcgggtttttgtttttgtttcggttcgttttttttcgttttttttagtttcgcgaacgcgcgagacgtcgggggatcgtgggcgttttgtatatagtagt

SEQ ID NO: 39472 - DNA, 586 bp, Artificial Sequence
  chemically treated genomic DNA (Homo sapiens) CpG-island No: 39472
actactatatacaaaacgcccacgatcccccgacgtctcgcgcgttcgcgaaactaaaaaaaacgaaaaaaaacgaaccgaaacaaaaacaaaaacccgcgcccatcgccgcgccgaaaacctaacgtaaaaacgacgaaacgacgacgcaaacctctaaaatatacgcgaaacgccgaacgcctctaaccgaaacactaactaaaccacgcctacccgcccctccctaacgccgcccgcgtaacgcgcctcgaccctactctcccgcgaaaaccgaaaaaactccgaaaccttacaaactccacgcgcctcacgactcctccaactcctcgaatctttctccttacgtcgccgccgaatcccctaaaacgaccccgcctccgaccgtctcctcaaaaaccttccctaaaaaacgccttcccctcaacgccccttcccgaacctcgaaccaacgactaccgcaaaaactaactccgaaacgaaaaacttcgaattcaaatccctaaccgacctcgataaaaaaactaaaaaaattctccgcgaatactcatttttatttctaaaataacgtcgaaattaccaatta

SEQ ID NO: 39473 - DNA, 554 bp, Artificial Sequence
  chemically treated genomic DNA (Homo sapiens) CpG-island No: 39473
ttcgcgcggatttattcgcgtttcgggcgttgcgttacgtttcgtcgagggtcggttgcgttggtgcgggtttttcgttcgtcgtttcggcgtttcggttgtgcgtttttattcgttgggttcgttttagtcgttttttatcgattatcgtcgcggttcggtagagttgttagcggcgcgtcggtttagacgttttgttattcgttgttgtttggggttttggttgttaggcgttggaattattggcgaggaggtagtttcgaatttatagtgaggggcgttgttgttttttgggtttcggggacgaggttttgttttgtatttttttttttttcgtttcgtttcgggagattttttcggtttaattttttttttttcgggatattgacggtagtaaggatgatgttatagtcgtttcgtgttaattattagattagcgtttacggggtttcgaatttcgtttagcgaggggtcgtgagggagagcgagttgggggtataggagtattattttttgcggagattcgtgttttttaatattttttttttttgaat

SEQ ID NO: 39474 - DNA, 554 bp, Artificial Sequence
  chemically treated genomic DNA (Homo sapiens) CpG-island No: 39474
attcaaaaaaaaaaaatattaaaaaacacgaatctccgcaaaaaataatactcctatacccccaactcgctctccctcacgacccctcgctaaacgaaattcgaaaccccgtaaacgctaatctaataattaacacgaaacgactataacatcatccttactaccgtcaatatcccgaaaaaaaaaaaattaaaccgaaaaaatctcccgaaacgaaacgaaaaaaaaaaaaatacaaaacaaaacctcgtccccgaaacccaaaaaacaacaacgcccctcactataaattcgaaactacctcctcgccaataattccaacgcctaacaaccaaaaccccaaacaacaacgaataacaaaacgtctaaaccgacgcgccgctaacaactctaccgaaccgcgacgataatcgataaaaaacgactaaaacgaacccaacgaataaaaacgcacaaccgaaacgccgaaacgacgaacgaaaaacccgcaccaacgcaaccgaccctcgacgaaacgtaacgcaacgcccgaaacgcgaataaatccgcgcgaa

SEQ ID NO: 39475 - DNA, 554 bp, Artificial Sequence
  chemically treated genomic DNA (Homo sapiens) CpG-island No: 39475
gtttagaaaaaaaaaatgttgaagaatacgaattttcgtaggaaatgatatttttgtatttttagttcgtttttttttacgatttttcgttaggcggggttcgggatttcgtgaacgttgatttgatagttgatacgggacgattgtggtattatttttgttgtcgttagtatttcgagagggaggaggttgggtcgggagggtttttcggggcggggcggaggaggagggaatgtaaaatagagtttcgttttcggaatttaagaagtagtaacgttttttattataaattcggagttgttttttcgttaatgattttagcgtttgatagttaggattttaggtagtagcgagtgataggacgtttggatcggcgcgtcgttagtagttttgtcgggtcgcggcggtgatcgatggggagcggttggagcggatttagcgagtgagggcgtatagtcgggacgtcgaggcggcgggcgggagattcgtattagcgtagtcggttttcggcgggacgtgacgtagcgttcggggcgcgggtgagttcgcgcgga

SEQ ID NO: 39476 - DNA, 554 bp, Artificial Sequence
  chemically treated genomic DNA (Homo sapiens) CpG-island No: 39476
tccgcgcgaactcacccgcgccccgaacgctacgtcacgtcccgccgaaaaccgactacgctaatacgaatctcccgcccgccgcctcgacgtcccgactatacgccctcactcgctaaatccgctccaaccgctccccatcgatcaccgccgcgacccgacaaaactactaacgacgcgccgatccaaacgtcctatcactcgctactacctaaaatcctaactatcaaacgctaaaatcattaacgaaaaaacaactccgaatttataataaaaaacgttactacttcttaaattccgaaaacgaaactctattttacattccctcctcctccgccccgccccgaaaaaccctcccgacccaacctcctccctctcgaaatactaacgacaacaaaaataataccacaatcgtcccgtatcaactatcaaatcaacgttcacgaaatcccgaaccccgcctaacgaaaaatcgtaaaaaaaaacgaactaaaaatacaaaaatatcatttcctacgaaaattcgtattcttcaacattttttttttctaaac

SEQ ID NO: 39477 - DNA, 517 bp, Artificial Sequence
  chemically treated genomic DNA (Homo sapiens) CpG-island No: 39477
gtgggttcgggagggggagacgggaggaattacgttagatatgttgaaaggaagaaacgtaaagtatcgcgagttatatagatatattgtagagatagtttcgaattttgtttttgtatacgttcgttttttacgaatttatcgcgttttttgtcgcgagttttcgtgggcgtcgggttgttacgggaagcggtgcgtatgcgcggggacgtttaacggggtaggagttcgttaggttttttcgttatttttggaaattatcggagttttggcgattggaggggaaaaggttaggcgatttaagatggcggaggatttggacgagtttttggatgaagtcgagtttaagttttgtatatttgattttttaagacggggtatggtcgagtagtttaaaggttgcggcggcggtatttatagtagcgatcggaattaagttaaggcgaaagagacgtttaggttaatcgggcgggaggggtggattgttttggtaaagttttgttttaggttttagagt

SEQ ID NO: 39478 - DNA, 517 bp, Artificial Sequence
  chemically treated genomic DNA (Homo sapiens) CpG-island No: 39478
actctaaaacctaaaacaaaactttaccaaaacaatccacccctcccgcccgattaacctaaacgtctctttcgccttaacttaattccgatcgctactataaataccgccgccgcaacctttaaactactcgaccataccccgtcttaaaaaatcaaatatacaaaacttaaactcgacttcatccaaaaactcgtccaaatcctccgccatcttaaatcgcctaaccttttcccctccaatcgccaaaactccgataatttccaaaaataacgaaaaaacctaacgaactcctaccccgttaaacgtccccgcgcatacgcaccgcttcccgtaacaacccgacgcccacgaaaactcgcgacaaaaaacgcgataaattcgtaaaaaacgaacgtatacaaaaacaaaattcgaaactatctctacaatatatctatataactcgcgatactttacgtttcttcctttcaacatatctaacgtaattcctcccgtctccccctcccgaacccac

SEQ ID NO: 39479 - DNA, 517 bp, Artificial Sequence
  chemically treated genomic DNA (Homo sapiens) CpG-island No: 39479
gttttagggtttggagtagggttttattagaatagtttatttttttcgttcggttaatttgagcgtttttttcgttttggtttggtttcggtcgttattgtgggtgtcgtcgtcgtagtttttgggttgttcgattatatttcgttttagaaggttaggtgtgtaaaatttggattcgattttatttaagagttcgtttaggtttttcgttattttgaatcgtttggtttttttttttttaatcgttaaggtttcggtggtttttaggagtaacgaggggatttggcgggtttttgtttcgttaggcgttttcgcgtatgcgtatcgtttttcgtggtaattcggcgtttacgagggttcgcggtagagaacgcggtgggttcgtgaggggcgggcgtatgtagggatagagttcggagttgtttttgtagtgtgtttgtgtgattcgcgatgttttgcgttttttttttttagtatgtttggcgtggtttttttcgtttttttttttcgggtttat

SEQ ID NO: 39480 - DNA, 517 bp, Artificial Sequence
  chemically treated genomic DNA (Homo sapiens) CpG-island No: 39480
ataaacccgaaaaaaaaaaacgaaaaaaaccacgccaaacatactaaaaaaaaaaaacgcaaaacatcgcgaatcacacaaacacactacaaaaacaactccgaactctatccctacatacgcccgcccctcacgaacccaccgcgttctctaccgcgaaccctcgtaaacgccgaattaccacgaaaaacgatacgcatacgcgaaaacgcctaacgaaacaaaaacccgccaaatcccctcgttactcctaaaaaccaccgaaaccttaacgattaaaaaaaaaaaaaccaaacgattcaaaataacgaaaaacctaaacgaactcttaaataaaatcgaatccaaattttacacacctaaccttctaaaacgaaatataatcgaacaacccaaaaactacgacgacgacacccacaataacgaccgaaaccaaaccaaaacgaaaaaaacgctcaaattaaccgaacgaaaaaaataaactattctaataaaaccctactccaaaccctaaaac

SEQ ID NO: 39481 - DNA, 701 bp, Artificial Sequence
  chemically treated genomic DNA (Homo sapiens) CpG-island No: 39481
agaacgattttgggcggttgtattgattgtcgggtgtgggcggagcgaagggcgtttcggtcggtatggcgggtaggaagtgcgggtgcgcgtttgcgtataggtcgggtttgcggtgttatcgttttcgtttttgtttgagttagtttttacggtgacgtttttttttagttttttcgagtaggatcgtgtttaggggaggaggtagagtgcggtagtggggagggggcggagcgtagagcgtttgcgggggcgttcgggtaaggagtggggatttttggggatgggggtacgggaggaggcgtgggtgggcgataaggttgcgtggaggggaggggcggggggcgtcggggcgggagacggaggggatttgttttgggggagttcggtttttttttagttttgttcggggtacgtcggtgatttcgtgtgtttgtttcgtggtagtattttcgtgggtcgtttgtttttttttttagttcgtttttattcgcggtttcgtttttagagtagggttttttattcgcggggtttcgggttttttattcggtatttttgttagaggggatcgtttttcggcgcgtcgggtattcgttttttttattttttttttttttaggagaaattgaatacgttttttagtttaaattcggtagggtaaattagaatatttttcgtttaagtagtttcggggagtttta

SEQ ID NO: 39482 - DNA, 701 bp, Artificial Sequence
  chemically treated genomic DNA (Homo sapiens) CpG-island No: 39482
taaaactccccgaaactacttaaacgaaaaatattctaatttaccctaccgaatttaaactaaaaaacgtattcaatttctcctaaaaaaaaaaaaaataaaaaaaacgaatacccgacgcgccgaaaaacgatcccctctaacaaaaataccgaataaaaaacccgaaaccccgcgaataaaaaaccctactctaaaaacgaaaccgcgaataaaaacgaactaaaaaaaaaaacaaacgacccacgaaaatactaccacgaaacaaacacacgaaatcaccgacgtaccccgaacaaaactaaaaaaaaaccgaactcccccaaaacaaatcccctccgtctcccgccccgacgccccccgcccctcccctccacgcaaccttatcgcccacccacgcctcctcccgtacccccatccccaaaaatccccactccttacccgaacgcccccgcaaacgctctacgctccgccccctccccactaccgcactctacctcctcccctaaacacgatcctactcgaaaaaactaaaaaaaaacgtcaccgtaaaaactaactcaaacaaaaacgaaaacgataacaccgcaaacccgacctatacgcaaacgcgcacccgcacttcctacccgccataccgaccgaaacgcccttcgctccgcccacacccgacaatcaatacaaccgcccaaaatcgttct

SEQ ID NO: 39483 - DNA, 701 bp, Artificial Sequence
  chemically treated genomic DNA (Homo sapiens) CpG-island No: 39483
taaaatttttcggaattgtttagacggggaatgttttggtttgttttgtcgagtttaggttggaaaacgtgtttagttttttttgaagagggaaggggtgaaagagacgaatgttcgacgcgtcgggaggcggttttttttggtagaggtgtcgggtgaggagttcgaagtttcgcgggtgagaaattttgttttgaaagcggagtcgcggataagggcgggttgagggggagggtaggcggtttacgaaagtattgttacggggtagatatacggggttatcggcgtgtttcgggtaaggttaggggagaatcgggtttttttaggatagatttttttcgtttttcgtttcggcgtttttcgttttttttttttacgtagttttatcgtttatttacgttttttttcgtatttttatttttaaggatttttattttttgttcgggcgttttcgtaggcgttttgcgtttcgttttttttttattgtcgtattttgtttttttttttgggtacgattttattcggaaaagttggggaaaagcgttatcgtgaggattgatttaagtagaagcgaaagcggtgatatcgtagattcgatttatgcgtaggcgcgtattcgtattttttgttcgttatatcggtcggggcgtttttcgtttcgtttatattcggtagttaatatagtcgtttagagtcgtttt

SEQ ID NO: 39484 - DNA, 701 bp, Artificial Sequence
  chemically treated genomic DNA (Homo sapiens) CpG-island No: 39484
aaaacgactctaaacgactatattaactaccgaatataaacgaaacgaaaaacgccccgaccgatataacgaacaaaaaatacgaatacgcgcctacgcataaatcgaatctacgatatcaccgctttcgcttctacttaaatcaatcctcacgataacgcttttccccaacttttccgaataaaatcgtacccaaaaaaaaaaacaaaatacgacaataaaaaaaaaacgaaacgcaaaacgcctacgaaaacgcccgaacaaaaaataaaaatccttaaaaataaaaatacgaaaaaaaacgtaaataaacgataaaactacgtaaaaaaaaaaaacgaaaaacgccgaaacgaaaaacgaaaaaaatctatcctaaaaaaacccgattctcccctaaccttacccgaaacacgccgataaccccgtatatctaccccgtaacaatactttcgtaaaccgcctaccctccccctcaacccgcccttatccgcgactccgctttcaaaacaaaatttctcacccgcgaaacttcgaactcctcacccgacacctctaccaaaaaaaaccgcctcccgacgcgtcgaacattcgtctctttcaccccttccctcttcaaaaaaaactaaacacgttttccaacctaaactcgacaaaacaaaccaaaacattccccgtctaaacaattccgaaaaatttta

SEQ ID NO: 39485 - DNA, 517 bp, Artificial Sequence
  chemically treated genomic DNA (Homo sapiens) CpG-island No: 39485
tcgttttttgattttttttacgtgatttcgggttattttgtaatcgttatatcgttttttgattttttttacgtgatttcgggttattttgtaatcgttatatcgttttttgattttgtttacgtgatttcgggttattttgtaatcgttatatcgttttttgattttttttacgtgatttcgggttattttgtaatttttatatcgttttttgattttgtttacgtgatttcgggttattttgtaattattatatcgttttttgattttttttacgtgatttcgggttattttgtaatcgttatatcgttttttgattttgtttacgtgatttcgggttattttgtaatcgttatatcgttttttgattttgtttacgtgatggttttattattttttcggtcggagagaaatcgtttttaaattttgtttcgttttttttcgtagtttttttggttttggttgagcggggtcggtttatacggtttagatcgtgataaatgtttagtaataaatg

SEQ ID NO: 39486 - DNA, 517 bp, Artificial Sequence
  chemically treated genomic DNA (Homo sapiens) CpG-island No: 39486
catttattactaaacatttatcacgatctaaaccgtataaaccgaccccgctcaaccaaaaccaaaaaaactacgaaaaaaaacgaaacaaaatttaaaaacgatttctctccgaccgaaaaaataataaaaccatcacgtaaacaaaatcaaaaaacgatataacgattacaaaataacccgaaatcacgtaaacaaaatcaaaaaacgatataacgattacaaaataacccgaaatcacgtaaaaaaaatcaaaaaacgatataataattacaaaataacccgaaatcacgtaaacaaaatcaaaaaacgatataaaaattacaaaataacccgaaatcacgtaaaaaaaatcaaaaaacgatataacgattacaaaataacccgaaatcacgtaaacaaaatcaaaaaacgatataacgattacaaaataacccgaaatcacgtaaaaaaaatcaaaaaacgatataacgattacaaaataacccgaaatcacgtaaaaaaaatcaaaaaacga

SEQ ID NO: 39487 - DNA, 517 bp, Artificial Sequence
  chemically treated genomic DNA (Homo sapiens) CpG-island No: 39487
tatttattgttggatatttgttacggtttgagtcgtgtggatcggtttcgtttagttagagttaggagggttacgaggggaggcggggtagggtttggggacgattttttttcgatcgaaggagtaatggggttattacgtaggtaaggttaaaggacgatgtggcggttgtagggtgattcgaggttacgtaggtaaggttaaaggacgatgtggcggttgtagggtgattcgaggttacgtagggaaggttaaaggacgatgtggtggttgtagggtgattcgaggttacgtaggtaaggttaaaggacgatgtgggggttgtagggtgattcgaggttacgtagggaaggttaaaggacgatgtggcggttgtagggtgattcgaggttacgtaggtaaggttaaaggacgatgtggcggttgtagggtgattcgaggttacgtagggaaggttaaaggacgatgtggcggttgtagggtgattcgaggttacgtagggaaggttaaaggacga

SEQ ID NO: 39488 - DNA, 517 bp, Artificial Sequence
  chemically treated genomic DNA (Homo sapiens) CpG-island No: 39488
tcgtcctttaaccttccctacgtaacctcgaatcaccctacaaccgccacatcgtcctttaaccttccctacgtaacctcgaatcaccctacaaccgccacatcgtcctttaaccttacctacgtaacctcgaatcaccctacaaccgccacatcgtcctttaaccttccctacgtaacctcgaatcaccctacaacccccacatcgtcctttaaccttacctacgtaacctcgaatcaccctacaaccaccacatcgtcctttaaccttccctacgtaacctcgaatcaccctacaaccgccacatcgtcctttaaccttacctacgtaacctcgaatcaccctacaaccgccacatcgtcctttaaccttacctacgtaataaccccattactccttcgatcgaaaaaaaatcgtccccaaaccctaccccgcctcccctcgtaaccctcctaactctaactaaacgaaaccgatccacacgactcaaaccgtaacaaatatccaacaataaata

SEQ ID NO: 39489 - DNA, 507 bp, Artificial Sequence
  chemically treated genomic DNA (Homo sapiens) CpG-island No: 39489
tttttttcgggggtttggggagtaggggttgggcgtgaggggcgcgcgatttaggttttgttagttcggaagtcgtaggtagtcgtaggtcggatattttttatttttcgttttcgttttattcgttttatcggtatttgcggtggtttgggcggggcggggtttcgtttatttggggagtcgaggagtaggggtatttaaattgcgggtaggatatggcgggcgcggttcggggcggacgggcggggtttgtagggttttgcgcgttggggtcggcgtggcgcggttattgtttcggagttgtaggtttttaggcgttgggagggcgaagtaggagagtcggttagtttattttcgcgtttcgtaaatttttttaatcgggtaataaagtgagtagcggtggtcgtcgcgatttttttaatttcgtatttcggaggttcgagggggttttgggatcgagcggtttcgtagcggcgatagaaatatatattttacgaaaaagaaaaa

SEQ ID NO: 39490 - DNA, 507 bp, Artificial Sequence
  chemically treated genomic DNA (Homo sapiens) CpG-island No: 39490
tttttctttttcgtaaaatatatatttctatcgccgctacgaaaccgctcgatcccaaaaccccctcgaacctccgaaatacgaaattaaaaaaatcgcgacgaccaccgctactcactttattacccgattaaaaaaatttacgaaacgcgaaaataaactaaccgactctcctacttcgccctcccaacgcctaaaaacctacaactccgaaacaataaccgcgccacgccgaccccaacgcgcaaaaccctacaaaccccgcccgtccgccccgaaccgcgcccgccatatcctacccgcaatttaaatacccctactcctcgactccccaaataaacgaaaccccgccccgcccaaaccaccgcaaataccgataaaacgaataaaacgaaaacgaaaaataaaaaatatccgacctacgactacctacgacttccgaactaacaaaacctaaatcgcgcgcccctcacgcccaacccctactccccaaacccccgaaaaaaa

SEQ ID NO: 39491 - DNA, 507 bp, Artificial Sequence
  chemically treated genomic DNA (Homo sapiens) CpG-island No: 39491
tttttttttttcgtaaaatatgtatttttgtcgtcgttgcgaggtcgttcggttttagagttttttcgagttttcggaatgcgaagttaaaggaatcgcggcggttatcgttgtttattttgttattcggttagaaaagtttgcggagcgcggggatggattaatcggtttttttgtttcgtttttttagcgtttagaagtttgtagtttcggagtagtggtcgcgttacgtcggttttagcgcgtagaattttgtaggtttcgttcgttcgtttcgggtcgcgttcgttatgttttattcgtagtttggatatttttatttttcggttttttaggtaagcggagtttcgtttcgtttaggttatcgtaggtgtcggtagggcggatggggcggggacggggggtggggagtgttcgatttacgattgtttgcggttttcgagttagtaaggtttgggtcgcgcgttttttacgtttaatttttgttttttaaattttcggggaaag

SEQ ID NO: 39492 - DNA, 507 bp, Artificial Sequence
  chemically treated genomic DNA (Homo sapiens) CpG-island No: 39492
ctttccccgaaaatttaaaaaacaaaaattaaacgtaaaaaacgcgcgacccaaaccttactaactcgaaaaccgcaaacaatcgtaaatcgaacactccccaccccccgtccccgccccatccgccctaccgacacctacgataacctaaacgaaacgaaactccgcttacctaaaaaaccgaaaaataaaaatatccaaactacgaataaaacataacgaacgcgacccgaaacgaacgaacgaaacctacaaaattctacgcgctaaaaccgacgtaacgcgaccactactccgaaactacaaacttctaaacgctaaaaaaacgaaacaaaaaaaccgattaatccatccccgcgctccgcaaacttttctaaccgaataacaaaataaacaacgataaccgccgcgattcctttaacttcgcattccgaaaactcgaaaaaactctaaaaccgaacgacctcgcaacgacgacaaaaatacatattttacgaaaaaaaaaaa

SEQ ID NO: 39493 - DNA, 829 bp, Artificial Sequence
  chemically treated genomic DNA (Homo sapiens) CpG-island No: 39493
tttcgtcgtttgttttttgggtacggtttgaggttggacggagcgtcgttcgggcgtttaggatttaggtttggttatttcgagttttttatttttcgtttcgcgtcggttcgcgtattttgtttttcgtaatttgtagtaaacgtagcggtttttggagagtttagcgacgggtagtaaattttgtttttttaagcgtaagagtaattttcgtaaagtttgtgcggcggagtttattttttatttgagttggggaagttttcgttcgcgtcgtgtggttgtcggggtcgcggggagtagttcgtagttcgggacgtatcggggagtcgtcgtagtcgtcgtcgttcgtttttttcggcggtcgcgcggagttttcgttttttcggaaggggggaggggtttcggaatttcggggcgggggcgggagcgggggattttatttatttgcggtggcgttgggtcgttttcggtagttcgcgagggtttcgcgcggaagttcggcgcgcgcgttttagcggggagtcggcgataattaatggagatatttttaggcggagtatttggcgagcggagcgcgtcggcgtttttaggcgtcgcggtcgttagtcgagttcgtatcggcgtgacgtgggcgagcgagcgcgttgtttttattcggtcgtttattaacgttttttttcgcgggcgtcgcgtttttgttaattttttttttcgttcggtttgcgcgcggcgcgtcgggtgtaggagttggggtgagggcgtttcgggtgttagtaggggcgttgggagttgtttgggcggggacgtagggtttcgggaggttatatag

SEQ ID NO: 39494 - DNA, 829 bp, Artificial Sequence
  chemically treated genomic DNA (Homo sapiens) CpG-island No: 39494
ctatataacctcccgaaaccctacgtccccgcccaaacaactcccaacgcccctactaacacccgaaacgccctcaccccaactcctacacccgacgcgccgcgcgcaaaccgaacgaaaaaaaaaattaacaaaaacgcgacgcccgcgaaaaaaaacgttaataaacgaccgaataaaaacaacgcgctcgctcgcccacgtcacgccgatacgaactcgactaacgaccgcgacgcctaaaaacgccgacgcgctccgctcgccaaatactccgcctaaaaatatctccattaattatcgccgactccccgctaaaacgcgcgcgccgaacttccgcgcgaaaccctcgcgaactaccgaaaacgacccaacgccaccgcaaataaataaaatcccccgctcccgcccccgccccgaaattccgaaacccctccccccttccgaaaaaacgaaaactccgcgcgaccgccgaaaaaaacgaacgacgacgactacgacgactccccgatacgtcccgaactacgaactactccccgcgaccccgacaaccacacgacgcgaacgaaaacttccccaactcaaataaaaaataaactccgccgcacaaactttacgaaaattactcttacgcttaaaaaaacaaaatttactacccgtcgctaaactctccaaaaaccgctacgtttactacaaattacgaaaaacaaaatacgcgaaccgacgcgaaacgaaaaataaaaaactcgaaataaccaaacctaaatcctaaacgcccgaacgacgctccgtccaacctcaaaccgtacccaaaaaacaaacgacgaaa

SEQ ID NO: 39495 - DNA, 829 bp, Artificial Sequence
  chemically treated genomic DNA (Homo sapiens) CpG-island No: 39495
ttgtgtgatttttcggagttttacgttttcgtttaaatagtttttagcgtttttgttggtattcggggcgtttttattttagtttttgtattcggcgcgtcgcgcgtagatcggacggaggggaaagttggtaagagcgcggcgttcgcgggagaaagcgttaatgggcggtcgggtgggagtagcgcgttcgttcgtttacgttacgtcggtgcgggttcggttgacgatcgcggcgtttggggacgtcggcgcgtttcgttcgttaggtgtttcgtttggaaatgtttttattagttgtcgtcggtttttcgttggagcgcgcgcgtcgagttttcgcgcggagttttcgcgggttgtcgggagcggtttagcgttatcgtaggtaggtgaggtttttcgttttcgttttcgtttcggggtttcgagattttttttttttttcgaggaggcggaggtttcgcgcggtcgtcgaggggagcgggcggcggcggttgcggcgatttttcggtgcgtttcgggttgcgagttgtttttcgcggtttcggtagttatacggcgcgggcgggagtttttttagtttaggtagggagtgggtttcgtcgtataaattttgcgaggattgtttttgcgtttaaggggataaagtttgttattcgtcgttaggttttttagaggtcgttgcgtttgttgtaagttgcgggaagtagggtgcgcgggtcggcgcggggcggggggtggggggttcggagtggttaggtttgagttttggacgttcggacggcgtttcgtttagttttaggtcgtatttagggagtaagcggcgggg

SEQ ID NO: 39496 - DNA, 829 bp, Artificial Sequence
  chemically treated genomic DNA (Homo sapiens) CpG-island No: 39496
ccccgccgcttactccctaaatacgacctaaaactaaacgaaacgccgtccgaacgtccaaaactcaaacctaaccactccgaaccccccaccccccgccccgcgccgacccgcgcaccctacttcccgcaacttacaacaaacgcaacgacctctaaaaaacctaacgacgaataacaaactttatccccttaaacgcaaaaacaatcctcgcaaaatttatacgacgaaacccactccctacctaaactaaaaaaactcccgcccgcgccgtataactaccgaaaccgcgaaaaacaactcgcaacccgaaacgcaccgaaaaatcgccgcaaccgccgccgcccgctcccctcgacgaccgcgcgaaacctccgcctcctcgaaaaaaaaaaaaaatctcgaaaccccgaaacgaaaacgaaaacgaaaaacctcacctacctacgataacgctaaaccgctcccgacaacccgcgaaaactccgcgcgaaaactcgacgcgcgcgctccaacgaaaaaccgacgacaactaataaaaacatttccaaacgaaacacctaacgaacgaaacgcgccgacgtccccaaacgccgcgatcgtcaaccgaacccgcaccgacgtaacgtaaacgaacgaacgcgctactcccacccgaccgcccattaacgctttctcccgcgaacgccgcgctcttaccaactttcccctccgtccgatctacgcgcgacgcgccgaatacaaaaactaaaataaaaacgccccgaataccaacaaaaacgctaaaaactatttaaacgaaaacgtaaaactccgaaaaatcacacaa

SEQ ID NO: 39497 - DNA, 720 bp, Artificial Sequence
  chemically treated genomic DNA (Homo sapiens) CpG-island No: 39497
gtttggggacgattttttttcgatcgaaggagtaatggggttattacgtaggtaaggttaaaggacgatgtggcggttgtagggtgattcgaggttacgtaggtaaggttaaaggacgatgtggcggttgtagggtgattcgaggttacgtagggaaggttaaaggacgatgtggtggttgtagggtgattcgaggttacgtaggtaaggttaaaggacgatgtgggggttgtagggtgattcgaggttacgtagggaaggttaaaggacgatgtggcggttgtagggtgattcgaggttacgtaggtaaggttaaaggacgatgtggcggttgtagggtgattcgaggttacgtagggaaggttaaaggacgatgtggcggttgtagggtgattcgaggttacgtagggaaggttaaaggacgatgtgggggttgtagggtgattcgaggttacgtaggtaaggttaaaggacgatgtggcggttgtagggtgattcgaggttacgtagggaaggttaaaggacgatgtgggggttgtagggtgattcgaggttacgtagggaaggttaaaggacgatgtgggggttgtagggtgattcgaggttatgtaggtaaggttaaaggacgatgtggcggttgtagggtgattcgaggttatgtaggtaaggttaaaggacgatgtgagggttgtaggggtgattcgaggttagtagtttttt

SEQ ID NO: 39498 - DNA, 720 bp, Artificial Sequence
  chemically treated genomic DNA (Homo sapiens) CpG-island No: 39498
aaaaaactactaacctcgaatcacccctacaaccctcacatcgtcctttaaccttacctacataacctcgaatcaccctacaaccgccacatcgtcctttaaccttacctacataacctcgaatcaccctacaacccccacatcgtcctttaaccttccctacgtaacctcgaatcaccctacaacccccacatcgtcctttaaccttccctacgtaacctcgaatcaccctacaaccgccacatcgtcctttaaccttacctacgtaacctcgaatcaccctacaacccccacatcgtcctttaaccttccctacgtaacctcgaatcaccctacaaccgccacatcgtcctttaaccttccctacgtaacctcgaatcaccctacaaccgccacatcgtcctttaaccttacctacgtaacctcgaatcaccctacaaccgccacatcgtcctttaaccttccctacgtaacctcgaatcaccctacaacccccacatcgtcctttaaccttacctacgtaacctcgaatcaccctacaaccaccacatcgtcctttaaccttccctacgtaacctcgaatcaccctacaaccgccacatcgtcctttaaccttacctacgtaacctcgaatcaccctacaaccgccacatcgtcctttaaccttacctacgtaataaccccattactccttcgatcgaaaaaaaatcgtccccaaac

SEQ ID NO: 39499 - DNA, 720 bp, Artificial Sequence
  chemically treated genomic DNA (Homo sapiens) CpG-island No: 39499
aaaggattgttggtttcgggttatttttgtaatttttatatcgttttttgattttgtttatatgatttcgggttattttgtaatcgttatatcgttttttgattttgtttatatgatttcgggttattttgtaatttttatatcgttttttgattttttttacgtgatttcgggttattttgtaatttttatatcgttttttgattttttttacgtgatttcgggttattttgtaatcgttatatcgttttttgattttgtttacgtgatttcgggttattttgtaatttttatatcgttttttgattttttttacgtgatttcgggttattttgtaatcgttatatcgttttttgattttttttacgtgatttcgggttattttgtaatcgttatatcgttttttgattttgtttacgtgatttcgggttattttgtaatcgttatatcgttttttgattttttttacgtgatttcgggttattttgtaatttttatatcgttttttgattttgtttacgtgatttcgggttattttgtaattattatatcgttttttgattttttttacgtgatttcgggttattttgtaatcgttatatcgttttttgattttgtttacgtgatttcgggttattttgtaatcgttatatcgttttttgattttgtttacgtgatggttttattattttttcggtcggagagaaatcgtttttaaat

SEQ ID NO: 39500 - DNA, 720 bp, Artificial Sequence
  chemically treated genomic DNA (Homo sapiens) CpG-island No: 39500
atttaaaaacgatttctctccgaccgaaaaaataataaaaccatcacgtaaacaaaatcaaaaaacgatataacgattacaaaataacccgaaatcacgtaaacaaaatcaaaaaacgatataacgattacaaaataacccgaaatcacgtaaaaaaaatcaaaaaacgatataataattacaaaataacccgaaatcacgtaaacaaaatcaaaaaacgatataaaaattacaaaataacccgaaatcacgtaaaaaaaatcaaaaaacgatataacgattacaaaataacccgaaatcacgtaaacaaaatcaaaaaacgatataacgattacaaaataacccgaaatcacgtaaaaaaaatcaaaaaacgatataacgattacaaaataacccgaaatcacgtaaaaaaaatcaaaaaacgatataaaaattacaaaataacccgaaatcacgtaaacaaaatcaaaaaacgatataacgattacaaaataacccgaaatcacgtaaaaaaaatcaaaaaacgatataaaaattacaaaataacccgaaatcacgtaaaaaaaatcaaaaaacgatataaaaattacaaaataacccgaaatcatataaacaaaatcaaaaaacgatataacgattacaaaataacccgaaatcatataaacaaaatcaaaaaacgatataaaaattacaaaaataacccgaaaccaacaatccttt

SEQ ID NO: 39501 - DNA, 523 bp, Artificial Sequence
  chemically treated genomic DNA (Homo sapiens) CpG-island No: 39501
ggggtttcgaatagtgtcgtattttgtgggtatacgtcgggtagatagaaagtatagacgcgacgcgttcggtttttcgtcgggcgtcgggttttggtgttgtcgtttaggtgttggtttttagttttaagttcgtttcgtagtcggcgttgcgggtgagatcgttcgtaagtatttagtttattggcggttgtttattagcggtttatttttttcggggcgtttaaagtttttcgttcggtattgtttcgggagcgaacgttgagtttttgggatttagtttcgattcggcgtagcggtttttttttcggtttgcgttcgggagaatttttttcgtcgtggcgtcggacggcgatgttagggttgagcggtgagttgtttcgggtttcgcgttttgatcgcggattagttttagggtttcgtcgcggaagtagggggcgcgtttggggttagtttgtagattttagagttcggcggtaggattttcggcgttattcggatatttggtagtagttttcgtttg

SEQ ID NO: 39502 - DNA, 523 bp, Artificial Sequence
  chemically treated genomic DNA (Homo sapiens) CpG-island No: 39502
caaacgaaaactactaccaaatatccgaataacgccgaaaatcctaccgccgaactctaaaatctacaaactaaccccaaacgcgccccctacttccgcgacgaaaccctaaaactaatccgcgatcaaaacgcgaaacccgaaacaactcaccgctcaaccctaacatcgccgtccgacgccacgacgaaaaaaattctcccgaacgcaaaccgaaaaaaaaaccgctacgccgaatcgaaactaaatcccaaaaactcaacgttcgctcccgaaacaataccgaacgaaaaactttaaacgccccgaaaaaaataaaccgctaataaacaaccgccaataaactaaatacttacgaacgatctcacccgcaacgccgactacgaaacgaacttaaaactaaaaaccaacacctaaacgacaacaccaaaacccgacgcccgacgaaaaaccgaacgcgtcgcgtctatactttctatctacccgacgtatacccacaaaatacgacactattcgaaacccc

SEQ ID NO: 39503 - DNA, 523 bp, Artificial Sequence
  chemically treated genomic DNA (Homo sapiens) CpG-island No: 39503
taggcgagaattgttgttaggtgttcgggtggcgtcgggggttttgtcgtcggattttggggtttataggttggttttaggcgcgttttttgttttcgcggcgggattttgaggttggttcgcggttaaagcgcgggattcgggatagtttatcgtttagttttggtatcgtcgttcgacgttacgacggagggggttttttcgggcgtaagtcgagagggaaatcgttgcgtcgagtcggggttgggttttaggggtttagcgttcgttttcggggtaatgtcgggcggggagttttaggcgtttcgaggaaagtgagtcgttggtaggtagtcgttagtaaattgagtgtttgcgggcgattttattcgtagcgtcgattacgaggcgggtttggagttggggattagtatttgagcgatagtattaggattcgacgttcgacgaggggtcgagcgcgtcgcgtttatattttttatttgttcggcgtgtgtttatagaatgcggtattattcggggtttt

SEQ ID NO: 39504 - DNA, 523 bp, Artificial Sequence
  chemically treated genomic DNA (Homo sapiens) CpG-island No: 39504
aaaaccccgaataataccgcattctataaacacacgccgaacaaataaaaaatataaacgcgacgcgctcgacccctcgtcgaacgtcgaatcctaatactatcgctcaaatactaatccccaactccaaacccgcctcgtaatcgacgctacgaataaaatcgcccgcaaacactcaatttactaacgactacctaccaacgactcactttcctcgaaacgcctaaaactccccgcccgacattaccccgaaaacgaacgctaaacccctaaaacccaaccccgactcgacgcaacgatttccctctcgacttacgcccgaaaaaaccccctccgtcgtaacgtcgaacgacgataccaaaactaaacgataaactatcccgaatcccgcgctttaaccgcgaaccaacctcaaaatcccgccgcgaaaacaaaaaacgcgcctaaaaccaacctataaaccccaaaatccgacgacaaaacccccgacgccacccgaacacctaacaacaattctcgccta

SEQ ID NO: 39505 - DNA, 1028 bp, Artificial Sequence
  chemically treated genomic DNA (Homo sapiens) CpG-island No: 39505
gcggtgcgcgtttttcgtatcgcgcgtatatttttgtatatatatttggagcgcgtttcgggggggagggggaggagagttaaaacgagcgttttaaaatagagagttaggtagaggagcgcgagatattagagcgggaggtagcgattgagagtcgtcgggtattaggcgcgtaggtcggcgtcggagtggtacgggcgggcgggggcggggtgggcgcggacgttttttagtatatatttcgtattcggttttgtaggaagttcgcgttgattgatagttgcgttgttttaaaaaggtttagcgaagatgttgatttgcgggtgggtttagacgcgcggtaggcgcgttcgttattcgttttttttcgcgcgttattcgagtttcgtcgtttttttagttgtcgggagcggggtttaggtttcgtcgtcgcgttagtttcgcggttttagcgggtcgggtattcgtagtcgcgttcgggtcggcggacgttcgcgtcggtttattatgtattgttacgtcgagttgaggttgagttcgttcggttagtttaaagtagttaggcggcgttataagatttttatgatcgacgagattttttttaaggagatttgcgattattttgagaaattttttttttatttcgtgtgttcgtcgttggtcgtgcgatttaagtttttgtatttttgtacgggtaagacgtttcgttaggggataagtggggttcggtagtttttacgttcgtgtaggtggtttgtgttttgcgattcgagggcgagaggaagggttaagttaagggattttttttttgcgttttagtaagcggtgggtattgtaaaggtatttgcgacgtggtcgggaaggattacgtaaggtgtggatggtacgagtggaaataaaggcggtagggttttaggagtgggttgttcgcgtaacgtttgattgttttgttcggaggagaacgttttttcgttttttgttgaaagtttaaatatttgagtaggtttagcgtttaaatcgttgtttta

SEQ ID NO: 39506 - DNA, 1028 bp, Artificial Sequence
  chemically treated genomic DNA (Homo sapiens) CpG-island No: 39506
taaaacaacgatttaaacgctaaacctactcaaatatttaaactttcaacaaaaaacgaaaaaacgttctcctccgaacaaaacaatcaaacgttacgcgaacaacccactcctaaaaccctaccgcctttatttccactcgtaccatccacaccttacgtaatccttcccgaccacgtcgcaaatacctttacaatacccaccgcttactaaaacgcaaaaaaaaaatcccttaacttaacccttcctctcgccctcgaatcgcaaaacacaaaccacctacacgaacgtaaaaactaccgaaccccacttatcccctaacgaaacgtcttacccgtacaaaaatacaaaaacttaaatcgcacgaccaacgacgaacacacgaaataaaaaaaaaatttctcaaaataatcgcaaatctccttaaaaaaaatctcgtcgatcataaaaatcttataacgccgcctaactactttaaactaaccgaacgaactcaacctcaactcgacgtaacaatacataataaaccgacgcgaacgtccgccgacccgaacgcgactacgaatacccgacccgctaaaaccgcgaaactaacgcgacgacgaaacctaaaccccgctcccgacaactaaaaaaacgacgaaactcgaataacgcgcgaaaaaaaacgaataacgaacgcgcctaccgcgcgtctaaacccacccgcaaatcaacatcttcgctaaacctttttaaaacaacgcaactatcaatcaacgcgaacttcctacaaaaccgaatacgaaatatatactaaaaaacgtccgcgcccaccccgcccccgcccgcccgtaccactccgacgccgacctacgcgcctaatacccgacgactctcaatcgctacctcccgctctaatatctcgcgctcctctacctaactctctattttaaaacgctcgttttaactctcctccccctcccccccgaaacgcgctccaaatatatatacaaaaatatacgcgcgatacgaaaaacgcgcaccgc

SEQ ID NO: 39507 - DNA, 1028 bp, Artificial Sequence
  chemically treated genomic DNA (Homo sapiens) CpG-island No: 39507
tgaaataacgatttagacgttgaatttgtttaagtgtttgaatttttagtaggaaacgaggaagcgttttttttcgagtaggataattaggcgttgcgcgagtagtttatttttaaggttttgtcgtttttatttttattcgtgttatttatattttgcgtggtttttttcggttacgtcgtagatgtttttgtaatgtttatcgtttgttgaggcgtaggaaaagaattttttaatttaattttttttttcgttttcggatcgtaaagtataggttatttatacggacgtgaaagttatcgaattttatttattttttagcggagcgttttattcgtataggaatgtaggggtttgggtcgtacgattagcgacgggtatacggagtagagggaaagttttttaaagtaatcgtaggtttttttggagaggatttcgtcgattatgaaagttttgtagcgtcgtttggttgttttgagttggtcgggcgagtttagttttagttcggcgtggtagtgtatggtgagtcggcgcgagcgttcgtcggttcgagcgcggttgcgagtgttcggttcgttggggtcgcggggttggcgcgacggcggggtttgggtttcgttttcggtagttggggaggcggcggggttcgggtggcgcgcggaggagagcgggtagcgggcgcgtttgtcgcgcgtttagatttattcgtagattagtattttcgttgagtttttttgggataacgtagttgttaattagcgcgagttttttgtagggtcgggtgcggagtgtgtgttgaggggcgttcgcgtttatttcgttttcgttcgttcgtgttatttcggcgtcgatttgcgcgtttagtgttcggcggtttttagtcgttgtttttcgttttggtgtttcgcgtttttttgtttggttttttattttaagacgttcgttttggtttttttttttttttttttcgggacgcgttttaggtgtgtgtgtaggagtgtgcgcgcggtgcggggagcgcgtatcgt

SEQ ID NO: 39508 - DNA, 1028 bp, Artificial Sequence
  chemically treated genomic DNA (Homo sapiens) CpG-island No: 39508
acgatacgcgctccccgcaccgcgcgcacactcctacacacacacctaaaacgcgtcccgaaaaaaaaaaaaaaaaaaaccaaaacgaacgtcttaaaataaaaaaccaaacaaaaaaacgcgaaacaccaaaacgaaaaacaacgactaaaaaccgccgaacactaaacgcgcaaatcgacgccgaaataacacgaacgaacgaaaacgaaataaacgcgaacgcccctcaacacacactccgcacccgaccctacaaaaaactcgcgctaattaacaactacgttatcccaaaaaaactcaacgaaaatactaatctacgaataaatctaaacgcgcgacaaacgcgcccgctacccgctctcctccgcgcgccacccgaaccccgccgcctccccaactaccgaaaacgaaacccaaaccccgccgtcgcgccaaccccgcgaccccaacgaaccgaacactcgcaaccgcgctcgaaccgacgaacgctcgcgccgactcaccatacactaccacgccgaactaaaactaaactcgcccgaccaactcaaaacaaccaaacgacgctacaaaactttcataatcgacgaaatcctctccaaaaaaacctacgattactttaaaaaactttccctctactccgtatacccgtcgctaatcgtacgacccaaacccctacattcctatacgaataaaacgctccgctaaaaaataaataaaattcgataactttcacgtccgtataaataacctatactttacgatccgaaaacgaaaaaaaaaattaaattaaaaaattcttttcctacgcctcaacaaacgataaacattacaaaaacatctacgacgtaaccgaaaaaaaccacgcaaaatataaataacacgaataaaaataaaaacgacaaaaccttaaaaataaactactcgcgcaacgcctaattatcctactcgaaaaaaaacgcttcctcgtttcctactaaaaattcaaacacttaaacaaattcaacgtctaaatcgttatttca

SEQ ID NO: 39509 - DNA, 596 bp, Artificial Sequence
  chemically treated genomic DNA (Homo sapiens) CpG-island No: 39509
ttttcgtagcgtttataggtttcgtaagtttttagttcgttttttgtttaaaataaaggacgttatttttagatttttggatatagaagttttatacgtacgtatacgtatttttttttgttattttttttcgagagttttttaaacgttttagaattcgcgtcgcggaagcgtttatttttcgcgggcgggcgggtttcgggtacgcggtgaaggtgtagcggcggtcgtttcgggcgatagacgggtggttacggtttttttttaaggtaggggtatcgtaggaggtcggcgcgttttttgttttcgttttcggtaggttacgtgggttagagttcgtagcgtttttcgttttttcggagcgttttttcgttatttaggggtttcgtcgtttcgtcggttttaatatcgtttttttttgcgtttgcgtttcggttttaggcgtttttatttaaatcgataacgtttcgcgtttttcggatcggttaatggcgggcggcgtagcggggcgggggcggggcgttggttgttttttttttcgtagttttggggaatcgtttgcgtgttaaggtgatagggggtttgggagtttggtt

SEQ ID NO: 39510 - DNA, 596 bp, Artificial Sequence
  chemically treated genomic DNA (Homo sapiens) CpG-island No: 39510
aaccaaactcccaaaccccctatcaccttaacacgcaaacgattccccaaaactacgaaaaaaaaaacaaccaacgccccgcccccgccccgctacgccgcccgccattaaccgatccgaaaaacgcgaaacgttatcgatttaaataaaaacgcctaaaaccgaaacgcaaacgcaaaaaaaaacgatattaaaaccgacgaaacgacgaaacccctaaataacgaaaaaacgctccgaaaaaacgaaaaacgctacgaactctaacccacgtaacctaccgaaaacgaaaacaaaaaacgcgccgacctcctacgatacccctaccttaaaaaaaaaccgtaaccacccgtctatcgcccgaaacgaccgccgctacaccttcaccgcgtacccgaaacccgcccgcccgcgaaaaataaacgcttccgcgacgcgaattctaaaacgtttaaaaaactctcgaaaaaaaataacaaaaaaaaatacgtatacgtacgtataaaacttctatatccaaaaatctaaaaataacgtcctttattttaaacaaaaaacgaactaaaaacttacgaaacctataaacgctacgaaaa

SEQ ID NO: 39511 - DNA, 596 bp, Artificial Sequence
  chemically treated genomic DNA (Homo sapiens) CpG-island No: 39511
gattaagtttttaagttttttgttattttgatacgtagacggttttttaggattgcgaagaggggggtaattagcgtttcgttttcgtttcgttgcgtcgttcgttattggtcggttcgaaagacgcggggcgttgtcggtttgaatgagagcgtttggagtcggggcgtaggcgtagaggagggcggtgttgagatcggcggagcggcgggatttttaggtggcggagggacgtttcgggaaagcgaggggcgttacgagttttggtttacgtgatttgtcgggggcgggagtagggggcgcgtcggttttttgcggtgtttttgttttggggaggggtcgtgattattcgtttgtcgttcgaggcggtcgtcgttgtatttttatcgcgtattcgggattcgttcgttcgcgggaggtgagcgttttcgcgacgcgggttttgaggcgtttgaggggttttcggagggaggtgatagggaggggtgcgtgtgcgtgcgtgtggggtttttgtgtttagaggtttgggggtgacgttttttgttttgggtaggaggcgggttgggggtttgcgggatttgtgggcgttgcgggga

SEQ ID NO: 39512 - DNA, 596 bp, Artificial Sequence
  chemically treated genomic DNA (Homo sapiens) CpG-island No: 39512
tccccgcaacgcccacaaatcccgcaaacccccaacccgcctcctacccaaaacaaaaaacgtcacccccaaacctctaaacacaaaaaccccacacgcacgcacacgcacccctccctatcacctccctccgaaaacccctcaaacgcctcaaaacccgcgtcgcgaaaacgctcacctcccgcgaacgaacgaatcccgaatacgcgataaaaatacaacgacgaccgcctcgaacgacaaacgaataatcacgacccctccccaaaacaaaaacaccgcaaaaaaccgacgcgccccctactcccgcccccgacaaatcacgtaaaccaaaactcgtaacgcccctcgctttcccgaaacgtccctccgccacctaaaaatcccgccgctccgccgatctcaacaccgccctcctctacgcctacgccccgactccaaacgctctcattcaaaccgacaacgccccgcgtctttcgaaccgaccaataacgaacgacgcaacgaaacgaaaacgaaacgctaattacccccctcttcgcaatcctaaaaaaccgtctacgtatcaaaataacaaaaaacttaaaaacttaatc

SEQ ID NO: 39513 - DNA, 614 bp, Artificial Sequence
  chemically treated genomic DNA (Homo sapiens) CpG-island No: 39513
tcgcgttcgcgtatttagaggcggttaggcggaggcgagggagtaggttagagggataaagagttttgtagacgttttcggcgttttgcgagcgttacgatcgggacgaggcggtcgggagttcgggaagagttcgtggatgttttgcgcgcggtttgggagtcgcgtcgtcgtcgttttagcgagaggaggaatgtatcggtcgcgcgtcgcggaacgtttcgtcgtttttggcgttgttggtcgcgttgttgttggtcgtacgcggggttgttgtttaaggtaagaggcgttcgcggttttcgttcgtttagattttttgattcgtggttattttttcgtcgtttagtcgggcgcgggatacgtaggaagcgtcgcgttggtttcggggcgcgttcggttattcgttacggggttcgtcggcgtcgtagcgtagggtttgtttcggagtttcgttaggttagggtttgtttcggagtttcgcggcgggtcgggggcgttagggattcgtttttcggtgcgtatagcgattgttagcgttgataggaagcgtggaggggtttgagggttttgggggtgatcggggtatttttgtgtagggcgtttttttttgt

SEQ ID NO: 39514 - DNA, 614 bp, Artificial Sequence
  chemically treated genomic DNA (Homo sapiens) CpG-island No: 39514
acaaaaaaaaacgccctacacaaaaataccccgatcacccccaaaaccctcaaacccctccacgcttcctatcaacgctaacaatcgctatacgcaccgaaaaacgaatccctaacgcccccgacccgccgcgaaactccgaaacaaaccctaacctaacgaaactccgaaacaaaccctacgctacgacgccgacgaaccccgtaacgaataaccgaacgcgccccgaaaccaacgcgacgcttcctacgtatcccgcgcccgactaaacgacgaaaaaataaccacgaatcaaaaaatctaaacgaacgaaaaccgcgaacgcctcttaccttaaacaacaaccccgcgtacgaccaacaacaacgcgaccaacaacgccaaaaacgacgaaacgttccgcgacgcgcgaccgatacattcctcctctcgctaaaacgacgacgacgcgactcccaaaccgcgcgcaaaacatccacgaactcttcccgaactcccgaccgcctcgtcccgatcgtaacgctcgcaaaacgccgaaaacgtctacaaaactctttatccctctaacctactccctcgcctccgcctaaccgcctctaaatacgcgaacgcga

SEQ ID NO: 39515 - DNA, 614 bp, Artificial Sequence
  chemically treated genomic DNA (Homo sapiens) CpG-island No: 39515
ataaggggggacgttttgtatagaagtgtttcgattatttttaggatttttaaatttttttacgttttttgttagcgttgataatcgttgtgcgtatcgaggaacgagtttttggcgttttcggttcgtcgcggggtttcggggtaaattttggtttggcggggtttcggggtaaattttgcgttgcggcgtcggcgagtttcgtggcgggtggtcggacgcgtttcggagttagcgcggcgttttttgcgtgtttcgcgttcggttggacgacggaagggtggttacgggttagggggtttgggcgggcgggggtcgcgggcgttttttattttgggtagtagtttcgcgtgcggttagtagtagcgcggttagtagcgttaggagcggcggggcgtttcgcggcgcgcggtcggtgtattttttttttcgttgaggcggcggcggcgcggtttttaggtcgcgcgtagaatatttacgggtttttttcgggttttcggtcgtttcgtttcggtcgtggcgttcgtaggacgtcggggacgtttgtaaagttttttgtttttttaatttgttttttcgttttcgtttggtcgtttttggatgcgcgagcgcga

SEQ ID NO: 39516 - DNA, 614 bp, Artificial Sequence
  chemically treated genomic DNA (Homo sapiens) CpG-island No: 39516
tcgcgctcgcgcatccaaaaacgaccaaacgaaaacgaaaaaacaaattaaaaaaacaaaaaactttacaaacgtccccgacgtcctacgaacgccacgaccgaaacgaaacgaccgaaaacccgaaaaaaacccgtaaatattctacgcgcgacctaaaaaccgcgccgccgccgcctcaacgaaaaaaaaaatacaccgaccgcgcgccgcgaaacgccccgccgctcctaacgctactaaccgcgctactactaaccgcacgcgaaactactacccaaaataaaaaacgcccgcgacccccgcccgcccaaaccccctaacccgtaaccacccttccgtcgtccaaccgaacgcgaaacacgcaaaaaacgccgcgctaactccgaaacgcgtccgaccacccgccacgaaactcgccgacgccgcaacgcaaaatttaccccgaaaccccgccaaaccaaaatttaccccgaaaccccgcgacgaaccgaaaacgccaaaaactcgttcctcgatacgcacaacgattatcaacgctaacaaaaaacgtaaaaaaatttaaaaatcctaaaaataatcgaaacacttctatacaaaacgtccccccttat

SEQ ID NO: 39517 - DNA, 683 bp, Artificial Sequence
  chemically treated genomic DNA (Homo sapiens) CpG-island No: 39517
gtatcggtcgtttttcgtcgggaagtgtcgggttcgtaggaggagcgcgaagtcgagttcgagttcgcggagttcgttttttagatcgtagaatcgttttttttattttttgttttgtttcgcgtcggggtttgggagcgatcggcggaggtcggcggcgcgtcggagttgattagttttttacgttttttcggttcgtagcggggagtttatatgtgtatgtgtaagaaggtgtggagaaggcgttagggtttcggtatttacgggttagggtagaacgttaacgagtcgtattgcgggttttcgcggtttcggtttttatgatatggtgacgtcggcggtaaggcggggggttgtttgtgggttttgaggttgttgggcggtgcgggcggagttagtaaaggggcgttggtaaagttttaaaattttacggttttacggagcgtaagttagattttttgaagtagttttttcgttcgttcgaagagggtattttatttgtatagcgggattttttgttagtttaggtttattgcgatttcgttttttcgagtatttttttcgttttagttttcgtttggtttgcgtatcgcgagtggggtttaaaggttaattttataatattagttagtttcggagggacgtttattattattgttttttatgttcgggttaaatgagtt

SEQ ID NO: 39518 - DNA, 683 bp, Artificial Sequence
  chemically treated genomic DNA (Homo sapiens) CpG-island No: 39518
aactcatttaacccgaacataaaaaacaataataataaacgtccctccgaaactaactaatattataaaattaacctttaaaccccactcgcgatacgcaaaccaaacgaaaactaaaacgaaaaaaatactcgaaaaaacgaaatcgcaataaacctaaactaacaaaaaatcccgctatacaaataaaataccctcttcgaacgaacgaaaaaactacttcaaaaaatctaacttacgctccgtaaaaccgtaaaattttaaaactttaccaacgcccctttactaactccgcccgcaccgcccaacaacctcaaaacccacaaacaaccccccgccttaccgccgacgtcaccatatcataaaaaccgaaaccgcgaaaacccgcaatacgactcgttaacgttctaccctaacccgtaaataccgaaaccctaacgccttctccacaccttcttacacatacacatataaactccccgctacgaaccgaaaaaacgtaaaaaactaatcaactccgacgcgccgccgacctccgccgatcgctcccaaaccccgacgcgaaacaaaacaaaaaataaaaaaaacgattctacgatctaaaaaacgaactccgcgaactcgaactcgacttcgcgctcctcctacgaacccgacacttcccgacgaaaaacgaccgatac

SEQ ID NO: 39519 - DNA, 683 bp, Artificial Sequence
  chemically treated genomic DNA (Homo sapiens) CpG-island No: 39519
ggtttatttggttcgagtatggaaggtagtgatagtgggcgttttttcggagttggttggtattgtggaattggtttttggattttattcgcgatgcgtagattagacggaagttgaaacgggggaaatgttcggggaagcggagtcgtagtgaatttgggttggtagggaatttcgttgtgtagatggaatatttttttcggacgaacggggaagttgttttagagaatttggtttgcgtttcgtggaatcgtggggttttagggttttgttaacgtttttttgttgatttcgttcgtatcgtttagtaattttaaggtttataggtagtttttcgttttgtcgtcggcgttattatgttatggaaatcgaagtcgcggagattcgtagtgcgattcgttggcgttttgttttgattcgtgggtgtcgggattttaacgttttttttatatttttttgtatatatatatgtgggtttttcgttgcgggtcggaggagcgtaggggattagttagtttcggcgcgtcgtcggttttcgtcggtcgtttttagatttcgacgcggggtagggtagaggatggagaaggcggttttgcgatttagggggcgggtttcgcgggttcggattcggtttcgcgttttttttgcggattcggtatttttcggcggaagacgatcggtat

SEQ ID NO: 39520 - DNA, 683 bp, Artificial Sequence
  chemically treated genomic DNA (Homo sapiens) CpG-island No: 39520
ataccgatcgtcttccgccgaaaaataccgaatccgcaaaaaaaacgcgaaaccgaatccgaacccgcgaaacccgccccctaaatcgcaaaaccgccttctccatcctctaccctaccccgcgtcgaaatctaaaaacgaccgacgaaaaccgacgacgcgccgaaactaactaatcccctacgctcctccgacccgcaacgaaaaacccacatatatatatacaaaaaaatataaaaaaaacgttaaaatcccgacacccacgaatcaaaacaaaacgccaacgaatcgcactacgaatctccgcgacttcgatttccataacataataacgccgacgacaaaacgaaaaactacctataaaccttaaaattactaaacgatacgaacgaaatcaacaaaaaaacgttaacaaaaccctaaaaccccacgattccacgaaacgcaaaccaaattctctaaaacaacttccccgttcgtccgaaaaaaatattccatctacacaacgaaattccctaccaacccaaattcactacgactccgcttccccgaacatttcccccgtttcaacttccgtctaatctacgcatcgcgaataaaatccaaaaaccaattccacaataccaaccaactccgaaaaaacgcccactatcactaccttccatactcgaaccaaataaacc

SEQ ID NO: 39521 - DNA, 538 bp, Artificial Sequence
  chemically treated genomic DNA (Homo sapiens) CpG-island No: 39521
tatttggacggggataggatcgggaatcgtcgggtagggggtttgcgcggcggcgttttttttttttcgttcggttttttcgttttattttcgcggtttggttaagggtagcgttaagggcgttcgcggagggcgtagttgtttcggacggagttttcgttatttttatagtcgcgcgggtgttttagagtatttaattttatttttattttaattttattagcggtcggggagtcgggcgggagataggaggtcggttttgatacgaattagttcggagattgttcgatacgttttggttagggcgtcggcgtcgcgcgttcgtttttttcgttttttttttgtgttcgtttcgtttcgtttttcggtttcgtcgcgttttattttcgcggcgttggttcgggtcgagcgaattgttttgtttttggttacgttgagcgcgtcgaggtagtcgggggcgcggggttttaggattcgtttgtttttggtgtttttagttttttagggttcggtcgggttatttgggtcgatttaggcg

SEQ ID NO: 39522 - DNA, 538 bp, Artificial Sequence
  chemically treated genomic DNA (Homo sapiens) CpG-island No: 39522
cgcctaaatcgacccaaataacccgaccgaaccctaaaaaactaaaaacaccaaaaacaaacgaatcctaaaaccccgcgcccccgactacctcgacgcgctcaacgtaaccaaaaacaaaacaattcgctcgacccgaaccaacgccgcgaaaataaaacgcgacgaaaccgaaaaacgaaacgaaacgaacacaaaaaaaaaacgaaaaaaacgaacgcgcgacgccgacgccctaaccaaaacgtatcgaacaatctccgaactaattcgtatcaaaaccgacctcctatctcccgcccgactccccgaccgctaataaaattaaaataaaaataaaattaaatactctaaaacacccgcgcgactataaaaataacgaaaactccgtccgaaacaactacgccctccgcgaacgcccttaacgctacccttaaccaaaccgcgaaaataaaacgaaaaaaccgaacgaaaaaaaaaaaacgccgccgcgcaaaccccctacccgacgattcccgatcctatccccgtccaaata

SEQ ID NO: 39523 - DNA, 538 bp, Artificial Sequence
  chemically treated genomic DNA (Homo sapiens) CpG-island No: 39523
cgtttggatcggtttaggtgattcggtcggattttgaggagttgggggtattaggagtagacgggttttggagtttcgcgttttcggttgtttcggcgcgtttaacgtggttaaaggtaaagtagttcgttcggttcgggttagcgtcgcgggaatggagcgcggcgaggtcgagaggcgaggcgaggcggatataaaggagaggcgagggaggcgagcgcgcggcgtcggcgttttggttaaggcgtatcggataattttcgggttaattcgtgttagggtcggttttttatttttcgttcggtttttcggtcgttgataaaattgaagtggaaatgaagttggatgttttggagtattcgcgcggttgtgggggtggcgggggtttcgttcggggtagttgcgtttttcgcgggcgtttttggcgttgtttttggttaggtcgcggggatggagcgggagagtcgggcggggaggggaggacgtcgtcgcgtagattttttgttcggcggttttcgattttgttttcgtttagatg

SEQ ID NO: 39524 - DNA, 538 bp, Artificial Sequence
  chemically treated genomic DNA (Homo sapiens) CpG-island No: 39524
catctaaacgaaaacaaaatcgaaaaccgccgaacaaaaaatctacgcgacgacgtcctcccctccccgcccgactctcccgctccatccccgcgacctaaccaaaaacaacgccaaaaacgcccgcgaaaaacgcaactaccccgaacgaaacccccgccacccccacaaccgcgcgaatactccaaaacatccaacttcatttccacttcaattttatcaacgaccgaaaaaccgaacgaaaaataaaaaaccgaccctaacacgaattaacccgaaaattatccgatacgccttaaccaaaacgccgacgccgcgcgctcgcctccctcgcctctcctttatatccgcctcgcctcgcctctcgacctcgccgcgctccattcccgcgacgctaacccgaaccgaacgaactactttacctttaaccacgttaaacgcgccgaaacaaccgaaaacgcgaaactccaaaacccgtctactcctaatacccccaactcctcaaaatccgaccgaatcacctaaaccgatccaaacg

SEQ ID NO: 39525 - DNA, 516 bp, Artificial Sequence
  chemically treated genomic DNA (Homo sapiens) CpG-island No: 39525
agagcggcggaatcgacggaaggatagggtacgtcgggggttagaagtggtcgggagattcgggagtgagtagttcgttcggtttagttcgtcgtatttattcgaggttcgggcggggtcgttcggcgttgcggtttttttcggtttgcggcggcggcggcggcgattgtagcggtcgaggtagggacgtattatgcggtcgcgtttatggtcgggttggagcgggtttcgcggttcggttcggtttggttttttgggtttcgtcgggtaggtcggaaggaggttgtagttaagtaaatgttttagttcggagttttggttggagagcggggcggtgcgagcgtcggaagtgaattcgacgaggttagtgacgttacgtcggcgtagtttcggtcgcgtagttttcgcggagaggggcgttcgaggcggtttgaggggattcggaggtttttataaattggtagtttattgagaaaaggtagtttttagttatagtttttttcgttaagatagaga

SEQ ID NO: 39526 - DNA, 516 bp, Artificial Sequence
  chemically treated genomic DNA (Homo sapiens) CpG-island No: 39526
tctctatcttaacgaaaaaaactataactaaaaactaccttttctcaataaactaccaatttataaaaacctccgaatcccctcaaaccgcctcgaacgcccctctccgcgaaaactacgcgaccgaaactacgccgacgtaacgtcactaacctcgtcgaattcacttccgacgctcgcaccgccccgctctccaaccaaaactccgaactaaaacatttacttaactacaacctccttccgacctacccgacgaaacccaaaaaaccaaaccgaaccgaaccgcgaaacccgctccaacccgaccataaacgcgaccgcataatacgtccctacctcgaccgctacaatcgccgccgccgccgccgcaaaccgaaaaaaaccgcaacgccgaacgaccccgcccgaacctcgaataaatacgacgaactaaaccgaacgaactactcactcccgaatctcccgaccacttctaacccccgacgtaccctatccttccgtcgattccgccgctct

SEQ ID NO: 39527 - DNA, 516 bp, Artificial Sequence
  chemically treated genomic DNA (Homo sapiens) CpG-island No: 39527
tttttgttttagcgagaggggttgtgattaaaagttgtttttttttaatgaattgttagtttgtaagagttttcgggtttttttaaatcgtttcgagcgttttttttcgcgagagttgcgcggtcggaattgcgtcggcgtgacgttattgatttcgtcgggtttattttcggcgttcgtatcgtttcgttttttagttaaggtttcgggttgaggtatttgtttggttgtagttttttttcgatttgttcggcgggatttaggggattaagtcgagtcgagtcgcggggttcgttttagttcggttatgagcgcggtcgtatgatgcgtttttgtttcggtcgttgtagtcgtcgtcgtcgtcgtcgtaggtcgggaggagtcgtagcgtcgggcgatttcgttcgggtttcgggtgagtgcggcgggttgggtcgggcgggttgtttattttcgggtttttcggttatttttggttttcggcgtgttttgttttttcgtcggtttcgtcgtttt

SEQ ID NO: 39528 - DNA, 516 bp, Artificial Sequence
  chemically treated genomic DNA (Homo sapiens) CpG-island No: 39528
aaaacgacgaaaccgacgaaaaaacaaaacacgccgaaaaccaaaaataaccgaaaaacccgaaaataaacaacccgcccgacccaacccgccgcactcacccgaaacccgaacgaaatcgcccgacgctacgactcctcccgacctacgacgacgacgacgacgactacaacgaccgaaacaaaaacgcatcatacgaccgcgctcataaccgaactaaaacgaaccccgcgactcgactcgacttaatcccctaaatcccgccgaacaaatcgaaaaaaaactacaaccaaacaaatacctcaacccgaaaccttaactaaaaaacgaaacgatacgaacgccgaaaataaacccgacgaaatcaataacgtcacgccgacgcaattccgaccgcgcaactctcgcgaaaaaaaacgctcgaaacgatttaaaaaaacccgaaaactcttacaaactaacaattcattaaaaaaaaacaacttttaatcacaacccctctcgctaaaacaaaaa

SEQ ID NO: 39529 - DNA, 1138 bp, Artificial Sequence
  chemically treated genomic DNA (Homo sapiens) CpG-island No: 39529
gttttttcgagttgtttttcgttttcggtttttttttcggcgttcgttcgttttttcgttcgttggcgtttttttcgtcgcgttttttttttttttttttaggcgttggtttcgcgttttttttagttgttaaagcgttagtttcggtcgcggttttatcgttttggaatttttttcgcgtcggttcggtttgggggtgtcgtcgtcgtcgttcgtacggtcgttcgtttttcgttcgttcgcgcgttcgttcggtttcgtttgcgtcgttttttgcgtttttagtatcgttgtcgtcgtcgtcgtcgtcgtcgttggtttatttggagtttaatcgaacgtggttattcgggcgagggagcgaggcgggcggtaacgtttcgcgatggatggtcgtttcggttaatcggcgtacgcgggggcgggttcgggtcggttgggagggacgttttgatagcgtcggtcgcggtagttttcgttgcggtcgttttcgcggagtcgttgtttgtttttgtaggcgaattgggggcgttcgggggcgcgagtttttttttttgtcgtcggggcggtgggcgacgtggatcgggttgggggtattttggttttttcgttttagcgaggagggggatttgattcgcgtttttcgcggcgtggattattggggggttaggggggcgttgcggtagcgttcgatgggagggggcgtagatttttaagcggtcgtcgttcgttttttttcgtttcgttttttttttttatttgttttttagttttttttcgtcgcggttcgtattagtttagtttttatttcgtttttcgtttttggttgttttttttttaggtttcgatttcgattttttttttagattttagttcggtttttagttcgtttcgttttcgggtttttttttcgtttagtttggttttcgagcgtcgggttcggggttttacgttgagagttgggcggttcgagtcggcgtcgaggcgcgcggttgtttttttattagattattaaaatattttggaaaattttaaagtggagtcgcgcgaaaatggtttttggcgtgttttggggagtcgggggggaggggggttggggataggggatttgaattaagaggagggagagtgatttttt

SEQ ID NO: 39530 - DNA, 1138 bp, Artificial Sequence
  chemically treated genomic DNA (Homo sapiens) CpG-island No: 39530
aaaaaatcactctccctcctcttaattcaaatcccctatccccaacccccctcccccccgactccccaaaacacgccaaaaaccattttcgcgcgactccactttaaaattttccaaaatattttaataatctaataaaaaaacaaccgcgcgcctcgacgccgactcgaaccgcccaactctcaacgtaaaaccccgaacccgacgctcgaaaaccaaactaaacgaaaaaaaaacccgaaaacgaaacgaactaaaaaccgaactaaaatctaaaaaaaaaatcgaaatcgaaacctaaaaaaaaaacaaccaaaaacgaaaaacgaaataaaaactaaactaatacgaaccgcgacgaaaaaaaactaaaaaacaaataaaaaaaaaaaacgaaacgaaaaaaaacgaacgacgaccgcttaaaaatctacgccccctcccatcgaacgctaccgcaacgcccccctaaccccccaataatccacgccgcgaaaaacgcgaatcaaatccccctcctcgctaaaacgaaaaaaccaaaatacccccaacccgatccacgtcgcccaccgccccgacgacaaaaaaaaaaactcgcgcccccgaacgcccccaattcgcctacaaaaacaaacaacgactccgcgaaaacgaccgcaacgaaaactaccgcgaccgacgctatcaaaacgtccctcccaaccgacccgaacccgcccccgcgtacgccgattaaccgaaacgaccatccatcgcgaaacgttaccgcccgcctcgctccctcgcccgaataaccacgttcgattaaactccaaataaaccaacgacgacgacgacgacgacgacaacgatactaaaaacgcaaaaaacgacgcaaacgaaaccgaacgaacgcgcgaacgaacgaaaaacgaacgaccgtacgaacgacgacgacgacacccccaaaccgaaccgacgcgaaaaaaattccaaaacgataaaaccgcgaccgaaactaacgctttaacaactaaaaaaaacgcgaaaccaacgcctaaaaaaaaaaaaaaaaaacgcgacgaaaaaaacgccaacgaacgaaaaaacgaacgaacgccgaaaaaaaaaccgaaaacgaaaaacaactcgaaaaaac

SEQ ID NO: 39531 - DNA, 1138 bp, Artificial Sequence
  chemically treated genomic DNA (Homo sapiens) CpG-island No: 39531
gagaaattattttttttttttttaatttaagttttttgtttttagtttttttttttttcggttttttaaagtacgttaagggttattttcgcgcggttttattttggggttttttaaagtattttaatgatttagtaaaggagtagtcgcgcgtttcggcgtcggttcgagtcgtttagtttttagcgtggagtttcgggttcggcgttcggaagttagattgggcgagagggaggttcgggggcggggcgggttgggggtcgggttggagtttggggagggggtcggggtcggagtttagggggaggataattaagagcggagggcgagataagggttgggttggtgcgggtcgcggcgggggggagttgaggggtagataagggagagggacggggcgggagggagcgagcggcgatcgtttgggggtttgcgtttttttttatcggacgttgtcgtagcgtttttttagttttttagtggtttacgtcgcggggagcgcgggttagattttttttttcgttggggcgaggagattagggtgtttttagttcgatttacgtcgtttatcgtttcggcgatagaaagagaggttcgcgttttcggacgtttttagttcgtttgtaggagtaggtagcggtttcgcggaggcggtcgtagcggggattgtcgcggtcggcgttgttagggcgttttttttagtcggttcgggttcgttttcgcgtgcgtcgattggtcgaggcggttatttatcgcgggacgttgtcgttcgtttcgttttttcgttcgggtagttacgttcggttgagttttaagtagattagcggcggcggcggcggcggcggtagcggtgttggaggcgtagagggcggcgtaggcggagtcgggcgggcgcgcgagcgagcggagagcgggcggtcgtgcgggcggcggcggcggtatttttaggtcgagtcggcgcggaaggagttttagggcgatggggtcgcggtcggggttgacgttttgatagttggaaagagcgcggagttagcgtttgggggggagggaggggagcgcggcgaggagagcgttagcgagcgagagagcgagcgagcgtcggggagggggtcgggagcgaggggtagttcgggagagt

SEQ ID NO: 39532 - DNA, 1138 bp, Artificial Sequence
  chemically treated genomic DNA (Homo sapiens) CpG-island No: 39532
actctcccgaactacccctcgctcccgaccccctccccgacgctcgctcgctctctcgctcgctaacgctctcctcgccgcgctcccctccctcccccccaaacgctaactccgcgctctttccaactatcaaaacgtcaaccccgaccgcgaccccatcgccctaaaactccttccgcgccgactcgacctaaaaataccgccgccgccgcccgcacgaccgcccgctctccgctcgctcgcgcgcccgcccgactccgcctacgccgccctctacgcctccaacaccgctaccgccgccgccgccgccgccgctaatctacttaaaactcaaccgaacgtaactacccgaacgaaaaaacgaaacgaacgacaacgtcccgcgataaataaccgcctcgaccaatcgacgcacgcgaaaacgaacccgaaccgactaaaaaaaacgccctaacaacgccgaccgcgacaatccccgctacgaccgcctccgcgaaaccgctacctactcctacaaacgaactaaaaacgtccgaaaacgcgaacctctctttctatcgccgaaacgataaacgacgtaaatcgaactaaaaacaccctaatctcctcgccccaacgaaaaaaaaaatctaacccgcgctccccgcgacgtaaaccactaaaaaactaaaaaaacgctacgacaacgtccgataaaaaaaaacgcaaacccccaaacgatcgccgctcgctccctcccgccccgtccctctcccttatctacccctcaactcccccccgccgcgacccgcaccaacccaacccttatctcgccctccgctcttaattatcctccccctaaactccgaccccgaccccctccccaaactccaacccgacccccaacccgccccgcccccgaacctccctctcgcccaatctaacttccgaacgccgaacccgaaactccacgctaaaaactaaacgactcgaaccgacgccgaaacgcgcgactactcctttactaaatcattaaaatactttaaaaaaccccaaaataaaaccgcgcgaaaataacccttaacgtactttaaaaaaccgaaaaaaaaaaaaactaaaaacaaaaaacttaaattaaaaaaaaaaaaaataatttctc

SEQ ID NO: 39533 - DNA, 511 bp, Artificial Sequence
  chemically treated genomic DNA (Homo sapiens) CpG-island No: 39533
tttggtgtcggtcggtacgttggggatgtattcgcgtaatttcgcgaatgcgttgttaatgtttttagtgcgttttcgtttttttttgggttttgagttttttcgtcggttaagacggtcgttaagcgtttttagtcgttcggggttttgtttaggtttggcgttaggattataggcggtggcggttgtagcggtcgcgggcggcggttcgttcgtagggaagttcggggtagcgttagtcgggtttagtagttagttttggaagtagggttttttttgatgatagcgcgaggtcggatcgaagaggaagggttcgtggagtatggggtgcgtagggtgcgggtggtgatggtggtgatggtgtgcgtagttgtttacgaggtttatgttggagcggttattggtttgcgtcgttagttttattaacgtcgttttatgcgttttagagattgtcgggggttatttgtgggttttggagttattattgggcgtcggttttgggagagttcgg

SEQ ID NO: 39534 - DNA, 511 bp, Artificial Sequence
  chemically treated genomic DNA (Homo sapiens) CpG-island No: 39534
ccgaactctcccaaaaccgacgcccaataataactccaaaacccacaaataacccccgacaatctctaaaacgcataaaacgacgttaataaaactaacgacgcaaaccaataaccgctccaacataaacctcgtaaacaactacgcacaccatcaccaccatcaccacccgcaccctacgcaccccatactccacgaacccttcctcttcgatccgacctcgcgctatcatcaaaaaaaaccctacttccaaaactaactactaaacccgactaacgctaccccgaacttccctacgaacgaaccgccgcccgcgaccgctacaaccgccaccgcctataatcctaacgccaaacctaaacaaaaccccgaacgactaaaaacgcttaacgaccgtcttaaccgacgaaaaaactcaaaacccaaaaaaaaacgaaaacgcactaaaaacattaacaacgcattcgcgaaattacgcgaatacatccccaacgtaccgaccgacaccaaa

SEQ ID NO: 39535 - DNA, 511 bp, Artificial Sequence
  chemically treated genomic DNA (Homo sapiens) CpG-island No: 39535
tcggatttttttaaagtcggcgtttagtagtggttttagagtttataggtggttttcggtagtttttggggcgtatggagcggcgttaatagggttggcggcgtaggttagtagtcgttttaatatgaatttcgtgggtagttacgtatattattattattattattattcgtattttgcgtattttatgttttacgaatttttttttttcggttcggtttcgcgttgttattaggaaaggttttatttttagagttggttgttgagttcggttgacgttgtttcggatttttttgcgggcgggtcgtcgttcgcggtcgttgtagtcgttatcgtttatggttttgacgttaggtttgggtagagtttcgggcggttggaggcgtttggcggtcgttttggtcggcggaaaggtttaggatttaagaaggagcggagacgtattgagagtattaatagcgtattcgcggagttgcgcgagtgtatttttaacgtgtcggtcgatattaag

SEQ ID NO: 39536 - DNA, 511 bp, Artificial Sequence
  chemically treated genomic DNA (Homo sapiens) CpG-island No: 39536
cttaatatcgaccgacacgttaaaaatacactcgcgcaactccgcgaatacgctattaatactctcaatacgtctccgctccttcttaaatcctaaacctttccgccgaccaaaacgaccgccaaacgcctccaaccgcccgaaactctacccaaacctaacgtcaaaaccataaacgataacgactacaacgaccgcgaacgacgacccgcccgcaaaaaaatccgaaacaacgtcaaccgaactcaacaaccaactctaaaaataaaacctttcctaataacaacgcgaaaccgaaccgaaaaaaaaaaattcgtaaaacataaaatacgcaaaatacgaataataataataataataatatacgtaactacccacgaaattcatattaaaacgactactaacctacgccgccaaccctattaacgccgctccatacgccccaaaaactaccgaaaaccacctataaactctaaaaccactactaaacgccgactttaaaaaaatccga

SEQ ID NO: 39537 - DNA, 504 bp, Artificial Sequence
  chemically treated genomic DNA (Homo sapiens) CpG-island No: 39537
gcgtacgagaatcgcgttgggcgttttgagagtagaatcggtcgtttaggtttttaaggagatttcgcgggcggtattaggaggaagcgcgcgtttcgggtagggtcgcggtcgaagagggggcgttaagttcggtatttgtcgttggcgttcggggtttgtaggtcgggggagggaagcgggttttgtgaagaggggttttcgagaaagtcgcgcgggacggcgaggggaggttttacgagggtagacgcgtttcggattcggagtttgggcgggcggggaagcggagaaggggacgttcgatttggacggagggagggtacggagtatttaggattagggcgggagcggcgagtagcgggcggcggttttaggcggataggttcgtagggagtgggtcggaggtcggggcggggttggggtttgtattcgttttagcgggtaggtcgttagtaggttgggagtcggggtcggggggcggggcggggtttgtatttatttagg

SEQ ID NO: 39538 - DNA, 504 bp, Artificial Sequence
  chemically treated genomic DNA (Homo sapiens) CpG-island No: 39538
cctaaataaatacaaaccccgccccgccccccgaccccgactcccaacctactaacgacctacccgctaaaacgaatacaaaccccaaccccgccccgacctccgacccactccctacgaacctatccgcctaaaaccgccgcccgctactcgccgctcccgccctaatcctaaatactccgtaccctccctccgtccaaatcgaacgtccccttctccgcttccccgcccgcccaaactccgaatccgaaacgcgtctaccctcgtaaaacctcccctcgccgtcccgcgcgactttctcgaaaacccctcttcacaaaacccgcttccctcccccgacctacaaaccccgaacgccaacgacaaataccgaacttaacgccccctcttcgaccgcgaccctacccgaaacgcgcgcttcctcctaataccgcccgcgaaatctccttaaaaacctaaacgaccgattctactctcaaaacgcccaacgcgattctcgtacgc

SEQ ID NO: 39539 - DNA, 504 bp, Artificial Sequence
  chemically treated genomic DNA (Homo sapiens) CpG-island No: 39539
tttaggtgagtgtagatttcgtttcgtttttcggtttcgatttttagtttgttggcgatttgttcgttagggcgagtgtagattttagtttcgtttcggttttcggtttattttttgcgaatttgttcgtttggggtcgtcgttcgttgttcgtcgttttcgttttagttttgagtgtttcgtgtttttttttcgtttaagtcgggcgttttttttttcgttttttcgttcgtttaggtttcgggttcggggcgcgtttgttttcgtgaagttttttttcgtcgtttcgcgcggttttttcggagatttttttttataaagttcgtttttttttttcggtttgtagatttcgagcgttagcggtaggtatcgggtttggcgtttttttttcggtcgcggttttgttcggagcgcgcgtttttttttggtgtcgttcgcggggtttttttaggggtttgagcggtcggttttgtttttagagcgtttagcgcgattttcgtgcgt

SEQ ID NO: 39540 - DNA, 504 bp, Artificial Sequence
  chemically treated genomic DNA (Homo sapiens) CpG-island No: 39540
acgcacgaaaatcgcgctaaacgctctaaaaacaaaaccgaccgctcaaacccctaaaaaaaccccgcgaacgacaccaaaaaaaaacgcgcgctccgaacaaaaccgcgaccgaaaaaaaaacgccaaacccgatacctaccgctaacgctcgaaatctacaaaccgaaaaaaaaaaacgaactttataaaaaaaaatctccgaaaaaaccgcgcgaaacgacgaaaaaaaacttcacgaaaacaaacgcgccccgaacccgaaacctaaacgaacgaaaaaacgaaaaaaaaaacgcccgacttaaacgaaaaaaaaacacgaaacactcaaaactaaaacgaaaacgacgaacaacgaacgacgaccccaaacgaacaaattcgcaaaaaataaaccgaaaaccgaaacgaaactaaaatctacactcgccctaacgaacaaatcgccaacaaactaaaaatcgaaaccgaaaaacgaaacgaaatctacactcacctaaa

SEQ ID NO: 39541 - DNA, 645 bp, Artificial Sequence
  chemically treated genomic DNA (Homo sapiens) CpG-island No: 39541
taacggtttgggtttgttacgcgttttatttttttcggcggtttgggtttgtcgcgcgttttatttttttcggcggtttgggtttgtcgcgcgttttatttttttcggcggtttgggtttgtcgcgcgttttatttttttcggcggtttgggtttgtcgcgcgttttatttttttcggcggtttgggtttgtcgcgcgttttatttttttcggcggtttgggtttgtcgcgcgttttatttttttcggcggtttgggtttgtcgcgcgttttatttttttcggcggtttgggtttgtcgcgcgttttatttttttcgacggtttgggtttgttattcgttttatttttttcgacggtttgggtttgtcgcgcgttttatttttttcgacggtttgggtttgtcgcgcgttttatttttttcgacggtttgggtttgtcgcgcgttttatttttttcgacggtttgggtttgtcgcgcgttttatttttttcgacggtttgggtttgtcgcgcgttttatttttttcggcggtttgggtttgtcgcgcgttttattttttttcgtggtttgggtttgtcgcgcgttttatttttttcgtcggtttgggtttgtcgcgcgttttattttttttaacggtttgggttt

SEQ ID NO: 39542 - DNA, 645 bp, Artificial Sequence
  chemically treated genomic DNA (Homo sapiens) CpG-island No: 39542
aaacccaaaccgttaaaaaaaataaaacgcgcgacaaacccaaaccgacgaaaaaaataaaacgcgcgacaaacccaaaccacgaaaaaaaataaaacgcgcgacaaacccaaaccgccgaaaaaaataaaacgcgcgacaaacccaaaccgtcgaaaaaaataaaacgcgcgacaaacccaaaccgtcgaaaaaaataaaacgcgcgacaaacccaaaccgtcgaaaaaaataaaacgcgcgacaaacccaaaccgtcgaaaaaaataaaacgcgcgacaaacccaaaccgtcgaaaaaaataaaacgaataacaaacccaaaccgtcgaaaaaaataaaacgcgcgacaaacccaaaccgccgaaaaaaataaaacgcgcgacaaacccaaaccgccgaaaaaaataaaacgcgcgacaaacccaaaccgccgaaaaaaataaaacgcgcgacaaacccaaaccgccgaaaaaaataaaacgcgcgacaaacccaaaccgccgaaaaaaataaaacgcgcgacaaacccaaaccgccgaaaaaaataaaacgcgcgacaaacccaaaccgccgaaaaaaataaaacgcgcgacaaacccaaaccgccgaaaaaaataaaacgcgtaacaaacccaaaccgtta

SEQ ID NO: 39543 - DNA, 645 bp, Artificial Sequence
  chemically treated genomic DNA (Homo sapiens) CpG-island No: 39543
aaatttaaatcgttgagaagggtgaggcgcgcgataaatttaaatcggcgagaagggtgaggcgcgcgataaatttaaattacggagaagggtgaggcgcgcgataaatttaaatcgtcgagaagggtgaggcgcgcgataaatttaaatcgtcgagaagggtgaggcgcgcgataaatttaaatcgtcgagaagggtgaggcgcgcgataaatttaaatcgtcgagaagggtgaggcgcgcgataaatttaaatcgtcgagaagggtgaggcgcgcgataaatttaaatcgtcgagaagggtgaggcgagtgataaatttaaatcgtcgagaagggtgaggcgcgcgataaatttaaatcgtcgagaagggtgaggcgcgcgataaatttaaatcgtcgagaagggtgaggcgcgcgataaatttaaatcgtcgagaagggtgaggcgcgcgataaatttaaatcgtcgagaagggtgaggcgcgcgataaatttaaatcgtcgagaagggtgaggcgcgcgataaatttaaatcgtcgagaagggtgaggcgcgcgataaatttaaatcgtcgagaagggtgaggcgcgcgataaatttaaatcgtcgagaagggtgaggcgcgtgataaatttaaatcgttg

SEQ ID NO: 39544 - DNA, 645 bp, Artificial Sequence
  chemically treated genomic DNA (Homo sapiens) CpG-island No: 39544
caacgatttaaatttatcacgcgcctcacccttctcgacgatttaaatttatcgcgcgcctcacccttctcgacgatttaaatttatcgcgcgcctcacccttctcgacgatttaaatttatcgcgcgcctcacccttctcgacgatttaaatttatcgcgcgcctcacccttctcgacgatttaaatttatcgcgcgcctcacccttctcgacgatttaaatttatcgcgcgcctcacccttctcgacgatttaaatttatcgcgcgcctcacccttctcgacgatttaaatttatcgcgcgcctcacccttctcgacgatttaaatttatcactcgcctcacccttctcgacgatttaaatttatcgcgcgcctcacccttctcgacgatttaaatttatcgcgcgcctcacccttctcgacgatttaaatttatcgcgcgcctcacccttctcgacgatttaaatttatcgcgcgcctcacccttctcgacgatttaaatttatcgcgcgcctcacccttctcgacgatttaaatttatcgcgcgcctcacccttctccgtaatttaaatttatcgcgcgcctcacccttctcgccgatttaaatttatcgcgcgcctcacccttctcaacgatttaaattt

SEQ ID NO: 39545 - DNA, 891 bp, Artificial Sequence
  chemically treated genomic DNA (Homo sapiens) CpG-island No: 39545
gggcgcgttgaggtcgtttagttgagtttagttaggtagtttcgggttcgcgtttttgtcgtttggagaggttttcgttgggagtcgagtttcggtttaggggattttcgcgaagaggtgtcgtttttaatttgttatttgttttcgttttttattttagaacgaattgtatattcgtttcgagaggataaattcggaagttttaaggtaattcgagggtttttcgtcgtatggaacgcggttttttatatatttgtttgttaagttttttttttatcgttcgtaattttagaattatttttcgttcgggtttgcgtgggtttagtattattttttttacggggcggatttcggaagggtagtaattttatttttttttttttcgcggtttgtagttatttatcgggaagcgttttcggaggcggtagtagaggtcgtcggataaggaacgtttagggaaatttttttagaattaatttagtttcggcgttagtagtagaagtcgagttttttataattgtgcgattaattttttcgggtgattggttatagggacgcgttcgcgttcgttttcgtcggcgacggggttggggacggattacgtgagcggcgcggcgcggcgcgtgcgtcgtcgttcgcgggtcgggttacgtgaagggcgcgcgttttttcgattttaggtcgtttttttgcgcgtcgcgcgtacgcgttgggtaggttcgcgtcgttacgtcgatcgtttttgggtttttagaaagtggtggggtgtttacgtcgtattttcgttgggtatttaggcgggatttagataaattttagttttagttacgagagtggaatttggggaatcggaggttgagggttaaggtttaaggtttgcggatttagttt

SEQ ID NO: 39546 - DNA, 891 bp, Artificial Sequence
  chemically treated genomic DNA (Homo sapiens) CpG-island No: 39546
aaactaaatccgcaaaccttaaaccttaaccctcaacctccgattccccaaattccactctcgtaactaaaactaaaatttatctaaatcccgcctaaatacccaacgaaaatacgacgtaaacaccccaccactttctaaaaacccaaaaacgatcgacgtaacgacgcgaacctacccaacgcgtacgcgcgacgcgcaaaaaaacgacctaaaatcgaaaaaacgcgcgcccttcacgtaacccgacccgcgaacgacgacgcacgcgccgcgccgcgccgctcacgtaatccgtccccaaccccgtcgccgacgaaaacgaacgcgaacgcgtccctataaccaatcacccgaaaaaattaatcgcacaattataaaaaactcgacttctactactaacgccgaaactaaattaattctaaaaaaatttccctaaacgttccttatccgacgacctctactaccgcctccgaaaacgcttcccgataaataactacaaaccgcgaaaaaaaaaaaaataaaattactacccttccgaaatccgccccgtaaaaaaaataatactaaacccacgcaaacccgaacgaaaaataattctaaaattacgaacgataaaaaaaaaacttaacaaacaaatatataaaaaaccgcgttccatacgacgaaaaaccctcgaattaccttaaaacttccgaatttatcctctcgaaacgaatatacaattcgttctaaaataaaaaacgaaaacaaataacaaattaaaaacgacacctcttcgcgaaaatcccctaaaccgaaactcgactcccaacgaaaacctctccaaacgacaaaaacgcgaacccgaaactacctaactaaactcaactaaacgacctcaacgcgccc

SEQ ID NO: 39547 - DNA, 891 bp, Artificial Sequence
  chemically treated genomic DNA (Homo sapiens) CpG-island No: 39547
agattggattcgtaagttttgaattttaatttttaattttcgattttttaagttttattttcgtagttgaggttgaagtttgtttaagtttcgtttaggtatttaacggagatacggcgtgaatattttattattttttgggaatttagaggcggtcggcgtggcggcgcgaatttgtttagcgcgtgcgcgcggcgcgtagggaggcggtttggaatcgagggagcgcgcgttttttacgtgattcgattcgcgggcggcgacgtacgcgtcgcgtcgcgtcgtttacgtggttcgtttttagtttcgtcgtcggcggaggcgggcgcgggcgcgtttttgtggttagttattcggaggagttggtcgtataattatgaaagattcggtttttgttgttagcgtcggagttgagttagttttgagaaggtttttttgggcgttttttgttcggcggtttttgttgtcgttttcggagacgtttttcgatagatggttataggtcgcggaggaggaggaggtggagttgttgttttttcggagttcgtttcgtgaggagaatggtattggatttacgtaggttcgggcggggaatggttttggggttgcgggcggtaaaggagagatttggtaggtaagtgtgtggggagtcgcgttttatgcggcgaaggattttcgaattgttttgaggttttcggatttgttttttcgggacgggtgtgtagttcgttttggggtgaggggcgggagtaggtagtaagttagaggcgatattttttcgcgggaattttttgagtcgagattcggtttttagcgagggtttttttaggcggtagaggcgcgagttcgggattatttggttgggtttagttgagcggttttagcgcgttt

SEQ ID NO: 39548 - DNA, 891 bp, Artificial Sequence
  chemically treated genomic DNA (Homo sapiens) CpG-island No: 39548
aaacgcgctaaaaccgctcaactaaacccaaccaaataatcccgaactcgcgcctctaccgcctaaaaaaaccctcgctaaaaaccgaatctcgactcaaaaaattcccgcgaaaaaatatcgcctctaacttactacctactcccgcccctcaccccaaaacgaactacacacccgtcccgaaaaaacaaatccgaaaacctcaaaacaattcgaaaatccttcgccgcataaaacgcgactccccacacacttacctaccaaatctctcctttaccgcccgcaaccccaaaaccattccccgcccgaacctacgtaaatccaataccattctcctcacgaaacgaactccgaaaaaacaacaactccacctcctcctcctccgcgacctataaccatctatcgaaaaacgtctccgaaaacgacaacaaaaaccgccgaacaaaaaacgcccaaaaaaaccttctcaaaactaactcaactccgacgctaacaacaaaaaccgaatctttcataattatacgaccaactcctccgaataactaaccacaaaaacgcgcccgcgcccgcctccgccgacgacgaaactaaaaacgaaccacgtaaacgacgcgacgcgacgcgtacgtcgccgcccgcgaatcgaatcacgtaaaaaacgcgcgctccctcgattccaaaccgcctccctacgcgccgcgcgcacgcgctaaacaaattcgcgccgccacgccgaccgcctctaaattcccaaaaaataataaaatattcacgccgtatctccgttaaatacctaaacgaaacttaaacaaacttcaacctcaactacgaaaataaaacttaaaaaatcgaaaattaaaaattaaaattcaaaacttacgaatccaatct

SEQ ID NO: 39549 - DNA, 561 bp, Artificial Sequence
  chemically treated genomic DNA (Homo sapiens) CpG-island No: 39549
tggtaaacgaatgagagaaggagggggtatattgaaaggtagtcggatacggaagtgttcggtttcgtattagatacggcgtggaggggaagcgaaggttcggaagggtaaagcgagagtttcgttcgttttcgttattatttcgcggttttttcggatagggtcggttcgttgtttttattttcgtacgagggtcgtttagtttttacggttttcggtttttagtttttagcggttaaatcgttgggtttttcggtcgaaaagggacgcgttcgagaagatttatatttttatgacgtttcgtttcgtcgtttttagttgttagtagataaagaattttatattttatagttgttttcgtcgttattaatagcgttaaggtgttagtttcgcgcgttaaggtgttcgtcgggatcgtcgcgttgtatgtcgggagtttggcggattcggaatttcgcgttgcgcgtttttttttttcggggggtagggtgggggagtgtttttgtatttttttattaggtcgatttaagattgttaagcgtttgcggataggattatttt

SEQ ID NO: 39550 - DNA, 561 bp, Artificial Sequence
  chemically treated genomic DNA (Homo sapiens) CpG-island No: 39550
aaaataatcctatccgcaaacgcttaacaatcttaaatcgacctaataaaaaaatacaaaaacactcccccaccctaccccccgaaaaaaaaaaacgcgcaacgcgaaattccgaatccgccaaactcccgacatacaacgcgacgatcccgacgaacaccttaacgcgcgaaactaacaccttaacgctattaataacgacgaaaacaactataaaatataaaattctttatctactaacaactaaaaacgacgaaacgaaacgtcataaaaatataaatcttctcgaacgcgtcccttttcgaccgaaaaacccaacgatttaaccgctaaaaactaaaaaccgaaaaccgtaaaaactaaacgaccctcgtacgaaaataaaaacaacgaaccgaccctatccgaaaaaaccgcgaaataataacgaaaacgaacgaaactctcgctttacccttccgaaccttcgcttcccctccacgccgtatctaatacgaaaccgaacacttccgtatccgactacctttcaatataccccctccttctctcattcgtttacca

SEQ ID NO: 39551 - DNA, 561 bp, Artificial Sequence
  chemically treated genomic DNA (Homo sapiens) CpG-island No: 39551
aagataattttgttcgtaaacgtttagtagttttaaatcggtttggtggaaggatgtagggatatttttttattttgtttttcgaaaaaggggaacgcgtagcgcgaggtttcgggttcgttaagttttcggtatgtagcgcggcgatttcggcgagtattttggcgcgcggagttggtattttggcgttgttggtggcggcggagatagttgtgaagtgtgaggttttttgtttgttggtagttaggggcgacgaggcgggacgttatggaagtgtaagttttttcgggcgcgttttttttcggtcgaggagtttaacggtttgatcgttgagagttgagagtcgagagtcgtggggattgggcgattttcgtacgggagtgagggtagcgggtcggttttgttcgggagggtcgcggggtggtgacggggacgaacgggattttcgttttgttttttcgaattttcgttttttttttacgtcgtgtttggtgcggggtcgagtattttcgtgttcggttgttttttaatgtgtttttttttttttttattcgtttatta

SEQ ID NO: 39552 - DNA, 561 bp, Artificial Sequence
  chemically treated genomic DNA (Homo sapiens) CpG-island No: 39552
taataaacgaataaaaaaaaaaaaaaacacattaaaaaacaaccgaacacgaaaatactcgaccccgcaccaaacacgacgtaaaaaaaaaacgaaaattcgaaaaaacaaaacgaaaatcccgttcgtccccgtcaccaccccgcgaccctcccgaacaaaaccgacccgctaccctcactcccgtacgaaaatcgcccaatccccacgactctcgactctcaactctcaacgatcaaaccgttaaactcctcgaccgaaaaaaaacgcgcccgaaaaaacttacacttccataacgtcccgcctcgtcgcccctaactaccaacaaacaaaaaacctcacacttcacaactatctccgccgccaccaacaacgccaaaataccaactccgcgcgccaaaatactcgccgaaatcgccgcgctacataccgaaaacttaacgaacccgaaacctcgcgctacgcgttcccctttttcgaaaaacaaaataaaaaaatatccctacatccttccaccaaaccgatttaaaactactaaacgtttacgaacaaaattatctt

SEQ ID NO: 39553 - DNA, 526 bp, Artificial Sequence
  chemically treated genomic DNA (Homo sapiens) CpG-island No: 39553
  misc_feature (291)..(291): n is either a, c, g or t
  misc_feature (406)..(406): n is either a, c, g or t
ggttcgtcgttttttttttttcgtcggaggttattgaatgttggtcgaggtttgttcgtttttttagggtttggttgtgtttatcgtttttgcgttcggcgggttcggtttggaaggttcggtttggaaggtttcgggacggcgcggcgggcgggtagtttaggggcgtcggcgcgggcgaaggggttaggagtagttattcggcgcggagacgtaaggttaatggtttcggttcggggcgagttcggggaatgcggcgttcgagaggagtcgtgggatcggggttcgggnggatcgtttttttttattcggtgtagaaagtttaggcggtttcgtagcggcggcgcggtagttatgatttaggttttttttcggtttgtttcgttttcgttaggttcgggttttntttaattttgcgcgggtttgggttcgtcggttaattttttacggtagggcgggttttgaggttggtttcgtaaataattggagtttaggttaattcgaagttttagagtatagatagatt

SEQ ID NO: 39554 - DNA, 526 bp, Artificial Sequence
  chemically treated genomic DNA (Homo sapiens) CpG-island No: 39554
  misc_feature (121)..(121): n is either a, c, g or t
  misc_feature (236)..(236): n is either a, c, g or t
aatctatctatactctaaaacttcgaattaacctaaactccaattatttacgaaaccaacctcaaaacccgccctaccgtaaaaaattaaccgacgaacccaaacccgcgcaaaattaaanaaaacccgaacctaacgaaaacgaaacaaaccgaaaaaaaacctaaatcataactaccgcgccgccgctacgaaaccgcctaaactttctacaccgaataaaaaaaaacgatccncccgaaccccgatcccacgactcctctcgaacgccgcattccccgaactcgccccgaaccgaaaccattaaccttacgtctccgcgccgaataactactcctaaccccttcgcccgcgccgacgcccctaaactacccgcccgccgcgccgtcccgaaaccttccaaaccgaaccttccaaaccgaacccgccgaacgcaaaaacgataaacacaaccaaaccctaaaaaaacgaacaaacctcgaccaacattcaataacctccgacgaaaaaaaaaaaacgacgaacc

SEQ ID NO: 39555 - DNA, 526 bp, Artificial Sequence
  chemically treated genomic DNA (Homo sapiens) CpG-island No: 39555
  misc_feature (121)..(121): n is either a, c, g or t
  misc_feature (236)..(236): n is either a, c, g or t
agtttgtttgtgttttgggatttcggattggtttaggttttaattgtttacgaagttaattttagggttcgttttatcgtgagggattggtcggcggatttagattcgcgtagagttgggnagggttcgggtttggcggaagcggggtagatcgggaggggatttggattatggttgtcgcgtcgtcgttacgggatcgtttgagttttttatatcgggtgaggaagggcggtttnttcgggtttcggttttacggtttttttcgagcgtcgtatttttcggattcgtttcgggtcggagttattgattttgcgttttcgcgtcgggtagttgtttttggttttttcgttcgcgtcgacgtttttgagttgttcgttcgtcgcgtcgtttcggggttttttaagtcgggttttttaagtcggattcgtcgagcgtaagggcgatgggtatagttagattttgggggaacgaataggtttcggttagtatttagtggttttcgacgggagggaaggagcggcggatt

SEQ ID NO: 39556 - DNA, 526 bp, Artificial Sequence
  chemically treated genomic DNA (Homo sapiens) CpG-island No: 39556
  misc_feature (291)..(291): n is either a, c, g or t
  misc_feature (406)..(406): n is either a, c, g or t
aatccgccgctccttccctcccgtcgaaaaccactaaatactaaccgaaacctattcgttcccccaaaatctaactatacccatcgcccttacgctcgacgaatccgacttaaaaaacccgacttaaaaaaccccgaaacgacgcgacgaacgaacaactcaaaaacgtcgacgcgaacgaaaaaaccaaaaacaactacccgacgcgaaaacgcaaaatcaataactccgacccgaaacgaatccgaaaaatacgacgctcgaaaaaaaccgtaaaaccgaaacccgaanaaaccgcccttcctcacccgatataaaaaactcaaacgatcccgtaacgacgacgcgacaaccataatccaaatcccctcccgatctaccccgcttccgccaaacccgaaccctncccaactctacgcgaatctaaatccgccgaccaatccctcacgataaaacgaaccctaaaattaacttcgtaaacaattaaaacctaaaccaatccgaaatcccaaaacacaaacaaact

SEQ ID NO: 39557 - DNA, 976 bp, Artificial Sequence
  chemically treated genomic DNA (Homo sapiens) CpG-island No: 39557
ggcgggttagaggtttcgtcggttagtgcgtacgcggcgtcggttttcgattaaggtttcggttcgttttgttggttcgtttgaaacgtcgatatttttagcgtacgattcggggtttcgggggtatttatggggttcgaagtttttgtttgtcggcggcgatcggatagttttttcgggcgcgtagggtagaggaagcgttttcgaaagttttcgtacgtatttacgagtcggttttgcgcgggtatagcggtagtcgcggcgggatattcggtagggttttcggcgttattttgtgttaaaaattgcgttttcggagattcgggtatcgtcggcgtcggtagttagagcgggatttagtttttatcgcgttttttattggagtttttttcggtttttcggcgagtgcggttcgtggggagtgggcgtcggcgcgaggaagtttttcggttcgggcgatttcggtttttgagcggtttttttttacgtcgtcgttcgttaggtcgacggaggatcggggcggggacgggggttttagcggtttattttgttgttatttttgatttattttttagtaacggcgcgtttttttttcggttttttcgcgaggtttgttgaagacggatttagttttcgtagagttggggaaggacggatggacggaaggtttagcgcggtttatttttttttttcgtcgtttttcggttggtaggagtcgtagcgatagtttcggggagcggggtttgttttaagatttttttcgcggtatcgggagttaggcgtggtcggaggtatcgcggttgttttacgtggttttcgtcggtcgttatttcgcgcggggaggacgcgtgcgtgcggtgcgtggtcggcgggttgcggggacgcgtttgaaattaaattttcgtagtgtttgattttgtttttttttcggttttgataattgtagtagttgttttttttagaatttttgttgttg

SEQ ID NO: 39558 - DNA, 976 bp, Artificial Sequence
  chemically treated genomic DNA (Homo sapiens) CpG-island No: 39558
caacaacaaaaattctaaaaaaaacaactactacaattatcaaaaccgaaaaaaaaacaaaatcaaacactacgaaaatttaatttcaaacgcgtccccgcaacccgccgaccacgcaccgcacgcacgcgtcctccccgcgcgaaataacgaccgacgaaaaccacgtaaaacaaccgcgatacctccgaccacgcctaactcccgataccgcgaaaaaaatcttaaaacaaaccccgctccccgaaactatcgctacgactcctaccaaccgaaaaacgacgaaaaaaaaaaataaaccgcgctaaaccttccgtccatccgtccttccccaactctacgaaaactaaatccgtcttcaacaaacctcgcgaaaaaaccgaaaaaaaaacgcgccgttactaaaaaataaatcaaaaataacaacaaaataaaccgctaaaacccccgtccccgccccgatcctccgtcgacctaacgaacgacgacgtaaaaaaaaaccgctcaaaaaccgaaatcgcccgaaccgaaaaacttcctcgcgccgacgcccactccccacgaaccgcactcgccgaaaaaccgaaaaaaactccaataaaaaacgcgataaaaactaaatcccgctctaactaccgacgccgacgatacccgaatctccgaaaacgcaatttttaacacaaaataacgccgaaaaccctaccgaatatcccgccgcgactaccgctatacccgcgcaaaaccgactcgtaaatacgtacgaaaactttcgaaaacgcttcctctaccctacgcgcccgaaaaaactatccgatcgccgccgacaaacaaaaacttcgaaccccataaatacccccgaaaccccgaatcgtacgctaaaaatatcgacgtttcaaacgaaccaacaaaacgaaccgaaaccttaatcgaaaaccgacgccgcgtacgcactaaccgacgaaacctctaacccgcc

SEQ ID NO: 39559 - DNA, 976 bp, Artificial Sequence
  chemically treated genomic DNA (Homo sapiens) CpG-island No: 39559
tagtagtagggattttggaaaaaatagttgttgtagttattagggtcgaggaaaaaataaggttaggtattgcgaagatttaattttaagcgcgttttcgtagttcgtcggttacgtatcgtacgtacgcgtttttttcgcgcggggtggcggtcggcgggagttacgtggagtagtcgcggtgttttcggttacgtttggttttcgatgtcgcgaagggggttttggggtaggtttcgtttttcgaagttgtcgttgcggtttttgttagtcgggagacgacgaggggaaggggtgggtcgcgttgggtttttcgtttattcgtttttttttagttttgcgggggttaaattcgtttttaataaatttcgcgaaaaagtcgagggggggacgcgtcgttgttggagaataggttagaagtgatagtagaatgggtcgttgagattttcgttttcgtttcggtttttcgtcggtttggcgggcggcgacgtggggaggggtcgtttagaagtcggggtcgttcgggtcggggaattttttcgcgtcgacgtttattttttacgggtcgtattcgtcgaggggtcgaaaggggttttagtggaggacgcggtgggagttgggtttcgttttagttgtcgacgtcggcggtgttcgggttttcgggagcgtagtttttggtataaagtagcgtcgaagattttgtcgggtgtttcgtcgcggttgtcgttgtgttcgcgtagggtcggttcgtgaatgcgtgcgggggttttcgagggcgttttttttattttgcgcgttcgggggagttgttcggtcgtcgtcggtaggtagaggtttcgggttttatgggtgttttcgagatttcggatcgtgcgttgagaatgtcgacgttttaaacgagttagtagagcgggtcggagttttggtcgggaatcggcgtcgcgtgcgtattggtcggcgaggtttttggttcgtt

SEQ ID NO: 39560 - DNA, 976 bp, Artificial Sequence
  chemically treated genomic DNA (Homo sapiens) CpG-island No: 39560
aacgaaccaaaaacctcgccgaccaatacgcacgcgacgccgattcccgaccaaaactccgacccgctctactaactcgtttaaaacgtcgacattctcaacgcacgatccgaaatctcgaaaacacccataaaacccgaaacctctacctaccgacgacgaccgaacaactcccccgaacgcgcaaaataaaaaaaacgccctcgaaaacccccgcacgcattcacgaaccgaccctacgcgaacacaacgacaaccgcgacgaaacacccgacaaaatcttcgacgctactttataccaaaaactacgctcccgaaaacccgaacaccgccgacgtcgacaactaaaacgaaacccaactcccaccgcgtcctccactaaaacccctttcgacccctcgacgaatacgacccgtaaaaaataaacgtcgacgcgaaaaaattccccgacccgaacgaccccgacttctaaacgacccctccccacgtcgccgcccgccaaaccgacgaaaaaccgaaacgaaaacgaaaatctcaacgacccattctactatcacttctaacctattctccaacaacgacgcgtccccccctcgactttttcgcgaaatttattaaaaacgaatttaacccccgcaaaactaaaaaaaaacgaataaacgaaaaacccaacgcgacccaccccttcccctcgtcgtctcccgactaacaaaaaccgcaacgacaacttcgaaaaacgaaacctaccccaaaacccccttcgcgacatcgaaaaccaaacgtaaccgaaaacaccgcgactactccacgtaactcccgccgaccgccaccccgcgcgaaaaaaacgcgtacgtacgatacgtaaccgacgaactacgaaaacgcgcttaaaattaaatcttcgcaatacctaaccttattttttcctcgaccctaataactacaacaactattttttccaaaatccctactacta

SEQ ID NO: 39561 - DNA, 624 bp, Artificial Sequence
  chemically treated genomic DNA (Homo sapiens) CpG-island No: 39561
aagcggacgttaagcgaggattagagcgttcggagaagcggacgttaagcgaggattagagcgttcggagaagcggacgttaagcgaggattagagcgttcggagaagcggacgttaagcgaggattagagcgttcggagaagcggacgttaagcgaggattagatcgttcggagaagcggacgttaagcgaggattagagcgttcggagaagcggacgttaagcgaggattagagcgttcggagaagcggacgttaagcgaggattagagcgttcggagaagcggacgttaagcgaggattagatcgtttcgagaagcggacgttaagcgaggattagagcgttcggagaagcggacgttaagcgaggattagagcgttcggagaagcggacgttaagcgaggattagatcgttcggagaagcggacgttaagcgaggattagagcgttcggagaagcggacgttaagcgaggattagagcgttcggagaagcggacgttaagcgaggattagagcgttcggagaagtagcgtttggggaagtggcgttcgggaaagtggtatttataagtattttacgttacgttttttgatttttttgtaggtttaaaaattttttaaatt

SEQ ID NO: 39562 - DNA, 624 bp, Artificial Sequence
  chemically treated genomic DNA (Homo sapiens) CpG-island No: 39562
aatttaaaaaatttttaaacctacaaaaaaatcaaaaaacgtaacgtaaaatacttataaataccactttcccgaacgccacttccccaaacgctacttctccgaacgctctaatcctcgcttaacgtccgcttctccgaacgctctaatcctcgcttaacgtccgcttctccgaacgctctaatcctcgcttaacgtccgcttctccgaacgatctaatcctcgcttaacgtccgcttctccgaacgctctaatcctcgcttaacgtccgcttctccgaacgctctaatcctcgcttaacgtccgcttctcgaaacgatctaatcctcgcttaacgtccgcttctccgaacgctctaatcctcgcttaacgtccgcttctccgaacgctctaatcctcgcttaacgtccgcttctccgaacgctctaatcctcgcttaacgtccgcttctccgaacgatctaatcctcgcttaacgtccgcttctccgaacgctctaatcctcgcttaacgtccgcttctccgaacgctctaatcctcgcttaacgtccgcttctccgaacgctctaatcctcgcttaacgtccgcttctccgaacgctctaatcctcgcttaacgtccgctt

SEQ ID NO: 39563 - DNA, 624 bp, Artificial Sequence
  chemically treated genomic DNA (Homo sapiens) CpG-island No: 39563
gatttggagggtttttaagtttataggaaagttagggagcgtagcgtaaggtatttatgagtgttattttttcgagcgttatttttttaagcgttattttttcgagcgttttgattttcgtttagcgttcgttttttcgagcgttttgattttcgtttagcgttcgttttttcgagcgttttgattttcgtttagcgttcgttttttcgagcggtttgattttcgtttagcgttcgttttttcgagcgttttgattttcgtttagcgttcgttttttcgagcgttttgattttcgtttagcgttcgtttttcggagcggtttgattttcgtttagcgttcgttttttcgagcgttttgattttcgtttagcgttcgttttttcgagcgttttgattttcgtttagcgttcgttttttcgagcgttttgattttcgtttagcgttcgttttttcgagcggtttgattttcgtttagcgttcgttttttcgagcgttttgattttcgtttagcgttcgttttttcgagcgttttgattttcgtttagcgttcgttttttcgagcgttttgattttcgtttagcgttcgttttttcgagcgttttgattttcgtttagcgttcgttt

SEQ ID NO: 39564 - DNA, 624 bp, Artificial Sequence
  chemically treated genomic DNA (Homo sapiens) CpG-island No: 39564
aaacgaacgctaaacgaaaatcaaaacgctcgaaaaaacgaacgctaaacgaaaatcaaaacgctcgaaaaaacgaacgctaaacgaaaatcaaaacgctcgaaaaaacgaacgctaaacgaaaatcaaaacgctcgaaaaaacgaacgctaaacgaaaatcaaaccgctcgaaaaaacgaacgctaaacgaaaatcaaaacgctcgaaaaaacgaacgctaaacgaaaatcaaaacgctcgaaaaaacgaacgctaaacgaaaatcaaaacgctcgaaaaaacgaacgctaaacgaaaatcaaaccgctccgaaaaacgaacgctaaacgaaaatcaaaacgctcgaaaaaacgaacgctaaacgaaaatcaaaacgctcgaaaaaacgaacgctaaacgaaaatcaaaccgctcgaaaaaacgaacgctaaacgaaaatcaaaacgctcgaaaaaacgaacgctaaacgaaaatcaaaacgctcgaaaaaacgaacgctaaacgaaaatcaaaacgctcgaaaaaataacgcttaaaaaaataacgctcgaaaaaataacactcataaataccttacgctacgctccctaactttcctataaacttaaaaaccctccaaatc

SEQ ID NO: 39565 - DNA, 915 bp, Artificial Sequence
  chemically treated genomic DNA (Homo sapiens) CpG-island No: 39565
gggggcgtagtcgcgaagtttgtttggcgcgcggggtttgtagattcggtcggcggggaggggatgcggaattagtcgcgtttaaatttcgggtcggcgatttggcgtttcgttatttttaatattgtttcgaggttcggtgataatgaagcggtcggacggtcggggtgagtagcggcggtagttagtaattagtttggtattatttttttagttcgttacgtcggttcgttttttttgcgcgcgtcgatttcggattggttttttacgttttcgtttaggtcgtttcgggagtttattgggtcgttcggttgtttttcgggaagtttaagcgtgggaggagcggcggatggttgagggacgcgattatagagagcggtcgattggacgcggttggaaaggggcgggttatatagggggcgggggatcgagggcggcgggaggagttggtcgggtaggggcggggttttagcggttgtgggcggggcgtgaggtgggggtgtgatgggcgagtagggcgaggtagatgtgggcggggtaaggtaggtgtgggcggggtacgtagggtttggggaggagatattagggagggcgcgaggagtacgcggtttcggttcggtttttcgatatttttaggtcgtcgtattttcgcggttcggggtttttttagtgttttaggtcgttttgtttttatttacgtgcgcgatttttttcgttatttagtacgattgcgagggcgtgtgggcgttttgttaatttttttgattttttttttttcgcgttgttttgttgttttttttttttttttaaagttttaacgttgcgtttcgtgcgtagtcgttttgtgatttttttttttttcgggagttttggggatttcgtttaggttttttttagggaagttatttttttttt

SEQ ID NO: 39566 - DNA, 915 bp, Artificial Sequence
  chemically treated genomic DNA (Homo sapiens) CpG-island No: 39566
aaaaaaaaaataacttccctaaaaaaaacctaaacgaaatccccaaaactcccgaaaaaaaaaaaaatcacaaaacgactacgcacgaaacgcaacgttaaaactttaaaaaaaaaaaaaaaacaacaaaacaacgcgaaaaaaaaaaaatcaaaaaaattaacaaaacgcccacacgccctcgcaatcgtactaaataacgaaaaaaatcgcgcacgtaaataaaaacaaaacgacctaaaacactaaaaaaaccccgaaccgcgaaaatacgacgacctaaaaatatcgaaaaaccgaaccgaaaccgcgtactcctcgcgccctccctaatatctcctccccaaaccctacgtaccccgcccacacctaccttaccccgcccacatctacctcgccctactcgcccatcacacccccacctcacgccccgcccacaaccgctaaaaccccgcccctacccgaccaactcctcccgccgccctcgatcccccgccccctatataacccgcccctttccaaccgcgtccaatcgaccgctctctataatcgcgtccctcaaccatccgccgctcctcccacgcttaaacttcccgaaaaacaaccgaacgacccaataaactcccgaaacgacctaaacgaaaacgtaaaaaaccaatccgaaatcgacgcgcgcaaaaaaaacgaaccgacgtaacgaactaaaaaaataataccaaactaattactaactaccgccgctactcaccccgaccgtccgaccgcttcattatcaccgaacctcgaaacaatattaaaaataacgaaacgccaaatcgccgacccgaaatttaaacgcgactaattccgcatcccctccccgccgaccgaatctacaaaccccgcgcgccaaacaaacttcgcgactacgccccc

SEQ ID NO: 39567 - DNA, 915 bp, Artificial Sequence
  chemically treated genomic DNA (Homo sapiens) CpG-island No: 39567
aggggaaggatggtttttttggagaggatttgggcggaatttttagggttttcggagagagggggagttatagagcggttacgtacggggcgtagcgttaaaattttggagaaggaaaaaaaataataaagtagcgcgaagggaaggaggttagggaggttagtaaggcgtttatacgttttcgtagtcgtattgagtaacgaggggagtcgcgtacgtgggtggggatagagcggtttaggatattgggggagtttcgggtcgcgggagtgcggcggtttgggggtgtcggggagtcgagtcgaggtcgcgtgtttttcgcgttttttttggtgttttttttttaggttttgcgtgtttcgtttatatttgttttgtttcgtttatatttgtttcgttttattcgtttattatatttttattttacgtttcgtttataatcgttggggtttcgtttttgttcggttagtttttttcgtcgttttcggtttttcgttttttatatgattcgtttttttttagtcgcgtttaatcggtcgttttttgtagtcgcgttttttagttattcgtcgttttttttacgtttgaatttttcgaaggatagtcgagcggtttaatgagttttcgggacggtttgagcgggagcgtgaagggttaattcggagtcggcgcgcgtaggaaaggcgggtcggcgtgacgggttggggaggtggtgttaggttggttgttagttgtcgtcgttgtttatttcggtcgttcggtcgttttattgttatcgggtttcggggtagtgttgggggtggcggggcgttaggtcgtcgattcgaggtttgggcgcgattggtttcgtatttttttttcgtcggtcgaatttgtaggtttcgcgcgttaggtaggtttcgcggttgcgttttt

SEQ ID NO: 39568 - DNA, 915 bp, Artificial Sequence
  chemically treated genomic DNA (Homo sapiens) CpG-island No: 39568
aaaaacgcaaccgcgaaacctacctaacgcgcgaaacctacaaattcgaccgacgaaaaaaaaatacgaaaccaatcgcgcccaaacctcgaatcgacgacctaacgccccgccacccccaacactaccccgaaacccgataacaataaaacgaccgaacgaccgaaataaacaacgacgacaactaacaaccaacctaacaccacctccccaacccgtcacgccgacccgcctttcctacgcgcgccgactccgaattaacccttcacgctcccgctcaaaccgtcccgaaaactcattaaaccgctcgactatccttcgaaaaattcaaacgtaaaaaaaacgacgaataactaaaaaacgcgactacaaaaaacgaccgattaaacgcgactaaaaaaaaacgaatcatataaaaaacgaaaaaccgaaaacgacgaaaaaaactaaccgaacaaaaacgaaaccccaacgattataaacgaaacgtaaaataaaaatataataaacgaataaaacgaaacaaatataaacgaaacaaaacaaatataaacgaaacacgcaaaacctaaaaaaaaaacaccaaaaaaaacgcgaaaaacacgcgacctcgactcgactccccgacacccccaaaccgccgcactcccgcgacccgaaactcccccaatatcctaaaccgctctatccccacccacgtacgcgactcccctcgttactcaatacgactacgaaaacgtataaacgccttactaacctccctaacctccttcccttcgcgctactttattattttttttccttctccaaaattttaacgctacgccccgtacgtaaccgctctataactccccctctctccgaaaaccctaaaaattccgcccaaatcctctccaaaaaaaccatccttcccct

SEQ ID NO: 39569 - DNA, 517 bp, Artificial Sequence
  chemically treated genomic DNA (Homo sapiens) CpG-island No: 39569
gggataaggttcgttggtcgaggggttgcgcgatcgggagagagacgatcgggcggtcggtgttagggtgttagggtgttagggtgtcgcggttggagcgtaggtagcgttttacgtgttggtgaggttagatagggtcgttttcgcgttcgtttggggagcgtcgtttcgggagtttagcgagggagggcggtcgtcgtttcgagttttaggataaggaagtcggtttttatatttgggtaggaggcgtgaggcgaggggattggtggaagtttttgttttgtcggttgcgggtcgcgaatttgcgaggtcgcgggacgtgcgcgcgcggggttaggcgcgggtgtgtgcgcgcgggtaggtgtgcgagtgtgcgttcgggcgcgcgtcggtttttttggggagtttcggatgtagtcggagaaatgaaggtaaagtgggtgtgtttaggtttttttttcgtgtcggttgttttttagtttttgcgtcgtgtaatattagattatttataaaatat

SEQ ID NO: 39570 - DNA, 517 bp, Artificial Sequence
  chemically treated genomic DNA (Homo sapiens) CpG-island No: 39570
atattttataaataatctaatattacacgacgcaaaaactaaaaaacaaccgacacgaaaaaaaaacctaaacacacccactttaccttcatttctccgactacatccgaaactccccaaaaaaaccgacgcgcgcccgaacgcacactcgcacacctacccgcgcgcacacacccgcgcctaaccccgcgcgcgcacgtcccgcgacctcgcaaattcgcgacccgcaaccgacaaaacaaaaacttccaccaatcccctcgcctcacgcctcctacccaaatataaaaaccgacttccttatcctaaaactcgaaacgacgaccgccctccctcgctaaactcccgaaacgacgctccccaaacgaacgcgaaaacgaccctatctaacctcaccaacacgtaaaacgctacctacgctccaaccgcgacaccctaacaccctaacaccctaacaccgaccgcccgatcgtctctctcccgatcgcgcaacccctcgaccaacgaaccttatccc

SEQ ID NO: 39571 - DNA, 517 bp, Artificial Sequence
  chemically treated genomic DNA (Homo sapiens) CpG-island No: 39571
gtgttttgtagatgatttagtgttatacggcgtagggattgggaagtagtcggtacgagaaaggaatttgagtatatttattttgtttttattttttcggttgtattcgaggttttttagaggggtcggcgcgcgttcgggcgtatattcgtatatttgttcgcgcgtatatattcgcgtttggtttcgcgcgcgtacgtttcgcgatttcgtaggttcgcggttcgtaatcggtagggtaggagtttttattaattttttcgttttacgttttttgtttaaatatagaaatcgatttttttgttttagagttcggagcggcggtcgttttttttcgttgggttttcgaggcggcgttttttaggcgggcgcggggacggttttgtttggttttattagtacgtggggcgttgtttgcgttttagtcgcggtattttggtattttggtattttggtatcgatcgttcggtcgtttttttttcggtcgcgtagtttttcggttagcgggttttgtttt

SEQ ID NO: 39572 - DNA, 517 bp, Artificial Sequence
  chemically treated genomic DNA (Homo sapiens) CpG-island No: 39572
aaaacaaaacccgctaaccgaaaaactacgcgaccgaaaaaaaaacgaccgaacgatcgataccaaaataccaaaataccaaaataccgcgactaaaacgcaaacaacgccccacgtactaataaaaccaaacaaaaccgtccccgcgcccgcctaaaaaacgccgcctcgaaaacccaacgaaaaaaaacgaccgccgctccgaactctaaaacaaaaaaatcgatttctatatttaaacaaaaaacgtaaaacgaaaaaattaataaaaactcctaccctaccgattacgaaccgcgaacctacgaaatcgcgaaacgtacgcgcgcgaaaccaaacgcgaatatatacgcgcgaacaaatatacgaatatacgcccgaacgcgcgccgacccctctaaaaaacctcgaatacaaccgaaaaaataaaaacaaaataaatatactcaaattcctttctcgtaccgactacttcccaatccctacgccgtataacactaaatcatctacaaaacac

SEQ ID NO: 39573 - DNA, 883 bp, Artificial Sequence
  chemically treated genomic DNA (Homo sapiens) CpG-island No: 39573
aatcgtatttcgggttcgggagtagcgcgttcgggtttttagcggttatcgttcgggggttttttaggttcggtttttgttttttgtcgttcgttttttaggtcgagttttcgttttcgcgatgtcgtcgcgttcgtcgtcgttaggcgcgttggttcgtcgggtcgttcgggcgcggggcgcgtcgttcgtcgtagtttttttttttttttcggtttggttttgcggttcgtagcggggttcggggtagagcggtcgttttgttttcgtcgttcgacggcgcggggttttgtaaaggcggaagttcggcgttcgttatgatttcgtgcggacgtttagtgcgtttagtttcgtcgcgtcggtcgggttttcgggttttttcgcgttgagcgttcgaattcgtttttttcgcggtcgtttatcgttcgtcgtcgtcgtagtacgagtcgttttttcgttttcgttttttcgtttcgtcgtcgtcgtcgtcgtaggagagggagggaggcggagggaagggaggcggcgggttttgtttagagttcgtttcgggcgtcggtaagcgagtttcggtcgcggcggtagcgttatttcgggtcgcgggtagtcgtttttcgtttttcgcgttcggaattgttttcgttttttcgcgatttcgtagtagtcggttttcggggcgttacgaacgttgttttttttgtggagtagagattttttttttttttttagggggtgtcgtttcggggatcgttgagcgttaggggtttaggaggcggggacgggagcgtcgtgattcgttatggtttaagcggttaaatagttgaagaaaattaaagatatcgaggcgtaggttttttaggagtagaaggagaaggaggaattt

SEQ ID NO: 39574 - DNA, 883 bp, Artificial Sequence
  chemically treated genomic DNA (Homo sapiens) CpG-island No: 39574
aaattcctccttctccttctactcctaaaaaacctacgcctcgatatctttaattttcttcaactatttaaccgcttaaaccataacgaatcacgacgctcccgtccccgcctcctaaacccctaacgctcaacgatccccgaaacgacaccccctaaaaaaaaaaaaaaaatctctactccacaaaaaaaacaacgttcgtaacgccccgaaaaccgactactacgaaatcgcgaaaaaacgaaaacaattccgaacgcgaaaaacgaaaaacgactacccgcgacccgaaataacgctaccgccgcgaccgaaactcgcttaccgacgcccgaaacgaactctaaacaaaacccgccgcctcccttccctccgcctccctccctctcctacgacgacgacgacgacgaaacgaaaaaacgaaaacgaaaaaacgactcgtactacgacgacgacgaacgataaacgaccgcgaaaaaaacgaattcgaacgctcaacgcgaaaaaacccgaaaacccgaccgacgcgacgaaactaaacgcactaaacgtccgcacgaaatcataacgaacgccgaacttccgcctttacaaaaccccgcgccgtcgaacgacgaaaacaaaacgaccgctctaccccgaaccccgctacgaaccgcaaaaccaaaccgaaaaaaaaaaaaaaactacgacgaacgacgcgccccgcgcccgaacgacccgacgaaccaacgcgcctaacgacgacgaacgcgacgacatcgcgaaaacgaaaactcgacctaaaaaacgaacgacaaaaaacaaaaaccgaacctaaaaaacccccgaacgataaccgctaaaaacccgaacgcgctactcccgaacccgaaatacgatt

SEQ ID NO: 39575 - DNA, 883 bp, Artificial Sequence
  chemically treated genomic DNA (Homo sapiens) CpG-island No: 39575
ggatttttttttttttttttgtttttggagggtttgcgtttcgatgtttttgattttttttagttgtttggtcgtttgagttatggcgggttacggcgttttcgttttcgttttttggatttttagcgtttagcgattttcgaggcgatattttttaagaaggggaagggggtttttgttttatagaggggatagcgttcgtggcgtttcgagggtcggttgttgcggggtcgcgggaaggcgaaggtagtttcggacgcggagggcgaggggcggttgttcgcggttcgggatggcgttgtcgtcgcggtcggagttcgtttgtcggcgttcgggacgggttttgggtagggttcgtcgtttttttttttttcgttttttttttttttttgcggcggcggcggcggcgaagcgggggggcgggggcggggaggcggttcgtattgcggcggcggcgggcggtgagcggtcgcggaaggggcggattcgggcgtttagcgcgggaaggttcgggggttcggtcggcgcggcgaggttgggcgtattgggcgttcgtacggggttatggcgagcgtcgagttttcgtttttgtagagtttcgcgtcgtcgggcggcgggaataaagcggtcgttttatttcggatttcgttgcgggtcgtagggttaagtcgggggaagaggggaggttgcggcgggcggcgcgtttcgcgttcgggcgattcggcggattagcgcgtttggcggcggcgagcgcggcgatatcgcgggagcggaggttcggtttagagggcgggcggtagagggtaaggatcgggtttggggagttttcgggcggtggtcgttgagggttcggacgcgttattttcgagttcggggtgcggtt

SEQ ID NO: 39576 - DNA, 883 bp, Artificial Sequence
  chemically treated genomic DNA (Homo sapiens) CpG-island No: 39576
aaccgcaccccgaactcgaaaataacgcgtccgaaccctcaacgaccaccgcccgaaaactccccaaacccgatccttaccctctaccgcccgccctctaaaccgaacctccgctcccgcgatatcgccgcgctcgccgccgccaaacgcgctaatccgccgaatcgcccgaacgcgaaacgcgccgcccgccgcaacctcccctcttcccccgacttaaccctacgacccgcaacgaaatccgaaataaaacgaccgctttattcccgccgcccgacgacgcgaaactctacaaaaacgaaaactcgacgctcgccataaccccgtacgaacgcccaatacgcccaacctcgccgcgccgaccgaacccccgaaccttcccgcgctaaacgcccgaatccgccccttccgcgaccgctcaccgcccgccgccgccgcaatacgaaccgcctccccgcccccgcccccccgcttcgccgccgccgccgccgcaaaaaaaaaaaaaaaacgaaaaaaaaaaaaacgacgaaccctacccaaaacccgtcccgaacgccgacaaacgaactccgaccgcgacgacaacgccatcccgaaccgcgaacaaccgcccctcgccctccgcgtccgaaactaccttcgccttcccgcgaccccgcaacaaccgaccctcgaaacgccacgaacgctatcccctctataaaacaaaaacccccttccccttcttaaaaaatatcgcctcgaaaatcgctaaacgctaaaaatccaaaaaacgaaaacgaaaacgccgtaacccgccataactcaaacgaccaaacaactaaaaaaaatcaaaaacatcgaaacgcaaaccctccaaaaacaaaaaaaaaaaaaaaaatcc

SEQ ID NO: 39577 - DNA, 521 bp, Artificial Sequence
  chemically treated genomic DNA (Homo sapiens) CpG-island No: 39577
atttcgttttttatttttagttatttcgtggtcgcgagttaagaggtttttttaaaggcgcgagtttcgtttttattgtttattagggttttcgattggcggtttttgggcggggcggggttcggtttgggttcggggttggttcggggcgggttcggggtcggatcggttttcgttttttttgttcgcgttgcggcgggaggtggttgtcgggtgggaggtgtgtgcgcgtgtgtcgcgtcgtagggagcggcgggtcgcgtcgtcggttgttagttagtttcgcgtcgtcgttcgatggcgcgaggaggcgcgcgggtttagtttcggggggtcggtcgcgggtgagtttttcggtttgtcgttcgcgagtatgttatttttagtcgtcgtcgtcgtagttttcgttagtcgcgttcgcgttttcgtttttcgtagtcgtagtcgttgtttcgggtattggtttttagattttcgtttttgatttacgtttagattttagttttagagggttatggtcg

SEQ ID NO: 39578 - DNA, 521 bp, Artificial Sequence
  chemically treated genomic DNA (Homo sapiens) CpG-island No: 39578
cgaccataaccctctaaaactaaaatctaaacgtaaatcaaaaacgaaaatctaaaaaccaatacccgaaacaacgactacgactacgaaaaacgaaaacgcgaacgcgactaacgaaaactacgacgacgacgactaaaaataacatactcgcgaacgacaaaccgaaaaactcacccgcgaccgaccccccgaaactaaacccgcgcgcctcctcgcgccatcgaacgacgacgcgaaactaactaacaaccgacgacgcgacccgccgctccctacgacgcgacacacgcgcacacacctcccacccgacaaccacctcccgccgcaacgcgaacaaaaaaaacgaaaaccgatccgaccccgaacccgccccgaaccaaccccgaacccaaaccgaaccccgccccgcccaaaaaccgccaatcgaaaaccctaataaacaataaaaacgaaactcgcgcctttaaaaaaacctcttaactcgcgaccacgaaataactaaaaataaaaaacgaaat

SEQ ID NO: 39579 - DNA, 521 bp, Artificial Sequence
  chemically treated genomic DNA (Homo sapiens) CpG-island No: 39579
cggttatggttttttggagttagggtttgggcgtggattagaggcgggggtttgggggttaatgttcgaggtagcggttgcggttgcgggaggcgggggcgcgggcgcggttggcggaggttgcggcggcggcggttggaggtgatatgttcgcgggcggtaggtcgaggggtttattcgcggtcggtttttcggggttgggttcgcgcgttttttcgcgttatcgggcggcggcgcggagttagttgatagtcggcggcgcgattcgtcgttttttacggcgcggtatacgcgtatatattttttattcggtagttatttttcgtcgtagcgcgaataaagggggcgggggtcgattcggtttcgagttcgtttcgagttagtttcgagtttaggtcgggtttcgtttcgtttaggagtcgttaatcgaaagttttaatgagtagtgggggcgggattcgcgtttttaaagggattttttggttcgcggttacggggtggttgggggtagggggcgggat

SEQ ID NO: 39580 - DNA, 521 bp, Artificial Sequence
  chemically treated genomic DNA (Homo sapiens) CpG-island No: 39580
atcccgccccctacccccaaccaccccgtaaccgcgaaccaaaaaatccctttaaaaacgcgaatcccgcccccactactcattaaaactttcgattaacgactcctaaacgaaacgaaacccgacctaaactcgaaactaactcgaaacgaactcgaaaccgaatcgacccccgccccctttattcgcgctacgacgaaaaataactaccgaataaaaaatatatacgcgtataccgcgccgtaaaaaacgacgaatcgcgccgccgactatcaactaactccgcgccgccgcccgataacgcgaaaaaacgcgcgaacccaaccccgaaaaaccgaccgcgaataaacccctcgacctaccgcccgcgaacatatcacctccaaccgccgccgccgcaacctccgccaaccgcgcccgcgcccccgcctcccgcaaccgcaaccgctacctcgaacattaacccccaaacccccgcctctaatccacgcccaaaccctaactccaaaaaaccataaccg

SEQ ID NO: 39581 - DNA, 717 bp, Artificial Sequence
  chemically treated genomic DNA (Homo sapiens) CpG-island No: 39581
cgtcgtttcgcgtgggtgggtttcgcgtttttttcggggttttagagttattacgtgatttttacgaagcgcggggcgtcggcggaaagtcgcggtaggggtgggatttgggatttcgaggtgcggagagagggcgggtagaggaggaaacgaggcgggggtgggagaaggagggcggggtagacgtgggacgggaaggacggttgtcgggattggcgcgcggggatattgggtcgacgcgtggagtagcggggagagcgggaagtttgagggggcggggtcggcgcgaggtcgtgggtgcggtacgaggatgtcggcggcgggatagcgttcgtaggtagttttacgggtagggcgcgcgggcggggcggggcgggtcgggttagaggagcgttcggtatgtcgtaagggttttcggtcgtcggtagcgttttgtagaggagcgtcgcggcgttcgggaattagtcgtagtcgtagtcgtagtagtaggtagagggcgagaggtttagggagggtcgtggggtgcggggatcggcgcgtcgcggggggcgaggaggtgggtgttggagtttcgtggtggtgattgcggaggtgtagaggtggcgggtgcggtcggagataagtagaggtaggggcgtagggatgttggggaatgggggcgatttagggattttgtcgtgcgtatagtgttcgcggtttttggaatggtttttgagt

SEQ ID NO: 39582 - DNA, 717 bp, Artificial Sequence
  chemically treated genomic DNA (Homo sapiens) CpG-island No: 39582
actcaaaaaccattccaaaaaccgcgaacactatacgcacgacaaaatccctaaatcgcccccattccccaacatccctacgcccctacctctacttatctccgaccgcacccgccacctctacacctccgcaatcaccaccacgaaactccaacacccacctcctcgccccccgcgacgcgccgatccccgcaccccacgaccctccctaaacctctcgccctctacctactactacgactacgactacgactaattcccgaacgccgcgacgctcctctacaaaacgctaccgacgaccgaaaacccttacgacataccgaacgctcctctaacccgacccgccccgccccgcccgcgcgccctacccgtaaaactacctacgaacgctatcccgccgccgacatcctcgtaccgcacccacgacctcgcgccgaccccgccccctcaaacttcccgctctccccgctactccacgcgtcgacccaatatccccgcgcgccaatcccgacaaccgtccttcccgtcccacgtctaccccgccctccttctcccacccccgcctcgtttcctcctctacccgccctctctccgcacctcgaaatcccaaatcccacccctaccgcgactttccgccgacgccccgcgcttcgtaaaaatcacgtaataactctaaaaccccgaaaaaaacgcgaaacccacccacgcgaaacgacg

SEQ ID NO: 39583 - DNA, 717 bp, Artificial Sequence
  chemically treated genomic DNA (Homo sapiens) CpG-island No: 39583
gtttaggagttattttaggagtcgcggatattgtgcgtacgatagggtttttggatcgtttttattttttaatatttttacgtttttatttttgtttgttttcggtcgtattcgttatttttgtattttcgtagttattattacggaattttagtatttattttttcgtttttcgcggcgcgtcggttttcgtattttacggttttttttgagtttttcgttttttatttgttgttgcggttgcggttgcggttggttttcgggcgtcgcgacgtttttttgtaggacgttgtcggcggtcgggagtttttgcgatatgtcgggcgtttttttggttcggttcgtttcgtttcgttcgcgcgttttgttcgtggggttgtttacgggcgttgtttcgtcgtcggtattttcgtgtcgtatttacggtttcgcgtcggtttcgtttttttaggtttttcgtttttttcgttattttacgcgtcggtttagtgttttcgcgcgttagtttcggtagtcgtttttttcgttttacgtttgtttcgtttttttttttttattttcgtttcgtttttttttttgttcgtttttttttcgtatttcggggttttaaattttatttttgtcgcggtttttcgtcggcgtttcgcgtttcgtggaagttacgtggtggttttgaaatttcggagggaacgcgaagtttatttacgcgaggcgacg

SEQ ID NO: 39584 - DNA, 717 bp, Artificial Sequence
  chemically treated genomic DNA (Homo sapiens) CpG-island No: 39584
cgtcgcctcgcgtaaataaacttcgcgttccctccgaaatttcaaaaccaccacgtaacttccacgaaacgcgaaacgccgacgaaaaaccgcgacaaaaataaaatttaaaaccccgaaatacgaaaaaaaaacgaacaaaaaaaaaaacgaaacgaaaataaaaaaaaaaaaacgaaacaaacgtaaaacgaaaaaaacgactaccgaaactaacgcgcgaaaacactaaaccgacgcgtaaaataacgaaaaaaacgaaaaacctaaaaaaacgaaaccgacgcgaaaccgtaaatacgacacgaaaataccgacgacgaaacaacgcccgtaaacaaccccacgaacaaaacgcgcgaacgaaacgaaacgaaccgaaccaaaaaaacgcccgacatatcgcaaaaactcccgaccgccgacaacgtcctacaaaaaaacgtcgcgacgcccgaaaaccaaccgcaaccgcaaccgcaacaacaaataaaaaacgaaaaactcaaaaaaaaccgtaaaatacgaaaaccgacgcgccgcgaaaaacgaaaaaataaatactaaaattccgtaataataactacgaaaatacaaaaataacgaatacgaccgaaaacaaacaaaaataaaaacgtaaaaatattaaaaaataaaaacgatccaaaaaccctatcgtacgcacaatatccgcgactcctaaaataactcctaaac

SEQ ID NO: 39585 - DNA, 572 bp, Artificial Sequence
  chemically treated genomic DNA (Homo sapiens) CpG-island No: 39585
ggtagaagcgagattcgtcgaagggaagttcgagtagtcggggagtttaggggggttttttcggggagagggtcgcgggttttttttgtcgtttatttgtcgcgtcgaggtaaagtcgtagtcgcgtcgcggggtggttttcgggtttttttatcggacggtcgggagggtgggatcggggcgggattttttttagttgtattaacgcgttcgtttcgtttttttttggttaggtgtagcgggtttcgtcgtgtttttagtttgttgcgggttcgggaattttcggcggatcggtagaggggcgtttcggtttttttgcgttttagttcgtttcgggggtgcggtttttgcggttaggtttttagcgcggaaaaagattggagggttttagttattttaaagaggataggtattagtagagtcgcgggcggcgggtgtatggaatcggaatgtgttgcgcgttagtttggagcgttcggagttcggaggtttgtttcggagggggaaacgcggcggggcggttatgggtttcggggttttgttttaggtttgttttttatttgtgttttatt

SEQ ID NO: 39586 - DNA, 572 bp, Artificial Sequence
  chemically treated genomic DNA (Homo sapiens) CpG-island No: 39586
aataaaacacaaataaaaaacaaacctaaaacaaaaccccgaaacccataaccgccccgccgcgtttccccctccgaaacaaacctccgaactccgaacgctccaaactaacgcgcaacacattccgattccatacacccgccgcccgcgactctactaatacctatcctctttaaaataactaaaaccctccaatctttttccgcgctaaaaacctaaccgcaaaaaccgcacccccgaaacgaactaaaacgcaaaaaaaccgaaacgcccctctaccgatccgccgaaaattcccgaacccgcaacaaactaaaaacacgacgaaacccgctacacctaaccaaaaaaaaacgaaacgaacgcgttaatacaactaaaaaaaatcccgccccgatcccaccctcccgaccgtccgataaaaaaacccgaaaaccaccccgcgacgcgactacgactttacctcgacgcgacaaataaacgacaaaaaaaacccgcgaccctctccccgaaaaaacccccctaaactccccgactactcgaacttcccttcgacgaatctcgcttctacc

SEQ ID NO: 39587 - DNA, 572 bp, Artificial Sequence
  chemically treated genomic DNA (Homo sapiens) CpG-island No: 39587
gatggagtataaatgagaagtaaatttggggtaggatttcggggtttatggtcgtttcgtcgcgttttttttttcggggtaggttttcgggtttcgagcgttttaggttggcgcgtagtatatttcggttttatgtattcgtcgttcgcggttttgttaatgtttgttttttttggggtgattaggattttttaattttttttcgcgttgaaagtttggtcgtaaagatcgtattttcggggcgggttgagacgtagagaagtcggggcgtttttttgtcggttcgtcgggagttttcgggttcgtagtaggttgaggatacggcgggattcgttgtatttggttagggaggggcggggcgggcgcgttagtgtagttgggggaggtttcgtttcggttttattttttcggtcgttcggtggggaaattcgggagttatttcgcggcgcggttgcggttttgtttcggcgcgataggtaagcggtagaaggagttcgcgatttttttttcgggagggtttttttgagtttttcgattgttcggattttttttcggcggatttcgtttttgtt

SEQ ID NO: 39588 - DNA, 572 bp, Artificial Sequence
  chemically treated genomic DNA (Homo sapiens) CpG-island No: 39588
aacaaaaacgaaatccgccgaaaaaaaatccgaacaatcgaaaaactcaaaaaaaccctcccgaaaaaaaaatcgcgaactccttctaccgcttacctatcgcgccgaaacaaaaccgcaaccgcgccgcgaaataactcccgaatttccccaccgaacgaccgaaaaaataaaaccgaaacgaaacctcccccaactacactaacgcgcccgccccgcccctccctaaccaaatacaacgaatcccgccgtatcctcaacctactacgaacccgaaaactcccgacgaaccgacaaaaaaacgccccgacttctctacgtctcaacccgccccgaaaatacgatctttacgaccaaactttcaacgcgaaaaaaaattaaaaaatcctaatcaccccaaaaaaaacaaacattaacaaaaccgcgaacgacgaatacataaaaccgaaatatactacgcgccaacctaaaacgctcgaaacccgaaaacctaccccgaaaaaaaaaacgcgacgaaacgaccataaaccccgaaatcctaccccaaatttacttctcatttatactccatc

SEQ ID NO: 39589 - DNA, 946 bp, Artificial Sequence
  chemically treated genomic DNA (Homo sapiens) CpG-island No: 39589
gcgcgaagggaaatcgcgttgagtagttggggtgggtgcgtttgggggcgtggtttgcgggtcggcgggcgggcgggagtttgcggtggaggcgtggtacgagggaggggcgaaatcgggtggcgcggagggggcgtggcgttgggaggggcggggggagtgggcggggtcgagatgggggcgtgcgcgttgataggagcgtcgggggagtgagagacgttttttggcgggagttggcggttgtggattttagcgggggcggaggggaagaggggagtaggggcggggagtaaggagtcgggaggagggcggcgggcgggtttgtttttttaaggtgttcgaggttcgcgggcgttgcgttgaggggacggcgggaggcgcggtttggtttcgtatttaaagtcgtcgtagcgcgtttcgggttcggtcgattcggcggggatttaggggtgggcgatttcgcgggatcgtggcgtatggtgagtgggagcggttggggggttgtgtagttttttggttttttggttgggaaggggtcgggcgtcgagttcggttttttagaggttcggggtcgcggcgagtttcgcgggggtcgggagaagtttgggttcggttgcgcggaggataaagtgggggtgttgggcgcgggcgtataggtcggacgtcgggagttagtagtatttttgcgtcgttttggtttagattatttttgggtcggttcgcgtttttcgtagttcgcgtcggtcgagtcggggtgggggtggtttcgggtgttcggttttttatatcgttatcggtttttgtttcgcggggcgttcggcgttttcggggttttggtatcgttttatagaggttcggttttgttttggtcgttgttagtgttattttttttaacgagaaatttgggcgtgatgtatgcgaaataattttgatgtatgatggtttt

SEQ ID NO: 39590 - DNA, 946 bp, Artificial Sequence
  chemically treated genomic DNA (Homo sapiens) CpG-island No: 39590
aaaaccatcatacatcaaaattatttcgcatacatcacgcccaaatttctcgttaaaaaaaataacactaacaacgaccaaaacaaaaccgaacctctataaaacgataccaaaaccccgaaaacgccgaacgccccgcgaaacaaaaaccgataacgatataaaaaaccgaacacccgaaaccacccccaccccgactcgaccgacgcgaactacgaaaaacgcgaaccgacccaaaaataatctaaaccaaaacgacgcaaaaatactactaactcccgacgtccgacctatacgcccgcgcccaacacccccactttatcctccgcgcaaccgaacccaaacttctcccgacccccgcgaaactcgccgcgaccccgaacctctaaaaaaccgaactcgacgcccgaccccttcccaaccaaaaaaccaaaaaactacacaaccccccaaccgctcccactcaccatacgccacgatcccgcgaaatcgcccacccctaaatccccgccgaatcgaccgaacccgaaacgcgctacgacgactttaaatacgaaaccaaaccgcgcctcccgccgtcccctcaacgcaacgcccgcgaacctcgaacaccttaaaaaaacaaacccgcccgccgccctcctcccgactccttactccccgcccctactcccctcttcccctccgcccccgctaaaatccacaaccgccaactcccgccaaaaaacgtctctcactcccccgacgctcctatcaacgcgcacgcccccatctcgaccccgcccactccccccgcccctcccaacgccacgccccctccgcgccacccgatttcgcccctccctcgtaccacgcctccaccgcaaactcccgcccgcccgccgacccgcaaaccacgcccccaaacgcacccaccccaactactcaacgcgatttcccttcgcgc

SEQ ID NO: 39591 - DNA, 946 bp, Artificial Sequence
  chemically treated genomic DNA (Homo sapiens) CpG-island No: 39591
gaaattattatgtattaaaattgtttcgtatatattacgtttaagtttttcgttaagggagatggtattgatagcgattagggtagagtcgagtttttgtagagcggtgttagggtttcgaaggcgtcggacgtttcgcgaggtagaggtcggtagcggtgtgggggatcgggtattcggaattatttttatttcggttcggtcgacgcgggttgcggaggacgcgggtcggtttagagatggtttggattaaagcggcgtagagatgttgttggttttcggcgttcggtttgtgcgttcgcgtttagtatttttattttgtttttcgcgtagtcgggtttaggtttttttcggttttcgcgaagttcgtcgcggtttcgggtttttagagggtcgagttcggcgttcggtttttttttaattaagaggttaagaggttgtataattttttagtcgtttttatttattatgcgttacggtttcgcgaagtcgtttatttttagattttcgtcgggtcggtcgagttcggggcgcgttgcggcggttttgagtgcgaggttaggtcgcgtttttcgtcgtttttttagcgtagcgttcgcgagtttcgggtattttaaagagataggttcgttcgtcgtttttttttcggttttttgtttttcgtttttgttttttttttttttttcgttttcgttggggtttatagtcgttagttttcgttaggaggcgttttttattttttcggcgtttttgttagcgcgtacgtttttatttcggtttcgtttatttttttcgttttttttaacgttacgtttttttcgcgttattcggtttcgtttttttttcgtgttacgtttttatcgtaggttttcgttcgttcgtcggttcgtaggttacgtttttaggcgtatttattttagttgtttaacgcgattttttttcgcgt

SEQ ID NO: 39592 - DNA, 946 bp, Artificial Sequence
  chemically treated genomic DNA (Homo sapiens) CpG-island No: 39592
acgcgaaaaaaaatcgcgttaaacaactaaaataaatacgcctaaaaacgtaacctacgaaccgacgaacgaacgaaaacctacgataaaaacgtaacacgaaaaaaaaacgaaaccgaataacgcgaaaaaaacgtaacgttaaaaaaaacgaaaaaaataaacgaaaccgaaataaaaacgtacgcgctaacaaaaacgccgaaaaaataaaaaacgcctcctaacgaaaactaacgactataaaccccaacgaaaacgaaaaaaaaaaaaaaaacaaaaacgaaaaacaaaaaaccgaaaaaaaaacgacgaacgaacctatctctttaaaatacccgaaactcgcgaacgctacgctaaaaaaacgacgaaaaacgcgacctaacctcgcactcaaaaccgccgcaacgcgccccgaactcgaccgacccgacgaaaatctaaaaataaacgacttcgcgaaaccgtaacgcataataaataaaaacgactaaaaaattatacaacctcttaacctcttaattaaaaaaaaaccgaacgccgaactcgaccctctaaaaacccgaaaccgcgacgaacttcgcgaaaaccgaaaaaaacctaaacccgactacgcgaaaaacaaaataaaaatactaaacgcgaacgcacaaaccgaacgccgaaaaccaacaacatctctacgccgctttaatccaaaccatctctaaaccgacccgcgtcctccgcaacccgcgtcgaccgaaccgaaataaaaataattccgaatacccgatcccccacaccgctaccgacctctacctcgcgaaacgtccgacgccttcgaaaccctaacaccgctctacaaaaactcgactctaccctaatcgctatcaataccatctcccttaacgaaaaacttaaacgtaatatatacgaaacaattttaatacataataatttc

SEQ ID NO: 39593 - DNA, 520 bp, Artificial Sequence
  chemically treated genomic DNA (Homo sapiens) CpG-island No: 39593
ttacgtaatttttcggcgggtttcggttataggcggagaggcggcggaaggcgggatttaaagggggtttcgttttacgggttttgattttcgtttaatggagggcggtttgagtttcgtttacgaaaggagtcgggaggcgttggcggttttaagagtttttgtgtttttggtagcggattttatttttttttacgtcggagtttcgatttttgcgtttcggttcgatttagttgcgttttgttcgtttaagacgcgcggaaattataatttttagagtttatttcgtcgagattcggttttacgagttaggtggcggaggttaggtgatagcggattcgttttttttaaagtttagtcgggtaggggaacgcggtgtatttttgatcggtatttggcgaggtttatgcgtttcgtgagggcggtttttcgagtttgggggcgtttaggtgagagcggacgcggttttttttgttttttaggcggattttttgaggtatagtaggttagcggggtagtt

SEQ ID NO: 39594 - DNA, 520 bp, Artificial Sequence
  chemically treated genomic DNA (Homo sapiens) CpG-island No: 39594
aactaccccgctaacctactatacctcaaaaaatccgcctaaaaaacaaaaaaaaccgcgtccgctctcacctaaacgcccccaaactcgaaaaaccgccctcacgaaacgcataaacctcgccaaataccgatcaaaaatacaccgcgttcccctacccgactaaactttaaaaaaaacgaatccgctatcacctaacctccgccacctaactcgtaaaaccgaatctcgacgaaataaactctaaaaattataatttccgcgcgtcttaaacgaacaaaacgcaactaaatcgaaccgaaacgcaaaaatcgaaactccgacgtaaaaaaaaataaaatccgctaccaaaaacacaaaaactcttaaaaccgccaacgcctcccgactcctttcgtaaacgaaactcaaaccgccctccattaaacgaaaatcaaaacccgtaaaacgaaaccccctttaaatcccgccttccgccgcctctccgcctataaccgaaacccgccgaaaaattacgtaa

SEQ ID NO: 39595 - DNA, 520 bp, Artificial Sequence
  chemically treated genomic DNA (Homo sapiens) CpG-island No: 39595
ggttgtttcgttgatttgttgtgttttaaggggttcgtttgggaaataggggaggtcgcgttcgtttttatttgagcgtttttaggttcgaggaatcgtttttacgggacgtatgagtttcgttaggtgtcggttaggaatgtatcgcgtttttttgttcggttagattttgggagaggcgggttcgttgttatttgattttcgttatttgattcgtggggtcggatttcggcgagatgagttttgggagttgtagttttcgcgcgttttagacggatagagcgtagttgggtcgggtcggggcgtagagatcggggtttcggcgtgagggaagatgaggttcgttgttagggatatagagatttttggagtcgttagcgtttttcggtttttttcgtgagcgaagtttagatcgttttttattgggcggaaattagagttcgtggggcggggttttttttaggtttcgtttttcgtcgttttttcgtttatagtcggggttcgtcgagaggttgcgtgg

SEQ ID NO: 39596 - DNA, 520 bp, Artificial Sequence
  chemically treated genomic DNA (Homo sapiens) CpG-island No: 39596
ccacgcaacctctcgacgaaccccgactataaacgaaaaaacgacgaaaaacgaaacctaaaaaaaaccccgccccacgaactctaatttccgcccaataaaaaacgatctaaacttcgctcacgaaaaaaaccgaaaaacgctaacgactccaaaaatctctatatccctaacaacgaacctcatcttccctcacgccgaaaccccgatctctacgccccgacccgacccaactacgctctatccgtctaaaacgcgcgaaaactacaactcccaaaactcatctcgccgaaatccgaccccacgaatcaaataacgaaaatcaaataacaacgaacccgcctctcccaaaatctaaccgaacaaaaaaacgcgatacattcctaaccgacacctaacgaaactcatacgtcccgtaaaaacgattcctcgaacctaaaaacgctcaaataaaaacgaacgcgacctcccctatttcccaaacgaaccccttaaaacacaacaaatcaacgaaacaacc

SEQ ID NO: 39597 - DNA, 587 bp, Artificial Sequence
  chemically treated genomic DNA (Homo sapiens) CpG-island No: 39597
atagggcgagggcggggtcggtaggtcggggcggggttgggaagtagtcgggcggggttgtgagacgtcgcgtttagtttttatcgttgggcggttaataagtgcgggtttggtttagcgcgggggggcgcggagatcgcgaggcgatcgggagcggttgggttttcggttgcgcgtttttcggttaggtcgggagtcgcgttagtcggagttttcggtttagcgtggttcgtttttttttgggcgtttatttgttcggagtattgttagcgggtatgatcgatttattaggggcgtcgtcgtcggcgttcgtaggtcgcggatgaagaagaaaattcggcgtcgttcgattcggagcgaggagttgattcggagcgaggagttgattttgagtgaggaagcgatttggagtgaagaggcgatttagagtgaggaggcgatttagggcgaagagatgaatcggagttaggaggtgattcgggacgaggagtcgattcggagcgaggaggtgattagggaggaaatggcggtagttgggtttatcgtgattgttatttatagtgagtgtcgggcgttaggtgggtttt

SEQ ID NO: 39598 - DNA, 587 bp, Artificial Sequence
  chemically treated genomic DNA (Homo sapiens) CpG-island No: 39598
aaaacccacctaacgcccgacactcactataaataacaatcacgataaacccaactaccgccatttcctccctaatcacctcctcgctccgaatcgactcctcgtcccgaatcacctcctaactccgattcatctcttcgccctaaatcgcctcctcactctaaatcgcctcttcactccaaatcgcttcctcactcaaaatcaactcctcgctccgaatcaactcctcgctccgaatcgaacgacgccgaattttcttcttcatccgcgacctacgaacgccgacgacgacgcccctaataaatcgatcatacccgctaacaatactccgaacaaataaacgcccaaaaaaaaacgaaccacgctaaaccgaaaactccgactaacgcgactcccgacctaaccgaaaaacgcgcaaccgaaaacccaaccgctcccgatcgcctcgcgatctccgcgcccccccgcgctaaaccaaacccgcacttattaaccgcccaacgataaaaactaaacgcgacgtctcacaaccccgcccgactacttcccaaccccgccccgacctaccgaccccgccctcgccctat

SEQ ID NO: 39599 - DNA, 587 bp, Artificial Sequence
  chemically treated genomic DNA (Homo sapiens) CpG-island No: 39599
ggagtttatttggcgttcgatatttattgtgggtgatagttacggtgagtttagttgtcgttattttttttttggttattttttcgtttcgggtcgatttttcgtttcgggttattttttggtttcgatttattttttcgttttgggtcgtttttttattttgggtcgtttttttattttaggtcgtttttttatttagggttaatttttcgtttcgggttaatttttcgtttcgggtcgagcggcgtcgggtttttttttttattcgcggtttgcgagcgtcggcggcggcgtttttggtgggtcggttatgttcgttggtagtatttcgggtaggtggacgtttagagggaggcggattacgttgggtcgggggtttcgattggcgcggttttcggtttggtcgaagggcgcgtagtcgggaatttagtcgttttcggtcgtttcgcggttttcgcgttttttcgcgttgagttaggttcgtatttgttgatcgtttagcgatggaagttgagcgcggcgttttataatttcgttcgattattttttagtttcgtttcggtttgtcggtttcgttttcgttttat

SEQ ID NO: 39600 - DNA, 587 bp, Artificial Sequence
  chemically treated genomic DNA (Homo sapiens) CpG-island No: 39600
ataaaacgaaaacgaaaccgacaaaccgaaacgaaactaaaaaataatcgaacgaaattataaaacgccgcgctcaacttccatcgctaaacgatcaacaaatacgaacctaactcaacgcgaaaaaacgcgaaaaccgcgaaacgaccgaaaacgactaaattcccgactacgcgcccttcgaccaaaccgaaaaccgcgccaatcgaaacccccgacccaacgtaatccgcctccctctaaacgtccacctacccgaaatactaccaacgaacataaccgacccaccaaaaacgccgccgccgacgctcgcaaaccgcgaataaaaaaaaaaacccgacgccgctcgacccgaaacgaaaaattaacccgaaacgaaaaattaaccctaaataaaaaaacgacctaaaataaaaaaacgacccaaaataaaaaaacgacccaaaacgaaaaaataaatcgaaaccaaaaaataacccgaaacgaaaaatcgacccgaaacgaaaaaataaccaaaaaaaaaataacgacaactaaactcaccgtaactatcacccacaataaatatcgaacgccaaataaactcc

SEQ ID NO: 39601 - DNA, 615 bp, Artificial Sequence
  chemically treated genomic DNA (Homo sapiens) CpG-island No: 39601
aggggttgtagcggggcggggagatgggcgggaggagtgggagttggtttcgcgcgcgggggagggttattaggttgggaaggagcgcgaagggttggggggcggagttaatggtttcgcgtgtttgttaggagagggcgggtagcgtcgcggcgcgcgcgattcggttgacgtatttggtttcggttttttaagattagagcggggtcgggagggagggggaagaggcgagagcgcggagggcgcgcgtgcgtattggcgcggggaggagtagggattttggtagcgggcgaggaggttgcgagcgagtcgcgaatcgagcgggcggcgggcgcgcgtattatgggggagaaattcgggattaggtaagggaggtggggttacgcggcggggtatgggcggcggttcggggcgggggttgggacggttttagacgagggcgtagcggagaggatttgggggtcggacgtttgggtttttagggatagttattcggggtcgtacgcgtaggttttcgaggataatgagggtgggggggaaatgttcgggtttttgtagaaagcgaggtttgagggggattagaaaaatcggtgtcggggttttcgtagggatgtg

SEQ ID NO: 39602 - DNA, 615 bp, Artificial Sequence
  chemically treated genomic DNA (Homo sapiens) CpG-island No: 39602
cacatccctacgaaaaccccgacaccgatttttctaatccccctcaaacctcgctttctacaaaaacccgaacatttcccccccaccctcattatcctcgaaaacctacgcgtacgaccccgaataactatccctaaaaacccaaacgtccgacccccaaatcctctccgctacgccctcgtctaaaaccgtcccaacccccgccccgaaccgccgcccataccccgccgcgtaaccccacctcccttacctaatcccgaatttctcccccataatacgcgcgcccgccgcccgctcgattcgcgactcgctcgcaacctcctcgcccgctaccaaaatccctactcctccccgcgccaatacgcacgcgcgccctccgcgctctcgcctcttccccctccctcccgaccccgctctaatcttaaaaaaccgaaaccaaatacgtcaaccgaatcgcgcgcgccgcgacgctacccgccctctcctaacaaacacgcgaaaccattaactccgccccccaacccttcgcgctccttcccaacctaataaccctcccccgcgcgcgaaaccaactcccactcctcccgcccatctccccgccccgctacaacccct

SEQ ID NO: 39603 - DNA, 615 bp, Artificial Sequence
  chemically treated genomic DNA (Homo sapiens) CpG-island No: 39603
tatatttttgcgagaatttcgatatcggtttttttgattttttttaggtttcgttttttgtaggggttcgggtattttttttttatttttattattttcgaggatttgcgcgtgcggtttcggatggttgtttttagggatttaggcgttcggtttttagatttttttcgttgcgttttcgtttgggatcgttttagttttcgtttcgagtcgtcgtttatgtttcgtcgcgtggttttattttttttatttggtttcgggttttttttttatggtgcgcgcgttcgtcgttcgttcggttcgcggttcgttcgtagttttttcgttcgttgttaagatttttgttttttttcgcgttaatgcgtacgcgcgtttttcgcgttttcgttttttttttttttttttcggtttcgttttggttttggggaatcggggttagatgcgttagtcggatcgcgcgcgtcgcggcgttgttcgtttttttttagtagatacgcggggttattggtttcgttttttagtttttcgcgtttttttttagtttggtagttttttttcgcgcgcggggttagtttttatttttttcgtttattttttcgtttcgttgtaattttt

SEQ ID NO: 39604 - DNA, 615 bp, Artificial Sequence
  chemically treated genomic DNA (Homo sapiens) CpG-island No: 39604
aaaaattacaacgaaacgaaaaaataaacgaaaaaaataaaaactaaccccgcgcgcgaaaaaaaactaccaaactaaaaaaaaacgcgaaaaactaaaaaacgaaaccaataaccccgcgtatctactaaaaaaaaacgaacaacgccgcgacgcgcgcgatccgactaacgcatctaaccccgattccccaaaaccaaaacgaaaccgaaaaaaaaaaaaaaaaaacgaaaacgcgaaaaacgcgcgtacgcattaacgcgaaaaaaaacaaaaatcttaacaacgaacgaaaaaactacgaacgaaccgcgaaccgaacgaacgacgaacgcgcgcaccataaaaaaaaaacccgaaaccaaataaaaaaaataaaaccacgcgacgaaacataaacgacgactcgaaacgaaaactaaaacgatcccaaacgaaaacgcaacgaaaaaaatctaaaaaccgaacgcctaaatccctaaaaacaaccatccgaaaccgcacgcgcaaatcctcgaaaataataaaaataaaaaaaaaatacccgaacccctacaaaaaacgaaacctaaaaaaaatcaaaaaaaccgatatcgaaattctcgcaaaaatata

SEQ ID NO: 39605 - DNA, 709 bp, Artificial Sequence
  chemically treated genomic DNA (Homo sapiens) CpG-island No: 39605
gttcgtagtttttttttttttaatttttttatcgtatttgtattgtatcgtaatttcggcgtataggtgtcgcgttattttttttatagggtcgcgggtacgcgggttacggatttatttgggtttcgtttatcgatttatgtagtcgtaataggtatatgagttcgggtaaatgtggggtcgagcggtttgggggatgtatcggagtaacggtagatttcgttcgaggttgtagtaaattagaaatattttttagtagtagtaggcggagtcgcgggttcgagtttattgtcgagagattttcggtttcgttaggaattttagtcgcggagttcgtagagggtttatttagaacggttgtcgttattttttttcgggttttagtggtggcgtggcgcgatgacgtaaatatatcgcgacggtcgtttattggggagggggcgtggggagggggttgcggttttgcgtattgagtgaaggtaggttggattcgcgggtttaagttgggaaggagtatgcgcggagagagtagtttgggcgtcgaggtagcggggtgttcggttttcggagtgatggcggatgaggttgtttgtgagcgtgttcgaggcggttttgtgatgttaaaggtatacgtggttcggataaaaggcgttaaagtcggaacgatttttatttagcggacggagttttgggatattttcgttgtagg

SEQ ID NO: 39606 - DNA, 709 bp, Artificial Sequence
  chemically treated genomic DNA (Homo sapiens) CpG-island No: 39606
cctacaacgaaaatatcccaaaactccgtccgctaaataaaaatcgttccgactttaacgccttttatccgaaccacgtatacctttaacatcacaaaaccgcctcgaacacgctcacaaacaacctcatccgccatcactccgaaaaccgaacaccccgctacctcgacgcccaaactactctctccgcgcatactccttcccaacttaaacccgcgaatccaacctaccttcactcaatacgcaaaaccgcaaccccctccccacgccccctccccaataaacgaccgtcgcgatatatttacgtcatcgcgccacgccaccactaaaacccgaaaaaaaataacgacaaccgttctaaataaaccctctacgaactccgcgactaaaattcctaacgaaaccgaaaatctctcgacaataaactcgaacccgcgactccgcctactactactaaaaaatatttctaatttactacaacctcgaacgaaatctaccgttactccgatacatcccccaaaccgctcgaccccacatttacccgaactcatatacctattacgactacataaatcgataaacgaaacccaaataaatccgtaacccgcgtacccgcgaccctataaaaaaaataacgcgacacctatacgccgaaattacgatacaatacaaatacgataaaaaaattaaaaaaaaaaaaactacgaac

SEQ ID NO: 39607 - DNA, 709 bp, Artificial Sequence
  chemically treated genomic DNA (Homo sapiens) CpG-island No: 39607
tttatagcgaagatgttttaagatttcgttcgttaaatggaaatcgtttcgattttggcgttttttgttcggattacgtgtatttttaatattataggatcgtttcggatacgtttataggtagttttattcgttattatttcgggaatcgagtatttcgttgtttcggcgtttaggttgtttttttcgcgtatgtttttttttagtttgagttcgcgagtttagtttgtttttatttagtgcgtaagatcgtagttttttttttacgttttttttttagtaggcggtcgtcgcggtgtgtttgcgttatcgcgttacgttattattggaattcgggggaagatggcggtagtcgttttgagtgggttttttgcgggtttcgcggttggggtttttggcgggatcgggggtttttcggtagtgagttcgggttcgcggtttcgtttgttgttgttggagagtgtttttggtttgttgtaatttcgaacggggtttgtcgttgtttcggtgtattttttaaatcgttcggttttatatttgttcgggtttatgtgtttattgcggttgtatgggtcggtgggcggggtttaggtgagttcgtggttcgcgtgttcgcggttttgtggggaggatggcgcggtatttgtgcgtcgggattacggtgtagtgtaagtgcgatagggaggttgaaggaaggagagttgcgggt

SEQ ID NO: 39608 - DNA, 709 bp, Artificial Sequence
  chemically treated genomic DNA (Homo sapiens) CpG-island No: 39608
acccgcaactctccttccttcaacctccctatcgcacttacactacaccgtaatcccgacgcacaaataccgcgccatcctccccacaaaaccgcgaacacgcgaaccacgaactcacctaaaccccgcccaccgacccatacaaccgcaataaacacataaacccgaacaaatataaaaccgaacgatttaaaaaatacaccgaaacaacgacaaaccccgttcgaaattacaacaaaccaaaaacactctccaacaacaacaaacgaaaccgcgaacccgaactcactaccgaaaaacccccgatcccgccaaaaaccccaaccgcgaaacccgcaaaaaacccactcaaaacgactaccgccatcttcccccgaattccaataataacgtaacgcgataacgcaaacacaccgcgacgaccgcctactaaaaaaaaaacgtaaaaaaaaaactacgatcttacgcactaaataaaaacaaactaaactcgcgaactcaaactaaaaaaaaacatacgcgaaaaaaacaacctaaacgccgaaacaacgaaatactcgattcccgaaataataacgaataaaactacctataaacgtatccgaaacgatcctataatattaaaaatacacgtaatccgaacaaaaaacgccaaaatcgaaacgatttccatttaacgaacgaaatcttaaaacatcttcgctataaa

SEQ ID NO: 39609 - DNA, 626 bp, Artificial Sequence
  chemically treated genomic DNA (Homo sapiens) CpG-island No: 39609
aatgataacgcgttagagattagttttagtatcgtgaaggaagcggtgagtgagggcgcggcgttcggtattgtggtggttttttttagcgtgattgatcgcgatttagaggagaatgggtaggtgtagtgcgagttattgggagacgtgttttttcgttttaagtttttttttaagaattattatattatcgttatcgaagtttttttggatcgagaggcgggggatttttatattttgattgtagtggttcgggatcggggcgagtttgcgttttttattagtaagtcgatttaggtataagtgtcggatgtgaacgataacgcgtcgcgttttagttagtcggtttacgacgtgtatgtgattgaaaataacgtgtttggcgtttatatttacgcggtgagcgttatcgatcgggatgagggcgttaacgtttagtttgtttattttattttcgagtgttagatttagggtatgagcgtttttatttacgtttttattaattttgagaacggttatttgtacgttttgcgttttttcgattatgagtagttgaaggattttagtttttaggtggaagttcgggacgttggtagtttttaggcgttggttggtaacgttattgt

SEQ ID NO: 39610 - DNA, 626 bp, Artificial Sequence
  chemically treated genomic DNA (Homo sapiens) CpG-island No: 39610
acaataacgttaccaaccaacgcctaaaaactaccaacgtcccgaacttccacctaaaaactaaaatccttcaactactcataatcgaaaaaacgcaaaacgtacaaataaccgttctcaaaattaataaaaacgtaaataaaaacgctcataccctaaatctaacactcgaaaataaaataaacaaactaaacgttaacgccctcatcccgatcgataacgctcaccgcgtaaatataaacgccaaacacgttattttcaatcacatacacgtcgtaaaccgactaactaaaacgcgacgcgttatcgttcacatccgacacttatacctaaatcgacttactaataaaaaacgcaaactcgccccgatcccgaaccactacaatcaaaatataaaaatcccccgcctctcgatccaaaaaaacttcgataacgataatataataattcttaaaaaaaaacttaaaacgaaaaaacacgtctcccaataactcgcactacacctacccattctcctctaaatcgcgatcaatcacgctaaaaaaaaccaccacaataccgaacgccgcgccctcactcaccgcttccttcacgatactaaaactaatctctaacgcgttatcatt

SEQ ID NO: 39611 - DNA, 626 bp, Artificial Sequence
  chemically treated genomic DNA (Homo sapiens) CpG-island No: 39611
atagtggcgttattagttagcgtttgggggttgttagcgtttcgggtttttatttgaaaattgaagttttttagttgtttatagtcgaaggagcgtagggcgtataagtagtcgtttttagagttgatagaaacgtaggtgaagacgtttatgttttggatttggtattcgaggatagagtaggtaagttgggcgttggcgtttttatttcggtcggtggcgtttatcgcgtagatgtaggcgttaggtacgttgtttttagttatatatacgtcgtagatcggttggttgaaacgcggcgcgttgtcgtttatattcgatatttgtatttggatcgatttattggtggagagcgtaggttcgtttcggtttcgagttattatagttagggtgtaggagtttttcgtttttcggtttaggggggtttcggtaacgatggtgtagtaatttttaaaggaagatttgaggcggaaaggtacgttttttagtagttcgtattgtatttgtttatttttttttgagtcgcggttagttacgttgaaaagggttattatagtgtcgggcgtcgcgtttttatttatcgttttttttacggtgttgaagttgatttttggcgcgttgttatt

SEQ ID NO: 39612 - DNA, 626 bp, Artificial Sequence
  chemically treated genomic DNA (Homo sapiens) CpG-island No: 39612
aataacaacgcgccaaaaatcaacttcaacaccgtaaaaaaaacgataaataaaaacgcgacgcccgacactataataacccttttcaacgtaactaaccgcgactcaaaaaaaaataaacaaatacaatacgaactactaaaaaacgtacctttccgcctcaaatcttcctttaaaaattactacaccatcgttaccgaaacccccctaaaccgaaaaacgaaaaactcctacaccctaactataataactcgaaaccgaaacgaacctacgctctccaccaataaatcgatccaaatacaaatatcgaatataaacgacaacgcgccgcgtttcaaccaaccgatctacgacgtatatataactaaaaacaacgtacctaacgcctacatctacgcgataaacgccaccgaccgaaataaaaacgccaacgcccaacttacctactctatcctcgaataccaaatccaaaacataaacgtcttcacctacgtttctatcaactctaaaaacgactacttatacgccctacgctccttcgactataaacaactaaaaaacttcaattttcaaataaaaacccgaaacgctaacaacccccaaacgctaactaataacgccactat

SEQ ID NO: 39613 - DNA, 1151 bp, Artificial Sequence
  chemically treated genomic DNA (Homo sapiens) CpG-island No: 39613
ttagtaggtgagtcgtaattattatttgcgcgggcgtattttgtaggtgtcgtcgaattataattcgtagacgcggtaatatagcggtatttgggacggaacgtttaaatcggtatatagtaataatatggtttggtgtttgtgggatatgttgatttattcgcgttacggtatggggaaacgttttggtgcggcggatgtggataaatgggcgttgtatgttatcggttagtattgcgattagttagtgtcggacggttttggcggtacggagtcgcgtattatttgtaatgcgtatttgattatatagcgtaaggcgtgggatgtgtttagcgatttttgttcggcgatgcgttgtatgtcggtatggaacgggtagacgttgacgttcgtgtaggatcgatcgtcggataagacgtggatttataatcgtagtaatgtggtgatgtcggatgatggcgcgtcgtttcgttatagttttagcgttttgaaggatcgttataatgtcgttgaggtgaattggattgattcgaataacggttgggagacggcgatagagtttgttgaagatacgtaggttattgttcgttacggtcgtaatgttacgaagatggatgtttttggttgtattagtcgggggtaggtatatcgcgtcgggttgtggttgattaaaatagaattgttggaaacgtagatcgtggattttagcgtcggcgtagaagggtttcgttatgtatcgggcgatgttattgaaatttgcgatgatgattatgtcggtattagtatcggtggtcgtgtgttggcggtgaatagttagattcggacgttgacgttcgatcgtgaaattacgttgttatttttcggtatcgcgttgataagtttggttgacggaagtggtaattcggttagcgtggaggtttagttcgttatcgacggcgtgaaggtaaaagtgagtcgtgtttttgacggtgttgttgaatatagcgtatgggagttgaagttgtcgacgttgcgttagcgattgtttcgttgcgtgagtattcgtgagaacgacgacggtacgtatgttattatcgtcgtgtagtatgtgtcggaaaaagaggttatcgtggataacggggcgtattttgacggcgaatagagtggtacgg

SEQ ID NO: 39614 - DNA, 1151 bp, Artificial Sequence
  chemically treated genomic DNA (Homo sapiens) CpG-island No: 39614
ccgtaccactctattcgccgtcaaaatacgccccgttatccacgataacctctttttccgacacatactacacgacgataataacatacgtaccgtcgtcgttctcacgaatactcacgcaacgaaacaatcgctaacgcaacgtcgacaacttcaactcccatacgctatattcaacaacaccgtcaaaaacacgactcacttttaccttcacgccgtcgataacgaactaaacctccacgctaaccgaattaccacttccgtcaaccaaacttatcaacgcgataccgaaaaataacaacgtaatttcacgatcgaacgtcaacgtccgaatctaactattcaccgccaacacacgaccaccgatactaataccgacataatcatcatcgcaaatttcaataacatcgcccgatacataacgaaacccttctacgccgacgctaaaatccacgatctacgtttccaacaattctattttaatcaaccacaacccgacgcgatatacctacccccgactaatacaaccaaaaacatccatcttcgtaacattacgaccgtaacgaacaataacctacgtatcttcaacaaactctatcgccgtctcccaaccgttattcgaatcaatccaattcacctcaacgacattataacgatccttcaaaacgctaaaactataacgaaacgacgcgccatcatccgacatcaccacattactacgattataaatccacgtcttatccgacgatcgatcctacacgaacgtcaacgtctacccgttccataccgacatacaacgcatcgccgaacaaaaatcgctaaacacatcccacgccttacgctatataatcaaatacgcattacaaataatacgcgactccgtaccgccaaaaccgtccgacactaactaatcgcaatactaaccgataacatacaacgcccatttatccacatccgccgcaccaaaacgtttccccataccgtaacgcgaataaatcaacatatcccacaaacaccaaaccatattattactatataccgatttaaacgttccgtcccaaataccgctatattaccgcgtctacgaattataattcgacgacacctacaaaatacgcccgcgcaaataataattacgactcacctactaa

SEQ ID NO: 39615 - DNA, 1151 bp, Artificial Sequence
  chemically treated genomic DNA (Homo sapiens) CpG-island No: 39615
tcgtgttattttgttcgtcgttaaagtgcgtttcgttatttacgatggttttttttttcggtatatgttgtacggcggtgatggtatacgtgtcgtcgtcgtttttacggatatttacgtagcggaatagtcgttggcgtagcgtcggtagttttagtttttatacgttgtatttagtaatatcgttaggaatacggtttatttttatttttacgtcgtcggtgacggattgaatttttacgttgatcggattgttattttcgttaattaggtttattagcgcggtatcggaggatggtagcgtgattttacggtcgagcgttagcgttcgggtttggttgtttatcgttagtatacgattatcggtgttgatatcggtatagttattatcgtagattttaataatatcgttcggtatatggcgaagtttttttgcgtcgacgttgaaatttacggtttgcgtttttagtagttttgttttaattagttatagttcggcgcggtgtgtttgttttcggttggtatagttaaaggtatttattttcgtaatattacgatcgtaacgggtaatggtttgcgtatttttaataagttttgtcgtcgttttttagtcgttgttcgggttaatttagtttattttaacggtattatggcggttttttagggcgttgaagttgtagcggaacggcgcgttattattcggtattattatattattgcggttataggtttacgttttattcgacggtcggttttgtacgaacgttagcgtttgttcgttttatatcggtatatagcgtatcgtcgagtagaaatcgttgagtatattttacgttttacgttgtgtggttaggtacgtattataggtgatgcgcggtttcgtgtcgttaaagtcgttcggtattgattggtcgtagtattggtcgatgatatatagcgtttatttatttatattcgtcgtattaagacgtttttttatgtcgtagcgcggatgggttagtatattttatagatattaggttatgttgttgttgtatgtcggtttaaacgtttcgttttagatatcgttgtattgtcgcgtttgcgggttatagttcgacggtatttgtagaatacgttcgcgtagatgataattacggtttatttgttgg

SEQ ID NO: 39616 - DNA, 1151 bp, Artificial Sequence
  chemically treated genomic DNA (Homo sapiens) CpG-island No: 39616
ccaacaaataaaccgtaattatcatctacgcgaacgtattctacaaataccgtcgaactataacccgcaaacgcgacaatacaacgatatctaaaacgaaacgtttaaaccgacatacaacaacaacataacctaatatctataaaatatactaacccatccgcgctacgacataaaaaaacgtcttaatacgacgaatataaataaataaacgctatatatcatcgaccaatactacgaccaatcaataccgaacgactttaacgacacgaaaccgcgcatcacctataatacgtacctaaccacacaacgtaaaacgtaaaatatactcaacgatttctactcgacgatacgctatataccgatataaaacgaacaaacgctaacgttcgtacaaaaccgaccgtcgaataaaacgtaaacctataaccgcaataatataataataccgaataataacgcgccgttccgctacaacttcaacgccctaaaaaaccgccataataccgttaaaataaactaaattaacccgaacaacgactaaaaaacgacgacaaaacttattaaaaatacgcaaaccattacccgttacgatcgtaatattacgaaaataaatacctttaactataccaaccgaaaacaaacacaccgcgccgaactataactaattaaaacaaaactactaaaaacgcaaaccgtaaatttcaacgtcgacgcaaaaaaacttcgccatataccgaacgatattattaaaatctacgataataactataccgatatcaacaccgataatcgtatactaacgataaacaaccaaacccgaacgctaacgctcgaccgtaaaatcacgctaccatcctccgataccgcgctaataaacctaattaacgaaaataacaatccgatcaacgtaaaaattcaatccgtcaccgacgacgtaaaaataaaaataaaccgtattcctaacgatattactaaatacaacgtataaaaactaaaactaccgacgctacgccaacgactattccgctacgtaaatatccgtaaaaacgacgacgacacgtataccatcaccgccgtacaacatataccgaaaaaaaaaaccatcgtaaataacgaaacgcactttaacgacgaacaaaataacacga

SEQ ID NO: 39617 - DNA, 581 bp, Artificial Sequence
  chemically treated genomic DNA (Homo sapiens) CpG-island No: 39617
tttcggttggaaggttacggttagcgtggtgttttgtttttttattatcgaggtgttggtaggcgttacggttatgtcggttgtcgttgttatcgtgttgcgattttttgttatcgacggacgttttatattggtgatttttatcgtgcgggtgattatttttttcgtcgttatcgttttatcgatattgttgatttagttacggaatatatcgatcgtgtcgttcgggaagcggattttataggtacgggtatcgtttttattaaattacgttagtagcgtttgttgtttttgtttttcgggtatttacgttagcgtgaagttggtattttcggtagatttttgtttttgttcggtcgtagtttagtttgtatttttattatcgagatagttgtcgttataggatttagcggttagttcgtcgggcgttaggtttttaatttttgttagacgcgattagttaacgtttgaaagcggattcgcgtaagggttatcgttttttttataaatttatagggtggtttcggtattttttatcggtattgtaggatttggtataggtatagcgtttttatatttta

SEQ ID NO: 39618 - DNA, 581 bp, Artificial Sequence
  chemically treated genomic DNA (Homo sapiens) CpG-island No: 39618
taaaatataaaaacgctatacctataccaaatcctacaataccgataaaaaataccgaaaccaccctataaatttataaaaaaaacgataacccttacgcgaatccgctttcaaacgttaactaatcgcgtctaacaaaaattaaaaacctaacgcccgacgaactaaccgctaaatcctataacgacaactatctcgataataaaaatacaaactaaactacgaccgaacaaaaacaaaaatctaccgaaaataccaacttcacgctaacgtaaatacccgaaaaacaaaaacaacaaacgctactaacgtaatttaataaaaacgatacccgtacctataaaatccgcttcccgaacgacacgatcgatatattccgtaactaaatcaacaatatcgataaaacgataacgacgaaaaaaataatcacccgcacgataaaaatcaccaatataaaacgtccgtcgataacaaaaaatcgcaacacgataacaacgacaaccgacataaccgtaacgcctaccaacacctcgataataaaaaaacaaaacaccacgctaaccgtaaccttccaaccgaaa

SEQ ID NO: 39619 - DNA, 581 bp, Artificial Sequence
  chemically treated genomic DNA (Homo sapiens) CpG-island No: 39619
tgaaatgtgaggacgttatgtttgtattaaattttataatgtcggtgaaaggtgtcgggattattttgtgggtttataaggggagcggtgatttttacgcgaattcgtttttagacgttgattggtcgcgtttggtaaaagttaaagatttgacgttcggcgaattgatcgttgagttttatgacgatagttatttcgatgatgaagatgtagattggattgcgatcgggtaggggtagaaatttgtcggagatattagttttacgttggcgtggatgttcggagagtaggggtagtaggcgttgttggcgtggtttaatgaaggcgatattcgtgtttataaaattcgtttttcgaacggtacggtcgatgtgtttcgtggttgggttagtagtatcggtaaggcggtgacggcgaaggaagtgattattcgtacggtgaaagttattaatgtgggacgttcgtcgatggtagaagatcgtagtacggtaatagcggtaatcggtatgatcgtgacgtttgttagtatttcggtggtgaaagggtagagtattacgttgatcgtggttttttagtcggag

SEQ ID NO: 39620 - DNA, 581 bp, Artificial Sequence
  chemically treated genomic DNA (Homo sapiens) CpG-island No: 39620
ctccgactaaaaaaccacgatcaacgtaatactctaccctttcaccaccgaaatactaacaaacgtcacgatcataccgattaccgctattaccgtactacgatcttctaccatcgacgaacgtcccacattaataactttcaccgtacgaataatcacttccttcgccgtcaccgccttaccgatactactaacccaaccacgaaacacatcgaccgtaccgttcgaaaaacgaattttataaacacgaatatcgccttcattaaaccacgccaacaacgcctactacccctactctccgaacatccacgccaacgtaaaactaatatctccgacaaatttctacccctacccgatcgcaatccaatctacatcttcatcatcgaaataactatcgtcataaaactcaacgatcaattcgccgaacgtcaaatctttaacttttaccaaacgcgaccaatcaacgtctaaaaacgaattcgcgtaaaaatcaccgctccccttataaacccacaaaataatcccgacacctttcaccgacattataaaatttaatacaaacataacgtcctcacatttca

SEQ ID NO: 39621 - DNA, 572 bp, Artificial Sequence
  chemically treated genomic DNA (Homo sapiens) CpG-island No: 39621
atcgcggtattagttttatcgtcgaggaggagcgttttttcgacgtcgtcgagtacggtaatattttagtggtgcgtaagatgttggaggagtttaagacgttgaacgttaattgcgtggattatatgggttagaacgcgttgtagttggttgtgggtaacgagtatttggaggtgatcgagttgttgtttaagaaggagaatttggcgcgtattggcgacgttttgttgttcgttattagtaagggttacgtgcgtatcgtagaggttatttttaattattttggtttcgcggttagtaagcgttttattttgagtttttgtgagtaggagttgtaggacgacgatttttacgtttacgacgaggacggtacgcgtttttcgtcggatattatttttattattttggcggcgtattgttagaaatacgaagtggtgtatatgttgttgatgaagggtgttaggatcgagcggtcgtacgattatttttgtaagtgcggggattgtatggagaagtagaggtacgatttttttagttatttacgttcgaggattaatgtttataaggggttg

SEQ ID NO: 39622 - DNA, 572 bp, Artificial Sequence
  chemically treated genomic DNA (Homo sapiens) CpG-island No: 39622
caaccccttataaacattaatcctcgaacgtaaataactaaaaaaatcgtacctctacttctccatacaatccccgcacttacaaaaataatcgtacgaccgctcgatcctaacacccttcatcaacaacatatacaccacttcgtatttctaacaatacgccgccaaaataataaaaataatatccgacgaaaaacgcgtaccgtcctcgtcgtaaacgtaaaaatcgtcgtcctacaactcctactcacaaaaactcaaaataaaacgcttactaaccgcgaaaccaaaataattaaaaataacctctacgatacgcacgtaacccttactaataacgaacaacaaaacgtcgccaatacgcgccaaattctccttcttaaacaacaactcgatcacctccaaatactcgttacccacaaccaactacaacgcgttctaacccatataatccacgcaattaacgttcaacgtcttaaactcctccaacatcttacgcaccactaaaatattaccgtactcgacgacgtcgaaaaaacgctcctcctcgacgataaaactaataccgcgat

SEQ ID NO: 39623 - DNA, 572 bp, Artificial Sequence
  chemically treated genomic DNA (Homo sapiens) CpG-island No: 39623
tagttttttgtaggtattgattttcgagcgtgagtggttgaaggagtcgtgtttttgtttttttatgtagttttcgtatttgtagaaatagtcgtgcggtcgttcgattttggtattttttattagtagtatgtgtattatttcgtatttttggtagtgcgtcgttaggatgatgggggtgatgttcggcgagaagcgcgtgtcgttttcgtcgtaagcgtagaagtcgtcgttttgtagtttttgtttataggggtttagagtgagacgtttgttggtcgcgaagttagggtggttgaggatggtttttacgatgcgtacgtagtttttgttgatggcgagtagtagggcgtcgttaatgcgcgttaggtttttttttttgagtagtagttcggttatttttaggtgttcgttgtttatagttagttgtagcgcgttttggtttatgtagtttacgtagttgacgtttagcgttttggatttttttagtattttgcgtattattgggatgttgtcgtattcggcggcgtcgaggaagcgttttttttcggcggtgaggttggtgtcgcggt

SEQ ID NO: 39624 - DNA, 572 bp, Artificial Sequence
  chemically treated genomic DNA (Homo sapiens) CpG-island No: 39624
accgcgacaccaacctcaccgccgaaaaaaaacgcttcctcgacgccgccgaatacgacaacatcccaataatacgcaaaatactaaaaaaatccaaaacgctaaacgtcaactacgtaaactacataaaccaaaacgcgctacaactaactataaacaacgaacacctaaaaataaccgaactactactcaaaaaaaaaaacctaacgcgcattaacgacgccctactactcgccatcaacaaaaactacgtacgcatcgtaaaaaccatcctcaaccaccctaacttcgcgaccaacaaacgtctcactctaaacccctataaacaaaaactacaaaacgacgacttctacgcttacgacgaaaacgacacgcgcttctcgccgaacatcacccccatcatcctaacgacgcactaccaaaaatacgaaataatacacatactactaataaaaaataccaaaatcgaacgaccgcacgactatttctacaaatacgaaaactacataaaaaaacaaaaacacgactccttcaaccactcacgctcgaaaatcaatacctacaaaaaacta

SEQ ID NO: 39625 - DNA, 828 bp, Artificial Sequence
  chemically treated genomic DNA (Homo sapiens) CpG-island No: 39625
cgcgcgggatcgagggggcgagttttcggtcgaggtttgttttttttaaattattttaaatcgaattgtttggtcgtattatgtgggtttcggaggtttcgggttcgacgtggagtcgttcggcgcgcgttttttcgtttttcgttcggtatcgtttttcgaggcgcgggtcgcggtcgggttcggtatttataggttcggttcgtgggagaagggcggcgggtagtagtcgtgcggttttcgttgcgagggcgtcgagcgcggttttagtttttcgttgacgtttttttagtttcggcggcggcgttgcggtttcgcgttttcgttttcgttttcgttttttttttttttcggcgtcgggaaggttatttttgtttgttttttgtattttttgattttggtggatatcgcgtcggttgcggttcgagtgtgggggtgtcggttgtcggtttttttcgttttcgcggtagtgtagttttttcgcggcgtttttttattatttttcgcggttttcggggtttcgggcggtttagggcgggaaggtaggagcggagagcgtcgcggttcgcgatttagtagttagaggttagcgtcgaagtcgagttgtcgtcgtttattattaaatcgtgggagtagttgtcgcggtcgtggttgcgacgaggaagttcggggtcgagcggggttttggtgttgggagaggttttttagtttcgcggcggcggcgatgttttttcggcgttcgttttttgttttcgatagtattatttgttaggatagtatcgttatttagggagaaggagagggagggcgggagggggaagaggaggg

SEQ ID NO: 39626 - DNA, 828 bp, Artificial Sequence
  chemically treated genomic DNA (Homo sapiens) CpG-island No: 39626
ccctcctcttccccctcccgccctccctctccttctccctaaataacgatactatcctaacaaataatactatcgaaaacaaaaaacgaacgccgaaaaaacatcgccgccgccgcgaaactaaaaaacctctcccaacaccaaaaccccgctcgaccccgaacttcctcgtcgcaaccacgaccgcgacaactactcccacgatttaataataaacgacgacaactcgacttcgacgctaacctctaactactaaatcgcgaaccgcgacgctctccgctcctaccttcccgccctaaaccgcccgaaaccccgaaaaccgcgaaaaataataaaaaaacgccgcgaaaaaactacactaccgcgaaaacgaaaaaaaccgacaaccgacacccccacactcgaaccgcaaccgacgcgatatccaccaaaatcaaaaaatacaaaaaacaaacaaaaataaccttcccgacgccgaaaaaaaaaaaaaacgaaaacgaaaacgaaaacgcgaaaccgcaacgccgccgccgaaactaaaaaaacgtcaacgaaaaactaaaaccgcgctcgacgccctcgcaacgaaaaccgcacgactactacccgccgcccttctcccacgaaccgaacctataaataccgaacccgaccgcgacccgcgcctcgaaaaacgataccgaacgaaaaacgaaaaaacgcgcgccgaacgactccacgtcgaacccgaaacctccgaaacccacataatacgaccaaacaattcgatttaaaataatttaaaaaaaacaaacctcgaccgaaaactcgccccctcgatcccgcgcg

SEQ ID NO: 39627 - DNA, 828 bp, Artificial Sequence
  chemically treated genomic DNA (Homo sapiens) CpG-island No: 39627
ttttttttttttttttttcgttttttttttttttttttttgagtaacgatgttgttttagtaagtgatgttgtcggagataggagacgggcgtcgaggaggtatcgtcgtcgtcgcggggttggagagttttttttagtattagagtttcgttcggtttcgggttttttcgtcgtagttacggtcgcggtagttgtttttacggtttgatggtgggcggcggtagttcggtttcggcgttagtttttaattgttggatcgcgggtcgcgacgtttttcgtttttgttttttcgttttgggtcgttcggggtttcggaagtcgcgggaggtggtgaaggggcgtcgcgggaagattgtattgtcgcgaaggcggaggaggtcggtagtcggtatttttatattcggatcgtagtcggcgcgatgtttattaaggttaggaagtgtaaagaataagtaagggtgattttttcggcgtcggaggaggaggaagacgagggcgaggacgagggcgcggagtcgtagcgtcgtcgtcggggttggaggggcgttaacggggggttggagtcgcgttcggcgttttcgtagcgggagtcgtacggttattgttcgtcgttttttttttacgggtcggatttgtgagtatcgggttcggtcgcggttcgcgtttcggagggcggtgtcgggcggggggcgggaaggcgcgcgtcgggcggttttacgtcgagttcgggattttcgagatttatatggtacggttaggtagttcgatttggagtgatttggaggggatagatttcggtcggaggttcgttttttcggtttcgcgcg

SEQ ID NO: 39628 - DNA, 828 bp, Artificial Sequence
  chemically treated genomic DNA (Homo sapiens) CpG-island No: 39628
cgcgcgaaaccgaaaaaacgaacctccgaccgaaatctatcccctccaaatcactccaaatcgaactacctaaccgtaccatataaatctcgaaaatcccgaactcgacgtaaaaccgcccgacgcgcgccttcccgccccccgcccgacaccgccctccgaaacgcgaaccgcgaccgaacccgatactcacaaatccgacccgtaaaaaaaaaacgacgaacaataaccgtacgactcccgctacgaaaacgccgaacgcgactccaaccccccgttaacgcccctccaaccccgacgacgacgctacgactccgcgccctcgtcctcgccctcgtcttcctcctcctccgacgccgaaaaaatcacccttacttattctttacacttcctaaccttaataaacatcgcgccgactacgatccgaatataaaaataccgactaccgacctcctccgccttcgcgacaatacaatcttcccgcgacgccccttcaccacctcccgcgacttccgaaaccccgaacgacccaaaacgaaaaaacaaaaacgaaaaacgtcgcgacccgcgatccaacaattaaaaactaacgccgaaaccgaactaccgccgcccaccatcaaaccgtaaaaacaactaccgcgaccgtaactacgacgaaaaaacccgaaaccgaacgaaactctaatactaaaaaaaactctccaaccccgcgacgacgacgatacctcctcgacgcccgtctcctatctccgacaacatcacttactaaaacaacatcgttactcaaaaaaaaaaaaaaaaaaaacgaaaaaaaaaaaaaaaaaa

SEQ ID NO: 39629 - DNA, 766 bp, Artificial Sequence
  chemically treated genomic DNA (Homo sapiens) CpG-island No: 39629
tattttttttcgtttcgcgtaggcgttttttttcgttttagttagtttgttttttttttttgtttcgtttttgtttagttttttttggtttattttttattcgtttgcgattttgtcgttttgaatgacgttaaggtcgcgagcgtttttattggtttattttaatagtcgcgggatatttgaattgtaagaatagtcgtcgtttcggcgggttgttcgttgtatttttgggcgtttttggttcgttacgttgggtagtgtttgtttgcgtttttcgtaattttttcggttttgcgtggtttcgagttgggtgagcgagcgggcgggttggtaggttggtttgggttgcgatcggcggttacgattattttttggtcgggtcggtgcgagtggtcggttgggtagagtgtacgttgtttggcgtcgtaggttgatttcgtcgtttattttcgggagtagtgatgttgggtaattttgcgtcggggtttgcgattcgcgaggcgggttcggcgttgttagtattgtagtagacggcgttttaagaggattaggagaatattaattcggaaaaggtagcgttcgtttaataatcgcggattcgggtcgcgttggcggtattgaagttcgggaattcgcggggtttagcgtagtagtagaggtcgaagacgagacgggtaaagggatgcgggatatttgtaggagggtgggtcgagtagggtttggtattggtttagtaggtagagaagagtggcgagaaggtatgttt

SEQ ID NO: 39630 - DNA, 766 bp, Artificial Sequence
  chemically treated genomic DNA (Homo sapiens) CpG-island No: 39630
aaacataccttctcgccactcttctctacctactaaaccaataccaaaccctactcgacccaccctcctacaaatatcccgcatccctttacccgtctcgtcttcgacctctactactacgctaaaccccgcgaattcccgaacttcaataccgccaacgcgacccgaatccgcgattattaaacgaacgctaccttttccgaattaatattctcctaatcctcttaaaacgccgtctactacaatactaacaacgccgaacccgcctcgcgaatcgcaaaccccgacgcaaaattacccaacatcactactcccgaaaataaacgacgaaatcaacctacgacgccaaacaacgtacactctacccaaccgaccactcgcaccgacccgaccaaaaaataatcgtaaccgccgatcgcaacccaaaccaacctaccaacccgcccgctcgctcacccaactcgaaaccacgcaaaaccgaaaaaattacgaaaaacgcaaacaaacactacccaacgtaacgaaccaaaaacgcccaaaaatacaacgaacaacccgccgaaacgacgactattcttacaattcaaatatcccgcgactattaaaataaaccaataaaaacgctcgcgaccttaacgtcattcaaaacgacaaaatcgcaaacgaataaaaaataaaccaaaaaaaactaaacaaaaacgaaacaaaaaaaaaaaacaaactaactaaaacgaaaaaaaacgcctacgcgaaacgaaaaaaaata

SEQ ID NO: 39631 - DNA, 766 bp, Artificial Sequence
  chemically treated genomic DNA (Homo sapiens) CpG-island No: 39631
ggatatgttttttcgttatttttttttgtttgttaagttaatgttaaattttgttcgatttatttttttgtagatatttcgtatttttttattcgtttcgttttcggtttttgttgttgcgttagatttcgcgggttttcggattttagtatcgttagcgcggttcgggttcgcggttgttggacgggcgttgtttttttcgggttgatatttttttggtttttttggagcgtcgtttgttgtaatgttagtagcgtcgagttcgtttcgcgggtcgtaggtttcggcgtagagttgtttaatattattgttttcgggagtggacggcgggattagtttgcggcgttaagtagcgtgtattttgtttagtcgattattcgtatcgattcggttaaagaatagtcgtagtcgtcggtcgtagtttaggttagtttattagttcgttcgttcgtttatttagttcgagattacgtagggtcgaggaggttgcgaaaggcgtaggtaggtattgtttagcgtggcgagttaaagacgtttagagatgtagcgagtagttcgtcggagcggcggttgtttttgtagtttaagtatttcgcgattattgaaatggattaatgaaagcgttcgcggttttgacgttatttaaggcgatagggtcgtaggcgagtgaagggtaaattaaaggaaattgagtaggggcggggtaggagggagaaataaattggttggggcgggagaaaacgtttgcgcggggcggggagaggta

SEQ ID NO: 39632 - DNA, 766 bp, Artificial Sequence
  chemically treated genomic DNA (Homo sapiens) CpG-island No: 39632
tacctctccccgccccgcgcaaacgttttctcccgccccaaccaatttatttctccctcctaccccgcccctactcaatttcctttaatttacccttcactcgcctacgaccctatcgccttaaataacgtcaaaaccgcgaacgctttcattaatccatttcaataatcgcgaaatacttaaactacaaaaacaaccgccgctccgacgaactactcgctacatctctaaacgtctttaactcgccacgctaaacaatacctacctacgcctttcgcaacctcctcgaccctacgtaatctcgaactaaataaacgaacgaacgaactaataaactaacctaaactacgaccgacgactacgactattctttaaccgaatcgatacgaataatcgactaaacaaaatacacgctacttaacgccgcaaactaatcccgccgtccactcccgaaaacaataatattaaacaactctacgccgaaacctacgacccgcgaaacgaactcgacgctactaacattacaacaaacgacgctccaaaaaaaccaaaaaaatatcaacccgaaaaaaacaacgcccgtccaacaaccgcgaacccgaaccgcgctaacgatactaaaatccgaaaacccgcgaaatctaacgcaacaacaaaaaccgaaaacgaaacgaataaaaaaatacgaaatatctacaaaaaaataaatcgaacaaaatttaacattaacttaacaaacaaaaaaaaataacgaaaaaacatatcc

SEQ ID NO: 39633 - DNA, 843 bp, Artificial Sequence
  chemically treated genomic DNA (Homo sapiens) CpG-island No: 39633
ggggttcgcgcgtatttttttcggcgcggtagaaggttggtattgttgtttttttgcgggttttagagtcgttgggcgttcgcggtcgcgtagtcggattgtatttttgcggggttcgttttcgggtttggttcggggtcgtcgtcgtcgtcgtcgtttttttcggcgcgtaggttgttttttagtcgcggttacggggtagcgttcggttttttttttcgcgttttcgttttcgtcgcgttcgttttcggtttacgttgttttcgtagtttcggttcggcgtaggtaggagcggttttttggacgtcgagttcgggaagcggagggcggcgggttcggcgagcggtagcggcggtcgaggcgttggggcggtcgttgttttttcggttcgggaggtcggcgatcgtcgggcgttcgaaggggcgtcgcgttttcggagtcggggttgttcgtcgggtttttcgtgcgttttttcgagagtttcggtcggggcgcggcggagggtagagtcgtcggtttttattttcgggtcggtaggaggttttgcgttcgggcgtcggcgatagttcgcgtcgcgaagtttagtattttttttcgtcgtttcgcggttggcgcggatatgggcgtttagggttgcgcgttcggtttcgggattcgtaaagtttgttagtcggttgggcgcggagtcgagggcgcgttcggttttagcgttttcggaggagattcggcgtttttcgattcggcgcgagggcggtggagtttagagggggtggttcggtttcgttagatgttgtttgtaaagttagagagaagaaaattttagttttagggagattcggatcg

SEQ ID NO: 39634 - DNA, 843 bp, Artificial Sequence
  chemically treated genomic DNA (Homo sapiens) CpG-island No: 39634
cgatccgaatctccctaaaactaaaattttcttctctctaactttacaaacaacatctaacgaaaccgaaccaccccctctaaactccaccgccctcgcgccgaatcgaaaaacgccgaatctcctccgaaaacgctaaaaccgaacgcgccctcgactccgcgcccaaccgactaacaaactttacgaatcccgaaaccgaacgcgcaaccctaaacgcccatatccgcgccaaccgcgaaacgacgaaaaaaaatactaaacttcgcgacgcgaactatcgccgacgcccgaacgcaaaacctcctaccgacccgaaaataaaaaccgacgactctaccctccgccgcgccccgaccgaaactctcgaaaaaacgcacgaaaaacccgacgaacaaccccgactccgaaaacgcgacgccccttcgaacgcccgacgatcgccgacctcccgaaccgaaaaaacaacgaccgccccaacgcctcgaccgccgctaccgctcgccgaacccgccgccctccgcttcccgaactcgacgtccaaaaaaccgctcctacctacgccgaaccgaaactacgaaaacaacgtaaaccgaaaacgaacgcgacgaaaacgaaaacgcgaaaaaaaaaaccgaacgctaccccgtaaccgcgactaaaaaacaacctacgcgccgaaaaaaacgacgacgacgacgacgaccccgaaccaaacccgaaaacgaaccccgcaaaaatacaatccgactacgcgaccgcgaacgcccaacgactctaaaacccgcaaaaaaacaacaataccaaccttctaccgcgccgaaaaaaatacgcgcgaacccc

SEQ ID NO: 39635 - DNA, 843 bp, Artificial Sequence
  chemically treated genomic DNA (Homo sapiens) CpG-island No: 39635
cggttcgaatttttttggagttgaagtttttttttttttaattttgtaggtagtatttggcggggtcgaattattttttttgggttttatcgttttcgcgtcgaatcgggagacgtcgggtttttttcgggggcgttggggtcgggcgcgttttcggtttcgcgtttagtcggttagtaaattttgcgggtttcggagtcgggcgcgtagttttgagcgtttatgttcgcgttagtcgcggggcggcgggggagggtgttgggtttcgcgacgcgggttgtcgtcggcgttcgggcgtagagttttttgtcggttcgaggatggagatcggcggttttgtttttcgtcgcgtttcggtcggagttttcgggaagacgtacggagagttcggcgggtagtttcggtttcggggacgcggcgttttttcggacgttcggcgatcgtcgatttttcgggtcggaggagtaacggtcgttttagcgtttcggtcgtcgttgtcgttcgtcgagttcgtcgtttttcgtttttcgggttcggcgtttagagagtcgtttttgtttgcgtcgagtcggagttgcgggggtagcgtgagtcggggacgagcgcggcggaggcggagacgcggagaggggggtcgagcgttatttcgtggtcgcgattggagagtagtttgcgcgtcgggaggggcggcggcggcggcggcggtttcgagttaggttcgggagcgagtttcgtagaaatataattcgattgcgcggtcgcgggcgtttagcggttttgggattcgtaggggggtagtagtgttaattttttgtcgcgtcgggagagatgcgcgcgagtttt

SEQ ID NO: 39636 - DNA, 843 bp, Artificial Sequence
  chemically treated genomic DNA (Homo sapiens) CpG-island No: 39636
aaaactcgcgcgcatctctcccgacgcgacaaaaaattaacactactacccccctacgaatcccaaaaccgctaaacgcccgcgaccgcgcaatcgaattatatttctacgaaactcgctcccgaacctaactcgaaaccgccgccgccgccgccgcccctcccgacgcgcaaactactctccaatcgcgaccacgaaataacgctcgacccccctctccgcgtctccgcctccgccgcgctcgtccccgactcacgctacccccgcaactccgactcgacgcaaacaaaaacgactctctaaacgccgaacccgaaaaacgaaaaacgacgaactcgacgaacgacaacgacgaccgaaacgctaaaacgaccgttactcctccgacccgaaaaatcgacgatcgccgaacgtccgaaaaaacgccgcgtccccgaaaccgaaactacccgccgaactctccgtacgtcttcccgaaaactccgaccgaaacgcgacgaaaaacaaaaccgccgatctccatcctcgaaccgacaaaaaactctacgcccgaacgccgacgacaacccgcgtcgcgaaacccaacaccctcccccgccgccccgcgactaacgcgaacataaacgctcaaaactacgcgcccgactccgaaacccgcaaaatttactaaccgactaaacgcgaaaccgaaaacgcgcccgaccccaacgcccccgaaaaaaacccgacgtctcccgattcgacgcgaaaacgataaaacccaaaaaaaataattcgaccccgccaaatactacctacaaaattaaaaaaaaaaaaacttcaactccaaaaaaattcgaaccg

SEQ ID NO: 39637 - DNA, 531 bp, Artificial Sequence
  chemically treated genomic DNA (Homo sapiens) CpG-island No: 39637
cgcgttgttgataagtagtagtcgttgtagttttttgggtcgggggagttcgcgtagggcgtcgagtagttgttgtaagtcggtttcggcgtttaggtcggcgggtattcgtattacgcgtaggttagatcgttcggcgtttagttcggtttttagttggcgtagtgtttcgtcgttgcgggcgttaaggataagtacggagtcgggcgatagtagcgaggttaggagcggggttagcgttcggtcgaagtcgcgggaggtttcggttagtaagtatatagtacgttttagttcgttttttatgtttttgtttttcgtcggcggcgttggtattcgagattaggtaggaggcggtgcggtcgcggggggcgggatcgttacgggtgtcggcggggtcgttttgtcggggcggggcgggaattttaggtttcgggtcgcgagcgtttaggggtgttggtttttttgggatttggtttttttggttgttggtggcggaagttaaatcgtggcggtagtttagttcgtgttaag

SEQ ID NO: 39638 - DNA, 531 bp, Artificial Sequence
  chemically treated genomic DNA (Homo sapiens) CpG-island No: 39638
cttaacacgaactaaactaccgccacgatttaacttccgccaccaacaaccaaaaaaaccaaatcccaaaaaaaccaacacccctaaacgctcgcgacccgaaacctaaaattcccgccccgccccgacaaaacgaccccgccgacacccgtaacgatcccgccccccgcgaccgcaccgcctcctacctaatctcgaataccaacgccgccgacgaaaaacaaaaacataaaaaacgaactaaaacgtactatatacttactaaccgaaacctcccgcgacttcgaccgaacgctaaccccgctcctaacctcgctactatcgcccgactccgtacttatccttaacgcccgcaacgacgaaacactacgccaactaaaaaccgaactaaacgccgaacgatctaacctacgcgtaatacgaatacccgccgacctaaacgccgaaaccgacttacaacaactactcgacgccctacgcgaactcccccgacccaaaaaactacaacgactactacttatcaacaacgcg

SEQ ID NO: 39639 - DNA, 531 bp, Artificial Sequence
  chemically treated genomic DNA (Homo sapiens) CpG-island No: 39639
tttggtacggattgggttatcgttacggtttgattttcgttattagtaattaagggaattagattttaagggaattagtatttttgggcgttcgcggttcgaagtttgaggttttcgtttcgtttcggtagggcggtttcgtcgatattcgtagcggtttcgtttttcgcggtcgtatcgttttttgtttggtttcgggtgttagcgtcgtcggcggagaataggagtatggagggcgggttggggcgtgttgtgtgtttgttgatcggggtttttcgcggtttcggtcggacgttggtttcgtttttggtttcgttgttgtcgttcggtttcgtgtttgtttttagcgttcgtaacgacgaggtattgcgttagttggaggtcgagttgggcgtcgagcggtttggtttgcgcgtggtgcgggtgttcgtcgatttgggcgtcgaggtcggtttgtagtagttgttcggcgttttgcgcgagttttttcggtttaaggggttgtagcgattgttgtttattaataacgcg

SEQ ID NO: 39640 - DNA, 531 bp, Artificial Sequence
  chemically treated genomic DNA (Homo sapiens) CpG-island No: 39640
cgcgttattaataaacaacaatcgctacaaccccttaaaccgaaaaaactcgcgcaaaacgccgaacaactactacaaaccgacctcgacgcccaaatcgacgaacacccgcaccacgcgcaaaccaaaccgctcgacgcccaactcgacctccaactaacgcaatacctcgtcgttacgaacgctaaaaacaaacacgaaaccgaacgacaacaacgaaaccaaaaacgaaaccaacgtccgaccgaaaccgcgaaaaaccccgatcaacaaacacacaacacgccccaacccgccctccatactcctattctccgccgacgacgctaacacccgaaaccaaacaaaaaacgatacgaccgcgaaaaacgaaaccgctacgaatatcgacgaaaccgccctaccgaaacgaaacgaaaacctcaaacttcgaaccgcgaacgcccaaaaatactaattcccttaaaatctaattcccttaattactaataacgaaaatcaaaccgtaacgataacccaatccgtaccaaa

SEQ ID NO: 39641 - DNA, 520 bp, Artificial Sequence
  chemically treated genomic DNA (Homo sapiens) CpG-island No: 39641
gttttttagcgtcggattagtttcggagggagaacgaaggttgtttttgtttcgagggaggtagcgggagggttttgagttattgggttgtagggcgtcgggaagggatttcgcgtcggggttgcgaagggagattcgtttcgttcggtatgtagggttttttcgaagggaggggtcggcgtcggatttggggatagtcggtcggaggttcgatttagaggagtttgtttcgtttcgttcgttttcgtttttttgtggtttcggtattcggggtatttgagcgtgggttcgatgtaggtcgtgttagtgttttcgatttttcgtaggattcgttcgtgttttgtcgttgtttttaggtttttcgttttcgttattttatttcgttttatagattgggggcgtttcgtagcgcgtttttttcgtcggttcggtttattttttttttgttttataatgtcgtttttattataggttttatagtcgttttagtttttggttattcgtaggtcgattttttttt

SEQ ID NO: 39642 - DNA, 520 bp, Artificial Sequence
  chemically treated genomic DNA (Homo sapiens) CpG-island No: 39642
aaaaaaaaatcgacctacgaataaccaaaaactaaaacgactataaaacctataataaaaacgacattataaaacaaaaaaaaaataaaccgaaccgacgaaaaaaacgcgctacgaaacgcccccaatctataaaacgaaataaaataacgaaaacgaaaaacctaaaaacaacgacaaaacacgaacgaatcctacgaaaaatcgaaaacactaacacgacctacatcgaacccacgctcaaataccccgaataccgaaaccacaaaaaaacgaaaacgaacgaaacgaaacaaactcctctaaatcgaacctccgaccgactatccccaaatccgacgccgacccctcccttcgaaaaaaccctacataccgaacgaaacgaatctcccttcgcaaccccgacgcgaaatcccttcccgacgccctacaacccaataactcaaaaccctcccgctacctccctcgaaacaaaaacaaccttcgttctccctccgaaactaatccgacgctaaaaaac

SEQ ID NO: 39643 - DNA, 520 bp, Artificial Sequence
  chemically treated genomic DNA (Homo sapiens) CpG-island No: 39643
agggaggggtcggtttgcgggtagttagaggttggggcggttgtggagtttgtggtgggagcggtattgtggggtagggaaaaggtgagtcgagtcgacggaggggacgcgttgcggggcgtttttagtttatggagcggggtaagatggcggaggcggagagtttggagatagcggtagagtacgagcggattttgcgagagatcgagagtattgatacggtttgtatcgggtttacgtttaggtatttcgggtgtcgggattatagaggggcgggaacgggcgggacggggtaggtttttttgggtcgggttttcggtcggttgtttttaggttcggcgtcggttttttttttcggagagattttgtatatcgggcgaggcgggttttttttcgtagtttcgacgcggggttttttttcggcgttttatagtttagtgatttaggattttttcgttgtttttttcggggtaggagtagttttcgtttttttttcgaggttggttcggcgttggggaat

SEQ ID NO: 39644 - DNA, 520 bp, Artificial Sequence
  chemically treated genomic DNA (Homo sapiens) CpG-island No: 39644
attccccaacgccgaaccaacctcgaaaaaaaaacgaaaactactcctaccccgaaaaaaacaacgaaaaaatcctaaatcactaaactataaaacgccgaaaaaaaaccccgcgtcgaaactacgaaaaaaaacccgcctcgcccgatatacaaaatctctccgaaaaaaaaaaccgacgccgaacctaaaaacaaccgaccgaaaacccgacccaaaaaaacctaccccgtcccgcccgttcccgcccctctataatcccgacacccgaaatacctaaacgtaaacccgatacaaaccgtatcaatactctcgatctctcgcaaaatccgctcgtactctaccgctatctccaaactctccgcctccgccatcttaccccgctccataaactaaaaacgccccgcaacgcgtcccctccgtcgactcgactcaccttttccctaccccacaataccgctcccaccacaaactccacaaccgccccaacctctaactacccgcaaaccgacccctccct

SEQ ID NO: 39645 - DNA, 990 bp, Artificial Sequence
  chemically treated genomic DNA (Homo sapiens) CpG-island No: 39645
cggggacgtaatagggtggatttggaattcgggttttttggtttaaggtatcgaaggcgtagggattgttgttttcggttcgtttttcgcggtagttgtaattgggggtaagtttagcggtacggttttcggcgttcgtagttcggttcgggaattatttcgtttatttgcggttttattagttatcgttgttcggcgtcgtcgggcgtagggcgcggggcgcggaacgcggagtatacggggatgcggtttcgggtgttgtagagggtggcgaagcgtttagtatttttcgcgcgttgatagatttttacgtgggaatcggtcgttagtttcgtaggcggggtttcggcgtagaagaatttgttatattcgttaaagtcggtttttttttcgtttacgagtcggttttttagtagtttagttagggcgaagaggttgtttagcgcgagttagcgcgcggtgtttatggcggtttttgcgagcgcggcggggtcgagcggttgggttgtcgcggcgcgagttttgtaggttgggcggggagcgtattacgtagtcgagtagggtagggaagggaagtcgtagtttaggcgcggcgttttgcggagtcgggcggggcggttcgggcggcgggggcgggttcgcgtcgggaggtcgcgtttttttttttgaagatggttgtagaggtttagggtcgcgtttcgcgatgttgataacgtattttgggttgcgttcgggattggagacgcgggttatttgttttcgcgtcgtttggttttagtagttcgggggacgcgcgttattaagagtggagaattcgagtggggcgggtttagtttcggggttgggaagagatagtcgtatggattgggcgttaagaagtttgttgatcgcgcgcgttttacggtcgttttggtgatgtagaggggtggcgtgagatgtttttggagttgcggttggttcggagtggatgggtagagtttttttttgaaa

SEQ ID NO: 39646 - DNA, 990 bp, Artificial Sequence
  chemically treated genomic DNA (Homo sapiens) CpG-island No: 39646
tttcaaaaaaaaactctacccatccactccgaaccaaccgcaactccaaaaacatctcacgccacccctctacatcaccaaaacgaccgtaaaacgcgcgcgatcaacaaacttcttaacgcccaatccatacgactatctcttcccaaccccgaaactaaacccgccccactcgaattctccactcttaataacgcgcgtcccccgaactactaaaaccaaacgacgcgaaaacaaataacccgcgtctccaatcccgaacgcaacccaaaatacgttatcaacatcgcgaaacgcgaccctaaacctctacaaccatcttcaaaaaaaaaaacgcgacctcccgacgcgaacccgcccccgccgcccgaaccgccccgcccgactccgcaaaacgccgcgcctaaactacgacttcccttccctaccctactcgactacgtaatacgctccccgcccaacctacaaaactcgcgccgcgacaacccaaccgctcgaccccgccgcgctcgcaaaaaccgccataaacaccgcgcgctaactcgcgctaaacaacctcttcgccctaactaaactactaaaaaaccgactcgtaaacgaaaaaaaaaccgactttaacgaatataacaaattcttctacgccgaaaccccgcctacgaaactaacgaccgattcccacgtaaaaatctatcaacgcgcgaaaaatactaaacgcttcgccaccctctacaacacccgaaaccgcatccccgtatactccgcgttccgcgccccgcgccctacgcccgacgacgccgaacaacgataactaataaaaccgcaaataaacgaaataattcccgaaccgaactacgaacgccgaaaaccgtaccgctaaacttacccccaattacaactaccgcgaaaaacgaaccgaaaacaacaatccctacgccttcgataccttaaaccaaaaaacccgaattccaaatccaccctattacgtccccg

SEQ ID NO: 39647 - DNA, 990 bp, Artificial Sequence
  chemically treated genomic DNA (Homo sapiens) CpG-island No: 39647
ttttagaggggaattttgtttatttatttcgaattagtcgtagttttaggagtattttacgttatttttttgtattattagggcggtcgtggggcgcgcgcgattagtaggttttttggcgtttagtttatgcgattatttttttttagtttcgggattaggttcgttttattcggattttttatttttggtagcgcgcgtttttcggattgttgagattaggcggcgcggaggtaggtgattcgcgtttttagtttcgggcgtagtttagggtacgttgttagtatcgcggagcgcggttttgggtttttgtagttatttttagggagggaggcgcggtttttcgacgcggattcgttttcgtcgttcgggtcgtttcgttcggtttcgtagagcgtcgcgtttaggttgcgattttttttttttattttgttcggttgcgtagtgcgtttttcgtttagtttgtagagttcgcgtcgcggtagtttagtcgttcggtttcgtcgcgttcgtagaggtcgttatgggtatcgcgcgttggttcgcgttgggtagttttttcgttttggttgggttgttggaaggtcggttcgtgggcgaggaggaagtcggttttggcgaatgtgataagtttttttacgtcgggatttcgtttgcggggttggcggtcgatttttacgtgaagatttgttagcgcgcggagggtgttgagcgtttcgttattttttatagtattcgggatcgtattttcgtgtatttcgcgtttcgcgtttcgcgttttgcgttcggcggcgtcgagtagcgatggttggtggagtcgtaggtaagcgaagtggttttcgagtcgggttgcgggcgtcggagatcgtgtcgttggatttgtttttagttgtagttatcgcgaggggcgggtcgggaatagtaatttttacgttttcggtgttttgggttaagaaattcgggttttaggtttattttgttgcgttttcg

SEQ ID NO: 39648 - DNA, 990 bp, Artificial Sequence
  chemically treated genomic DNA (Homo sapiens) CpG-island No: 39648
cgaaaacgcaacaaaataaacctaaaacccgaatttcttaacccaaaacaccgaaaacgtaaaaattactattcccgacccgcccctcgcgataactacaactaaaaacaaatccaacgacacgatctccgacgcccgcaacccgactcgaaaaccacttcgcttacctacgactccaccaaccatcgctactcgacgccgccgaacgcaaaacgcgaaacgcgaaacgcgaaatacacgaaaatacgatcccgaatactataaaaaataacgaaacgctcaacaccctccgcgcgctaacaaatcttcacgtaaaaatcgaccgccaaccccgcaaacgaaatcccgacgtaaaaaaacttatcacattcgccaaaaccgacttcctcctcgcccacgaaccgaccttccaacaacccaaccaaaacgaaaaaactacccaacgcgaaccaacgcgcgatacccataacgacctctacgaacgcgacgaaaccgaacgactaaactaccgcgacgcgaactctacaaactaaacgaaaaacgcactacgcaaccgaacaaaataaaaaaaaaaaatcgcaacctaaacgcgacgctctacgaaaccgaacgaaacgacccgaacgacgaaaacgaatccgcgtcgaaaaaccgcgcctccctccctaaaaataactacaaaaacccaaaaccgcgctccgcgatactaacaacgtaccctaaactacgcccgaaactaaaaacgcgaatcacctacctccgcgccgcctaatctcaacaatccgaaaaacgcgcgctaccaaaaataaaaaatccgaataaaacgaacctaatcccgaaactaaaaaaaaataatcgcataaactaaacgccaaaaaacctactaatcgcgcgcgccccacgaccgccctaataatacaaaaaaataacgtaaaatactcctaaaactacgactaattcgaaataaataaacaaaattcccctctaaaa

SEQ ID NO: 39649 - DNA, 574 bp, Artificial Sequence
  chemically treated genomic DNA (Homo sapiens) CpG-island No: 39649
ggtcgttcgttttttttttaggttttttttggcgtttttacgcggggcgtaatcgtaagagaggaacgtaggtcgttttattagcgtttagtgtcgcgttagtttttaggttcgggttgttttcggagttatgagttgcggtcgtttttttttcgacgtggatggtatgattatttttaaggtggataatttgatttatcgtatttttttcgatagtttgaggcgcgtgttcgagaagtacgggcgcgtgggcgacgtgtatatttcgttggagttttatattaaggcgtttcggggtttcgttttcgttcgtttttacgatcggagcgacgcgtaagacgtcgaggtcgttatggacggggcggtgttggacgaacgcgagttgcgtgtgcggatggcgcgttatggtcgtcgggatttgtttcgtagtagttaggaagagttacgcggtaggttttggggcggtcgttacggacggcggagcggtagttttagggggcgatatcgtagttaatttcggggttttagttattttaggtttcgtagtagattttattatggggggtttcgttat

SEQ ID NO: 39650 - DNA, 574 bp, Artificial Sequence
  chemically treated genomic DNA (Homo sapiens) CpG-island No: 39650
ataacgaaaccccccataataaaatctactacgaaacctaaaataactaaaaccccgaaattaactacgatatcgccccctaaaactaccgctccgccgtccgtaacgaccgccccaaaacctaccgcgtaactcttcctaactactacgaaacaaatcccgacgaccataacgcgccatccgcacacgcaactcgcgttcgtccaacaccgccccgtccataacgacctcgacgtcttacgcgtcgctccgatcgtaaaaacgaacgaaaacgaaaccccgaaacgccttaatataaaactccaacgaaatatacacgtcgcccacgcgcccgtacttctcgaacacgcgcctcaaactatcgaaaaaaatacgataaatcaaattatccaccttaaaaataatcataccatccacgtcgaaaaaaaaacgaccgcaactcataactccgaaaacaacccgaacctaaaaactaacgcgacactaaacgctaataaaacgacctacgttcctctcttacgattacgccccgcgtaaaaacgccaaaaaaaacctaaaaaaaaaacgaacgacc

SEQ ID NO: 39651 - DNA, 574 bp, Artificial Sequence
  chemically treated genomic DNA (Homo sapiens) CpG-island No: 39651
atagcgagattttttatagtgagatttgttgcgggatttagagtagttgggatttcgggattggttgcggtgtcgttttttggggttgtcgtttcgtcgttcgtagcggtcgttttaggatttgtcgcgtggttttttttggttgttgcgaggtaggtttcggcggttatagcgcgttattcgtatacgtagttcgcgttcgtttagtatcgtttcgtttatggcggtttcggcgttttgcgcgtcgtttcggtcgtgaaagcggacgaaggcgaagtttcggggcgttttggtgtggggttttagcgggatgtatacgtcgtttacgcgttcgtatttttcgaatacgcgttttaagttgtcgggagaggtgcggtaggttaggttgtttattttgagggtgattatgttatttacgtcgggaggggggcggtcgtagtttatggtttcgagagtagttcgggtttggaaattggcgcggtattgggcgttggtggggcgatttgcgttttttttttgcggttgcgtttcgcgtggggacgttaggagagatttgggggagaggcgggcggtt

SEQ ID NO: 39652 - DNA, 574 bp, Artificial Sequence
  chemically treated genomic DNA (Homo sapiens) CpG-island No: 39652
aaccgcccgcctctcccccaaatctctcctaacgtccccacgcgaaacgcaaccgcaaaaaaaaaacgcaaatcgccccaccaacgcccaataccgcgccaatttccaaacccgaactactctcgaaaccataaactacgaccgcccccctcccgacgtaaataacataatcaccctcaaaataaacaacctaacctaccgcacctctcccgacaacttaaaacgcgtattcgaaaaatacgaacgcgtaaacgacgtatacatcccgctaaaaccccacaccaaaacgccccgaaacttcgccttcgtccgctttcacgaccgaaacgacgcgcaaaacgccgaaaccgccataaacgaaacgatactaaacgaacgcgaactacgtatacgaataacgcgctataaccgccgaaacctacctcgcaacaaccaaaaaaaaccacgcgacaaatcctaaaacgaccgctacgaacgacgaaacgacaaccccaaaaaacgacaccgcaaccaatcccgaaatcccaactactctaaatcccgcaacaaatctcactataaaaaatctcgctat

SEQ ID NO: 39653 - DNA, 567 bp, Artificial Sequence
  chemically treated genomic DNA (Homo sapiens) CpG-island No: 39653
gttcgagtttagttcgcggttttagtagtagcgtcgagagtagttttagtagtagcgttatggtcgggtggaacgtttatatcgataattttatggcggacgggatttgttaggacgcggttatcgtgggttataaggattcgtttttcgtttgggtcgtcgttttcgggaaaacgttcgttaatattacggtattgcgaggtttgcgcggttcggggtattgtttcggtttggattttgagggagggatttgggtgggggcgggcgcggtttagggcgcgtagcgagaggttttgattgggtgtttgttttggaagcggcgcgaatggcggttgtacgtgagtgggttttttagttgttcgtaggttttatgttttaggcggcggcgtttatttcgttcgttatttcgtttttcgcgacggggcgttatattcggggtatagggcggggaggggcgcggcgttcggtgcggcggtttattttcgttttttttagggcggggcggggacgcgttttagtttttattggggattgggattgagaggggattcggggatttttggattt

SEQ ID NO: 39654 - DNA, 567 bp, Artificial Sequence
  chemically treated genomic DNA (Homo sapiens) CpG-island No: 39654
aaatccaaaaatccccgaatcccctctcaatcccaatccccaataaaaactaaaacgcgtccccgccccgccctaaaaaaaacgaaaataaaccgccgcaccgaacgccgcgcccctccccgccctataccccgaatataacgccccgtcgcgaaaaacgaaataacgaacgaaataaacgccgccgcctaaaacataaaacctacgaacaactaaaaaacccactcacgtacaaccgccattcgcgccgcttccaaaacaaacacccaatcaaaacctctcgctacgcgccctaaaccgcgcccgcccccacccaaatccctccctcaaaatccaaaccgaaacaataccccgaaccgcgcaaacctcgcaataccgtaatattaacgaacgttttcccgaaaacgacgacccaaacgaaaaacgaatccttataacccacgataaccgcgtcctaacaaatcccgtccgccataaaattatcgatataaacgttccacccgaccataacgctactactaaaactactctcgacgctactactaaaaccgcgaactaaactcgaac

SEQ ID NO: 39655 - DNA, 567 bp, Artificial Sequence
  chemically treated genomic DNA (Homo sapiens) CpG-island No: 39655
gggtttaaggattttcgggtttttttttaattttaatttttagtaaaaattgaggcgcgttttcgtttcgttttgggagaggcggaagtgggtcgtcgtatcgggcgtcgcgttttttttcgttttgtgtttcggatgtaacgtttcgtcgcggaaagcggggtagcgggcgggatgggcgtcgtcgtttggggtataggatttacgggtaattgagggatttatttacgtgtagtcgttattcgcgtcgtttttagggtaagtatttagttagggtttttcgttgcgcgttttagatcgcgttcgtttttatttaagttttttttttagggtttaaatcggagtagtgtttcggatcgcgtaggtttcgtagtatcgtgatgttgacgaacgttttttcggggacggcggtttagacggagggcgagtttttgtagtttacgatggtcgcgttttgataggtttcgttcgttatgaggttgtcgatgtaggcgttttattcggttatggcgttgttattggggttgttttcggcgttgttgttggggtcgcggattgggttcgagt

SEQ ID NO: 39656 - DNA, 567 bp, Artificial Sequence
  chemically treated genomic DNA (Homo sapiens) CpG-island No: 39656
actcgaacccaatccgcgaccccaacaacaacgccgaaaacaaccccaataacaacgccataaccgaataaaacgcctacatcgacaacctcataacgaacgaaacctatcaaaacgcgaccatcgtaaactacaaaaactcgccctccgtctaaaccgccgtccccgaaaaaacgttcgtcaacatcacgatactacgaaacctacgcgatccgaaacactactccgatttaaaccctaaaaaaaaaacttaaataaaaacgaacgcgatctaaaacgcgcaacgaaaaaccctaactaaatacttaccctaaaaacgacgcgaataacgactacacgtaaataaatccctcaattacccgtaaatcctataccccaaacgacgacgcccatcccgcccgctaccccgctttccgcgacgaaacgttacatccgaaacacaaaacgaaaaaaaacgcgacgcccgatacgacgacccacttccgcctctcccaaaacgaaacgaaaacgcgcctcaatttttactaaaaattaaaattaaaaaaaaacccgaaaatccttaaaccc

SEQ ID NO: 39657 - DNA, 705 bp, Artificial Sequence
  chemically treated genomic DNA (Homo sapiens) CpG-island No: 39657
tcggggaggtttgataattagacggtagtttaaggcgacggaattggttttttttttttatttcggttttcgattagtagtcggttttttaaatgtgaaatcgttggttttttcgtttttttatttttatttttattttcgttagaggttaagtcggtaaaatgtaaagattaaggggaagcgcgaggtagggttatttttaacgaagttcgttttttttcgggttggtgttttcgggggggggttggagattgcgggaggaggagcgagcggttttcgtttagagattttcggagacgcgattttcgatattcgggttttttttttattcggtttttttttttcgcggtcgattcggagaattgtagtagcgttcgggcggattttaagtcggttttattggtatatacgttatatataaaagcgtcgcggtcgtcgtttttttatttttatagttttggcgaagtaattaatgaggcggcggcgttcgcgtttttttcgtgtatattcgaatacgggggtttgagcgggttagcgggggttgggtagttgttggtttattatcgttgcgtttgatttttacgtaaaattttcgatttggattttgtcgaagttggtcgttgttattattttatttggagtagtagtagcgggtcgaggggaggggggattcgggaaggggtcgggaataaggcgggggagggg

SEQ ID NO: 39658 - DNA, 705 bp, Artificial Sequence
  chemically treated genomic DNA (Homo sapiens) CpG-island No: 39658
cccctcccccgccttattcccgaccccttcccgaatcccccctcccctcgacccgctactactactccaaataaaataataacaacgaccaacttcgacaaaatccaaatcgaaaattttacgtaaaaatcaaacgcaacgataataaaccaacaactacccaacccccgctaacccgctcaaacccccgtattcgaatatacacgaaaaaaacgcgaacgccgccgcctcattaattacttcgccaaaactataaaaataaaaaaacgacgaccgcgacgcttttatatataacgtatataccaataaaaccgacttaaaatccgcccgaacgctactacaattctccgaatcgaccgcgaaaaaaaaaaaccgaataaaaaaaaaacccgaatatcgaaaatcgcgtctccgaaaatctctaaacgaaaaccgctcgctcctcctcccgcaatctccaacccccccccgaaaacaccaacccgaaaaaaaacgaacttcgttaaaaataaccctacctcgcgcttccccttaatctttacattttaccgacttaacctctaacgaaaataaaaataaaaataaaaaaacgaaaaaaccaacgatttcacatttaaaaaaccgactactaatcgaaaaccgaaataaaaaaaaaaaaccaattccgtcgccttaaactaccgtctaattatcaaacctccccga

SEQ ID NO: 39659 - DNA, 705 bp, Artificial Sequence
  chemically treated genomic DNA (Homo sapiens) CpG-island No: 39659
tttttttttcgttttgttttcggttttttttcgggtttttttttttttcggttcgttgttgttgttttagatgaggtgatggtaacggttaatttcggtaagatttagatcggggattttacgtggagattaagcgtagcgatggtgagttagtagttgtttagttttcgttggttcgtttaggttttcgtgttcgggtgtgtacggaggggacgcgggcgtcgtcgttttattgattgtttcgttagggttgtgggggtgggaaggcggcggtcgcggcgtttttgtgtgtggcgtgtgtgttagtgaggtcggtttggggttcgttcgggcgttgttgtagtttttcggatcggtcgcgggggagggaagtcgggtggggaaagggttcgggtgtcgagggtcgcgttttcgggggtttttgggcgagggtcgttcgttttttttttcgtaatttttagttttttttcggggatattagttcgggagggagcgggtttcgttagggatgattttgtttcgcgtttttttttggtttttgtattttatcggtttggtttttgacggggatggggatgggggtgggggagcgggaagattagcgattttatatttagagaatcgattgttggtcggaggtcgagatggggggaaagagttagtttcgtcgttttaaattgtcgtttggttgttaggttttttcgg

SEQ ID NO: 39660 - DNA, 705 bp, Artificial Sequence
  chemically treated genomic DNA (Homo sapiens) CpG-island No: 39660
ccgaaaaaacctaacaaccaaacgacaatttaaaacgacgaaactaactctttccccccatctcgacctccgaccaacaatcgattctctaaatataaaatcgctaatcttcccgctcccccacccccatccccatccccgtcaaaaaccaaaccgataaaatacaaaaaccaaaaaaaaacgcgaaacaaaatcatccctaacgaaacccgctccctcccgaactaatatccccgaaaaaaaactaaaaattacgaaaaaaaaaacgaacgaccctcgcccaaaaacccccgaaaacgcgaccctcgacacccgaaccctttccccacccgacttccctcccccgcgaccgatccgaaaaactacaacaacgcccgaacgaaccccaaaccgacctcactaacacacacgccacacacaaaaacgccgcgaccgccgccttcccacccccacaaccctaacgaaacaatcaataaaacgacgacgcccgcgtcccctccgtacacacccgaacacgaaaacctaaacgaaccaacgaaaactaaacaactactaactcaccatcgctacgcttaatctccacgtaaaatccccgatctaaatcttaccgaaattaaccgttaccatcacctcatctaaaacaacaacaacgaaccgaaaaaaaaaaaaacccgaaaaaaaaccgaaaacaaaacgaaaaaaaaa

SEQ ID NO: 39661 - DNA, 516 bp, Artificial Sequence
  chemically treated genomic DNA (Homo sapiens) CpG-island No: 39661
gaggacgcgtacgtcgggtagtcggggtgaagttagggtcggggtcgtgagacggcgcggggtagagtgggagggttcgtatcgttcgtcggggagtcgacgttggggaggcggggcgtcgcgcgtttgcgtagagcgcgttttcggcgtttttttttttttttcggttggttttttttcgttgtttttaggcggtttcgtttagttttgtagcggggtgggcggcggtcgcggtttatttagtcgttggagcgttgagcgttcggttcggtttatagttagtcggcgtcgcgtttgattttagcgcgcggtttagaagacgcgggaagcgtcgcgtcgagtttttttgttttttcgttttcgggaattggcgttgttgtcggaatgggttaaaggttacgtggttttaggggttttttagcgggttgagggatgtgaatttaagggtttttcgttgatagtacgggattcgggtttttatcggaaggtggtattttttatttttatttataggta

SEQ ID NO: 39662 - DNA, 516 bp, Artificial Sequence
  chemically treated genomic DNA (Homo sapiens) CpG-island No: 39662
tacctataaataaaaataaaaaataccaccttccgataaaaacccgaatcccgtactatcaacgaaaaacccttaaattcacatccctcaacccgctaaaaaacccctaaaaccacgtaacctttaacccattccgacaacaacgccaattcccgaaaacgaaaaaacaaaaaaactcgacgcgacgcttcccgcgtcttctaaaccgcgcgctaaaatcaaacgcgacgccgactaactataaaccgaaccgaacgctcaacgctccaacgactaaataaaccgcgaccgccgcccaccccgctacaaaactaaacgaaaccgcctaaaaacaacgaaaaaaaaccaaccgaaaaaaaaaaaaaaacgccgaaaacgcgctctacgcaaacgcgcgacgccccgcctccccaacgtcgactccccgacgaacgatacgaaccctcccactctaccccgcgccgtctcacgaccccgaccctaacttcaccccgactacccgacgtacgcgtcctc

SEQ ID NO: 39663 - DNA, 516 bp, Artificial Sequence
  chemically treated genomic DNA (Homo sapiens) CpG-island No: 39663
tatttgtaagtggaaatagggggtgttatttttcgatgaaaattcggatttcgtattgttaacggagggtttttgaatttatattttttagttcgttagaaagtttttgaaattacgtggtttttaatttatttcggtaatagcgttaattttcggaagcgagagggtaagaaagttcggcgcgacgtttttcgcgttttttaggtcgcgcgttgaaattaaacgcgacgtcggttagttgtgggtcgggtcgagcgtttaacgttttagcggttgggtaagtcgcggtcgtcgtttatttcgttgtagagttgggcggggtcgtttggaggtagcggggagaggttagtcgaaaaggaagaagagacgtcggaggcgcgttttgcgtaggcgcgcggcgtttcgtttttttagcgtcggtttttcggcgggcggtgcgggtttttttattttatttcgcgtcgttttacggtttcggttttagttttatttcgattattcggcgtgcgcgttttt

SEQ ID NO: 39664 - DNA, 516 bp, Artificial Sequence
  chemically treated genomic DNA (Homo sapiens) CpG-island No: 39664
aaaaacgcgcacgccgaataatcgaaataaaactaaaaccgaaaccgtaaaacgacgcgaaataaaataaaaaaacccgcaccgcccgccgaaaaaccgacgctaaaaaaacgaaacgccgcgcgcctacgcaaaacgcgcctccgacgtctcttcttccttttcgactaacctctccccgctacctccaaacgaccccgcccaactctacaacgaaataaacgacgaccgcgacttacccaaccgctaaaacgttaaacgctcgacccgacccacaactaaccgacgtcgcgtttaatttcaacgcgcgacctaaaaaacgcgaaaaacgtcgcgccgaactttcttaccctctcgcttccgaaaattaacgctattaccgaaataaattaaaaaccacgtaatttcaaaaactttctaacgaactaaaaaatataaattcaaaaaccctccgttaacaatacgaaatccgaattttcatcgaaaaataacaccccctatttccacttacaaata

SEQ ID NO: 39665 - DNA, 1015 bp, Artificial Sequence
  chemically treated genomic DNA (Homo sapiens) CpG-island No: 39665
acggttacgttaaaagtttatacgggtgtggtttatttacggcgaagttgtatgggagaagttcgggttttagtttttcggttcgtcgagttcgcgttttcgtcgttttatcgggaagttttagcggtcgggaagggggagggggtaggaacgtttcggagtcggacgataattatttttcgggaaagcggtttttagataagtcgttttagggaaggaaggcggtcgaggggttcggcgcggggttgtcgcgcgcgtcgaggtcgcggtaataaagtttggaaatcgcgagaaaatttttttaagaggaaacgcggcggcggcgttgggtttatagttttttttttttagtttaggcggtttttcgatttttcgagcgttgggaagcgtcggtcgtgttcgttcgggttttatattcgggttttgcgggggaagggatcgtcggttcgacgcgggttttacgttcgttcggggtttaattttcggcgacgtcgttaaagaaatcgcgtttcgttcgttcgttcgttcgcggttcgcggggtttagtttgggacggttcggtttaaggattttttcggtttggttcgagagatcgcgttcgcgaggagggaggtacgaagttatttgcggttagttgggcgagcgttaaattttagaggttcgaagtagacgggcgttgttttgtttttttttagttcggttaggaggaggaaatgggtcgttttacgttttcgttttcggttcgtttttcgttcgcggttttcgtttttgtttcggtttcgttcgttttttttggtattttttttcgattcgtttttttcggcgtttttcgtcgtcgtttcgttcgtttttttcggtcgtttcggttttcgtttttggggaaagggaaggtttttatcgcgaagagagtttggtaacgtcggatcgggattttcgagggattttttttttttcgtcgtttattttagaattttttttttttcggtttttagtgggagtttaggtcgggagtgat

SEQ ID NO: 39666 - DNA, 1015 bp, Artificial Sequence
  chemically treated genomic DNA (Homo sapiens) CpG-island No: 39666
atcactcccgacctaaactcccactaaaaaccgaaaaaaaaaaaattctaaaataaacgacgaaaaaaaaaaaatccctcgaaaatcccgatccgacgttaccaaactctcttcgcgataaaaaccttccctttccccaaaaacgaaaaccgaaacgaccgaaaaaaacgaacgaaacgacgacgaaaaacgccgaaaaaaacgaatcgaaaaaaaataccaaaaaaaacgaacgaaaccgaaacaaaaacgaaaaccgcgaacgaaaaacgaaccgaaaacgaaaacgtaaaacgacccatttcctcctcctaaccgaactaaaaaaaaacaaaacaacgcccgtctacttcgaacctctaaaatttaacgctcgcccaactaaccgcaaataacttcgtacctccctcctcgcgaacgcgatctctcgaaccaaaccgaaaaaatccttaaaccgaaccgtcccaaactaaaccccgcgaaccgcgaacgaacgaacgaacgaaacgcgatttctttaacgacgtcgccgaaaattaaaccccgaacgaacgtaaaacccgcgtcgaaccgacgatcccttcccccgcaaaacccgaatataaaacccgaacgaacacgaccgacgcttcccaacgctcgaaaaatcgaaaaaccgcctaaactaaaaaaaaaaaactataaacccaacgccgccgccgcgtttcctcttaaaaaaattttctcgcgatttccaaactttattaccgcgacctcgacgcgcgcgacaaccccgcgccgaacccctcgaccgccttccttccctaaaacgacttatctaaaaaccgctttcccgaaaaataattatcgtccgactccgaaacgttcctaccccctcccccttcccgaccgctaaaacttcccgataaaacgacgaaaacgcgaactcgacgaaccgaaaaactaaaacccgaacttctcccatacaacttcgccgtaaataaaccacacccgtataaacttttaacgtaaccgt

SEQ ID NO: 39667 - DNA, 1015 bp, Artificial Sequence
  chemically treated genomic DNA (Homo sapiens) CpG-island No: 39667
gttattttcggtttaagtttttattaggggtcggggaggaaggaattttgaggtgggcggcggggaggaagaggtttttcgggggtttcggttcggcgttgttagatttttttcgcggtgggggttttttttttttttaaaagcggaggtcggaacggtcgggaggagcgggcggggcggcggcgggaggcgtcgggaagagcgagtcggagggaggtgttaggaagggcgggcggggtcgggataggggcgggggtcgcgggcggggggcgggtcgggggcgggggcgtggggcggtttattttttttttttagtcggattggagggagataaagtagcgttcgtttgtttcgggtttttggaatttagcgttcgtttagttagtcgtaggtaatttcgtattttttttttcgcgggcgcggtttttcgggttaggtcgagagggtttttgggtcgggtcgttttaagttgggtttcgcgagtcgcgggcgggcgagcgggcggggcgcggtttttttggcgacgtcgtcgggaattgggtttcgggcgggcgtgggattcgcgtcgggtcggcggttttttttttcgtagggttcgagtatggggttcgggcgggtacggtcggcgttttttagcgttcgggaagtcggggggtcgtttgggttggggaggagaaattataggtttagcgtcgtcgtcgcgtttttttttggaaaagttttttcgcggtttttaaattttgttatcgcggtttcggcgcgcgcggtagtttcgcgtcgggtttttcggtcgttttttttttttggggcggtttgtttgggagtcgttttttcgggaagtgattgtcgttcggtttcgaggcgtttttgtttttttttttttttcggtcgttgagatttttcgatggggcggcggggacgcgggttcggcgaatcgggaggttggagttcgggttttttttatatagtttcgtcgtaggtgggttatattcgtgtggatttttggcgtgatcgt

SEQ ID NO: 39668 - DNA, 1015 bp, Artificial Sequence
  chemically treated genomic DNA (Homo sapiens) CpG-island No: 39668
acgatcacgccaaaaatccacacgaatataacccacctacgacgaaactatataaaaaaaacccgaactccaacctcccgattcgccgaacccgcgtccccgccgccccatcgaaaaatctcaacgaccgaaaaaaaaaaaaaaacaaaaacgcctcgaaaccgaacgacaatcacttcccgaaaaaacgactcccaaacaaaccgccccaaaaaaaaaaaacgaccgaaaaacccgacgcgaaactaccgcgcgcgccgaaaccgcgataacaaaatttaaaaaccgcgaaaaaacttttccaaaaaaaaacgcgacgacgacgctaaacctataatttctcctccccaacccaaacgaccccccgacttcccgaacgctaaaaaacgccgaccgtacccgcccgaaccccatactcgaaccctacgaaaaaaaaaaccgccgacccgacgcgaatcccacgcccgcccgaaacccaattcccgacgacgtcgccaaaaaaaccgcgccccgcccgctcgcccgcccgcgactcgcgaaacccaacttaaaacgacccgacccaaaaaccctctcgacctaacccgaaaaaccgcgcccgcgaaaaaaaaaatacgaaattacctacgactaactaaacgaacgctaaattccaaaaacccgaaacaaacgaacgctactttatctccctccaatccgactaaaaaaaaaaaataaaccgccccacgcccccgcccccgacccgccccccgcccgcgacccccgcccctatcccgaccccgcccgcccttcctaacacctccctccgactcgctcttcccgacgcctcccgccgccgccccgcccgctcctcccgaccgttccgacctccgcttttaaaaaaaaaaaaaacccccaccgcgaaaaaaatctaacaacgccgaaccgaaacccccgaaaaacctcttcctccccgccgcccacctcaaaattccttcctccccgacccctaataaaaacttaaaccgaaaataac

SEQ ID NO: 39669 - DNA, 665 bp, Artificial Sequence
  chemically treated genomic DNA (Homo sapiens) CpG-island No: 39669
ttacgtttcgcgggggttttcgtgatagattaagtttggcgtttttttagcgtcgtagttggatcgagagaggagcggtcgttttgtaaaaggaagtaagtcgttaatttcgtcggaatcgcgtttcggttttttcggtcgggcgagtttcggggtttttagaatcgcggtttcggtcgttaggttttcggcgtcgtttttagggattgtagagtgagggatgtttcgttaggtgtaggggaggcggtaggtggtcgtggtttttttgcgtcgtcggttttacgttttagcgtttatttcgtttagtttacgggtggcgttcggggttttcggggaggtacgtacgtttttaagcgtcgttcgttttggggtcgggaacgttgcgtatttttttttgcggggagttcgcgttttattttcggagtggagtttcggtttttattcggaatcgtggggcggggagatagtgattgaggcgttttagtcgtatcggggttcggattattagacgcgcgtcggttaggttttcgtttttttttttttcgcgtcgggtgtttgcggaggagtcgcggagagaagggggttggttcggagagttgtcgttattcggtaggattcggagcgggaggttgggtgaggcgtcgttgtttgttttattttttgat

SEQ ID NO: 39670 - DNA, 665 bp, Artificial Sequence
  chemically treated genomic DNA (Homo sapiens) CpG-island No: 39670
atcaaaaaataaaacaaacaacgacgcctcacccaacctcccgctccgaatcctaccgaataacgacaactctccgaaccaacccccttctctccgcgactcctccgcaaacacccgacgcgaaaaaaaaaaaaacgaaaacctaaccgacgcgcgtctaataatccgaaccccgatacgactaaaacgcctcaatcactatctccccgccccacgattccgaataaaaaccgaaactccactccgaaaataaaacgcgaactccccgcaaaaaaaaatacgcaacgttcccgaccccaaaacgaacgacgcttaaaaacgtacgtacctccccgaaaaccccgaacgccacccgtaaactaaacgaaataaacgctaaaacgtaaaaccgacgacgcaaaaaaaccacgaccacctaccgcctcccctacacctaacgaaacatccctcactctacaatccctaaaaacgacgccgaaaacctaacgaccgaaaccgcgattctaaaaaccccgaaactcgcccgaccgaaaaaaccgaaacgcgattccgacgaaattaacgacttacttccttttacaaaacgaccgctcctctctcgatccaactacgacgctaaaaaaacgccaaacttaatctatcacgaaaacccccgcgaaacgtaa

SEQ ID NO: 39671 - DNA, 665 bp, Artificial Sequence
  chemically treated genomic DNA (Homo sapiens) CpG-island No: 39671
gttaggaggtggggtaagtagcggcgttttatttagtttttcgtttcgggttttgtcggatggcggtagtttttcgggttagttttttttttttcgcggttttttcgtagatattcggcgcggaagaaggaggggcggagatttggtcggcgcgcgtttgatgattcggatttcggtgcgattggagcgttttagttattgttttttcgttttacggtttcgagtaaggatcggagttttatttcgggggtggagcgcgggtttttcgtagggaaaggtgcgtagcgttttcgattttaaaacgagcggcgtttgggagcgtgcgtgttttttcgagagtttcgggcgttattcgtgggttggacgaggtgggcgttggggcgtggggtcggcggcgtagagaagttacggttatttgtcgttttttttgtatttggcggagtattttttattttatagtttttggaggcggcgtcggaaatttggcggtcgggatcgcgattttggaagtttcggagttcgttcggtcggaggagtcggggcgcggtttcggcgagattggcgatttgtttttttttgtagaacggtcgtttttttttcggtttagttgcgacgttgggaaagcgttagatttggtttgttacgggagttttcgcggggcgtgg

SEQ ID NO: 39672 - DNA, 665 bp, Artificial Sequence
  chemically treated genomic DNA (Homo sapiens) CpG-island No: 39672
ccacgccccgcgaaaactcccgtaacaaaccaaatctaacgctttcccaacgtcgcaactaaaccgaaaaaaaaacgaccgttctacaaaaaaaaacaaatcgccaatctcgccgaaaccgcgccccgactcctccgaccgaacgaactccgaaacttccaaaatcgcgatcccgaccgccaaatttccgacgccgcctccaaaaactataaaataaaaaatactccgccaaatacaaaaaaaacgacaaataaccgtaacttctctacgccgccgaccccacgccccaacgcccacctcgtccaacccacgaataacgcccgaaactctcgaaaaaacacgcacgctcccaaacgccgctcgttttaaaatcgaaaacgctacgcacctttccctacgaaaaacccgcgctccacccccgaaataaaactccgatccttactcgaaaccgtaaaacgaaaaaacaataactaaaacgctccaatcgcaccgaaatccgaatcatcaaacgcgcgccgaccaaatctccgcccctccttcttccgcgccgaatatctacgaaaaaaccgcgaaaaaaaaaaaactaacccgaaaaactaccgccatccgacaaaacccgaaacgaaaaactaaataaaacgccgctacttaccccacctcctaac

SEQ ID NO: 39673 - DNA, 555 bp, Artificial Sequence
  chemically treated genomic DNA (Homo sapiens) CpG-island No: 39673
tttttatcgttgagtacgacgaaaatatcgttaggtttagcgtttcggtatttgttcgcgttttgggatggagaaggcgtttgtttgtaggtttttttttttcgttttttcgcgtttatttatagtgtcggtcgtcgataggaagacggcgagttcggggagtagttataagtaaagttaaaaattagtaaacgttaatcgttattattttttaaatttgtcgttttttattggaagtttcgttttatttcgttaagtttacgtttaatcgcgacggatgtcggttgggtttaagagacgttaggtaggtgggattggagttgttatggaaggggtagggcgtagggcggaattattgttcgcggagttggcgtcgagtcggaatttcggattgtaggaagtgggagtatcgcggtttcggggaagagatcggggttgagcgtttagtttatttttgcgtgattttcgttagcgtttagagcgttttcggggttcgagttgaagagtaaaattaagtgaaggaaattttattaagtttagggtgataagggagga

SEQ ID NO: 39674 - DNA, 555 bp, Artificial Sequence
  chemically treated genomic DNA (Homo sapiens) CpG-island No: 39674
tcctcccttatcaccctaaacttaataaaatttccttcacttaattttactcttcaactcgaaccccgaaaacgctctaaacgctaacgaaaatcacgcaaaaataaactaaacgctcaaccccgatctcttccccgaaaccgcgatactcccacttcctacaatccgaaattccgactcgacgccaactccgcgaacaataattccgccctacgccctaccccttccataacaactccaatcccacctacctaacgtctcttaaacccaaccgacatccgtcgcgattaaacgtaaacttaacgaaataaaacgaaacttccaataaaaaacgacaaatttaaaaaataataacgattaacgtttactaatttttaactttacttataactactccccgaactcgccgtcttcctatcgacgaccgacactataaataaacgcgaaaaaacgaaaaaaaaaaacctacaaacaaacgccttctccatcccaaaacgcgaacaaataccgaaacgctaaacctaacgatattttcgtcgtactcaacgataaaaa

SEQ ID NO: 39675 - DNA, 555 bp, Artificial Sequence
  chemically treated genomic DNA (Homo sapiens) CpG-island No: 39675
tttttttttgttattttgaatttagtgaagttttttttatttggttttgttttttaattcggatttcgaaaacgttttaaacgttggcggaagttacgtagagatgggttagacgtttaatttcggtttttttttcgaaatcgcggtgtttttattttttgtagttcgaggtttcgattcgacgttagtttcgcgagtaatggtttcgttttgcgttttgttttttttatgataattttagttttatttgtttggcgttttttgagtttaatcggtattcgtcgcggttggacgtgggtttggcggaatggggcgggatttttagtaggaggcggtaagtttgaaaagtgatgacggttgacgtttgttgatttttgattttgtttgtagttgtttttcgaattcgtcgtttttttgtcggcggtcggtattgtaggtgagcgcgagaggacggaggaaggaagtttgtagatagacgttttttttattttaaggcgcgggtaggtgtcgggacgttgggtttggcggtgttttcgtcgtgtttagcggtgggag

SEQ ID NO: 39676 - DNA, 555 bp, Artificial Sequence
  chemically treated genomic DNA (Homo sapiens) CpG-island No: 39676
ctcccaccgctaaacacgacgaaaacaccgccaaacccaacgtcccgacacctacccgcgccttaaaataaaaaaaacgtctatctacaaacttccttcctccgtcctctcgcgctcacctacaataccgaccgccgacaaaaaaacgacgaattcgaaaaacaactacaaacaaaatcaaaaatcaacaaacgtcaaccgtcatcacttttcaaacttaccgcctcctactaaaaatcccgccccattccgccaaacccacgtccaaccgcgacgaataccgattaaactcaaaaaacgccaaacaaataaaactaaaattatcataaaaaaaacaaaacgcaaaacgaaaccattactcgcgaaactaacgtcgaatcgaaacctcgaactacaaaaaataaaaacaccgcgatttcgaaaaaaaaaccgaaattaaacgtctaacccatctctacgtaacttccgccaacgtttaaaacgttttcgaaatccgaattaaaaaacaaaaccaaataaaaaaaacttcactaaattcaaaataacaaaaaaaaa

SEQ ID NO: 39677 - DNA, 661 bp, Artificial Sequence
  chemically treated genomic DNA (Homo sapiens) CpG-island No: 39677
ttttcgggtcgttttttttttttttttttttaggtcgcgatttggagggtttcgtttcgcggcgggggtagagttaggggcggggttgagcgcggtttgggcgattttttcggcggttggggtgggttggcgtttttttcgcgttcgggggattttttcgcgatcgtcgggacgtaaaaggggtttggtaggggcgttttcgttttattttcggaatttggtttttcgttgttttcgcgagcgtcgggagtttagtaggtttggtcgaggcgggattttcgtcgttttagttttcgttttcgttttcgcgttttttcgtcgcgcggagttttggttggtttgttttttaatcggattttggggttagcgtttagaaaagtttcgatttttttcggttcggttttattttaagaatcgattaaggttgtgagtgttcgggaattagattcgtttggaggttatagtttcgacgtttcgcgtttacgcggtagatcgggcgttgcggtttgggagtttcggggagatgcggagtaggagtaatttcggggttcgtttggacgggtacgcgcggttggtgtagtaaattattttgtgttattaggtaaggagggatcgtttttagggaacgcgtggaattatttttttatgtaatttatttttt

SEQ ID NO: 39678 - DNA, 661 bp, Artificial Sequence
  chemically treated genomic DNA (Homo sapiens) CpG-island No: 39678
aaaaaataaattacataaaaaaataattccacgcgttccctaaaaacgatccctccttacctaataacacaaaataatttactacaccaaccgcgcgtacccgtccaaacgaaccccgaaattactcctactccgcatctccccgaaactcccaaaccgcaacgcccgatctaccgcgtaaacgcgaaacgtcgaaactataacctccaaacgaatctaattcccgaacactcacaaccttaatcgattcttaaaataaaaccgaaccgaaaaaaatcgaaacttttctaaacgctaaccccaaaatccgattaaaaaacaaaccaaccaaaactccgcgcgacgaaaaaacgcgaaaacgaaaacgaaaactaaaacgacgaaaatcccgcctcgaccaaacctactaaactcccgacgctcgcgaaaacaacgaaaaaccaaattccgaaaataaaacgaaaacgcccctaccaaaccccttttacgtcccgacgatcgcgaaaaaatcccccgaacgcgaaaaaaacgccaacccaccccaaccgccgaaaaaatcgcccaaaccgcgctcaaccccgcccctaactctacccccgccgcgaaacgaaaccctccaaatcgcgacctaaaaaaaaaaaaaaaaaaaacgacccgaaaa

SEQ ID NO: 39679 - DNA, 661 bp, Artificial Sequence
  chemically treated genomic DNA (Homo sapiens) CpG-island No: 39679
ggagaatgagttatatgagagggtagttttacgcgttttttgggggcggtttttttttatttggtaatataggatggtttgttgtattagtcgcgcgtattcgtttaagcggatttcggaattgtttttgtttcgtattttttcgaggtttttaggtcgtagcgttcgatttgtcgcgtgggcgcgggacgtcggggttgtggtttttaagcgggtttggttttcggatatttatagttttagtcggtttttgggatgggatcgggtcggaggaggtcgagatttttttaaacgttagttttaaagttcggttggaaagtaagttaattagagtttcgcgcggcggggaggcgcgggggcggggacgggggttggagcgacgaaggtttcgtttcggttaggtttgttgggttttcgacgttcgcgggagtagcgggaaattaggtttcgggagtggggcgaggacgtttttgttaagttttttttacgtttcggcggtcgcgaggaggtttttcgggcgcgaagaagacgttagtttattttagtcgtcggggagatcgtttaggtcgcgtttagtttcgtttttggttttgttttcgtcgcggagcggaattttttaagtcgcggtttgaggaggaaggaaaagggggcggttcgggag

SEQ ID NO: 39680 - DNA, 661 bp, Artificial Sequence
  chemically treated genomic DNA (Homo sapiens) CpG-island No: 39680
ctcccgaaccgcccccttttccttcctcctcaaaccgcgacttaaaaaattccgctccgcgacgaaaacaaaaccaaaaacgaaactaaacgcgacctaaacgatctccccgacgactaaaataaactaacgtcttcttcgcgcccgaaaaacctcctcgcgaccgccgaaacgtaaaaaaaacttaacaaaaacgtcctcgccccactcccgaaacctaatttcccgctactcccgcgaacgtcgaaaacccaacaaacctaaccgaaacgaaaccttcgtcgctccaacccccgtccccgcccccgcgcctccccgccgcgcgaaactctaattaacttactttccaaccgaactttaaaactaacgtttaaaaaaatctcgacctcctccgacccgatcccatcccaaaaaccgactaaaactataaatatccgaaaaccaaacccgcttaaaaaccacaaccccgacgtcccgcgcccacgcgacaaatcgaacgctacgacctaaaaacctcgaaaaaatacgaaacaaaaacaattccgaaatccgcttaaacgaatacgcgcgactaatacaacaaaccatcctatattaccaaataaaaaaaaaccgcccccaaaaaacgcgtaaaactaccctctcatataactcattctcc

SEQ ID NO: 39681 - DNA, 510 bp, Artificial Sequence
  chemically treated genomic DNA (Homo sapiens) CpG-island No: 39681
aatgtttcgatttacgtcgttaagaaagttaaattcgaagtttttttatttttcgtagaatattcgatatttacgttcgtttttttggtcgtttgtatcgttattttggcgggttgatgaagttatcgtagtagatattgaaattttttcggagttcgttcggtttcgggggttatatcgcgttagatgtaggatattaatatttaggattcgtcggaagttgttatagcggaatagcgtcgttttacgttgagacgcgttgacgtagtagtttttttcgaatagatttcggggtaaaatcgagtttgagcgagattcgaggtcggaagatggaaaggcgagagtttaagatattttcgggttttgtatcgtaaagggcggggcgtagtttttaaaaggcgagatgtttcggtcggggaggttttgagtagaggaattcgggtggagagggcggggtttgaggagggcggagagttggggcgggttttaggtgagtaattggggagcgga

SEQ ID NO: 39682 - DNA, 510 bp, Artificial Sequence
  chemically treated genomic DNA (Homo sapiens) CpG-island No: 39682
tccgctccccaattactcacctaaaacccgccccaactctccgccctcctcaaaccccgccctctccacccgaattcctctactcaaaacctccccgaccgaaacatctcgccttttaaaaactacgccccgccctttacgatacaaaacccgaaaatatcttaaactctcgcctttccatcttccgacctcgaatctcgctcaaactcgattttaccccgaaatctattcgaaaaaaactactacgtcaacgcgtctcaacgtaaaacgacgctattccgctataacaacttccgacgaatcctaaatattaatatcctacatctaacgcgatataacccccgaaaccgaacgaactccgaaaaaatttcaatatctactacgataacttcatcaacccgccaaaataacgatacaaacgaccaaaaaaacgaacgtaaatatcgaatattctacgaaaaataaaaaaacttcgaatttaactttcttaacgacgtaaatcgaaacatt

SEQ ID NO: 39683 - DNA, 510 bp, Artificial Sequence
  chemically treated genomic DNA (Homo sapiens) CpG-island No: 39683
ttcgttttttagttatttatttgagattcgttttagtttttcgttttttttaggtttcgttttttttattcgggtttttttgtttagggttttttcgatcggaatatttcgttttttggaggttacgtttcgttttttacggtatagagttcggaagtgttttggattttcgtttttttatttttcggtttcgagtttcgtttaggttcggttttatttcggagtttattcgaagggggttgttacgttagcgcgttttagcgtaagacggcgttatttcgttgtaatagttttcggcgggttttggatgttgatgttttgtatttaacgcggtgtaattttcgaagtcgagcgagtttcggaggaattttagtatttgttacggtaattttattagttcgttaagatggcgatgtaagcggttaagagggcgaacgtgagtatcgggtgttttgcggagggtgggagaatttcgggtttgatttttttagcggcgtggatcggagtatt

SEQ ID NO: 39684 - DNA, 510 bp, Artificial Sequence
  chemically treated genomic DNA (Homo sapiens) CpG-island No: 39684
aatactccgatccacgccgctaaaaaaatcaaacccgaaattctcccaccctccgcaaaacacccgatactcacgttcgccctcttaaccgcttacatcgccatcttaacgaactaataaaattaccgtaacaaatactaaaattcctccgaaactcgctcgacttcgaaaattacaccgcgttaaatacaaaacatcaacatccaaaacccgccgaaaactattacaacgaaataacgccgtcttacgctaaaacgcgctaacgtaacaacccccttcgaataaactccgaaataaaaccgaacctaaacgaaactcgaaaccgaaaaataaaaaaacgaaaatccaaaacacttccgaactctataccgtaaaaaacgaaacgtaacctccaaaaaacgaaatattccgatcgaaaaaaccctaaacaaaaaaacccgaataaaaaaaacgaaacctaaaaaaaacgaaaaactaaaacgaatctcaaataaataactaaaaaacgaa

SEQ ID NO: 39685 - DNA, 748 bp, Artificial Sequence
  chemically treated genomic DNA (Homo sapiens) CpG-island No: 39685
cggacgttatttcgttttgtggtgttcgtaaggattcggcgattaaggattcgatcgttaacggacgcggttgcgggtgggtggcggcggtaggattggtcgggttacgcgtcggttatcgagaagtagcgattttagtttttttcgtaaattaagattcgttatttagagtcgtcgtttaattttttttgggtttgaagtcgtttttcgtcgtttcggtatcgttcgcgcggattcgttgtggaattcgcggcgtagggggcggagtgttcgcgcggcgttgcgttcgggagacggtgggcgttaatattcgcgcgtttcgtagacgcgggcgggtttttttttagtcgtagtcggacggtttcggggtcgtcgggtcgggttcgagtgtgtagtaggacggtcgcgggtttgttggttttgggagggtagagaggtgtttgtcgcggtcggcgattttttcgttaggtcgggcggttttcgcgtacgacgcgtttgcgcgggaggttttcggttcggggttggcgtggaggtcgtaggcgttcggtttagtgggtgggaggaagggtcgggagtgggcgcgatgagcgagagcgggtgcggacgtttacgatattttcgtcgtattcgtgtttcggggaggatttcgagtcgtttagagttcgaagattcgcgtagtatgatcgaaagtttttttttgttttttttaagtagtttagtttgtgtttttgtggttagaaagttgtag

SEQ ID NO: 39686 - DNA, 748 bp, Artificial Sequence
  chemically treated genomic DNA (Homo sapiens) CpG-island No: 39686
ctacaactttctaaccacaaaaacacaaactaaactacttaaaaaaaacaaaaaaaaactttcgatcatactacgcgaatcttcgaactctaaacgactcgaaatcctccccgaaacacgaatacgacgaaaatatcgtaaacgtccgcacccgctctcgctcatcgcgcccactcccgacccttcctcccacccactaaaccgaacgcctacgacctccacgccaaccccgaaccgaaaacctcccgcgcaaacgcgtcgtacgcgaaaaccgcccgacctaacgaaaaaatcgccgaccgcgacaaacacctctctaccctcccaaaaccaacaaacccgcgaccgtcctactacacactcgaacccgacccgacgaccccgaaaccgtccgactacgactaaaaaaaaacccgcccgcgtctacgaaacgcgcgaatattaacgcccaccgtctcccgaacgcaacgccgcgcgaacactccgccccctacgccgcgaattccacaacgaatccgcgcgaacgataccgaaacgacgaaaaacgacttcaaacccaaaaaaaattaaacgacgactctaaataacgaatcttaatttacgaaaaaaactaaaatcgctacttctcgataaccgacgcgtaacccgaccaatcctaccgccgccacccacccgcaaccgcgtccgttaacgatcgaatccttaatcgccgaatccttacgaacaccacaaaacgaaataacgtccg

SEQ ID NO: 39687 - DNA, 748 bp, Artificial Sequence
  chemically treated genomic DNA (Homo sapiens) CpG-island No: 39687
ttgtaattttttggttatagaaatataggttgagttgtttagagaaggtagggaggggttttcggttatattgcgcgagttttcgagttttgagcggttcgaagtttttttcgaggtacgggtgcgacggggatgtcgtaggcgttcgtattcgttttcgtttatcgcgtttattttcggtttttttttttatttattaggtcgggcgtttgcggtttttacgttagtttcgggtcgggggtttttcgcgtaggcgcgtcgtgcgcggggatcgttcggtttggcggggaggtcgtcggtcgcgataggtatttttttgtttttttaaggttagtaggttcgcggtcgttttgttatatattcgggttcggttcgacgatttcggagtcgttcgattgcggttggaagggagttcgttcgcgtttgcggaacgcgcgaatgttggcgtttatcgtttttcggacgtagcgtcgcgcgagtatttcgttttttgcgtcgcgggttttatagcgagttcgcgcgggcggtgtcggggcggcggaggacggttttaggtttaaaggggattgggcggcggttttaggtggcgggttttggtttgcggaaggggttggagtcgttgtttttcggtgatcggcgcgtggttcggttaattttgtcgtcgttatttattcgtaatcgcgttcgttgacggtcgggtttttggtcgtcgggtttttgcgggtattatagagcggggtggcgttcg

SEQ ID NO: 39688 - DNA, 748 bp, Artificial Sequence
  chemically treated genomic DNA (Homo sapiens) CpG-island No: 39688
cgaacgccaccccgctctataatacccgcaaaaacccgacgaccaaaaacccgaccgtcaacgaacgcgattacgaataaataacgacgacaaaattaaccgaaccacgcgccgatcaccgaaaaacaacgactccaaccccttccgcaaaccaaaacccgccacctaaaaccgccgcccaatcccctttaaacctaaaaccgtcctccgccgccccgacaccgcccgcgcgaactcgctataaaacccgcgacgcaaaaaacgaaatactcgcgcgacgctacgtccgaaaaacgataaacgccaacattcgcgcgttccgcaaacgcgaacgaactcccttccaaccgcaatcgaacgactccgaaatcgtcgaaccgaacccgaatatataacaaaacgaccgcgaacctactaaccttaaaaaaacaaaaaaatacctatcgcgaccgacgacctccccgccaaaccgaacgatccccgcgcacgacgcgcctacgcgaaaaacccccgacccgaaactaacgtaaaaaccgcaaacgcccgacctaataaataaaaaaaaaaaccgaaaataaacgcgataaacgaaaacgaatacgaacgcctacgacatccccgtcgcacccgtacctcgaaaaaaacttcgaaccgctcaaaactcgaaaactcgcgcaatataaccgaaaacccctccctaccttctctaaacaactcaacctatatttctataaccaaaaaattacaa

SEQ ID NO: 39689 - DNA, 654 bp, Artificial Sequence
  chemically treated genomic DNA (Homo sapiens) CpG-island No: 39689
gtcgttcgtgttttgtagcgttttttttcgcgttttcgcggtggggttatagcgatatttagtggttgaatgtattttaaatattcggtttgttgagggcgtgagtcggagcgttgttttttaggatttagtttttattcgtttttgcgtttcggcggggacggggagtcgggtcgagttagagtgaatatatattttttgcgcgtgtaattgagtcgagcggtagggttggttttattcgataggttaacgttttcgttttagttttcggttatatttgttttaaggaggggtggagtttcggcgtggattttcgttttttgtgtttcgtttttttataacggcgttcgtttattgcgtttgcgtatgttatacgcgtattcgcgtggttttcgcgaaggtgtcgttgttaagaaacgtgttttgcgcgttacgtcgtttgtttttagggtaacgtcggcgttttttagtaatcgcgcgcggtttaggtgggttttttcggtatttttagatttgttatggcgatcgcgagttttagcgtttttttatttatggttaacgggtaggtggagagcgtttaggtgagcggtcgtggatttcgttagggttcgttttttagcgtttttcggggtttttttcgtaatttttcgggtt

SEQ ID NO: 39690 - DNA, 654 bp, Artificial Sequence
  chemically treated genomic DNA (Homo sapiens) CpG-island No: 39690
aacccgaaaaattacgaaaaaaaccccgaaaaacgctaaaaaacgaaccctaacgaaatccacgaccgctcacctaaacgctctccacctacccgttaaccataaataaaaaaacgctaaaactcgcgatcgccataacaaatctaaaaataccgaaaaaacccacctaaaccgcgcgcgattactaaaaaacgccgacgttaccctaaaaacaaacgacgtaacgcgcaaaacacgtttcttaacaacgacaccttcgcgaaaaccacgcgaatacgcgtataacatacgcaaacgcaataaacgaacgccgttataaaaaaacgaaacacaaaaaacgaaaatccacgccgaaactccacccctccttaaaacaaatataaccgaaaactaaaacgaaaacgttaacctatcgaataaaaccaaccctaccgctcgactcaattacacgcgcaaaaaatatatattcactctaactcgacccgactccccgtccccgccgaaacgcaaaaacgaataaaaactaaatcctaaaaaacaacgctccgactcacgccctcaacaaaccgaatatttaaaatacattcaaccactaaatatcgctataaccccaccgcgaaaacgcgaaaaaaaacgctacaaaacacgaacgac

SEQ ID NO: 39691 - DNA, 654 bp, Artificial Sequence
  chemically treated genomic DNA (Homo sapiens) CpG-island No: 39691
agttcggggggttgcgggaagggtttcgggggacgttggggggcgggttttggcggggtttacggtcgtttatttgggcgttttttatttgttcgttgattatgagtagaaagacgttaggattcgcggtcgttatggtaggtttgggggtgtcggggggatttatttaggtcgcgcgcggttgttaagagacgtcggcgttgttttagaaatagacggcgtagcgcgtaggatacgttttttggtagcgatattttcgcgaaggttacgcgagtgcgcgtgtggtatgcgtaggcgtagtgaacgggcgtcgttataagggggcggggtataaggggcggggatttacgtcgaggttttatttttttttagggtaggtatgatcgagagttggggcgggagcgttgatttgtcgggtaaagttagttttatcgttcgatttagttgtacgcgtagggagtgtgtgtttattttgattcggttcggtttttcgttttcgtcgaagcgtagaggcgaatgagagttgagttttggggagtagcgtttcgatttacgtttttagtaagtcgagtgtttaaaatatatttagttattagatgtcgttgtggttttatcgcgaggacgcggagggaggcgttgtagagtacgggcgat

SEQ ID NO: 39692 - DNA, 654 bp, Artificial Sequence
  chemically treated genomic DNA (Homo sapiens) CpG-island No: 39692
atcgcccgtactctacaacgcctccctccgcgtcctcgcgataaaaccacaacgacatctaataactaaatatattttaaacactcgacttactaaaaacgtaaatcgaaacgctactccccaaaactcaactctcattcgcctctacgcttcgacgaaaacgaaaaaccgaaccgaatcaaaataaacacacactccctacgcgtacaactaaatcgaacgataaaactaactttacccgacaaatcaacgctcccgccccaactctcgatcatacctaccctaaaaaaaaataaaacctcgacgtaaatccccgccccttataccccgcccccttataacgacgcccgttcactacgcctacgcataccacacgcgcactcgcgtaaccttcgcgaaaatatcgctaccaaaaaacgtatcctacgcgctacgccgtctatttctaaaacaacgccgacgtctcttaacaaccgcgcgcgacctaaataaatccccccgacacccccaaacctaccataacgaccgcgaatcctaacgtctttctactcataatcaacgaacaaataaaaaacgcccaaataaacgaccgtaaaccccgccaaaacccgccccccaacgtcccccgaaacccttcccgcaaccccccgaact

SEQ ID NO: 39693 - DNA, 782 bp, Artificial Sequence
  chemically treated genomic DNA (Homo sapiens) CpG-island No: 39693
ttttcgcgttttaaatttttcggggttttcgattaggttcggtttcgtttcgttttttcggttttcgcgtagcggttgcgttcgggcgggaaggggcgaaggaggaagggagaggtaggtaggagagttttcgtttgggagcgggacggaggtcgcgggtcgaggttcggggttgtagggtcgtcgcgggacggagggcggtcggggcgggggtgcgcggtagcgtcggtttttagtcggtagggcgggcgggcggtcgtagtgttttattatgttggtgttttttaggtttttttttttttttttcggtttcgtagcgaatggacggcggcggcggcggcggttttttttacgggtttgttcggttttcgtttatgcgtagtgcggggcggttcggcgcggttcgaggaggtagtttcggatttcggggaggcggagggacggaggtaggcggagggcgtttcgcgcggggtttttttcgggcgcgggggtttttcggggagtgggcgggggcggggggcgcggcgggggaggggcgggcgacgtaagtttttcgcgcgtcgatatttttttgtcgcgtcgggcggtttttggtgggggcgtcgggggatattttattttcgttttttacgcggtttttttcggacgattacggtcgggtttacgtaggttggaagcgggtacgagcggcggcggataagttgagtagttgggggcggttgaaacggatggttgaggagttttatttattttagattttttttttttattagtattaaaaa

SEQ ID NO: 39694 - DNA, 782 bp, Artificial Sequence
  chemically treated genomic DNA (Homo sapiens) CpG-island No: 39694
tttttaatactaataaaaaaaaaaaatctaaaataaataaaactcctcaaccatccgtttcaaccgcccccaactactcaacttatccgccgccgctcgtacccgcttccaacctacgtaaacccgaccgtaatcgtccgaaaaaaaccgcgtaaaaaacgaaaataaaatatcccccgacgcccccaccaaaaaccgcccgacgcgacaaaaaaatatcgacgcgcgaaaaacttacgtcgcccgcccctcccccgccgcgccccccgcccccgcccactccccgaaaaacccccgcgcccgaaaaaaaccccgcgcgaaacgccctccgcctacctccgtccctccgcctccccgaaatccgaaactacctcctcgaaccgcgccgaaccgccccgcactacgcataaacgaaaaccgaacaaacccgtaaaaaaaaccgccgccgccgccgccgtccattcgctacgaaaccgaaaaaaaaaaaaaaaaacctaaaaaacaccaacataataaaacactacgaccgcccgcccgccctaccgactaaaaaccgacgctaccgcgcacccccgccccgaccgccctccgtcccgcgacgaccctacaaccccgaacctcgacccgcgacctccgtcccgctcccaaacgaaaactctcctacctacctctcccttcctccttcgccccttcccgcccgaacgcaaccgctacgcgaaaaccgaaaaaacgaaacgaaaccgaacctaatcgaaaaccccgaaaaatttaaaacgcgaaaa

SEQ ID NO: 39695 - DNA, 782 bp, Artificial Sequence
  chemically treated genomic DNA (Homo sapiens) CpG-island No: 39695
tttttgatattgatggggaggggaggtttgggatggatgaagttttttaattattcgttttagtcgtttttagttgtttaatttattcgtcgtcgttcgtgttcgtttttagtttgcgtagattcggtcgtggtcgttcggaaggaatcgcgtaggaaacggaggtggggtgtttttcggcgtttttattagagatcgttcggcgcggtaggaggatgtcggcgcgcggagggtttgcgtcgttcgtttttttttcgtcgcgtttttcgttttcgtttatttttcgggggattttcgcgttcgggggaagtttcgcgcggggcgtttttcgtttgttttcgttttttcgttttttcgaggttcggggttgttttttcgggtcgcgtcgggtcgtttcgtattgcgtatgagcgggagtcgggtaagttcgtgagaggagtcgtcgtcgtcgtcgtcgtttattcgttgcggagtcggaggaggaggggagaggtttggaggatattaatatggtgaggtattgcggtcgttcgttcgttttgtcggttgggggtcggcgttgtcgcgtattttcgtttcggtcgtttttcgtttcgcggcgattttgtagtttcgagtttcggttcgcggttttcgtttcgtttttaggcgggggtttttttgtttgtttttttttttttttttcgttttttttcgttcgggcgtagtcgttacgcgagagtcgaggaggcggagcggagtcgggtttagtcgggagtttcggggagtttggggcgcgggga

SEQ ID NO: 39696 - DNA, 782 bp, Artificial Sequence
  chemically treated genomic DNA (Homo sapiens) CpG-island No: 39696
tccccgcgccccaaactccccgaaactcccgactaaacccgactccgctccgcctcctcgactctcgcgtaacgactacgcccgaacgaaaaaaaacgaaaaaaaaaaaaaaaaacaaacaaaaaaacccccgcctaaaaacgaaacgaaaaccgcgaaccgaaactcgaaactacaaaatcgccgcgaaacgaaaaacgaccgaaacgaaaatacgcgacaacgccgacccccaaccgacaaaacgaacgaacgaccgcaatacctcaccatattaatatcctccaaacctctcccctcctcctccgactccgcaacgaataaacgacgacgacgacgacgactcctctcacgaacttacccgactcccgctcatacgcaatacgaaacgacccgacgcgacccgaaaaaacaaccccgaacctcgaaaaaacgaaaaaacgaaaacaaacgaaaaacgccccgcgcgaaacttcccccgaacgcgaaaatcccccgaaaaataaacgaaaacgaaaaacgcgacgaaaaaaaaacgaacgacgcaaaccctccgcgcgccgacatcctcctaccgcgccgaacgatctctaataaaaacgccgaaaaacaccccacctccgtttcctacgcgattccttccgaacgaccacgaccgaatctacgcaaactaaaaacgaacacgaacgacgacgaataaattaaacaactaaaaacgactaaaacgaataattaaaaaacttcatccatcccaaacctcccctccccatcaatatcaaaaa

SEQ ID NO: 39697 - DNA, 614 bp, Artificial Sequence
  chemically treated genomic DNA (Homo sapiens) CpG-island No: 39697
ttcgtagttattagagacggaaattgtgaggttgtaggaagggatgcgttcgcggtttaaggcgttggttattttgattaggtttaggttcggtattttgttgttttgtattttaaagtggcgttgtttattgttttcgagaatttgtacggagatgttttcgttggtcgcgggagaatttgcgttcgttacggtgagtagagttattacggtgtttatttgagtatttttatttatcgaggcgtagcgcgaggtggtcgggaagtagcggaattttattatcgggttattgttatttacgtttagtagttgaattagcgtttcggcgcgtttagtgagggaaggtacgtttttgtttatcgtttgtatcgtaagcgagtattggcgtcgagtttcgaagtttaggggttttcgtatcgtgataagtttcgttttagggtttatttggaagggggttttttcgttttgtaggcgatagcggatgttcgcgttggtgttttcgttcgcgttcgtcgtcgttatttggaggacgttggaatttataatcgcgtttttaggtattttcgtttggtagtgagaattgttaaaaatcggggggttgttattaatgtttt

SEQ ID NO: 39698 - DNA, 614 bp, Artificial Sequence
  chemically treated genomic DNA (Homo sapiens) CpG-island No: 39698
aaaacattaataacaaccccccgatttttaacaattctcactaccaaacgaaaatacctaaaaacgcgattataaattccaacgtcctccaaataacgacgacgaacgcgaacgaaaacaccaacgcgaacatccgctatcgcctacaaaacgaaaaaacccccttccaaataaaccctaaaacgaaacttatcacgatacgaaaacccctaaacttcgaaactcgacgccaatactcgcttacgatacaaacgataaacaaaaacgtaccttccctcactaaacgcgccgaaacgctaattcaactactaaacgtaaataacaataacccgataataaaattccgctacttcccgaccacctcgcgctacgcctcgataaataaaaatactcaaataaacaccgtaataactctactcaccgtaacgaacgcaaattctcccgcgaccaacgaaaacatctccgtacaaattctcgaaaacaataaacaacgccactttaaaatacaaaacaacaaaataccgaacctaaacctaatcaaaataaccaacgccttaaaccgcgaacgcatcccttcctacaacctcacaatttccgtctctaataactacgaa

SEQ ID NO: 39699 - DNA, 614 bp, Artificial Sequence
  chemically treated genomic DNA (Homo sapiens) CpG-island No: 39699
aagatattaatgataatttttcggtttttggtagtttttattattaggcgggggtgtttgaggacgcggttgtgggttttagcgttttttaggtggcggcggcggacgcggacgagggtattaacgcggatattcgttatcgtttgtaggacgaggggatttttttttaaatggattttgagacgggatttattacggtgcgggagtttttggatttcgaagttcggcgttaatattcgtttacggtgtaggcgatggatagaggcgtgtttttttttattgggcgcgtcgaggcgttgatttagttgttggacgtgaatgataatgattcggtagtgaagtttcgttatttttcggttatttcgcgttacgtttcggtagatgagaatgtttaagtgggtatcgtggtggttttgtttatcgtgacggacgtagattttttcgcggttaacgggaatattttcgtgtaaattttcgggggtaatgagtagcgttattttgaagtgtaaagtagtaaagtgtcgaatttgagtttaattaaggtggttagcgttttggatcgcgagcgtatttttttttataattttatagttttcgtttttgataattacggg

SEQ ID NO: 39700 - DNA, 614 bp, Artificial Sequence
  chemically treated genomic DNA (Homo sapiens) CpG-island No: 39700
cccgtaattatcaaaaacgaaaactataaaattataaaaaaaaatacgctcgcgatccaaaacgctaaccaccttaattaaactcaaattcgacactttactactttacacttcaaaataacgctactcattacccccgaaaatttacacgaaaatattcccgttaaccgcgaaaaaatctacgtccgtcacgataaacaaaaccaccacgatacccacttaaacattctcatctaccgaaacgtaacgcgaaataaccgaaaaataacgaaacttcactaccgaatcattatcattcacgtccaacaactaaatcaacgcctcgacgcgcccaataaaaaaaaacacgcctctatccatcgcctacaccgtaaacgaatattaacgccgaacttcgaaatccaaaaactcccgcaccgtaataaatcccgtctcaaaatccatttaaaaaaaaatcccctcgtcctacaaacgataacgaatatccgcgttaataccctcgtccgcgtccgccgccgccacctaaaaaacgctaaaacccacaaccgcgtcctcaaacacccccgcctaataataaaaactaccaaaaaccgaaaaattatcattaatatctt

SEQ ID NO: 39701 - DNA, 509 bp, Artificial Sequence
  chemically treated genomic DNA (Homo sapiens) CpG-island No: 39701
gggggcgggtaaggggatagcggaaagggtgggcgagggattcgtgttttaattcgtcgagtcgtagttttgtttttgcgagttttcgtcgagatcgtttttcgggaagtcgcgttttttttttgtagtcgcggttcggcgtggggtacggaggggttcgcgtttttagaagtcggtaggttttttcgcgggcgggttcgtagcgcgtttcgtttcggaaatacgtttatggtcgttttggcgcgtttttaaacgtttaggttttttatttttcggttgtttgggaattttttttttgttcgttaagttcgtagttattcgggcgcggcgggatttttagattcggcgttgcgatgaagaggattcgcgacgaggtggatgcgacgttgtagatcgttaagttgaatgcggtcgagttgttgtcggcggtgtattgtttgggtttcggttttggggttagcggcgttgtagtcggcgatttttgtttgttggagttggagtttacgttg

SEQ ID NO: 39702 - DNA, 509 bp, Artificial Sequence
  chemically treated genomic DNA (Homo sapiens) CpG-island No: 39702
caacgtaaactccaactccaacaaacaaaaatcgccgactacaacgccgctaaccccaaaaccgaaacccaaacaatacaccgccgacaacaactcgaccgcattcaacttaacgatctacaacgtcgcatccacctcgtcgcgaatcctcttcatcgcaacgccgaatctaaaaatcccgccgcgcccgaataactacgaacttaacgaacaaaaaaaaaattcccaaacaaccgaaaaataaaaaacctaaacgtttaaaaacgcgccaaaacgaccataaacgtatttccgaaacgaaacgcgctacgaacccgcccgcgaaaaaacctaccgacttctaaaaacgcgaacccctccgtaccccacgccgaaccgcgactacaaaaaaaaaacgcgacttcccgaaaaacgatctcgacgaaaactcgcaaaaacaaaactacgactcgacgaattaaaacacgaatccctcgcccaccctttccgctatccccttacccgccccc

SEQ ID NO: 39703 - DNA, 509 bp, Artificial Sequence
  chemically treated genomic DNA (Homo sapiens) CpG-island No: 39703
tagcgtgggttttagttttagtaggtagaagtcgtcggttgtagcgtcgttggttttagggtcgaagtttaggtagtgtatcgtcggtagtagttcggtcgtatttagtttggcgatttgtagcgtcgtatttatttcgtcgcgggttttttttatcgtagcgtcgggtttaggagtttcgtcgcgttcgggtggttgcgggtttggcgggtaagaaagaagtttttaagtagtcggaaggtaggaaatttgagcgtttgaaagcgcgttaaggcggttatgggcgtgttttcggggcggagcgcgttgcgggttcgttcgcgggaaggtttgtcggtttttgggagcgcgagttttttcgtgttttacgtcggatcgcgattgtaggaaggaaacgcggtttttcggggggcggtttcggcggaagttcgtaggggtagagttgcgattcggcgggttgggatacggatttttcgtttatttttttcgttgtttttttgttcgttttt

SEQ ID NO: 39704 - DNA, 509 bp, Artificial Sequence
  chemically treated genomic DNA (Homo sapiens) CpG-island No: 39704
aaaaacgaacaaaaaaacaacgaaaaaaataaacgaaaaatccgtatcccaacccgccgaatcgcaactctacccctacgaacttccgccgaaaccgccccccgaaaaaccgcgtttccttcctacaatcgcgatccgacgtaaaacacgaaaaaactcgcgctcccaaaaaccgacaaaccttcccgcgaacgaacccgcaacgcgctccgccccgaaaacacgcccataaccgccttaacgcgctttcaaacgctcaaatttcctaccttccgactacttaaaaacttctttcttacccgccaaacccgcaaccacccgaacgcgacgaaactcctaaacccgacgctacgataaaaaaaacccgcgacgaaataaatacgacgctacaaatcgccaaactaaatacgaccgaactactaccgacgatacactacctaaacttcgaccctaaaaccaacgacgctacaaccgacgacttctacctactaaaactaaaacccacgcta

SEQ ID NO: 39705 - DNA, 747 bp, Artificial Sequence
  chemically treated genomic DNA (Homo sapiens) CpG-island No: 39705
tatcgtttttttttagttttttatttttataaacgattttttaggttttttggtttatgcgtatcgtttatttacggaacgtcgaatttggtcgggttcggttgttgttgcggtgttaggtgagtttaggtcgtcgttatcgttttttaagcgtattagtcgcgtttcgtttcgcgttatacgtagttcgcgttttcgcgtattatacgtaatcgttcggcgtcgtacgattgggtaatggcgtgttagtttattggttgagtcggattaaattcgagtaaggacgtttgttttttggtaacggttaaacgtaagggcggggtcgtcgacggttattcgagggaggagtatcgtttttttttttggtttcgttttttcgtacgtaaatttcgttttttagaaggatttcggcgtgttataggcgaaggtttttgggaaggtggaggtcggtagggcggaggcggagttcgggaaggaaaggtggaattagagggtagaaggcgggatttaaggagaggcgatttttataggtagggaaagattagacgggcggggtttgggagagatggagtcggaagaaagacgagcgagaaaggggtggggttatggattttaggagacgtttggagtggaagagtgggtgtggaggggcgaggttattacgaaaagagaggaggaattagtaggtgggtcgggtttgcggaaaagtggagttttagagagggttgattgcgggtattttagttt

SEQ ID NO: 39706 - DNA, 747 bp, Artificial Sequence
  chemically treated genomic DNA (Homo sapiens) CpG-island No: 39706
aaactaaaatacccgcaatcaaccctctctaaaactccacttttccgcaaacccgacccacctactaattcctcctctcttttcgtaataacctcgcccctccacacccactcttccactccaaacgtctcctaaaatccataaccccacccctttctcgctcgtctttcttccgactccatctctcccaaaccccgcccgtctaatctttccctacctataaaaatcgcctctccttaaatcccgccttctaccctctaattccacctttccttcccgaactccgcctccgccctaccgacctccaccttcccaaaaaccttcgcctataacacgccgaaatccttctaaaaaacgaaatttacgtacgaaaaaacgaaaccaaaaaaaaaaacgatactcctccctcgaataaccgtcgacgaccccgcccttacgtttaaccgttaccaaaaaacaaacgtccttactcgaatttaatccgactcaaccaataaactaacacgccattacccaatcgtacgacgccgaacgattacgtataatacgcgaaaacgcgaactacgtataacgcgaaacgaaacgcgactaatacgcttaaaaaacgataacgacgacctaaactcacctaacaccgcaacaacaaccgaacccgaccaaattcgacgttccgtaaataaacgatacgcataaaccaaaaaacctaaaaaatcgtttataaaaataaaaaactaaaaaaaaacgata

SEQ ID NO: 39707 - DNA, 747 bp, Artificial Sequence
  chemically treated genomic DNA (Homo sapiens) CpG-island No: 39707
gaattagagtgttcgtagttagttttttttagggttttattttttcgtaggttcggtttatttattgatttttttttttttttcgtgatagtttcgtttttttatatttatttttttattttaagcgttttttggaatttatggttttatttttttttcgttcgtttttttttcggttttattttttttaagtttcgttcgtttgatttttttttgtttgtaaaaatcgtttttttttaggtttcgttttttgttttttggttttatttttttttttcgggtttcgttttcgttttgtcggtttttatttttttagaggttttcgtttatgatacgtcggagtttttttgaggggcggggtttacgtacgaagggacggaattaagaggagaggcggtgtttttttttcggatagtcgtcggcgatttcgtttttgcgtttagtcgttgttaggaaataagcgtttttgttcgggtttggttcggtttagttaatgagttggtacgttattgtttagtcgtgcgacgtcgggcggttgcgtgtggtgcgcgggggcgcgggttgcgtgtggcgcggggcggggcgcggttggtgcgtttgagaagcgatggcggcggtttgaatttatttaatatcgtagtaataatcgggttcggttaggttcggcgtttcgtgagtgaacggtacgtatgggttagagggtttggagagtcgtttgtggggatgagagattgggaaaagacggtg

SEQ ID NO: 39708 - DNA, 747 bp, Artificial Sequence
  chemically treated genomic DNA (Homo sapiens) CpG-island No: 39708
caccgtcttttcccaatctctcatccccacaaacgactctccaaaccctctaacccatacgtaccgttcactcacgaaacgccgaacctaaccgaacccgattattactacgatattaaataaattcaaaccgccgccatcgcttctcaaacgcaccaaccgcgccccgccccgcgccacacgcaacccgcgcccccgcgcaccacacgcaaccgcccgacgtcgcacgactaaacaataacgtaccaactcattaactaaaccgaaccaaacccgaacaaaaacgcttatttcctaacaacgactaaacgcaaaaacgaaatcgccgacgactatccgaaaaaaaaacaccgcctctcctcttaattccgtcccttcgtacgtaaaccccgcccctcaaaaaaactccgacgtatcataaacgaaaacctctaaaaaaataaaaaccgacaaaacgaaaacgaaacccgaaaaaaaaaaataaaaccaaaaaacaaaaaacgaaacctaaaaaaaaacgatttttacaaacaaaaaaaaatcaaacgaacgaaacttaaaaaaaataaaaccgaaaaaaaaacgaacgaaaaaaaaataaaaccataaattccaaaaaacgcttaaaataaaaaaataaatataaaaaaacgaaactatcacgaaaaaaaaaaaaaaatcaataaataaaccgaacctacgaaaaaataaaaccctaaaaaaaactaactacgaacactctaattc

SEQ ID NO: 39709 - DNA, 576 bp, Artificial Sequence
  chemically treated genomic DNA (Homo sapiens) CpG-island No: 39709
aggggggcgaggagaggtcgttttttgttgtcgttgtttaggttggagttgttgttttttacgtcggcgttgggtttggtcgcgtagttgtgtcgggataggttcgtggatatcgtttcgtcgtcgttattcgatacggcgggcgttattaatataggtcgtatcgggttttcgaggtcgttcgagtcggcggtttgggttatttcgtcggatattagcgttgtcgtcgaaatcgttacggaaggcggcgacggggaagaggataaagacgaggaggcggaagttatcgaggaggtcgtcgaggattcggggtttgttttagcggagttcgattcggtttggcggttattagatatcgtgatttttttttttttagtcgggcgttcggaggagagggatcgcgatttcgatttttcgtcgttttttttttttttagttttagtgtattttgaggacgttcgtcgagtcggaggtggggttgaggaataataaagttgcgtttttttttaaggtagttatataatagcgttttacgggagggggcggaggaaattaaaaaagcggagtagaaggtat

SEQ ID NO: 39710 - DNA, 576 bp, Artificial Sequence
  chemically treated genomic DNA (Homo sapiens) CpG-island No: 39710
ataccttctactccgcttttttaatttcctccgccccctcccgtaaaacgctattatataactaccttaaaaaaaaacgcaactttattattcctcaaccccacctccgactcgacgaacgtcctcaaaatacactaaaactaaaaaaaaaaaaaacgacgaaaaatcgaaatcgcgatccctctcctccgaacgcccgactaaaaaaaaaaaaatcacgatatctaataaccgccaaaccgaatcgaactccgctaaaacaaaccccgaatcctcgacgacctcctcgataacttccgcctcctcgtctttatcctcttccccgtcgccgccttccgtaacgatttcgacgacaacgctaatatccgacgaaataacccaaaccgccgactcgaacgacctcgaaaacccgatacgacctatattaataacgcccgccgtatcgaataacgacgacgaaacgatatccacgaacctatcccgacacaactacgcgaccaaacccaacgccgacgtaaaaaacaacaactccaacctaaacaacgacaacaaaaaacgacctctcctcgcccccct

SEQ ID NO: 39711 - DNA, 576 bp, Artificial Sequence
  chemically treated genomic DNA (Homo sapiens) CpG-island No: 39711
gtgttttttatttcgtttttttagtttttttcgttttttttcgtgggacgttgttgtgtggttgttttaaaaaaaaacgtaattttattgttttttagttttattttcggttcggcgggcgtttttaggatgtattgaggttgaggggaggggaggcggcggagggtcgaggtcgcggtttttttttttcgagcgttcggttggaggggagggagttacgatgtttggtagtcgttaggtcgggtcgggtttcgttgggataagtttcgggttttcggcggttttttcggtgattttcgttttttcgtttttattttttttttcgtcgtcgtttttcgtggcggtttcggcggtagcgttggtgttcggcggggtggtttaggtcgtcggttcgggcggtttcgggggttcggtgcggtttgtgttggtggcgttcgtcgtatcgggtagcggcggcggggcggtgtttacgggtttgtttcggtatagttgcgcggttaggtttagcgtcggcgtaggaggtagtagttttagtttaggtagcggtagtaggaagcgattttttttcgttttttt

SEQ ID NO: 39712 - DNA, 576 bp, Artificial Sequence
  chemically treated genomic DNA (Homo sapiens) CpG-island No: 39712
aaaaaaacgaaaaaaaatcgcttcctactaccgctacctaaactaaaactactacctcctacgccgacgctaaacctaaccgcgcaactataccgaaacaaacccgtaaacaccgccccgccgccgctacccgatacgacgaacgccaccaacacaaaccgcaccgaacccccgaaaccgcccgaaccgacgacctaaaccaccccgccgaacaccaacgctaccgccgaaaccgccacgaaaaacgacgacgaaaaaaaaaataaaaacgaaaaaacgaaaatcaccgaaaaaaccgccgaaaacccgaaacttatcccaacgaaacccgacccgacctaacgactaccaaacatcgtaactccctcccctccaaccgaacgctcgaaaaaaaaaaaccgcgacctcgaccctccgccgcctcccctcccctcaacctcaatacatcctaaaaacgcccgccgaaccgaaaataaaactaaaaaacaataaaattacgtttttttttaaaacaaccacacaacaacgtcccacgaaaaaaaacgaaaaaaactaaaaaaacgaaataaaaaacac

SEQ ID NO: 39713 - DNA, 649 bp, Artificial Sequence
  chemically treated genomic DNA (Homo sapiens) CpG-island No: 39713
ggcgggcggttgtttcggtttaggggtggaggtcggggttttgattcgacgtagttaggcggaagcgcggttgttattggaggttgtttttatttgcgcggggttcggggcgtaaagttcgaggcgtcggggggaggaggcggcggacggtagcgtaggtgggttcgcgttttcggttttgtaagatgtttttgaagttgcgggggaagaagaaggttaagtttaaggagatcgtcgggttggtggagggcgagtcgacgggcgcgggcggcgggagttttttagcgtttcgggttttcgtacgtaggttggttttttacgcgtagttggcgtacggtagtgttacgggtcgagtggagggtttttttagtatttaggagttttacgtttagatcgcgggcgcgtttgaaatttcgtcgtcggaggtaaggcgttaggtgtttaggttttttcgttttttcgtcgcgtcgcgtcgcgtcgcgcgtatttttgtgggtttaggagggttgagcggcgtttttcggagcgcgaaattcgatgtcgtgttgagttcgtcgggggcgtttcgggggaaagtgagtgtgttttttttggaagggaaaatttaatttggtaggatcgtagaaagttatagttttttttgtttcga

SEQ ID NO: 39714 - DNA, 649 bp, Artificial Sequence
  chemically treated genomic DNA (Homo sapiens) CpG-island No: 39714
tcgaaacaaaaaaaactataactttctacgatcctaccaaattaaattttcccttccaaaaaaaacacactcactttcccccgaaacgcccccgacgaactcaacacgacatcgaatttcgcgctccgaaaaacgccgctcaaccctcctaaacccacaaaaatacgcgcgacgcgacgcgacgcgacgaaaaaacgaaaaaacctaaacacctaacgccttacctccgacgacgaaatttcaaacgcgcccgcgatctaaacgtaaaactcctaaatactaaaaaaaccctccactcgacccgtaacactaccgtacgccaactacgcgtaaaaaaccaacctacgtacgaaaacccgaaacgctaaaaaactcccgccgcccgcgcccgtcgactcgccctccaccaacccgacgatctccttaaacttaaccttcttcttcccccgcaacttcaaaaacatcttacaaaaccgaaaacgcgaacccacctacgctaccgtccgccgcctcctccccccgacgcctcgaactttacgccccgaaccccgcgcaaataaaaacaacctccaataacaaccgcgcttccgcctaactacgtcgaatcaaaaccccgacctccacccctaaaccgaaacaaccgcccgcc

SEQ ID NO: 39715 - DNA, 649 bp, Artificial Sequence
  chemically treated genomic DNA (Homo sapiens) CpG-island No: 39715
tcggagtaagggggattgtgattttttgcggttttgttaagttaaatttttttttttagggaaggtatatttattttttttcgggacgttttcggcggatttaatacggtatcggatttcgcgtttcgggaaacgtcgtttaatttttttgggtttatagaaatacgcgcggcgcggcgcggcgcggcggagaggcgggagagtttgagtatttggcgttttattttcgacggcgagattttaaacgcgttcgcgatttgggcgtagagtttttggatgttggagaagttttttattcggttcgtggtattatcgtgcgttagttgcgcgtggaagattagtttgcgtgcgggagttcgggacgttgagaggttttcgtcgttcgcgttcgtcggttcgttttttattagttcggcggtttttttggatttggttttttttttttttcgtagttttaggggtattttgtagggtcgagagcgcgggtttatttgcgttgtcgttcgtcgtttttttttttcggcgtttcggattttgcgtttcgggtttcgcgtaggtaaaagtagtttttaatggtagtcgcgttttcgtttggttgcgtcgggttagggtttcgatttttatttttggatcggagtagtcgttcgtt

SEQ ID NO: 39716 - DNA, 649 bp, Artificial Sequence
  chemically treated genomic DNA (Homo sapiens) CpG-island No: 39716
aacgaacgactactccgatccaaaaataaaaatcgaaaccctaacccgacgcaaccaaacgaaaacgcgactaccattaaaaactacttttacctacgcgaaacccgaaacgcaaaatccgaaacgccgaaaaaaaaaaacgacgaacgacaacgcaaataaacccgcgctctcgaccctacaaaatacccctaaaactacgaaaaaaaaaaaaaaccaaatccaaaaaaaccgccgaactaataaaaaacgaaccgacgaacgcgaacgacgaaaacctctcaacgtcccgaactcccgcacgcaaactaatcttccacgcgcaactaacgcacgataataccacgaaccgaataaaaaacttctccaacatccaaaaactctacgcccaaatcgcgaacgcgtttaaaatctcgccgtcgaaaataaaacgccaaatactcaaactctcccgcctctccgccgcgccgcgccgcgccgcgcgtatttctataaacccaaaaaaattaaacgacgtttcccgaaacgcgaaatccgataccgtattaaatccgccgaaaacgtcccgaaaaaaaataaatataccttccctaaaaaaaaaaatttaacttaacaaaaccgcaaaaaatcacaatcccccttactccga

SEQ ID NO: 39717 - DNA, 546 bp, Artificial Sequence
  chemically treated genomic DNA (Homo sapiens) CpG-island No: 39717
tttcgggagtcggtgaggcggttgtaggtttttttttgcggagtcgttggttcggttggcggagatgtgatcgcgggttcggtcggtttgttttaggcgtcgcgttagttttcgtgttcgtgtttttaatttatatcgatggcgggattcggttgcgtttggggcgcggagtcgtcgcgttttttggaggttttcgggcggttgtggtaggtatagagtcgtttgggtagcggttttttcgtttcggtgtatcgggttcgttgttgcggtaattttggttcgtttttcggcgtttttaagtagtttttgtcgttaggaattatcggggttgcggtttttgtcgtcgagtatggttttcgtaaagagagggcggcgttggaatagttgtagggttatagaaatatcggtaattgtcgttgttttttttttttttttgtttaggttatagttcgagtatattttttttttcgttgtttggcgttttatttttttttttttttgcgggagaagcgggtttagttttttttattattttatttaggtttt

SEQ ID NO: 39718 - DNA, 546 bp, Artificial Sequence
  chemically treated genomic DNA (Homo sapiens) CpG-island No: 39718
aaaacctaaataaaataataaaaaaaactaaacccgcttctcccgcaaaaaaaaaaaaaaataaaacgccaaacaacgaaaaaaaaaatatactcgaactataacctaaacaaaaaaaaaaaaaaaacaacgacaattaccgatatttctataaccctacaactattccaacgccgccctctctttacgaaaaccatactcgacgacaaaaaccgcaaccccgataattcctaacgacaaaaactacttaaaaacgccgaaaaacgaaccaaaattaccgcaacaacgaacccgatacaccgaaacgaaaaaaccgctacccaaacgactctatacctaccacaaccgcccgaaaacctccaaaaaacgcgacgactccgcgccccaaacgcaaccgaatcccgccatcgatataaattaaaaacacgaacacgaaaactaacgcgacgcctaaaacaaaccgaccgaacccgcgatcacatctccgccaaccgaaccaacgactccgcaaaaaaaaacctacaaccgcctcaccgactcccgaaa

SEQ ID NO: 39719 - DNA, 546 bp, Artificial Sequence
  chemically treated genomic DNA (Homo sapiens) CpG-island No: 39719
ggggtttggatggggtgataaagagggttaaattcgtttttttcgtagaaggggaggaagatggaacgttagatagcgagaggaagagtgtgttcggattgtgatttgggtaagaagagaaaggagatagcggtaattatcgatgtttttgtgattttgtaattgttttagcgtcgttttttttttgcggaaattatattcggcggtagaggtcgtagtttcggtggtttttggcggtaagaattgtttgagggcgtcggggggcgagttagggttgtcgtagtagcgaattcgatatatcgaggcggaggagtcgttatttagacggttttgtatttgttatagtcgttcgaaggtttttagaaaacgcggcggtttcgcgttttaggcgtagtcggatttcgttatcggtgtgggttaagggtacggatacgggagttgacgcgacgtttgaggtaggtcggtcgggttcgcggttatattttcgttagtcggattagcggtttcgtagggagggatttgtagtcgttttatcgattttcggga

SEQ ID NO: 39720 - DNA, 546 bp, Artificial Sequence
  chemically treated genomic DNA (Homo sapiens) CpG-island No: 39720
tcccgaaaatcgataaaacgactacaaatccctccctacgaaaccgctaatccgactaacgaaaatataaccgcgaacccgaccgacctacctcaaacgtcgcgtcaactcccgtatccgtacccttaacccacaccgataacgaaatccgactacgcctaaaacgcgaaaccgccgcgttttctaaaaaccttcgaacgactataacaaatacaaaaccgtctaaataacgactcctccgcctcgatatatcgaattcgctactacgacaaccctaactcgccccccgacgccctcaaacaattcttaccgccaaaaaccaccgaaactacgacctctaccgccgaatataatttccgcaaaaaaaaaacgacgctaaaacaattacaaaatcacaaaaacatcgataattaccgctatctcctttctcttcttacccaaatcacaatccgaacacactcttcctctcgctatctaacgttccatcttcctccccttctacgaaaaaaacgaatttaaccctctttatcaccccatccaaacccc

SEQ ID NO: 39721 - DNA, 589 bp, Artificial Sequence
  chemically treated genomic DNA (Homo sapiens) CpG-island No: 39721
tcgtttcggcgtttcgggtcgcggtcgttttcgcgttcgcgtcgtcgtttgtgttttcggcgttgacgtgtttgggcggtcggtttttatttttttaggcgtcggtagttattagtcgtggcgagaggggcggggtggtcggggttggcgttttatttggttttcgttttcggttcgtttcgtcgtcgcggtttttcgtatgagggtatatattcggagcgagcgcgggacgtcgatgagtggtcgcgcggaaggagttggagacggtcgtagttgcggtcgcgtcgagaaaggtgaggggtttttagtttagcgaggagacggcggggttcgggattcgggcgggcggagggtttggttttatcgtatatacggttacgcgtttagacgtggatacgcgtcgtacgaacgtgtatagcgcgggtagtcgagtatacgtcgaggagtttttcgttcgttcgtagatatatattttagttcgtgcgtttcgtagtcgtattttatttttcgttatttcgcgagagggtgtgtgggttgggtagtcgggtggatggcggggttagggatggaatgagcgcgttttagatgg

SEQ ID NO: 39722 - DNA, 589 bp, Artificial Sequence
  chemically treated genomic DNA (Homo sapiens) CpG-island No: 39722
ccatctaaaacgcgctcattccatccctaaccccgccatccacccgactacccaacccacacaccctctcgcgaaataacgaaaaataaaatacgactacgaaacgcacgaactaaaatatatatctacgaacgaacgaaaaactcctcgacgtatactcgactacccgcgctatacacgttcgtacgacgcgtatccacgtctaaacgcgtaaccgtatatacgataaaaccaaaccctccgcccgcccgaatcccgaaccccgccgtctcctcgctaaactaaaaacccctcacctttctcgacgcgaccgcaactacgaccgtctccaactccttccgcgcgaccactcatcgacgtcccgcgctcgctccgaatatataccctcatacgaaaaaccgcgacgacgaaacgaaccgaaaacgaaaaccaaataaaacgccaaccccgaccaccccgcccctctcgccacgactaataactaccgacgcctaaaaaaataaaaaccgaccgcccaaacacgtcaacgccgaaaacacaaacgacgacgcgaacgcgaaaacgaccgcgacccgaaacgccgaaacga

SEQ ID NO: 39723 - DNA, 589 bp, Artificial Sequence
  chemically treated genomic DNA (Homo sapiens) CpG-island No: 39723
ttatttggggcgcgtttattttatttttggtttcgttatttattcggttgtttagtttatatattttttcgcggggtggcggaggatggggtgcgattgcggggcgtacgggttggggtgtgtgtttgcgggcgagcgggaggtttttcggcgtgtgttcggttgttcgcgttgtgtacgttcgtgcgacgcgtgtttacgtttgagcgcgtggtcgtgtgtgcggtggggttaggtttttcgttcgttcgggtttcgagtttcgtcgttttttcgttgggttgggagttttttatttttttcggcgcgatcgtagttacgatcgtttttagtttttttcgcgcggttatttatcggcgtttcgcgttcgtttcgaatatatatttttatgcggggggtcgcggcggcggggcgggtcgggagcgggggttaagtggagcgttagtttcggttatttcgtttttttcgttacgattagtggttgtcgacgtttgaaggagtggaagtcgatcgtttagatacgttagcgtcgggagtatagacgacgacgcggacgcggaggcggtcgcggttcggggcgtcggggcgg

SEQ ID NO: 39724 - DNA, 589 bp, Artificial Sequence
  chemically treated genomic DNA (Homo sapiens) CpG-island No: 39724
ccgccccgacgccccgaaccgcgaccgcctccgcgtccgcgtcgtcgtctatactcccgacgctaacgtatctaaacgatcgacttccactccttcaaacgtcgacaaccactaatcgtaacgaaaaaaacgaaataaccgaaactaacgctccacttaacccccgctcccgacccgccccgccgccgcgaccccccgcataaaaatatatattcgaaacgaacgcgaaacgccgataaataaccgcgcgaaaaaaactaaaaacgatcgtaactacgatcgcgccgaaaaaaataaaaaactcccaacccaacgaaaaaacgacgaaactcgaaacccgaacgaacgaaaaacctaaccccaccgcacacacgaccacgcgctcaaacgtaaacacgcgtcgcacgaacgtacacaacgcgaacaaccgaacacacgccgaaaaacctcccgctcgcccgcaaacacacaccccaacccgtacgccccgcaatcgcaccccatcctccgccaccccgcgaaaaaatatataaactaaacaaccgaataaataacgaaaccaaaaataaaataaacgcgccccaaataa

SEQ ID NO: 39725 - DNA, 1085 bp, Artificial Sequence
  chemically treated genomic DNA (Homo sapiens) CpG-island No: 39725
aagacgttcgtttcgtattttttcgggaatgaggtttttgtaggcgagggcggcgttgtttttttttttcgcggtagtgagatttcgagggcgttttagggtaggaggggaggtcgaattattttttgagaagagcgttagagaattttagagcgtttcgttttttttcgggagaggtaaatatcgatacgtttgtgttttttattaataagtgtttttaagttcggcgggggtagatattttcgcgtcggtcgtcggcgaggttttcgcggtttgcgggggttacggtttcgttttagttgcgttgatttagggcgttattcggtttcggggcgggaggcggtttttcgggcggcgaagtagcgttcgcggcgtggggcgatcgcgcggtgggcggaggggtagggggaggggcggagaggcgttttcggggcgtagggggcgggcgtgcgggtatacgcggtgcgcggcgggggcggttatcgtgttgcgtagtttgggcgtttggggagtcgtttatttcgtcgggtcgcgtttcgacggtcggagcgtggatgcggcggcgttcgtcgagtcggggcggacgcggggcggttcgggttcgggagacgcgtcggtagtttcggtatcgtagcggtcgtaggatggtcgaggtaagcgcggcgtttttcgcgggcgcggggattttttgtgcgcggagtaggcggttcgggacgtcgttgggtttcggttttcgtgggtattcgagggttatttttcgagggttagttggttatttgcgcggtagcgcggtttcgaggcgcggcgggagggatcgtggttttcggtcgggaggcggcggcgggggggttggggttttgggattcgtttttgttcgacgtttcggagttggtaaacggttttcgcgtcggatttgcgggcgcgtcggaggtgtcggcgggttagtttgtggaaatcggcggcggtattcggcgggtattttatacgttattttttgtcgttcgtattttaggttttagtttaggacgttaggatttgttgtttttatttgtgggggtcgatttttttttttttttttttttttt

SEQ ID NO: 39726 - DNA, 1085 bp, Artificial Sequence
  chemically treated genomic DNA (Homo sapiens) CpG-island No: 39726
aaaaaaaaaaaaaaaaaaaaaaaatcgacccccacaaataaaaacaacaaatcctaacgtcctaaactaaaacctaaaatacgaacgacaaaaaataacgtataaaatacccgccgaataccgccgccgatttccacaaactaacccgccgacacctccgacgcgcccgcaaatccgacgcgaaaaccgtttaccaactccgaaacgtcgaacaaaaacgaatcccaaaaccccaacccccccgccgccgcctcccgaccgaaaaccacgatccctcccgccgcgcctcgaaaccgcgctaccgcgcaaataaccaactaaccctcgaaaaataaccctcgaatacccacgaaaaccgaaacccaacgacgtcccgaaccgcctactccgcgcacaaaaaatccccgcgcccgcgaaaaacgccgcgcttacctcgaccatcctacgaccgctacgataccgaaactaccgacgcgtctcccgaacccgaaccgccccgcgtccgccccgactcgacgaacgccgccgcatccacgctccgaccgtcgaaacgcgacccgacgaaataaacgactccccaaacgcccaaactacgcaacacgataaccgcccccgccgcgcaccgcgtatacccgcacgcccgccccctacgccccgaaaacgcctctccgcccctccccctacccctccgcccaccgcgcgatcgccccacgccgcgaacgctacttcgccgcccgaaaaaccgcctcccgccccgaaaccgaataacgccctaaatcaacgcaactaaaacgaaaccgtaacccccgcaaaccgcgaaaacctcgccgacgaccgacgcgaaaatatctacccccgccgaacttaaaaacacttattaataaaaaacacaaacgtatcgatatttacctctcccgaaaaaaaacgaaacgctctaaaattctctaacgctcttctcaaaaaataattcgacctcccctcctaccctaaaacgccctcgaaatctcactaccgcgaaaaaaaaaaacaacgccgccctcgcctacaaaaacctcattcccgaaaaaatacgaaacgaacgtctt

SEQ ID NO: 39727 - DNA, 1085 bp, Artificial Sequence
  chemically treated genomic DNA (Homo sapiens) CpG-island No: 39727
aaagaaaaaaaaaaaaagaaggggtcgatttttataggtggaaatagtaagttttaacgttttgggttgaagtttggggtgcgggcggtagagagtggcgtgtagggtattcgtcgagtgtcgtcgtcgatttttataggttggttcgtcggtattttcgacgcgttcgtagattcggcgcggagatcgtttgttagtttcgggacgtcgggtagggacgggttttagagttttaattttttcgtcgtcgtttttcggtcggagattacggtttttttcgtcgcgtttcggggtcgcgttgtcgcgtaggtagttagttggttttcgggaggtggttttcgggtatttacgggagtcggagtttagcggcgtttcgggtcgtttgtttcgcgtatagagaattttcgcgttcgcggagggcgtcgcgtttatttcggttattttgcgatcgttgcggtgtcggggttgtcggcgcgtttttcgggttcgggtcgtttcgcgttcgtttcggttcggcgggcgtcgtcgtatttacgtttcggtcgtcggggcgcgattcggcgaagtgggcggttttttaagcgtttaggttgcgtagtacgatggtcgttttcgtcgcgtatcgcgtgtgttcgtacgttcgttttttgcgtttcggggacgttttttcgtttttttttttgttttttcgtttatcgcgcggtcgttttacgtcgcgggcgttgtttcgtcgttcgggaggtcgtttttcgtttcgggatcggataacgttttaaattagcgtagttgaggcgaggtcgtggttttcgtagatcgcggagatttcgtcggcggtcggcgcggaggtgtttgttttcgtcgggtttgaaggtatttgttggtaaaagatatagacgtgtcggtgtttgtttttttcggggaagggcgaaacgttttgaagttttttggcgttttttttaggagatgattcggtttttttttttattttggggcgttttcggggttttattgtcgcggaggaagaaggtagcgtcgttttcgtttgtagaaattttattttcgagaaagtgcgggacgagcgtttt

SEQ ID NO: 39728 - DNA, 1085 bp, Artificial Sequence
  chemically treated genomic DNA (Homo sapiens) CpG-island No: 39728
aaaacgctcgtcccgcactttctcgaaaataaaatttctacaaacgaaaacgacgctaccttcttcctccgcgacaataaaaccccgaaaacgccccaaaataaaaaaaaaaaccgaatcatctcctaaaaaaaacgccaaaaaacttcaaaacgtttcgcccttccccgaaaaaaacaaacaccgacacgtctatatcttttaccaacaaataccttcaaacccgacgaaaacaaacacctccgcgccgaccgccgacgaaatctccgcgatctacgaaaaccacgacctcgcctcaactacgctaatttaaaacgttatccgatcccgaaacgaaaaacgacctcccgaacgacgaaacaacgcccgcgacgtaaaacgaccgcgcgataaacgaaaaaacaaaaaaaaaaacgaaaaaacgtccccgaaacgcaaaaaacgaacgtacgaacacacgcgatacgcgacgaaaacgaccatcgtactacgcaacctaaacgcttaaaaaaccgcccacttcgccgaatcgcgccccgacgaccgaaacgtaaatacgacgacgcccgccgaaccgaaacgaacgcgaaacgacccgaacccgaaaaacgcgccgacaaccccgacaccgcaacgatcgcaaaataaccgaaataaacgcgacgccctccgcgaacgcgaaaattctctatacgcgaaacaaacgacccgaaacgccgctaaactccgactcccgtaaatacccgaaaaccacctcccgaaaaccaactaactacctacgcgacaacgcgaccccgaaacgcgacgaaaaaaaccgtaatctccgaccgaaaaacgacgacgaaaaaattaaaactctaaaacccgtccctacccgacgtcccgaaactaacaaacgatctccgcgccgaatctacgaacgcgtcgaaaataccgacgaaccaacctataaaaatcgacgacgacactcgacgaataccctacacgccactctctaccgcccgcaccccaaacttcaacccaaaacgttaaaacttactatttccacctataaaaatcgaccccttctttttttttttttcttt

SEQ ID NO: 39729 - DNA, 593 bp, Artificial Sequence
  chemically treated genomic DNA (Homo sapiens) CpG-island No: 39729
tcgtgtgcggggtagatttgattagttttattgcggattttggagtttttgtcgcggtttcgcgcgaggtggttcgttttttagaaagcgttgggacggggttaaggcgtttgggttttgggttggaagtcgggtcgagtcgcgttcgtcgtttcgaggtttttttggagtgataggaagtgggtttgggttgcggagttcgcggttgcgtttgtcgttttttttaggggtttgtatgggaagcgtcgggacgggaagttttcggttttcgatttcgagtttttttaatagtttcgtttagtttggttttgggatttgcgagcgcgtggttcgttcgtttcgggagcgtttcgtcggtttcgtgttgggagtcgggcggcggcggcgaggttgggggtcgcgggcggagaaggaggaggtcgttgcggggtttttcgttgttttttcggagtcgtcgtttagattcggagtttcgttcgttcgtttggttttgtcggagtttttcgggatttgttagttagatgtgataagattgtggcgaggcgagtgaaggagatttgatattaattagcgcgtagtttcgagttaaattt

SEQ ID NO: 39730 - DNA, 593 bp, Artificial Sequence
  chemically treated genomic DNA (Homo sapiens) CpG-island No: 39730
aaatttaactcgaaactacgcgctaattaatatcaaatctccttcactcgcctcgccacaatcttatcacatctaactaacaaatcccgaaaaactccgacaaaaccaaacgaacgaacgaaactccgaatctaaacgacgactccgaaaaaacaacgaaaaaccccgcaacgacctcctccttctccgcccgcgacccccaacctcgccgccgccgcccgactcccaacacgaaaccgacgaaacgctcccgaaacgaacgaaccacgcgctcgcaaatcccaaaaccaaactaaacgaaactattaaaaaaactcgaaatcgaaaaccgaaaacttcccgtcccgacgcttcccatacaaacccctaaaaaaaacgacaaacgcaaccgcgaactccgcaacccaaacccacttcctatcactccaaaaaaacctcgaaacgacgaacgcgactcgacccgacttccaacccaaaacccaaacgccttaaccccgtcccaacgctttctaaaaaacgaaccacctcgcgcgaaaccgcgacaaaaactccaaaatccgcaataaaactaatcaaatctaccccgcacacga

SEQ ID NO: 39731 - DNA, 593 bp, Artificial Sequence
  chemically treated genomic DNA (Homo sapiens) CpG-island No: 39731
aagtttggttcggagttacgcgttgattaatattagattttttttattcgtttcgttataattttgttatatttggttgataaatttcgaggaatttcggtaaagttaggcgggcgggcggggtttcgggtttgggcggcggtttcggaggagtagcgggagatttcgtagcggtttttttttttttcgttcgcggtttttagtttcgtcgtcgtcgttcggtttttagtacggaatcgacggggcgttttcgagacgggcgagttacgcgttcgtaggttttaaggttaggttgggcgggattgttaagggagttcgaagtcgggggtcgggggtttttcgtttcggcgttttttatgtaaatttttgaaggaagcggtaggcgtagtcgcgggtttcgtagtttaggtttattttttgttattttaggaaaatttcggagcggcggacgcggttcggttcggtttttagtttagagtttaagcgttttagtttcgttttagcgttttttgaaagacgggttatttcgcgcggagtcgcgataaggattttagggttcgtagtgaagttggttaaatttgtttcgtatacgg

SEQ ID NO: 39732 - DNA, 593 bp, Artificial Sequence
  chemically treated genomic DNA (Homo sapiens) CpG-island No: 39732
ccgtatacgaaacaaatttaaccaacttcactacgaaccctaaaatccttatcgcgactccgcgcgaaataacccgtctttcaaaaaacgctaaaacgaaactaaaacgcttaaactctaaactaaaaaccgaaccgaaccgcgtccgccgctccgaaattttcctaaaataacaaaaaataaacctaaactacgaaacccgcgactacgcctaccgcttccttcaaaaatttacataaaaaacgccgaaacgaaaaacccccgacccccgacttcgaactcccttaacaatcccgcccaacctaaccttaaaacctacgaacgcgtaactcgcccgtctcgaaaacgccccgtcgattccgtactaaaaaccgaacgacgacgacgaaactaaaaaccgcgaacgaaaaaaaaaaaaaccgctacgaaatctcccgctactcctccgaaaccgccgcccaaacccgaaaccccgcccgcccgcctaactttaccgaaattcctcgaaatttatcaaccaaatataacaaaattataacgaaacgaataaaaaaaatctaatattaatcaacgcgtaactccgaaccaaactt

SEQ ID NO: 39733 - DNA, 596 bp, Artificial Sequence
  chemically treated genomic DNA (Homo sapiens) CpG-island No: 39733
tcgttcgcggtttttgttatttaggcgatattagaagattttagttcggatttcgagtttcggtttcgtcgttcgtttattttcgttttttttttatatttttaatttcgttgtcgggttgagtttggtttcgttttttttttatagtcgttttttcgtcgtcgtcgtagtagtagtcgtcgtcgttatcgagttttttattttcgtcggagttatatggaatagttaagttagttacggcgttcgcggtagtcgggatttgtagttttttaggcggacggcgttttttacgtttattttttttttgatagatcgtttcgcgatcgttttttattttattaagttttgttagagttatcgtttagcgtttagtattttttttttcgtttttttttttcgttattattattattatttttttcgtcgtattttttatattaattttatttacggtagtttaatttttatcgtttcgtcgttattggttaggtttcgcgcgtgtttcgtttatttcggcggtcgggttttatagcggttggggtattttattggtagaattgtttgtttattataggggtttcgttttgtttttgttt

SEQ ID NO: 39734 - DNA, 596 bp, Artificial Sequence
  chemically treated genomic DNA (Homo sapiens) CpG-island No: 39734
aaacaaaaacaaaacgaaacccctataataaacaaacaattctaccaataaaataccccaaccgctataaaacccgaccgccgaaataaacgaaacacgcgcgaaacctaaccaataacgacgaaacgataaaaattaaactaccgtaaataaaattaatataaaaaatacgacgaaaaaaataataataataataacgaaaaaaaaaaacgaaaaaaaaaatactaaacgctaaacgataactctaacaaaacttaataaaataaaaaacgatcgcgaaacgatctatcaaaaaaaaaataaacgtaaaaaacgccgtccgcctaaaaaactacaaatcccgactaccgcgaacgccgtaactaacttaactattccatataactccgacgaaaataaaaaactcgataacgacgacgactactactacgacgacgacgaaaaaacgactataaaaaaaaaacgaaaccaaactcaacccgacaacgaaattaaaaatataaaaaaaaaacgaaaataaacgaacgacgaaaccgaaactcgaaatccgaactaaaatcttctaatatcgcctaaataacaaaaaccgcgaacga

SEQ ID NO: 39735 - DNA, 596 bp, Artificial Sequence
  chemically treated genomic DNA (Homo sapiens) CpG-island No: 39735
gagtaagggtaaggcggagtttttgtgatgggtaggtagttttattaatgaggtgttttagtcgttgtaagattcggtcgtcgaggtgggcggggtacgcgcggggtttggttaatggcggcggggcggtggaggttgagttgtcgtgggtagggttagtgtgagaggtgcggcgggggaggtaatgatgatggtggcggaggagaaaggcgggggagggggtgttgggcgttgagcggtggttttggtagggtttggtagggtgggggacggtcgcggggcgatttgttagggagggggtgggcgtgaggggcgtcgttcgtttgaggggttgtagatttcggttatcgcgagcgtcgtggttggtttggttgttttatgtggtttcggcggggatggaggattcggtggcggcggcggttgttgttgcggcggcgacggaggagcggttatgagaagggaacggggttagatttagttcgatagcgggattagaggtgtgaggagggggcgggagtggacgagcggcggggtcggggttcggggttcgggttggggttttttggtatcgtttgggtgatagggatcgcggacga

SEQ ID NO: 39736 - DNA, 596 bp, Artificial Sequence
  chemically treated genomic DNA (Homo sapiens) CpG-island No: 39736
tcgtccgcgatccctatcacccaaacgataccaaaaaaccccaacccgaaccccgaaccccgaccccgccgctcgtccactcccgccccctcctcacacctctaatcccgctatcgaactaaatctaaccccgttcccttctcataaccgctcctccgtcgccgccgcaacaacaaccgccgccgccaccgaatcctccatccccgccgaaaccacataaaacaaccaaaccaaccacgacgctcgcgataaccgaaatctacaacccctcaaacgaacgacgcccctcacgcccaccccctccctaacaaatcgccccgcgaccgtcccccaccctaccaaaccctaccaaaaccaccgctcaacgcccaacaccccctcccccgcctttctcctccgccaccatcatcattacctcccccgccgcacctctcacactaaccctacccacgacaactcaacctccaccgccccgccgccattaaccaaaccccgcgcgtaccccgcccacctcgacgaccgaatcttacaacgactaaaacacctcattaataaaactacctacccatcacaaaaactccgccttacccttactc

SEQ ID NO: 39737 - DNA, 893 bp, Artificial Sequence
  chemically treated genomic DNA (Homo sapiens) CpG-island No: 39737
gtcgttcgttttttcgttattatttaagtcgtatgcgcgcgtcggggtcgacgggcgttaggttttatcgagttattttcgtcgtggcggtttttcgtgtttttgcggagggaaggtcgtcggtttcgttagggggcgcgcgtcggggtcgcggttttttgaattcggttttacgaggggacgcgttatcggtttcgtggtttgcgtggcgtcgtagtaacgagttggtcgtttcggggcgttgtttagttcgggtttcgttgcgagtttgtgggcgaggcgggaggtgtttttttggttaggcgggtggaggaaggtgtgggcgtcgtattttagcgtcgcggagtttttaggcgcgggtaggcgagattggcgtgtagcgcgacggtttagtttcggcgttttatcgttttttattttcgtaggcgtcgagtcgatttagtcgcgcggttgtagtgatatttagcggtcgtcgcgggaagtgcggtcgtcgcggttaggttttcggggtttttgtttttcgaggtttttatttcggttacgcgcgggtatttcggaggagagcggtcgcgcgttgtagatgttcgcgggggtattttttttgtttttttttcgtttttttttcgtaggcgttcgagcgtcgggagattttgcgtagcggtagtgttcggaagggcggggcggggtgtagtagcggcgttgggttgtgattcgggtagttttatttttggattttgttcgggttgtgataggatagcgcgggggtagcgggggaatacgcgggtacgtcgagattcggcgttcgggatttcgatgaggggaggttttttatttttggggtgttacgcgatttacgtttttttttatgtttatttttattttttatgggtttt

SEQ ID NO: 39738 - DNA, 893 bp, Artificial Sequence
  chemically treated genomic DNA (Homo sapiens) CpG-island No: 39738
aaaacccataaaaaataaaaataaacataaaaaaaaacgtaaatcgcgtaacaccccaaaaataaaaaacctcccctcatcgaaatcccgaacgccgaatctcgacgtacccgcgtattcccccgctacccccgcgctatcctatcacaacccgaacaaaatccaaaaataaaactacccgaatcacaacccaacgccgctactacaccccgccccgcccttccgaacactaccgctacgcaaaatctcccgacgctcgaacgcctacgaaaaaaaaacgaaaaaaaaacaaaaaaaatacccccgcgaacatctacaacgcgcgaccgctctcctccgaaatacccgcgcgtaaccgaaataaaaacctcgaaaaacaaaaaccccgaaaacctaaccgcgacgaccgcacttcccgcgacgaccgctaaatatcactacaaccgcgcgactaaatcgactcgacgcctacgaaaataaaaaacgataaaacgccgaaactaaaccgtcgcgctacacgccaatctcgcctacccgcgcctaaaaactccgcgacgctaaaatacgacgcccacaccttcctccacccgcctaaccaaaaaaacacctcccgcctcgcccacaaactcgcaacgaaacccgaactaaacaacgccccgaaacgaccaactcgttactacgacgccacgcaaaccacgaaaccgataacgcgtcccctcgtaaaaccgaattcaaaaaaccgcgaccccgacgcgcgccccctaacgaaaccgacgaccttccctccgcaaaaacacgaaaaaccgccacgacgaaaataactcgataaaacctaacgcccgtcgaccccgacgcgcgcatacgacttaaataataacgaaaaaacgaacgac

SEQ ID NO: 39739 - DNA, 893 bp, Artificial Sequence
  chemically treated genomic DNA (Homo sapiens) CpG-island No: 39739
ggaatttatggggggtgggagtggatatggaggaaagcgtgggtcgcgtgatattttaggagtgaaaggtttttttttatcggggtttcgagcgtcggatttcggcgtgttcgcgtgttttttcgttgttttcgcgttgttttattatagttcgagtaggatttagaagtgaaattgttcgggttatagtttagcgtcgttgttgtatttcgtttcgttttttcgggtattgtcgttgcgtaggatttttcggcgttcgggcgtttgcggggaggaaacgggggaggggtaggggaagtgttttcgcgggtatttgtagcgcgcggtcgttttttttcggggtgttcgcgcgtaatcggggtgggaatttcgagagataggagtttcggaggtttggtcgcggcgatcgtatttttcgcgacggtcgttgggtgttattgtagtcgcgcggttgaatcggttcggcgtttgcgggagtgggggacggtgggacgtcgggattaggtcgtcgcgttgtacgttagtttcgtttgttcgcgtttggaggtttcgcgacgttgggatgcggcgtttatatttttttttattcgtttggttaaggaagtatttttcgtttcgtttatagattcgtagcgaggttcggattaagtaacgtttcggggcgattagttcgttgttgcggcgttacgtaagttacgaaatcgatggcgcgttttttcgtggggtcgagtttaaagagtcgcgatttcgacgcgcgttttttggcgaagtcggcggtttttttttcgtagaggtacgaggggtcgttacgacgagggtggttcggtggagtttggcgttcgtcggtttcggcgcgcgtatgcgatttgggtggtggcggaagggcgggcggt

SEQ ID NO: 39740 - DNA, 893 bp, Artificial Sequence
  chemically treated genomic DNA (Homo sapiens) CpG-island No: 39740
accgcccgcccttccgccaccacccaaatcgcatacgcgcgccgaaaccgacgaacgccaaactccaccgaaccaccctcgtcgtaacgacccctcgtacctctacgaaaaaaaaaccgccgacttcgccaaaaaacgcgcgtcgaaatcgcgactctttaaactcgaccccacgaaaaaacgcgccatcgatttcgtaacttacgtaacgccgcaacaacgaactaatcgccccgaaacgttacttaatccgaacctcgctacgaatctataaacgaaacgaaaaatacttccttaaccaaacgaataaaaaaaaatataaacgccgcatcccaacgtcgcgaaacctccaaacgcgaacaaacgaaactaacgtacaacgcgacgacctaatcccgacgtcccaccgtcccccactcccgcaaacgccgaaccgattcaaccgcgcgactacaataacacccaacgaccgtcgcgaaaaatacgatcgccgcgaccaaacctccgaaactcctatctctcgaaattcccaccccgattacgcgcgaacaccccgaaaaaaaacgaccgcgcgctacaaatacccgcgaaaacacttcccctacccctcccccgtttcctccccgcaaacgcccgaacgccgaaaaatcctacgcaacgacaatacccgaaaaaacgaaacgaaatacaacaacgacgctaaactataacccgaacaatttcacttctaaatcctactcgaactataataaaacaacgcgaaaacaacgaaaaaacacgcgaacacgccgaaatccgacgctcgaaaccccgataaaaaaaaacctttcactcctaaaatatcacgcgacccacgctttcctccatatccactcccaccccccataaattcc

SEQ ID NO: 39741 - DNA, 607 bp, Artificial Sequence
  chemically treated genomic DNA (Homo sapiens) CpG-island No: 39741
ttatacgcggtttcgcgtttcgttttgatcgaggtagagttcggttttttttgcgtttttatttttaggttagttcggtcggggtagcgttttgggagggcgaagaagtttcgcggggtgtgtcgggtacgttgtcggggtggggtacgggttttttattatttttatttggcgggggtcgagttggttagggggcgcgggtatcgagaattggatttttttgcggtttttggggtttatggcgcgcggggtgggcggtggggttggggtgcgcgattcggggtttcggcggcggtttgtgttgggttttttcgcgtaggcggcgggttgtgcggcgagaggaggaggagggttgttcgcgtacggataaaaatatcgtgttcgtcgaggggagggcgcgggagcgggaggagggtcggcgttcgggttgggcgcgtttttaggttttcgggattcggggttcgtttttcgcgttcgttgagttaggtttgtgtttcgttttttcgcgtttttcggtttgggtgtttttgcgtttcggtgtttttttttttttgagtgtttttgcgtttcggtgtttttttttttttgagtgtttttgcgtgttttt

SEQ ID NO: 39742 - DNA, 607 bp, Artificial Sequence
  chemically treated genomic DNA (Homo sapiens) CpG-island No: 39742
aaaaacacgcaaaaacactcaaaaaaaaaaaaacaccgaaacgcaaaaacactcaaaaaaaaaaaaacaccgaaacgcaaaaacacccaaaccgaaaaacgcgaaaaaacgaaacacaaacctaactcaacgaacgcgaaaaacgaaccccgaatcccgaaaacctaaaaacgcgcccaacccgaacgccgaccctcctcccgctcccgcgccctcccctcgacgaacacgatatttttatccgtacgcgaacaaccctcctcctcctctcgccgcacaacccgccgcctacgcgaaaaaacccaacacaaaccgccgccgaaaccccgaatcgcgcaccccaaccccaccgcccaccccgcgcgccataaaccccaaaaaccgcaaaaaaatccaattctcgatacccgcgccccctaaccaactcgacccccgccaaataaaaataataaaaaacccgtaccccaccccgacaacgtacccgacacaccccgcgaaacttcttcgccctcccaaaacgctaccccgaccgaactaacctaaaaataaaaacgcaaaaaaaaccgaactctacctcgatcaaaacgaaacgcgaaaccgcgtataa

SEQ ID NO: 39743 - DNA, 607 bp, Artificial Sequence
  chemically treated genomic DNA (Homo sapiens) CpG-island No: 39743
ggagatacgtagagatatttaggaggggagagatatcgagacgtagagatatttaggaggggagagatatcgagacgtagagatatttaggtcggggagcgcgagggagcgaggtatagatttggtttagcgagcgcggggggcgagtttcgagtttcgagagtttgggggcgcgtttagttcgggcgtcgatttttttttcgttttcgcgtttttttttcggcgggtacggtatttttattcgtgcgcgaatagtttttttttttttttcgtcgtatagttcgtcgtttgcgcgggggagtttagtatagatcgtcgtcgggatttcgagtcgcgtattttagttttatcgtttatttcgcgcgttatggattttaaggatcgtaagaagatttagttttcggtgttcgcgttttttagttagttcgattttcgttaggtggagatggtaaggggttcgtgttttatttcggtagcgtattcgatatatttcgcggggttttttcgtttttttaaggcgttgtttcggtcggattggtttgggggtgggggcgtaaggagagtcgggttttgtttcggttaggacggggcgcggggtcgcgtgtga

SEQ ID NO: 39744 - DNA, 607 bp, Artificial Sequence
  chemically treated genomic DNA (Homo sapiens) CpG-island No: 39744
tcacacgcgaccccgcgccccgtcctaaccgaaacaaaacccgactctccttacgcccccacccccaaaccaatccgaccgaaacaacgccttaaaaaaacgaaaaaaccccgcgaaatatatcgaatacgctaccgaaataaaacacgaaccccttaccatctccacctaacgaaaatcgaactaactaaaaaacgcgaacaccgaaaactaaatcttcttacgatccttaaaatccataacgcgcgaaataaacgataaaactaaaatacgcgactcgaaatcccgacgacgatctatactaaactcccccgcgcaaacgacgaactatacgacgaaaaaaaaaaaaaaactattcgcgcacgaataaaaataccgtacccgccgaaaaaaaaacgcgaaaacgaaaaaaaaatcgacgcccgaactaaacgcgcccccaaactctcgaaactcgaaactcgccccccgcgctcgctaaaccaaatctatacctcgctccctcgcgctccccgacctaaatatctctacgtctcgatatctctcccctcctaaatatctctacgtctcgatatctctcccctcctaaatatctctacgtatctcc

SEQ ID NO: 39745 - DNA, 683 bp, Artificial Sequence
  chemically treated genomic DNA (Homo sapiens) CpG-island No: 39745
aaggcgtcgacggtgtcggtcgtttttacggttcgggcggttcgttcgttatgtatttttattcgtattcgtgttcgcgtttggcgggcgtatagtgttaggcggtcggcggtttgggcggcggcgcggcgtacgttttgcggatttacggtttttgcgtcgtttacgagacgttgtatgcggcggtaggcggtggcggcgcgagttcggattataatagtttcgagtacgagggttcgtttagtttttcgttttgttttaatggtaattttttatttaagtaggatttttcgttcgattacgagaaaagttattattattttatgtattattcggcgttgttcggttcgcggtttacgggttacgggttagttttcggttcgtcggttgtgcgcgggggcgtttattcggagaattttttgttttacgatatgtatttttattacgatcggggttttatgtacgaggagtttaatgcgtttttttataattgagatttcgcgtcggttttttttttttttttttgtttttgttcgtttttttgtttttagtttttagagcgtagggatatttttattttatttcggcgtcgggcgcggggagcgggttatcggttttgtcgtttttttggggtagcgtagttttgttatttgtgggtggtttgttttaggggtttcgttttt

SEQ ID NO: 39746 - DNA, 683 bp, Artificial Sequence
  chemically treated genomic DNA (Homo sapiens) CpG-island No: 39746
aaaaacgaaacccctaaaacaaaccacccacaaataacaaaactacgctaccccaaaaaaacgacaaaaccgataacccgctccccgcgcccgacgccgaaataaaataaaaatatccctacgctctaaaaactaaaaacaaaaaaacgaacaaaaacaaaaaaaaaaaaaaaaaaccgacgcgaaatctcaattataaaaaaacgcattaaactcctcgtacataaaaccccgatcgtaataaaaatacatatcgtaaaacaaaaaattctccgaataaacgcccccgcgcacaaccgacgaaccgaaaactaacccgtaacccgtaaaccgcgaaccgaacaacgccgaataatacataaaataataataacttttctcgtaatcgaacgaaaaatcctacttaaataaaaaattaccattaaaacaaaacgaaaaactaaacgaaccctcgtactcgaaactattataatccgaactcgcgccgccaccgcctaccgccgcatacaacgtctcgtaaacgacgcaaaaaccgtaaatccgcaaaacgtacgccgcgccgccgcccaaaccgccgaccgcctaacactatacgcccgccaaacgcgaacacgaatacgaataaaaatacataacgaacgaaccgcccgaaccgtaaaaacgaccgacaccgtcgacgcctt

SEQ ID NO: 39747 - DNA, 683 bp, Artificial Sequence
  chemically treated genomic DNA (Homo sapiens) CpG-island No: 39747
ggaagcgaggtttttgggataggttatttataggtaataggattgcgttgttttaggagagcggtaggatcggtggttcgtttttcgcgttcggcgtcggggtaggatgggggtgtttttgcgttttgggggttggggataggggggcgggtaaaggtaaaagaaaaagaagggagtcggcgcgaagttttagttatgaaaaaacgtattgagtttttcgtatatggggtttcggtcgtggtgaaggtgtatatcgtaagataagagatttttcgagtggacgttttcgcgtatagtcgacgagtcgaagattagttcgtggttcgtgggtcgcgaatcgggtagcgtcgagtagtgtatagagtagtggtagtttttttcgtggtcgggcgaggagttttgtttgagtgagaagttgttattgagatagagcggggggttgagcgggttttcgtattcggagttgttgtagttcgggttcgcgtcgttatcgtttgtcgtcgtatatagcgtttcgtaagcggcgtaggggtcgtgggttcgtagggcgtgcgtcgcgtcgtcgtttaggtcgtcggtcgtttggtattgtgcgttcgttaggcgcgagtacgggtacgggtaggggtgtatggcgaacgggtcgttcgagtcgtggaagcggtcggtatcgtcggcgtttt

SEQ ID NO: 39748 - DNA, 683 bp, Artificial Sequence
  chemically treated genomic DNA (Homo sapiens) CpG-island No: 39748
aaaacgccgacgataccgaccgcttccacgactcgaacgacccgttcgccatacacccctacccgtacccgtactcgcgcctaacgaacgcacaataccaaacgaccgacgacctaaacgacgacgcgacgcacgccctacgaacccacgacccctacgccgcttacgaaacgctatatacgacgacaaacgataacgacgcgaacccgaactacaacaactccgaatacgaaaacccgctcaaccccccgctctatctcaataacaacttctcactcaaacaaaactcctcgcccgaccacgaaaaaaactaccactactctatacactactcgacgctacccgattcgcgacccacgaaccacgaactaatcttcgactcgtcgactatacgcgaaaacgtccactcgaaaaatctcttatcttacgatatacaccttcaccacgaccgaaaccccatatacgaaaaactcaatacgttttttcataactaaaacttcgcgccgactcccttctttttcttttacctttacccgcccccctatccccaacccccaaaacgcaaaaacacccccatcctaccccgacgccgaacgcgaaaaacgaaccaccgatcctaccgctctcctaaaacaacgcaatcctattacctataaataacctatcccaaaaacctcgcttcc

SEQ ID NO: 39749 - DNA, 695 bp, Artificial Sequence
  chemically treated genomic DNA (Homo sapiens) CpG-island No: 39749
tcggcgggggtgagggggtttaaagattgtgggggtgaggaattgagggtggggggcgtttagaggcgggattcggggcggggtaggcgaggcggagggcgagggttgcgggagtaagtacggagtcgggggtgtgggggacgattgtcgttgtagtcgtcgttttatttattttcggtgtgtttgtagttcggatattaagggagatggatgaatgggtggggaggatgcggcgtatatggtttcgggcggttcggcggttagttgtcgtttttttagcggatcggtcggggcgggggtcgggcggtagaaaaaagggtcgcgaggcgagcggggtattgggcggatcgcggcggtagtatgagcggcgtagatcgtagttttaatgcgggcgtagtttttgattcggtttcgggttaggcggcggtggtttcggtttattagcgtttcgagtcgcgcgtttattttcgtaataattacgcgttttttcgcggggatttgtgtaattcgaacggcgtcgggtcgtggaagttgcgttgtttggcgtagattttcgttatcggtgagcgggggaaattgaggtacgagggataagaggtcgtcggggagtgaaagtaggcgtagggaaataaaaagaaggaaagggagatagattaggcgtttaatagatggggattaagaaataagagatagtt

SEQ ID NO: 39750 - DNA, 695 bp, Artificial Sequence
  chemically treated genomic DNA (Homo sapiens) CpG-island No: 39750
aactatctcttatttcttaatccccatctattaaacgcctaatctatctccctttccttctttttatttccctacgcctactttcactccccgacgacctcttatccctcgtacctcaatttcccccgctcaccgataacgaaaatctacgccaaacaacgcaacttccacgacccgacgccgttcgaattacacaaatccccgcgaaaaaacgcgtaattattacgaaaataaacgcgcgactcgaaacgctaataaaccgaaaccaccgccgcctaacccgaaaccgaatcaaaaactacgcccgcattaaaactacgatctacgccgctcatactaccgccgcgatccgcccaataccccgctcgcctcgcgacccttttttctaccgcccgacccccgccccgaccgatccgctaaaaaaacgacaactaaccgccgaaccgcccgaaaccatatacgccgcatcctccccacccattcatccatctcccttaatatccgaactacaaacacaccgaaaataaataaaacgacgactacaacgacaatcgtcccccacacccccgactccgtacttactcccgcaaccctcgccctccgcctcgcctaccccgccccgaatcccgcctctaaacgccccccaccctcaattcctcacccccacaatctttaaaccccctcacccccgccga

SEQ ID NO: 39751 - DNA, 695 bp, Artificial Sequence
  chemically treated genomic DNA (Homo sapiens) CpG-island No: 39751
agttattttttgttttttggtttttatttgttaggcgtttggtttgtttttttttttttttttttatttttttgcgtttgtttttatttttcgacgattttttgtttttcgtgttttagtttttttcgtttatcggtggcgaaggtttgcgttaagtagcgtagtttttacggttcgacgtcgttcgggttgtataggttttcgcgagggggcgcgtagttgttgcggaggtaggcgcgcggttcgaagcgttggtaggtcgaagttatcgtcgtttggttcggggtcgagttaggggttgcgttcgtattggggttacggtttgcgtcgtttatgttgtcgtcgcggttcgtttagtgtttcgttcgtttcgcggtttttttttttatcgttcgattttcgtttcgatcggttcgttgggggggcggtagttgatcgtcgagtcgttcggggttatgtgcgtcgtattttttttatttatttatttattttttttagtgttcgggttgtagatatatcggaggtgagtggggcggcggttgtagcggtaatcgttttttatattttcggtttcgtatttgttttcgtagttttcgtttttcgtttcgtttgtttcgtttcgagtttcgtttttgggcgttttttatttttagttttttatttttataatttttagatttttttattttcgtcgg

SEQ ID NO: 39752 - DNA, 695 bp, Artificial Sequence
  chemically treated genomic DNA (Homo sapiens) CpG-island No: 39752
ccgacgaaaataaaaaaatctaaaaattataaaaataaaaaactaaaaataaaaaacgcccaaaaacgaaactcgaaacgaaacaaacgaaacgaaaaacgaaaactacgaaaacaaatacgaaaccgaaaatataaaaaacgattaccgctacaaccgccgccccactcacctccgatatatctacaacccgaacactaaaaaaaataaataaataaataaaaaaaatacgacgcacataaccccgaacgactcgacgatcaactaccgcccccccaacgaaccgatcgaaacgaaaatcgaacgataaaaaaaaaaaccgcgaaacgaacgaaacactaaacgaaccgcgacgacaacataaacgacgcaaaccgtaaccccaatacgaacgcaacccctaactcgaccccgaaccaaacgacgataacttcgacctaccaacgcttcgaaccgcgcgcctacctccgcaacaactacgcgccccctcgcgaaaacctatacaacccgaacgacgtcgaaccgtaaaaactacgctacttaacgcaaaccttcgccaccgataaacgaaaaaaactaaaacacgaaaaacaaaaaatcgtcgaaaaataaaaacaaacgcaaaaaaataaaaaaaaaaaaaaaaaaacaaaccaaacgcctaacaaataaaaaccaaaaaacaaaaaataact

SEQ ID NO: 39753 - DNA, 534 bp, Artificial Sequence
  chemically treated genomic DNA (Homo sapiens) CpG-island No: 39753
gacgttttcgtaaagtatttttagtcggggaataaagtacggaaagttgttgggtagagcggtcgggaggagatatcgggagtcgggtgggcggtggggtggtcggtgggttgtttcgggttcgggagttcgttcgtagcgcgttttgttagtaaggggagagggacggtgggaagcggtcgtttttcgggtttgggtcggggatggggatggttaagttattcgagttttcgtttttcgtcggtaggtattattcgggggtcgtgtaattcgggcgtttattgataggtattttacgttcgcgaggggttgtttcggttttaattgcggcgttgcgttttttttttaggacgtaggttaatgttcgttcgttcgtttttagtcgggcgtagagttgttagatttcgggcgttttagcgttcgttttggggttaacgggcgggagggggcggttaagttcgtaggcggttttttcggttttggtttagtttttttcggttggtttttggagacgttgtgttcggtagagaagta

SEQ ID NO: 39754 - DNA, 534 bp, Artificial Sequence
  chemically treated genomic DNA (Homo sapiens) CpG-island No: 39754
tacttctctaccgaacacaacgtctccaaaaaccaaccgaaaaaaactaaaccaaaaccgaaaaaaccgcctacgaacttaaccgccccctcccgcccgttaaccccaaaacgaacgctaaaacgcccgaaatctaacaactctacgcccgactaaaaacgaacgaacgaacattaacctacgtcctaaaaaaaaaacgcaacgccgcaattaaaaccgaaacaacccctcgcgaacgtaaaatacctatcaataaacgcccgaattacacgacccccgaataatacctaccgacgaaaaacgaaaactcgaataacttaaccatccccatccccgacccaaacccgaaaaacgaccgcttcccaccgtccctctccccttactaacaaaacgcgctacgaacgaactcccgaacccgaaacaacccaccgaccaccccaccgcccacccgactcccgatatctcctcccgaccgctctacccaacaactttccgtactttattccccgactaaaaatactttacgaaaacgtc

SEQ ID NO: 39755 - DNA, 534 bp, Artificial Sequence
  chemically treated genomic DNA (Homo sapiens) CpG-island No: 39755
tgtttttttgtcgggtatagcgtttttaggagttagtcggggagagttgagttaaggtcgaaggagtcgtttgcgggtttagtcgttttttttcgttcgttggttttagagcggacgttgggacgttcggggtttggtagttttgcgttcggttaggagcgggcgggcgagtattagtttgcgttttggagaaggggcgtagcgtcgtagttgaggtcggagtagtttttcgcgggcgtaggatatttgttagtgagcgttcggattgtacggttttcgggtagtgtttgtcggcgaggggcgggagttcgggtgatttggttatttttattttcggtttaggttcggagggcggtcgttttttatcgtttttttttttttattggtagagcgcgttgcgggcggattttcgggttcggagtagtttatcggttattttatcgtttattcggttttcggtgttttttttcggtcgttttatttagtaatttttcgtgttttgtttttcgattggaaatgttttacggaagcgtt

SEQ ID NO: 39756 - DNA, 534 bp, Artificial Sequence
  chemically treated genomic DNA (Homo sapiens) CpG-island No: 39756
aacgcttccgtaaaacatttccaatcgaaaaacaaaacacgaaaaattactaaataaaacgaccgaaaaaaaacaccgaaaaccgaataaacgataaaataaccgataaactactccgaacccgaaaatccgcccgcaacgcgctctaccaataaaaaaaaaaaaacgataaaaaacgaccgccctccgaacctaaaccgaaaataaaaataaccaaatcacccgaactcccgcccctcgccgacaaacactacccgaaaaccgtacaatccgaacgctcactaacaaatatcctacgcccgcgaaaaactactccgacctcaactacgacgctacgccccttctccaaaacgcaaactaatactcgcccgcccgctcctaaccgaacgcaaaactaccaaaccccgaacgtcccaacgtccgctctaaaaccaacgaacgaaaaaaaacgactaaacccgcaaacgactccttcgaccttaactcaactctccccgactaactcctaaaaacgctatacccgacaaaaaaaca

SEQ ID NO: 39757 - DNA, 773 bp, Artificial Sequence
  chemically treated genomic DNA (Homo sapiens) CpG-island No: 39757
gttcgcgtagatttcgcgtcgcgtatcgcggtcggcggggggcgttcgggtcgtatcgagagtagcgcgggtagttagcgtcgggtcgtagtcgattcgtagagtttttcgcgtttttcgaggaaataaagtgtatttttgttcgcggttcgaggcgtcgcgtgggagacgttgggtaggggttaggtcgggtcggtcgtcgtcgcgtgcggggattttgggcgcgcgttattgattcgggatttagattttcgcgggtttggcgcggatcggaggaagcgggttgtggcgcgcggtcgagttggtagtttttttatttcgagtacggttcgggattcgtattggtttttgtcgggtcgcggcgttttacgcgtcgttatcggggttcgtgtatttcgtttttcgggttggcgacggggcgggaagggggtaagcgggagtttgcgggggggtgttggggatttcggtttggttgggtcgtttttgagtcgtttgtcggtcgggcggtgttcgttttcgttttcggtgtcgtttcggggcgggttttcgtttcgatagtcgcgcgttagtttagtttagtttcggcgtcgcgcggtcgggaggattttagtttttagtaggtttcgcgtcgcgagtatcgaggtaggaggcgcgtttgggtcggcgtttgcgtagtgcggtcgttcgagtttgttagtattatattttcgggagggattgaggggaggtagaagtattcgaggtattaaagtattcgagggagtcggagggga

SEQ ID NO: 39758 - DNA, 773 bp, Artificial Sequence
  chemically treated genomic DNA (Homo sapiens) CpG-island No: 39758
tcccctccgactccctcgaatactttaatacctcgaatacttctacctcccctcaatccctcccgaaaatataatactaacaaactcgaacgaccgcactacgcaaacgccgacccaaacgcgcctcctacctcgatactcgcgacgcgaaacctactaaaaactaaaatcctcccgaccgcgcgacgccgaaactaaactaaactaacgcgcgactatcgaaacgaaaacccgccccgaaacgacaccgaaaacgaaaacgaacaccgcccgaccgacaaacgactcaaaaacgacccaaccaaaccgaaatccccaacacccccccgcaaactcccgcttacccccttcccgccccgtcgccaacccgaaaaacgaaatacacgaaccccgataacgacgcgtaaaacgccgcgacccgacaaaaaccaatacgaatcccgaaccgtactcgaaataaaaaaactaccaactcgaccgcgcgccacaacccgcttcctccgatccgcgccaaacccgcgaaaatctaaatcccgaatcaataacgcgcgcccaaaatccccgcacgcgacgacgaccgacccgacctaacccctacccaacgtctcccacgcgacgcctcgaaccgcgaacaaaaatacactttatttcctcgaaaaacgcgaaaaactctacgaatcgactacgacccgacgctaactacccgcgctactctcgatacgacccgaacgccccccgccgaccgcgatacgcgacgcgaaatctacgcgaac

SEQ ID NO: 39759 - DNA, 773 bp, Artificial Sequence
  chemically treated genomic DNA (Homo sapiens) CpG-island No: 39759
tttttttcggttttttcggatgttttaatgtttcggatgtttttgtttttttttagtttttttcgggggtgtggtattagtaggttcgggcggtcgtattgcgtaagcgtcggtttaggcgcgttttttgtttcggtgttcgcggcgcggggtttgttgggagttggagttttttcggtcgcgcggcgtcggggttgagttgggttggcgcgcggttgtcggagcgaggattcgtttcgggacggtatcgaaagcgaaggcgggtatcgttcggtcgataggcgatttaaaggcggtttagttaagtcgaagtttttagtattttttcgtaggttttcgtttgtttttttttcgtttcgtcgttagttcggaaagcggagtgtacgggtttcggtgacggcgcgtgaagcgtcgcggttcggtaggagttagtgcgggtttcgagtcgtgttcggagtgggagggttgttagttcggtcgcgcgttatagttcgtttttttcggttcgcgttaggttcgcgagggtttgagtttcgggttagtgacgcgcgtttagggttttcgtacgcggcggcggtcggttcggtttggtttttgtttagcgttttttacgcggcgtttcgggtcgcggataaagatgtattttgttttttcggagggcgcgaagggttttgcgggtcggttgcgattcggcgttggttgttcgcgttgttttcggtgcgattcgagcgtttttcgtcggtcgcggtgcgcggcgcggggtttacgcggat

SEQ ID NO: 39760 - DNA, 773 bp, Artificial Sequence
  chemically treated genomic DNA (Homo sapiens) CpG-island No: 39760
atccgcgtaaaccccgcgccgcgcaccgcgaccgacgaaaaacgctcgaatcgcaccgaaaacaacgcgaacaaccaacgccgaatcgcaaccgacccgcaaaacccttcgcgccctccgaaaaaacaaaatacatctttatccgcgacccgaaacgccgcgtaaaaaacgctaaacaaaaaccaaaccgaaccgaccgccgccgcgtacgaaaaccctaaacgcgcgtcactaacccgaaactcaaaccctcgcgaacctaacgcgaaccgaaaaaaacgaactataacgcgcgaccgaactaacaaccctcccactccgaacacgactcgaaacccgcactaactcctaccgaaccgcgacgcttcacgcgccgtcaccgaaacccgtacactccgctttccgaactaacgacgaaacgaaaaaaaaacaaacgaaaacctacgaaaaaatactaaaaacttcgacttaactaaaccgcctttaaatcgcctatcgaccgaacgatacccgccttcgctttcgataccgtcccgaaacgaatcctcgctccgacaaccgcgcgccaacccaactcaaccccgacgccgcgcgaccgaaaaaactccaactcccaacaaaccccgcgccgcgaacaccgaaacaaaaaacgcgcctaaaccgacgcttacgcaatacgaccgcccgaacctactaataccacacccccgaaaaaaactaaaaaaaaacaaaaacatccgaaacattaaaacatccgaaaaaaccgaaaaaaa

SEQ ID NO: 39761 - DNA, 556 bp, Artificial Sequence
  chemically treated genomic DNA (Homo sapiens) CpG-island No: 39761
gaagtcggtgtcgcgtcgtcgaacgtataacgcggcgtcgtaggttcgtagttttttttcgtcggcgttattgcgttttttcgcgtcgcgtaaggttagtaagtagttgcggtcgcgggggagatacggcgagcgcgttcggcggggagatattgtcgtttttcgttcggtcggggaagagtagtcgcgtagaagttcgtcgcgagagggcgggtgggcggtcgggtggggaggggtttcgaggcgtcggtaatggttgttacgtcgtttaggtggatcgtcgtttatcgtttttttttaagttcgtcggttgttcgttacgatttttgtttcgttttcgagtttcgtttcggcgcggcggttcgggggatttgagttcgcgggcgtttttatttttttcgttttcgttttttcgttggagagtaagttttgttcggtcggttcggttgttttcggtcgtttattttttaagtttcgttcgagagcgggtcgtggtttttattttttttattagggggtttttggaggagtaagttttttttcgagtgtcgggttt

SEQ ID NO: 39762 - DNA, 556 bp, Artificial Sequence
  chemically treated genomic DNA (Homo sapiens) CpG-island No: 39762
aaacccgacactcgaaaaaaaacttactcctccaaaaaccccctaataaaaaaaataaaaaccacgacccgctctcgaacgaaacttaaaaaataaacgaccgaaaacaaccgaaccgaccgaacaaaacttactctccaacgaaaaaacgaaaacgaaaaaaataaaaacgcccgcgaactcaaatcccccgaaccgccgcgccgaaacgaaactcgaaaacgaaacaaaaatcgtaacgaacaaccgacgaacttaaaaaaaaacgataaacgacgatccacctaaacgacgtaacaaccattaccgacgcctcgaaacccctccccacccgaccgcccacccgccctctcgcgacgaacttctacgcgactactcttccccgaccgaacgaaaaacgacaatatctccccgccgaacgcgctcgccgtatctcccccgcgaccgcaactacttactaaccttacgcgacgcgaaaaaacgcaataacgccgacgaaaaaaaactacgaacctacgacgccgcgttatacgttcgacgacgcgacaccgacttc

SEQ ID NO: 39763 - DNA, 556 bp, Artificial Sequence
  chemically treated genomic DNA (Homo sapiens) CpG-island No: 39763
gaattcgatattcgaagaagggtttgtttttttagggattttttgataagaaaagtggggattacggttcgttttcgggcgagatttggggggtgggcgatcggaagtagtcgaatcggtcgggtagggtttgttttttaacgggagagcgggagcgggagaggtgggagcgttcgcgggtttaagtttttcgggtcgtcgcgtcgaggcggagttcggggacgaagtagaggtcgtggcggatagtcggcgggtttgggggggggcggtgggcggcgatttatttgggcgacgtggtagttattgtcggcgtttcgagatttttttttattcggtcgtttattcgttttttcgcggcgggtttttgcgcggttgttttttttcggtcggacggagagcggtagtgttttttcgtcgggcgcgttcgtcgtgtttttttcgcggtcgtagttgtttgttagttttgcgcggcgcgggagagcgtagtggcgtcggcgggaaagggttgcggatttgcggcgtcgcgttgtgcgttcgacgacgcggtatcggtttt

SEQ ID NO: 39764 - DNA, 556 bp, Artificial Sequence
  chemically treated genomic DNA (Homo sapiens) CpG-island No: 39764
aaaaccgataccgcgtcgtcgaacgcacaacgcgacgccgcaaatccgcaaccctttcccgccgacgccactacgctctcccgcgccgcgcaaaactaacaaacaactacgaccgcgaaaaaaacacgacgaacgcgcccgacgaaaaaacactaccgctctccgtccgaccgaaaaaaaacaaccgcgcaaaaacccgccgcgaaaaaacgaataaacgaccgaataaaaaaaaatctcgaaacgccgacaataactaccacgtcgcccaaataaatcgccgcccaccgcccccccccaaacccgccgactatccgccacgacctctacttcgtccccgaactccgcctcgacgcgacgacccgaaaaacttaaacccgcgaacgctcccacctctcccgctcccgctctcccgttaaaaaacaaaccctacccgaccgattcgactacttccgatcgcccaccccccaaatctcgcccgaaaacgaaccgtaatccccacttttcttatcaaaaaatccctaaaaaaacaaacccttcttcgaatatcgaattc

SEQ ID NO: 39765 - DNA, 540 bp, Artificial Sequence
  chemically treated genomic DNA (Homo sapiens) CpG-island No: 39765
tgttaaaataagcggcgcggtaaattatagttgtttttagttttcggtattttttcgagttttaaaaaataaaataaatataaggtcggtttcgcggggtgaggggagaaaggaaagtagagttgggacgagttttgacgcgcgcggggtttaggttgtaagttgggagggacggcgaggcgagcgatcggtttcggtattgtttgattagggtcgtggtcgttgcggcgggtacgggaattcgttttttcgcgcgcggttttttcgcggggggttttcgggcgcgcggtttcggagttttacgggaagataaaggggtaggcgattgttacggggtggagggaggtcgtttagttttatcggttttgttagcgtgcggtttgagttcggggaatgtgtgcgttttagtcggtggaatcgtagtcgttggtttttgtttttagttcgagtttgagttttcggatgttaagaaaaagtaaagacgtgttttttttttttgcgatcgttgtagtatgagttcgtttttaagtttgtattatt

SEQ ID NO: 39766 - DNA, 540 bp, Artificial Sequence
  chemically treated genomic DNA (Homo sapiens) CpG-island No: 39766
aataatacaaacttaaaaacgaactcatactacaacgatcgcaaaaaaaaaaaacacgtctttactttttcttaacatccgaaaactcaaactcgaactaaaaacaaaaaccaacgactacgattccaccgactaaaacgcacacattccccgaactcaaaccgcacgctaacaaaaccgataaaactaaacgacctccctccaccccgtaacaatcgcctacccctttatcttcccgtaaaactccgaaaccgcgcgcccgaaaaccccccgcgaaaaaaccgcgcgcgaaaaaacgaattcccgtacccgccgcaacgaccacgaccctaatcaaacaataccgaaaccgatcgctcgcctcgccgtccctcccaacttacaacctaaaccccgcgcgcgtcaaaactcgtcccaactctactttcctttctcccctcaccccgcgaaaccgaccttatatttattttattttttaaaactcgaaaaaataccgaaaactaaaaacaactataatttaccgcgccgcttattttaaca

SEQ ID NO: 39767 - DNA, 540 bp, Artificial Sequence
  chemically treated genomic DNA (Homo sapiens) CpG-island No: 39767
aatggtgtaggtttggggacggatttatattatagcggtcgtaagagggaagagtacgtttttgtttttttttggtattcgaaaatttaagttcgaattgggggtaaaggttagcggttgcggttttatcggttaaggcgtatatatttttcgagtttagatcgtacgttggtagggtcgatggggttgggcggtttttttttatttcgtggtagtcgtttatttttttgttttttcgtggggtttcgaggtcgcgcgttcggaagtttttcgcgggagggtcgcgcgcgagaaggcgggttttcgtgttcgtcgtagcggttacggttttagttaggtaatgtcgaggtcggtcgttcgtttcgtcgttttttttaatttgtagtttggatttcgcgcgcgttagggttcgttttagttttgtttttttttttttttttatttcgcgaggtcgattttgtgtttgttttgttttttggggttcgggagagtgtcgagggttagaaatagttgtggtttatcgcgtcgtttattttggta

SEQ ID NO: 39768 - DNA, 540 bp, Artificial Sequence
  chemically treated genomic DNA (Homo sapiens) CpG-island No: 39768
taccaaaataaacgacgcgataaaccacaactatttctaaccctcgacactctcccgaaccccaaaaaacaaaacaaacacaaaatcgacctcgcgaaataaaaaaaaaaaaaaaaacaaaactaaaacgaaccctaacgcgcgcgaaatccaaactacaaattaaaaaaaacgacgaaacgaacgaccgacctcgacattacctaactaaaaccgtaaccgctacgacgaacacgaaaacccgccttctcgcgcgcgaccctcccgcgaaaaacttccgaacgcgcgacctcgaaaccccacgaaaaaacaaaaaaataaacgactaccacgaaataaaaaaaaaccgcccaaccccatcgaccctaccaacgtacgatctaaactcgaaaaatatatacgccttaaccgataaaaccgcaaccgctaacctttacccccaattcgaacttaaattttcgaataccaaaaaaaaacaaaaacgtactcttccctcttacgaccgctataatataaatccgtccccaaacctacaccatt

SEQ ID NO: 39769 - DNA, 551 bp, Artificial Sequence
  chemically treated genomic DNA (Homo sapiens) CpG-island No: 39769
ttttaggttatcgcgtcgttgttatggtagtaggggggcgcggttgacgtgcggcggtgttttcgggaagatggcggttgtcgaagcggttgtagagtcggtaacggtggtggcggttgttgggttaaaggcgaaagacgaagaggaggaggaagaggagtcgttgttatcgtgcgaggcggtgcgttgggttttagtgggggcggtggcggaggttcggtttggggtaatcgcgtttttagaagaggcgacggtcgaggagtttggcgcggtttcgggtttttcgtcggattcgtcgggtcggacgttgcggcggttgcgggtagagcggcggcggttggattcggcgttgttggcgttgttttcgtatttcgcgtaggtgtagtttcgtttgcgttaggtggtgcgcggggcgtcggcggagtagtagcgttttttgcgggagttcgaagatttcgtttttcgcggttgtttttacgttttaggttacgaagggttcggcgatttcgttagcgatgagggcgatgggttgttaggggatcggttacggt

SEQ ID NO: 39770 - DNA, 551 bp, Artificial Sequence
  chemically treated genomic DNA (Homo sapiens) CpG-island No: 39770
accgtaaccgatcccctaacaacccatcgccctcatcgctaacgaaatcgccgaacccttcgtaacctaaaacgtaaaaacaaccgcgaaaaacgaaatcttcgaactcccgcaaaaaacgctactactccgccgacgccccgcgcaccacctaacgcaaacgaaactacacctacgcgaaatacgaaaacaacgccaacaacgccgaatccaaccgccgccgctctacccgcaaccgccgcaacgtccgacccgacgaatccgacgaaaaacccgaaaccgcgccaaactcctcgaccgtcgcctcttctaaaaacgcgattaccccaaaccgaacctccgccaccgcccccactaaaacccaacgcaccgcctcgcacgataacaacgactcctcttcctcctcctcttcgtctttcgcctttaacccaacaaccgccaccaccgttaccgactctacaaccgcttcgacaaccgccatcttcccgaaaacaccgccgcacgtcaaccgcgcccccctactaccataacaacgacgcgataacctaaaa

SEQ ID NO: 39771 - DNA, 551 bp, Artificial Sequence
  chemically treated genomic DNA (Homo sapiens) CpG-island No: 39771
atcgtggtcggttttttggtagtttatcgtttttatcgttggcggggtcgtcgggtttttcgtaatttaagacgtgagggtagtcgcggaaggcgaagttttcgagttttcgtagaaggcgttgttgtttcgtcggcgtttcgcgtattatttggcgtaggcggaattgtatttgcgcgaagtgcgaggatagcgttagtagcgtcgagtttagtcgtcgtcgttttgttcgtagtcgtcgtagcgttcggttcggcgaattcggcggggagttcggggtcgcgttaggtttttcggtcgtcgttttttttaaaaacgcggttgttttaggtcgggttttcgttatcgtttttattggggtttagcgtatcgtttcgtacggtggtagcggttttttttttttttttttttcgtttttcgtttttggtttaatagtcgttattatcgttatcggttttgtagtcgtttcgatagtcgttattttttcggaaatatcgtcgtacgttagtcgcgtttttttgttgttatggtaacggcgcggtggtttggaa

SEQ ID NO: 39772 - DNA, 551 bp, Artificial Sequence
  chemically treated genomic DNA (Homo sapiens) CpG-island No: 39772
ttccaaaccaccgcgccgttaccataacaacaaaaaaacgcgactaacgtacgacgatatttccgaaaaaataacgactatcgaaacgactacaaaaccgataacgataataacgactattaaaccaaaaacgaaaaacgaaaaaaaaaaaaaaaaaaaaccgctaccaccgtacgaaacgatacgctaaaccccaataaaaacgataacgaaaacccgacctaaaacaaccgcgtttttaaaaaaaacgacgaccgaaaaacctaacgcgaccccgaactccccgccgaattcgccgaaccgaacgctacgacgactacgaacaaaacgacgacgactaaactcgacgctactaacgctatcctcgcacttcgcgcaaatacaattccgcctacgccaaataatacgcgaaacgccgacgaaacaacaacgccttctacgaaaactcgaaaacttcgccttccgcgactaccctcacgtcttaaattacgaaaaacccgacgaccccgccaacgataaaaacgataaactaccaaaaaaccgaccacgat

SEQ ID NO: 39773 - DNA, 798 bp, Artificial Sequence
  chemically treated genomic DNA (Homo sapiens) CpG-island No: 39773
gtcgttttcgtcggcgttgggtttcggggatatgttagtcgtttttttcggggtcgcgggtttttgggtgatgtcggtggaggttgggggcgagtgtggcggtattagcgcgggggtttcggagttcgcgggtcgcgagtttagtagttggcgtagttgggggtttaggtagtgggttgtcggttttgaggtttggtcggcggggggtcgtaagtcgatgattaggttcgtgatgagttcgtttagttgttttaggattcgttggcggttagaggtggggtcgtcgggggtcgtatgaggaagtggtcgcgtgtagttttcgggtaatttttaggttttggtgcgcgttcggtggcgtgtaggttattgttagtgatggtgatttcgggtattacgtattagttgcggttcgggtttttattcgcgcggttttttttcgttagcgacgtttcggatagggatagtggggtatagcgtttgggcgaggtggataggtttacgacgataggtgggtattagttttcgggggatacgtttcgcggttttcgtattttacgttttagtaggtttttatagttgcggttacggttttattggtttcggtacggttttattggtttcggtacggttcggggttagaatgttgttttaggagtacgagtagtggcggttgtcggtggttagtcggggtggattggtgtcggtgtcgttatgttaggaggcgagtaatcggtcggggttagaggattgtattatttgtagggtgcggtagggtcgtaggttttagttcgtttaggt

SEQ ID NO: 39774 - DNA, 798 bp, Artificial Sequence
  chemically treated genomic DNA (Homo sapiens) CpG-island No: 39774
acctaaacgaactaaaacctacgaccctaccgcaccctacaaataatacaatcctctaaccccgaccgattactcgcctcctaacataacgacaccgacaccaatccaccccgactaaccaccgacaaccgccactactcgtactcctaaaacaacattctaaccccgaaccgtaccgaaaccaataaaaccgtaccgaaaccaataaaaccgtaaccgcaactataaaaacctactaaaacgtaaaatacgaaaaccgcgaaacgtatcccccgaaaactaatacccacctatcgtcgtaaacctatccacctcgcccaaacgctataccccactatccctatccgaaacgtcgctaacgaaaaaaaaccgcgcgaataaaaacccgaaccgcaactaatacgtaatacccgaaatcaccatcactaacaataacctacacgccaccgaacgcgcaccaaaacctaaaaattacccgaaaactacacgcgaccacttcctcatacgacccccgacgaccccacctctaaccgccaacgaatcctaaaacaactaaacgaactcatcacgaacctaatcatcgacttacgaccccccgccgaccaaacctcaaaaccgacaacccactacctaaacccccaactacgccaactactaaactcgcgacccgcgaactccgaaacccccgcgctaataccgccacactcgcccccaacctccaccgacatcacccaaaaacccgcgaccccgaaaaaaacgactaacatatccccgaaacccaacgccgacgaaaacgac

SEQ ID NO: 39775 - DNA, 798 bp, Artificial Sequence
  chemically treated genomic DNA (Homo sapiens) CpG-island No: 39775
gtttgggcggattggggtttgcgattttatcgtattttgtaagtggtgtagttttttaatttcgatcggttgttcgttttttggtatggcggtatcggtattagtttatttcggttggttatcgatagtcgttattattcgtgtttttgggataatattttggtttcgggtcgtgtcgagattagtggggtcgtgtcgagattagtggggtcgtggtcgtagttatgagaatttgttggggcgtgaggtgcgggagtcgcgaggcgtgtttttcgaaggttggtgtttatttgtcgtcgtgaatttgtttatttcgtttagacgttatgttttattgtttttgttcgagacgtcgttgacggagaagggtcgcgcgggtgagggttcgggtcgtaattggtacgtgatgttcgagattattattattgataatgatttgtacgttatcgagcgcgtattagggtttgggagttgttcgggggttgtacgcggttatttttttatgcggttttcgacggttttatttttggtcgttagcggattttagagtagttggacgagtttattacggatttggttatcgatttgcgatttttcgtcggttaggttttagagtcggtagtttattgtttgggtttttaattgcgttaattgttggattcgcggttcgcgggtttcggggttttcgcgttggtgtcgttatattcgtttttagtttttatcggtattatttaggagttcgcggtttcgggagaggcggttgatatgttttcggaatttagcgtcgacgaagacgat

SEQ ID NO: 39776 - DNA, 798 bp, Artificial Sequence
  chemically treated genomic DNA (Homo sapiens) CpG-island No: 39776
atcgtcttcgtcgacgctaaattccgaaaacatatcaaccgcctctcccgaaaccgcgaactcctaaataataccgataaaaactaaaaacgaatataacgacaccaacgcgaaaaccccgaaacccgcgaaccgcgaatccaacaattaacgcaattaaaaacccaaacaataaactaccgactctaaaacctaaccgacgaaaaatcgcaaatcgataaccaaatccgtaataaactcgtccaactactctaaaatccgctaacgaccaaaaataaaaccgtcgaaaaccgcataaaaaaataaccgcgtacaacccccgaacaactcccaaaccctaatacgcgctcgataacgtacaaatcattatcaataataataatctcgaacatcacgtaccaattacgacccgaaccctcacccgcgcgacccttctccgtcaacgacgtctcgaacaaaaacaataaaacataacgtctaaacgaaataaacaaattcacgacgacaaataaacaccaaccttcgaaaaacacgcctcgcgactcccgcacctcacgccccaacaaattctcataactacgaccacgaccccactaatctcgacacgaccccactaatctcgacacgacccgaaaccaaaatattatcccaaaaacacgaataataacgactatcgataaccaaccgaaataaactaataccgataccgccataccaaaaaacgaacaaccgatcgaaattaaaaaactacaccacttacaaaatacgataaaatcgcaaaccccaatccgcccaaac

SEQ ID NO: 39777 - DNA, 810 bp, Artificial Sequence
  chemically treated genomic DNA (Homo sapiens) CpG-island No: 39777
cggcgtttagcgtagttacggggtttaggtaggggttcgtcgtagtagaacgttcggggattcgtacggtatgagtcgtttggcgtcggggtgtgcgatagcgttatatggcggggttcgggtatcgtgaggtcgtggaattgcggggcggggcgggttcgtaggatcgtaagttttaggcggcgtgttggagtattgcgttttttggtttgatgttcggaaggagcgtacgtaggggtagggattcgcgggtggttcgggaggtgcgtagcggttcgcggcggcgtataggggcgcgatgtggtcggggtcgtttagttgcggttgtaatttgatgggacgtagttagttggtaagggcgcggcgatgtttcggttcgcgtcgtacgttgggtttttcgttttcggttgggtaatatttgtagtaaggcgggcgcgggcgttaggttcgggggcgcgcggggcgcgtttttggagtgggcgcggcggtgtggttcggtttcgcgggttcgggcgcgcggtatagcgggttttaggggcggtggtttcggtagggtttttatggttggtcggtttagcgtttttaggaagtcgaagttgtcgtagtggcgtttgttgaaaggcgcgggtttagtaggtcgagttagggatcgtttatatggcgagcgtttggacgcgggtttcggggtcgttattttgatgttttggtatacggtcgatattagtaggttcggagcgttcgtatgggttattttaaaagaggtttttaggttggcggttttagtttatattgttttgcggggtttttgtt

SEQ ID NO: 39778 - DNA, 810 bp, Artificial Sequence
  chemically treated genomic DNA (Homo sapiens) CpG-island No: 39778
aacaaaaaccccgcaaaacaatataaactaaaaccgccaacctaaaaacctcttttaaaataacccatacgaacgctccgaacctactaatatcgaccgtataccaaaacatcaaaataacgaccccgaaacccgcgtccaaacgctcgccatataaacgatccctaactcgacctactaaacccgcgcctttcaacaaacgccactacgacaacttcgacttcctaaaaacgctaaaccgaccaaccataaaaaccctaccgaaaccaccgcccctaaaacccgctataccgcgcgcccgaacccgcgaaaccgaaccacaccgccgcgcccactccaaaaacgcgccccgcgcgcccccgaacctaacgcccgcgcccgccttactacaaatattacccaaccgaaaacgaaaaacccaacgtacgacgcgaaccgaaacatcgccgcgcccttaccaactaactacgtcccatcaaattacaaccgcaactaaacgaccccgaccacatcgcgcccctatacgccgccgcgaaccgctacgcacctcccgaaccacccgcgaatccctacccctacgtacgctccttccgaacatcaaaccaaaaaacgcaatactccaacacgccgcctaaaacttacgatcctacgaacccgccccgccccgcaattccacgacctcacgatacccgaaccccgccatataacgctatcgcacaccccgacgccaaacgactcataccgtacgaatccccgaacgttctactacgacgaacccctacctaaaccccgtaactacgctaaacgccg

SEQ ID NO: 39779 - DNA, 810 bp, Artificial Sequence
  chemically treated genomic DNA (Homo sapiens) CpG-island No: 39779
ggtaaaagtttcgtaaggtagtgtgagttggagtcgttagtttgaggattttttttaagatgatttatacggacgtttcggatttgttggtgtcgatcgtgtattaggatattaaggtggcgatttcgggattcgcgtttaagcgttcgttatgtgagcgatttttggttcggtttgttgagttcgcgttttttaataagcgttattgcggtagtttcgattttttggaggcgttggatcggttaattatggagattttgtcggagttatcgtttttggagttcgttgtgtcgcgcgttcggattcgcgaggtcgagttatatcgtcgcgtttattttaagagcgcgtttcgcgcgttttcgggtttgacgttcgcgttcgttttgttgtaggtgttgtttagtcgagggcgggaggtttagcgtgcggcgcgggtcgaggtatcgtcgcgtttttgttaattagttgcgttttattaagttgtagtcgtagttgggcggtttcggttatatcgcgtttttgtgcgtcgtcgcgggtcgttgcgtatttttcgagttattcgcgggtttttatttttacgtgcgtttttttcggatattaagttagaggacgtagtgttttagtacgtcgtttggggtttgcggttttgcgggttcgtttcgtttcgtagttttacggttttacggtgttcgggtttcgttatatggcgttgtcgtatatttcgacgttaagcgatttatatcgtgcggattttcgggcgttttattgcgacgagtttttgtttgggtttcgtgattacgttgagcgtcg

SEQ ID NO: 39780 - DNA, 810 bp, Artificial Sequence
  chemically treated genomic DNA (Homo sapiens) CpG-island No: 39780
cgacgctcaacgtaatcacgaaacccaaacaaaaactcgtcgcaataaaacgcccgaaaatccgcacgatataaatcgcttaacgtcgaaatatacgacaacgccatataacgaaacccgaacaccgtaaaaccgtaaaactacgaaacgaaacgaacccgcaaaaccgcaaaccccaaacgacgtactaaaacactacgtcctctaacttaatatccgaaaaaaacgcacgtaaaaataaaaacccgcgaataactcgaaaaatacgcaacgacccgcgacgacgcacaaaaacgcgatataaccgaaaccgcccaactacgactacaacttaataaaacgcaactaattaacaaaaacgcgacgatacctcgacccgcgccgcacgctaaacctcccgccctcgactaaacaacacctacaacaaaacgaacgcgaacgtcaaacccgaaaacgcgcgaaacgcgctcttaaaataaacgcgacgatataactcgacctcgcgaatccgaacgcgcgacacaacgaactccaaaaacgataactccgacaaaatctccataattaaccgatccaacgcctccaaaaaatcgaaactaccgcaataacgcttattaaaaaacgcgaactcaacaaaccgaaccaaaaatcgctcacataacgaacgcttaaacgcgaatcccgaaatcgccaccttaatatcctaatacacgatcgacaccaacaaatccgaaacgtccgtataaatcatcttaaaaaaaatcctcaaactaacgactccaactcacactaccttacgaaacttttacc

SEQ ID NO: 39781 - DNA, 1173 bp, Artificial Sequence
  chemically treated genomic DNA (Homo sapiens) CpG-island No: 39781
ttttcgtttaaacgttgggttaattttacgaattggcggtggtaaggttttgggtatcggtgaagttttcgtggtagcgtagatcggcgatttttttttttttcgcgtttagacggcggcggtagtagtacgttttcgggttgttggagtcggtagcgcgcgaggtcggagttcgggtagttaggttgggtgggggaggggcggcggtagcggagtcgggagcgtgcgcgcgtattttatatttcgtcgttcggggacgtttattcgcgagtcggggtcggtacggtcggttcgggttttatcgttttcgtttttcggttttttttcggcgtgagtttaacgggtgtcggtttagtagttgttgcgtttattaggtttggggaggtagggtacggggatcgggtcgtagtttcgagcggcgtgggcgcgttgtttttttggtagtcgtcgttagagttagtagttgcgagttatcggaggcggcgcggaggaggttttcgcggtcgggtaggaaggagacgcggtcgatttttgttcgttcgagggcggttgttttcgcgcgtttaggttttttcgtcgttttagggttgagtgaggaatgagtcggcgtttatttcgggttttcggagcgtgggtttcggttcggttttttaggcgcgagggttcggttattgcggtcggcggtttagttcggggagtaggcgtcggggtttattgaatcggtcgcggagaggaggaggaggaggaggaagaggaggaggaggaggaggaggagttcggcgggggcggtcgtcgcgtttttttttttttaggatacgtcggggttttttagtggtcgtcggaggaggaagtttcgttttttgatagattcgtgcggtagtaatagcggcggcggtcgcggcggttggtcggatttaggtgtttcggacgttattgtttttcgcgttagtcgtcgagtgggtagtagcgggatttagtcgggcgttaggtttttgttaggtagcgtcgggaagcgcgggcggtcgagaatttttttttgttatttcgtttagcgtcgttgtttcggttttttagcgaagtgggagatttttttttttgtttgtagacgttcgtgggagatttttattttttttatcgttaaggttaagagattttggaatagaagcgtcgaag

SEQ ID NO: 39782 - DNA, 1173 bp, Artificial Sequence
  chemically treated genomic DNA (Homo sapiens) CpG-island No: 39782
cttcgacgcttctattccaaaatctcttaaccttaacgataaaaaaaataaaaatctcccacgaacgtctacaaacaaaaaaaaaaatctcccacttcgctaaaaaaccgaaacaacgacgctaaacgaaataacaaaaaaaaattctcgaccgcccgcgcttcccgacgctacctaacaaaaacctaacgcccgactaaatcccgctactacccactcgacgactaacgcgaaaaacaataacgtccgaaacacctaaatccgaccaaccgccgcgaccgccgccgctattactaccgcacgaatctatcaaaaaacgaaacttcctcctccgacgaccactaaaaaaccccgacgtatcctaaaaaaaaaaaaacgcgacgaccgcccccgccgaactcctcctcctcctcctcctcctcttcctcctcctcctcctcctctccgcgaccgattcaataaaccccgacgcctactccccgaactaaaccgccgaccgcaataaccgaaccctcgcgcctaaaaaaccgaaccgaaacccacgctccgaaaacccgaaataaacgccgactcattcctcactcaaccctaaaacgacgaaaaaacctaaacgcgcgaaaacaaccgccctcgaacgaacaaaaatcgaccgcgtctccttcctacccgaccgcgaaaacctcctccgcgccgcctccgataactcgcaactactaactctaacgacgactaccaaaaaaacaacgcgcccacgccgctcgaaactacgacccgatccccgtaccctacctccccaaacctaataaacgcaacaactactaaaccgacacccgttaaactcacgccgaaaaaaaaccgaaaaacgaaaacgataaaacccgaaccgaccgtaccgaccccgactcgcgaataaacgtccccgaacgacgaaatataaaatacgcgcgcacgctcccgactccgctaccgccgcccctcccccacccaacctaactacccgaactccgacctcgcgcgctaccgactccaacaacccgaaaacgtactactaccgccgccgtctaaacgcgaaaaaaaaaaaaatcgccgatctacgctaccacgaaaacttcaccgatacccaaaaccttaccaccgccaattcgtaaaattaacccaacgtttaaacgaaaa

SEQ ID NO: 39783 - DNA, 1173 bp, Artificial Sequence
  chemically treated genomic DNA (Homo sapiens) CpG-island No: 39783
tttcgacgtttttattttagaattttttaattttagcggtggaaaaaataagggttttttacggacgtttgtaaatagggaggaaggttttttatttcgttgggaagtcgaagtagcggcgttgggcgaagtagtaggaaggagttttcggtcgttcgcgtttttcggcgttgtttggtaggaatttggcgttcggttgagtttcgttgttgtttattcgacggttggcgcgaagggtaatagcgttcgaaatatttgagttcggttagtcgtcgcggtcgtcgtcgttgttgttatcgtacgggtttgttagggagcggaattttttttttcggcggttattgagaagtttcggcgtgttttgggggaggggaggcgcggcggtcgttttcgtcgagtttttttttttttttttttttttttttttttttttttttttttttttcgcggtcggtttagtgaatttcggcgtttgtttttcgagttaggtcgtcggtcgtagtggtcgagttttcgcgtttaagaagtcgagtcggggtttacgtttcgagagttcggggtaggcgtcggtttattttttatttagttttggagcggcgggagggtttgggcgcgcgggagtagtcgttttcgggcgggtagaggtcggtcgcgttttttttttgttcggtcgcgggggtttttttcgcgtcgttttcggtggttcgtagttgttggttttggcggcggttgttagagaggtagcgcgtttacgtcgttcggggttgcggttcggttttcgtattttgtttttttaggtttggtgagcgtagtagttgttgggtcgatattcgttgggtttacgtcggagaggaatcggagggcgggggcgatgggattcgggtcggtcgtatcggtttcggttcgcgagtgggcgttttcgggcggcggagtgtgaggtgcgcgcgtacgttttcggtttcgttgtcgtcgttttttttttatttagtttggttgttcgggtttcggtttcgcgcgttgtcggttttagtagttcgaaagcgtattgttgtcgtcgtcgtttgagcgcgaaagaagagaaggtcgtcgatttgcgttgttacgagaattttatcggtgtttagggttttgttatcgttagttcgtggggttgatttagcgtttgggcgagag

SEQ ID NO: 39784 - DNA, 1173 bp, Artificial Sequence
  chemically treated genomic DNA (Homo sapiens) CpG-island No: 39784
ctctcgcccaaacgctaaatcaaccccacgaactaacgataacaaaaccctaaacaccgataaaattctcgtaacaacgcaaatcgacgaccttctcttctttcgcgctcaaacgacgacgacaacaatacgctttcgaactactaaaaccgacaacgcgcgaaaccgaaacccgaacaaccaaactaaataaaaaaaaaacgacgacaacgaaaccgaaaacgtacgcgcgcacctcacactccgccgcccgaaaacgcccactcgcgaaccgaaaccgatacgaccgacccgaatcccatcgcccccgccctccgattcctctccgacgtaaacccaacgaatatcgacccaacaactactacgctcaccaaacctaaaaaaacaaaatacgaaaaccgaaccgcaaccccgaacgacgtaaacgcgctacctctctaacaaccgccgccaaaaccaacaactacgaaccaccgaaaacgacgcgaaaaaaacccccgcgaccgaacaaaaaaaaaacgcgaccgacctctacccgcccgaaaacgactactcccgcgcgcccaaaccctcccgccgctccaaaactaaataaaaaataaaccgacgcctaccccgaactctcgaaacgtaaaccccgactcgacttcttaaacgcgaaaactcgaccactacgaccgacgacctaactcgaaaaacaaacgccgaaattcactaaaccgaccgcgaaaaaaaaaaaaaaaaaaaaaaaaaaaaaaaaaaaaaaaaaaaaaaactcgacgaaaacgaccgccgcgcctcccctcccccaaaacacgccgaaacttctcaataaccgccgaaaaaaaaaattccgctccctaacaaacccgtacgataacaacaacgacgacgaccgcgacgactaaccgaactcaaatatttcgaacgctattacccttcgcgccaaccgtcgaataaacaacaacgaaactcaaccgaacgccaaattcctaccaaacaacgccgaaaaacgcgaacgaccgaaaactccttcctactacttcgcccaacgccgctacttcgacttcccaacgaaataaaaaaccttcctccctatttacaaacgtccgtaaaaaacccttattttttccaccgctaaaattaaaaaattctaaaataaaaacgtcgaaa

SEQ ID NO: 39785 - DNA, 596 bp, Artificial Sequence
  chemically treated genomic DNA (Homo sapiens) CpG-island No: 39785
ggttcggtttcgttcgttttgggttatgtagttgtatacgtcggcgttttgcgtttcgtagcgtcgtagttataggagttgggttcgggggtcggcgcgggtaggagttgttatttcggaattagcggaggttggttggggcgtttcgtttattattattcgtagtcgtacgtcgttgttcgcgtatatcgtcgcgttttttaggggtcgtagaagattggcggtcggtacgttataggagtttcgtcgtcggtttttattttggtttttttcgggggtatttcggggttggggggtgttttcgtgttcgtattttcgtttcgcgtgtttcgggttttttgtatggttattgagagttgggttggggggacgtcggaattgggcggttacgggggtattcgcgggacggtgttttaggagataagtttggggggtcggcgttgtttttttgttgttcgttcgttttcggtttgtgttatttagaaggttatcggggcggtcggcgattgcgtttgggggttatttttaggtttttcggttcgggttgcgagggagtcgtggagggagggggtagtaggggagggatttgattttat

SEQ ID NO: 39786 - DNA, 596 bp, Artificial Sequence
  chemically treated genomic DNA (Homo sapiens) CpG-island No: 39786
ataaaatcaaatccctcccctactaccccctccctccacgactccctcgcaacccgaaccgaaaaacctaaaaataacccccaaacgcaatcgccgaccgccccgataaccttctaaataacacaaaccgaaaacgaacgaacaacaaaaaaacaacgccgaccccccaaacttatctcctaaaacaccgtcccgcgaatacccccgtaaccgcccaattccgacgtccccccaacccaactctcaataaccatacaaaaaacccgaaacacgcgaaacgaaaatacgaacacgaaaacaccccccaaccccgaaatacccccgaaaaaaaccaaaataaaaaccgacgacgaaactcctataacgtaccgaccgccaatcttctacgacccctaaaaaacgcgacgatatacgcgaacaacgacgtacgactacgaataataataaacgaaacgccccaaccaacctccgctaattccgaaataacaactcctacccgcgccgacccccgaacccaactcctataactacgacgctacgaaacgcaaaacgccgacgtatacaactacataacccaaaacgaacgaaaccgaacc

SEQ ID NO: 39787 - DNA, 596 bp, Artificial Sequence
  chemically treated genomic DNA (Homo sapiens) CpG-island No: 39787
gtggagttaagttttttttttgttgttttttttttttacggttttttcgtaattcgagtcggggggtttaaaaatagtttttaggcgtaatcgtcggtcgtttcggtgattttttgggtagtataggtcgaaggcgggcgggtagtaggaaggtagcgtcggttttttagatttgttttttagggtatcgtttcgcgggtgttttcgtggtcgtttagtttcggcgtttttttagtttagtttttagtggttatgtagaaagttcggggtacgcgaggcgaggatgcgggtacgagggtattttttagtttcggagtgttttcgaaaagggttaaggtgggggtcggcggcggggtttttgtggcgtgtcggtcgttagttttttgcggtttttgaagaacgcggcggtgtgcgcgggtagcgacgtgcggttgcgggtggtggtgagcgggacgttttagttagttttcgttggtttcgggatggtagtttttgttcgcgtcggttttcgagtttagtttttgtggttgcggcgttgcggggcgtaggacgtcggcgtgtatagttgtatggtttagaacgagcggggtcgggtt

SEQ ID NO: 39788 - DNA, 596 bp, Artificial Sequence
  chemically treated genomic DNA (Homo sapiens) CpG-island No: 39788
aacccgaccccgctcgttctaaaccatacaactatacacgccgacgtcctacgccccgcaacgccgcaaccacaaaaactaaactcgaaaaccgacgcgaacaaaaactaccatcccgaaaccaacgaaaactaactaaaacgtcccgctcaccaccacccgcaaccgcacgtcgctacccgcgcacaccgccgcgttcttcaaaaaccgcaaaaaactaacgaccgacacgccacaaaaaccccgccgccgacccccaccttaacccttttcgaaaacactccgaaactaaaaaataccctcgtacccgcatcctcgcctcgcgtaccccgaactttctacataaccactaaaaactaaactaaaaaaacgccgaaactaaacgaccacgaaaacacccgcgaaacgataccctaaaaaacaaatctaaaaaaccgacgctaccttcctactacccgcccgccttcgacctatactacccaaaaaatcaccgaaacgaccgacgattacgcctaaaaactatttttaaaccccccgactcgaattacgaaaaaaccgtaaaaaaaaaaaacaacaaaaaaaaaacttaactccac

SEQ ID NO: 39789 - DNA, 880 bp, Artificial Sequence
  chemically treated genomic DNA (Homo sapiens) CpG-island No: 39789
tcgggggtgcgttcgtttcggtgtttagtttcggtttttagttttgggtttatcgttagtcggtgttagtagatttacgtcgtattttttatttatggcggggtaggcgcggacgaggattcgagtaaggaaaaggcgtaggggtttcgtgattattttacgaggttgggaggcgtttttgggtcgaaggaaaggggaagagaaagagaggaaaatggagttggtataaggcgagatcgatcgttattttagacgggaagagaagaattgggcggggagaggaggggagggagcgaggaggggagggttgtgattgagttttcgtagtcggggcgcggtttgtaggcgtcgtaagggcgttaaattaggcgttttacgtttttaattggttacgttttcgtcgttcgtataattatttttttttttcgttttcgcgagaggaaaagggcgggcgttttattttggttttcggtttttttgcgtttttgttacggtggttcgggaggcgcgcgcgagtcggagtggaggtgtacggagcgcgggcggggattgttggttattatcgttttagaattcgtcgtcggggcgggagttcgttcggtttaaggttttagagtcggatcgtcgtttttggattttgagcgggcgcgtgcggcggttacgtgggcgaggagcgcgggtcgggttgtttttcgggggtggcggttttggtttttttcgcggggttgggtttgtcggggttcggagttcgtcgggaagagttcggaaattatacgtgttttttttttcgttttgtgttttttttgtttagtgcgttgtcggtgggcgttttaggaaattggtaggaggaaaagcggttttttttgaaaaggtaattttt

SEQ ID NO: 39790 - DNA, 880 bp, Artificial Sequence
  chemically treated genomic DNA (Homo sapiens) CpG-island No: 39790
aaaaattaccttttcaaaaaaaaccgcttttcctcctaccaatttcctaaaacgcccaccgacaacgcactaaacaaaaaaaacacaaaacgaaaaaaaaaacacgtataatttccgaactcttcccgacgaactccgaaccccgacaaacccaaccccgcgaaaaaaaccaaaaccgccacccccgaaaaacaacccgacccgcgctcctcgcccacgtaaccgccgcacgcgcccgctcaaaatccaaaaacgacgatccgactctaaaaccttaaaccgaacgaactcccgccccgacgacgaattctaaaacgataataaccaacaatccccgcccgcgctccgtacacctccactccgactcgcgcgcgcctcccgaaccaccgtaacaaaaacgcaaaaaaaccgaaaaccaaaataaaacgcccgcccttttcctctcgcgaaaacgaaaaaaaaaaataattatacgaacgacgaaaacgtaaccaattaaaaacgtaaaacgcctaatttaacgcccttacgacgcctacaaaccgcgccccgactacgaaaactcaatcacaaccctcccctcctcgctccctcccctcctctccccgcccaattcttctcttcccgtctaaaataacgatcgatctcgccttataccaactccattttcctctctttctcttcccctttccttcgacccaaaaacgcctcccaacctcgtaaaataatcacgaaacccctacgccttttccttactcgaatcctcgtccgcgcctaccccgccataaataaaaaatacgacgtaaatctactaacaccgactaacgataaacccaaaactaaaaaccgaaactaaacaccgaaacgaacgcacccccga

SEQ ID NO: 39791 - DNA, 880 bp, Artificial Sequence
  chemically treated genomic DNA (Homo sapiens) CpG-island No: 39791
aagggttatttttttaaaagaagtcgtttttttttttattaattttttaaagcgtttatcggtaacgtattaaataaggagggtatagagcgggaaaaaggatacgtgtgattttcgaatttttttcggcgggtttcgggtttcggtaagtttagtttcgcgggaggaattaaggtcgttattttcgagaggtagttcggttcgcgtttttcgtttacgtggtcgtcgtacgcgttcgtttaaagtttaagggcggcgattcggttttgggattttggatcgagcgagttttcgtttcgacggcgagttttagaacggtggtggttagtagttttcgttcgcgtttcgtgtatttttatttcggttcgcgcgcgtttttcgaattatcgtggtagaggcgtaagggaatcggaagttaaaatgggacgttcgttttttttttttcgcgagggcggggaaggaaaatagttgtgcgagcgacggggacgtaattaattagaagcgtgaagcgtttgatttggcgtttttgcggcgtttgtaagtcgcgtttcggttgcggaggtttagttatagttttttttttttcgtttttttttttttttttttcgtttagttttttttttttcgtttgaggtggcggtcggtttcgttttgtgttagttttatttttttttttttttttttttttttttttcggtttaagagcgttttttagtttcgtagggtggttacggagtttttgcgttttttttttgttcgggttttcgttcgcgtttgtttcgttatgaatgaggagtacgacgtgagtttgttggtatcggttgacggtgggtttagggttgagggtcggggttgagtatcggggcgggcgtattttcgg

SEQ ID NO: 39792 - DNA, 880 bp, Artificial Sequence
  chemically treated genomic DNA (Homo sapiens) CpG-island No: 39792
ccgaaaatacgcccgccccgatactcaaccccgaccctcaaccctaaacccaccgtcaaccgataccaacaaactcacgtcgtactcctcattcataacgaaacaaacgcgaacgaaaacccgaacaaaaaaaaaacgcaaaaactccgtaaccaccctacgaaactaaaaaacgctcttaaaccgaaaaaaaaaaaaaaaaaaaaaaaaaaaaataaaactaacacaaaacgaaaccgaccgccacctcaaacgaaaaaaaaaaaactaaacgaaaaaaaaaaaaaaaaaaacgaaaaaaaaaaaactataactaaacctccgcaaccgaaacgcgacttacaaacgccgcaaaaacgccaaatcaaacgcttcacgcttctaattaattacgtccccgtcgctcgcacaactattttccttccccgccctcgcgaaaaaaaaaaaacgaacgtcccattttaacttccgattcccttacgcctctaccacgataattcgaaaaacgcgcgcgaaccgaaataaaaatacacgaaacgcgaacgaaaactactaaccaccaccgttctaaaactcgccgtcgaaacgaaaactcgctcgatccaaaatcccaaaaccgaatcgccgcccttaaactttaaacgaacgcgtacgacgaccacgtaaacgaaaaacgcgaaccgaactacctctcgaaaataacgaccttaattcctcccgcgaaactaaacttaccgaaacccgaaacccgccgaaaaaaattcgaaaatcacacgtatcctttttcccgctctataccctccttatttaatacgttaccgataaacgctttaaaaaattaataaaaaaaaaaacgacttcttttaaaaaaataaccctt

SEQ ID NO: 39793 - DNA, 515 bp, Artificial Sequence
  chemically treated genomic DNA (Homo sapiens) CpG-island No: 39793
taggtcggtatttagttcgtatggttcgcggcgtgagattcggggcgaggttttcggtaaatttcgtttttcgtttcggtatttgcggggtcgagcgttatttcggcgggtcgagaagaacgtagtcgtttgcgtatcggggtacgtaggaaggggagtggaggggaggggtttgggttcggacgtacgtgcgattttcgggagtttttcgtaatagaaatacgggttttttgtaaagtatcgttaggattcgttttttttttttttttaggtttttattttcgtcgttcgttgcgtttgtcgttttttggtttcgtttaattttgtaattagagtggaattgatttcgtagggggaatgattaggaaagggggcgtgtttgcgtgtttttggggcgggatcgtgtaggacgcgcgtacgttcgttttaggaggtttgtgtattagttgtagattcgggtcggtcgtgattggaggcggatttgtaggattttgggattgtgttttattcggtga

SEQ ID NO: 39794 - DNA, 515 bp, Artificial Sequence
  chemically treated genomic DNA (Homo sapiens) CpG-island No: 39794
tcaccgaataaaacacaatcccaaaatcctacaaatccgcctccaatcacgaccgacccgaatctacaactaatacacaaacctcctaaaacgaacgtacgcgcgtcctacacgatcccgccccaaaaacacgcaaacacgccccctttcctaatcattccccctacgaaatcaattccactctaattacaaaattaaacgaaaccaaaaaacgacaaacgcaacgaacgacgaaaataaaaacctaaaaaaaaaaaaaaaacgaatcctaacgatactttacaaaaaacccgtatttctattacgaaaaactcccgaaaatcgcacgtacgtccgaacccaaacccctcccctccactccccttcctacgtaccccgatacgcaaacgactacgttcttctcgacccgccgaaataacgctcgaccccgcaaataccgaaacgaaaaacgaaatttaccgaaaacctcgccccgaatctcacgccgcgaaccatacgaactaaataccgaccta

SEQ ID NO: 39795 - DNA, 515 bp, Artificial Sequence
  chemically treated genomic DNA (Homo sapiens) CpG-island No: 39795
ttatcgagtgaggtatagttttaaagttttgtaggttcgtttttagttacggtcgattcgggtttgtaattggtgtataagttttttgaagcgagcgtgcgcgcgttttgtacggtttcgttttaaaggtacgtagatacgtttttttttttggttattttttttgcgaagttagttttattttagttataggattgggcggggttagaaagcggtaggcgtaacgggcggcggaagtaggagtttgggaaggaagagggaacgggttttggcggtgttttgtaaagggttcgtgtttttgttgcgggaagttttcgggggtcgtacgtgcgttcgagtttaagttttttttttttatttttttttttgcgtgtttcggtacgtaagcggttacgtttttttcggttcgtcgagatggcgttcgatttcgtaggtatcggggcgggaagcggggtttgtcgagggtttcgtttcgggttttacgtcgcgggttatgcgggttggatgtcgatttg

SEQ ID NO: 39796 - DNA, 515 bp, Artificial Sequence
  chemically treated genomic DNA (Homo sapiens) CpG-island No: 39796
caaatcgacatccaacccgcataacccgcgacgtaaaacccgaaacgaaaccctcgacaaaccccgcttcccgccccgatacctacgaaatcgaacgccatctcgacgaaccgaaaaaaacgtaaccgcttacgtaccgaaacacgcaaaaaaaaaaataaaaaaaaaaaacttaaactcgaacgcacgtacgacccccgaaaacttcccgcaacaaaaacacgaaccctttacaaaacaccgccaaaacccgttccctcttccttcccaaactcctacttccgccgcccgttacgcctaccgctttctaaccccgcccaatcctataactaaaataaaactaacttcgcaaaaaaaataaccaaaaaaaaaaacgtatctacgtacctttaaaacgaaaccgtacaaaacgcgcgcacgctcgcttcaaaaaacttatacaccaattacaaacccgaatcgaccgtaactaaaaacgaacctacaaaactttaaaactatacctcactcgataa

SEQ ID NO: 39797 - DNA, 1035 bp, Artificial Sequence
  chemically treated genomic DNA (Homo sapiens) CpG-island No: 39797
  misc_feature (340)..(340): n is either a, c, g or t
  misc_feature (456)..(456): n is either a, c, g or t
gcggaatagagttgggcgtggtagtgtttgcgagttagcgttacgtaattagaggcgttcgtattaatttgatttttaagagagattaagcgtagggaatagcgggtgcggatattacggcggaaggttttggaggaagtagaagtgaaggatttcgtagttttgggacggtggggtatagagagagaaagggagtttcgggcgcggcgcggtgaggatgcgagtagaggaaggatacgcggcgtcgggtatttgtcgggagcgtcggatttaatgggaggagggttcgcgtcgtattttaatttggtagaggacgttacgacgttaaggcggtcgcgangttaatgggaggtcgtcgcgggtagggacggggtcgggaagagtcggggttgggtcgcgcgaggtagttggttgattttagtttagtcgtcgtcggagaggacgggcgtcgagcgngggttgcggatttcggtttgtttttattttattttcgttgtttgtatttttcggatggtgttgattgttttttaagcggcggcgtcggcgagtcgtgaggacgcgtcggaggttgttcggggtcgaggtttttcgtcgtcggtatttttttttgcggcgttcgtgcgtgtcggttcgtaggcgggaatggcggtcgtgttttcggggaacggtcgcgtatcggtttcggttgtttttgttttttttggtttcgttgttgtgggtttcggttgcggttcggtcggtttagatgaagattttagttatcggaataaagaatcgtcggcgtcggttagtagttgtagtcgtagtttgtggttgtgtagggtttcgagtcggttcgggtcgaggtgagcgggtcgggatggggcgagcgaggttgtagggtcggttgcgtagttaattaggttttaggattttgatagcgtcgtatttcgtcggtttcgttggggggaggggagtcggtttttgttttcggggtggagggcggtcggttgcgttgtttttcggtgaggttttggtttgttcgtttttttaggg

SEQ ID NO: 39798 - DNA, 1035 bp, Artificial Sequence
  chemically treated genomic DNA (Homo sapiens) CpG-island No: 39798
  misc_feature (580)..(580): n is either a, c, g or t
  misc_feature (696)..(696): n is either a, c, g or t
ccctaaaaaaacgaacaaaccaaaacctcaccgaaaaacaacgcaaccgaccgccctccaccccgaaaacaaaaaccgactcccctccccccaacgaaaccgacgaaatacgacgctatcaaaatcctaaaacctaattaactacgcaaccgaccctacaacctcgctcgccccatcccgacccgctcacctcgacccgaaccgactcgaaaccctacacaaccacaaactacgactacaactactaaccgacgccgacgattctttattccgataactaaaatcttcatctaaaccgaccgaaccgcaaccgaaacccacaacaacgaaaccaaaaaaaacaaaaacaaccgaaaccgatacgcgaccgttccccgaaaacacgaccgccattcccgcctacgaaccgacacgcacgaacgccgcaaaaaaaaataccgacgacgaaaaacctcgaccccgaacaacctccgacgcgtcctcacgactcgccgacgccgccgcttaaaaaacaatcaacaccatccgaaaaatacaaacaacgaaaataaaataaaaacaaaccgaaatccgcaacccncgctcgacgcccgtcctctccgacgacgactaaactaaaatcaaccaactacctcgcgcgacccaaccccgactcttcccgaccccgtccctacccgcgacgacctcccattaacntcgcgaccgccttaacgtcgtaacgtcctctaccaaattaaaatacgacgcgaaccctcctcccattaaatccgacgctcccgacaaatacccgacgccgcgtatccttcctctactcgcatcctcaccgcgccgcgcccgaaactccctttctctctctataccccaccgtcccaaaactacgaaatccttcacttctacttcctccaaaaccttccgccgtaatatccgcacccgctattccctacgcttaatctctcttaaaaatcaaattaatacgaacgcctctaattacgtaacgctaactcgcaaacactaccacgcccaactctattccgc

SEQ ID NO: 39799 - DNA, 1035 bp, Artificial Sequence
  chemically treated genomic DNA (Homo sapiens) CpG-island No: 39799
  misc_feature (580)..(580): n is either a, c, g or t
  misc_feature (696)..(696): n is either a, c, g or t
ttttaaaggagcgggtagattaaggttttatcggaaaatagcgtagtcgatcgttttttatttcgggagtaggggtcggtttttttttttttagcgaggtcggcggagtgcggcgttattaaagttttggagtttggttaattgcgtagtcggttttgtagtttcgttcgttttatttcggttcgtttatttcgattcgggtcggttcggggttttgtatagttataggttgcggttgtagttgttggtcggcgtcggcggttttttgtttcggtggttaaggtttttatttgggtcggtcggatcgtagtcggggtttatagtagcggaattagaaagagtagaagtagtcggggtcgatgcgcggtcgtttttcggagatacggtcgttattttcgtttgcgggtcggtacgtacgggcgtcgtaagaggaagtgtcggcgacgggaagtttcgatttcgaatagttttcggcgcgtttttacgattcgtcgacgtcgtcgtttagggagtagttagtattattcgggaggtgtaagtagcgggagtgaggtgagggtaggtcgaagttcgtagtttncgttcggcgttcgtttttttcggcggcggttaaattggagttagttagttgtttcgcgcggtttagtttcgatttttttcggtttcgtttttgttcgcgacggttttttattggtntcgcgatcgttttggcgtcgtgacgttttttgttaggttgaggtgcggcgcgggttttttttttattggattcggcgttttcggtaggtattcggcgtcgcgtgttttttttttgttcgtatttttatcgcgtcgcgttcggggttttttttttttttttgtgttttatcgttttaggattgcgaggttttttatttttgttttttttagagtttttcgtcgtaatgttcgtattcgttgttttttgcgtttagttttttttagaggttaaattagtgcgagcgtttttggttacgtggcgttgattcgtaggtattgttacgtttagttttgtttcgt

SEQ ID NO: 39800 - DNA, 1035 bp, Artificial Sequence
  chemically treated genomic DNA (Homo sapiens) CpG-island No: 39800
  misc_feature (340)..(340): n is either a, c, g or t
  misc_feature (456)..(456): n is either a, c, g or t
acgaaacaaaactaaacgtaacaatacctacgaatcaacgccacgtaaccaaaaacgctcgcactaatttaacctctaaaaaaaactaaacgcaaaaaacaacgaatacgaacattacgacgaaaaactctaaaaaaaacaaaaataaaaaacctcgcaatcctaaaacgataaaacacaaaaaaaaaaaaaaaaccccgaacgcgacgcgataaaaatacgaacaaaaaaaaaacacgcgacgccgaatacctaccgaaaacgccgaatccaataaaaaaaaaacccgcgccgcacctcaacctaacaaaaaacgtcacgacgccaaaacgatcgcganaccaataaaaaaccgtcgcgaacaaaaacgaaaccgaaaaaaatcgaaactaaaccgcgcgaaacaactaactaactccaatttaaccgccgccgaaaaaaacgaacgccgaacgnaaactacgaacttcgacctaccctcacctcactcccgctacttacacctcccgaataatactaactactccctaaacgacgacgtcgacgaatcgtaaaaacgcgccgaaaactattcgaaatcgaaacttcccgtcgccgacacttcctcttacgacgcccgtacgtaccgacccgcaaacgaaaataacgaccgtatctccgaaaaacgaccgcgcatcgaccccgactacttctactctttctaattccgctactataaaccccgactacgatccgaccgacccaaataaaaaccttaaccaccgaaacaaaaaaccgccgacgccgaccaacaactacaaccgcaacctataactatacaaaaccccgaaccgacccgaatcgaaataaacgaaccgaaataaaacgaacgaaactacaaaaccgactacgcaattaaccaaactccaaaactttaataacgccgcactccgccgacctcgctaaaaaaaaaaaaaccgacccctactcccgaaataaaaaacgatcgactacgctattttccgataaaaccttaatctacccgctcctttaaaa

SEQ ID NO: 39801 - DNA, 526 bp, Artificial Sequence
  chemically treated genomic DNA (Homo sapiens) CpG-island No: 39801
  misc_feature (171)..(171): n is either a, c, g or t
ggttaggggttcgtcgattttttttagcgtttcgggcggcggggttcgagaattaaggtggttttcgcggtttcgtcgcgcgttttttttttttttttcgcggatttcgcgggtcgtcgtttatttcgcgtatttcgttttttggaaatttagtagtcggggggcgaatantgcggcgtttttatgggaatttggtttcgggtttagagcgcgggtagttggtagagtttggggggcgcggcggcggtagtagtaggttggagggcgcgcggcgggggttaaggggatttggtcggcgttcggagtcggagtcggagttcgagtcggagttggaggcgttcggagtcgtcgacgttaaatttcgagtagatggtggcgggggcggggcgggcgggggtacgggggggttttcgggttcgcgttgttaatcgcgttaagttcggttttttttttttcgcgatttcgtcgttttcgttgaggtggaggagggtcgtggggagatgggggggtgggagaggtgggggtg

SEQ ID NO: 39802 - DNA, 526 bp, Artificial Sequence
  chemically treated genomic DNA (Homo sapiens) CpG-island No: 39802
  misc_feature (356)..(356): n is either a, c, g or t
cacccccacctctcccacccccccatctccccacgaccctcctccacctcaacgaaaacgacgaaatcgcgaaaaaaaaaaaaccgaacttaacgcgattaacaacgcgaacccgaaaacccccccgtacccccgcccgccccgcccccgccaccatctactcgaaatttaacgtcgacgactccgaacgcctccaactccgactcgaactccgactccgactccgaacgccgaccaaatccccttaacccccgccgcgcgccctccaacctactactaccgccgccgcgccccccaaactctaccaactacccgcgctctaaacccgaaaccaaattcccataaaaacgccgcantattcgccccccgactactaaatttccaaaaaacgaaatacgcgaaataaacgacgacccgcgaaatccgcgaaaaaaaaaaaaaaaacgcgcgacgaaaccgcgaaaaccaccttaattctcgaaccccgccgcccgaaacgctaaaaaaaatcgacgaacccctaacc

SEQ ID NO: 39803 - DNA, 526 bp, Artificial Sequence
  chemically treated genomic DNA (Homo sapiens) CpG-island No: 39803
  misc_feature (356)..(356): n is either a, c, g or t
tatttttattttttttatttttttatttttttacgatttttttttattttagcggaggcggcggggtcgcgggagggagggggtcgggtttagcgcgattggtagcgcgagttcgggagttttttcgtgttttcgttcgtttcgttttcgttattatttgttcgggatttggcgtcggcggtttcgggcgtttttagtttcggttcgggtttcggtttcggtttcgggcgtcgattaggtttttttggttttcgtcgcgcgttttttaatttgttgttgtcgtcgtcgcgttttttaggttttgttagttattcgcgttttgagttcggggttagatttttatggaagcgtcgtantgttcgtttttcggttgttggatttttagaagacgaaatacgcgaggtgagcggcggttcgcgaggttcgcggggagggagggaggggcgcgcggcggggtcgcggaggttattttggttttcgggtttcgtcgttcggagcgttagaggggatcggcggatttttgatt

SEQ ID NO: 39804 - DNA, 526 bp, Artificial Sequence
  chemically treated genomic DNA (Homo sapiens) CpG-island No: 39804
  misc_feature (171)..(171): n is either a, c, g or t
aatcaaaaatccgccgatcccctctaacgctccgaacgacgaaacccgaaaaccaaaataacctccgcgaccccgccgcgcgcccctccctccctccccgcgaacctcgcgaaccgccgctcacctcgcgtatttcgtcttctaaaaatccaacaaccgaaaaacgaacantacgacgcttccataaaaatctaaccccgaactcaaaacgcgaataactaacaaaacctaaaaaacgcgacgacgacaacaacaaattaaaaaacgcgcgacgaaaaccaaaaaaacctaatcgacgcccgaaaccgaaaccgaaacccgaaccgaaactaaaaacgcccgaaaccgccgacgccaaatcccgaacaaataataacgaaaacgaaacgaacgaaaacacgaaaaaactcccgaactcgcgctaccaatcgcgctaaacccgaccccctccctcccgcgaccccgccgcctccgctaaaataaaaaaaaatcgtaaaaaaataaaaaaataaaaaaaataaaaata

SEQ ID NO: 39805 - DNA, 637 bp, Artificial Sequence
  chemically treated genomic DNA (Homo sapiens) CpG-island No: 39805
  misc_feature (139)..(139): n is either a, c, g or t
cggatgtatttcgcgatttttttcgtagtcgttgtcggggttatagcgaggttatgacgttcgtgacgtatacgtagttagtacgtacgcgcgcgcgtggttcgttttttttttttatttcggagcggggtcgtgagtnttcgttcgtttcggagcgtacgtttttttcgggtttcgtttttagttcgtttaggatcgtttggagtcgtagttcgtttgttaaattcggttgggaacgtttggtagtttttaggaggggcgggttcgggggtggtggttttaggagcggttgtcgcggggatcgggtagtgacgcgtttaagggcggaagtgagaaagttgtttgcgtttcgaggcgagttggcggagttgtggcgcggcggggcgatggggggttcgggtagtcgtttgtttaaggagttgttggtcgagtattaggtgcgcgggacgtttggttttggggagttcgcgtgcgggttttttttcgggagtagggttcgggagttggttgcggggacgtcgcggttttttagcggttcgttaattttcgttttggttttgttttttaggatttgacgtttttgacgaagtaggagatttttttgtaagtgttgttttgaattttgttttcgatttcg

SEQ ID NO: 39806 - DNA, 637 bp, Artificial Sequence
  chemically treated genomic DNA (Homo sapiens) CpG-island No: 39806
  misc_feature (499)..(499): n is either a, c, g or t
cgaaatcgaaaacaaaattcaaaacaacacttacaaaaaaatctcctacttcgtcaaaaacgtcaaatcctaaaaaacaaaaccaaaacgaaaattaacgaaccgctaaaaaaccgcgacgtccccgcaaccaactcccgaaccctactcccgaaaaaaaacccgcacgcgaactccccaaaaccaaacgtcccgcgcacctaatactcgaccaacaactccttaaacaaacgactacccgaaccccccatcgccccgccgcgccacaactccgccaactcgcctcgaaacgcaaacaactttctcacttccgcccttaaacgcgtcactacccgatccccgcgacaaccgctcctaaaaccaccacccccgaacccgcccctcctaaaaactaccaaacgttcccaaccgaatttaacaaacgaactacgactccaaacgatcctaaacgaactaaaaacgaaacccgaaaaaaacgtacgctccgaaacgaacgaanactcacgaccccgctccgaaataaaaaaaaaaaacgaaccacgcgcgcgcgtacgtactaactacgtatacgtcacgaacgtcataacctcgctataaccccgacaacgactacgaaaaaaatcgcgaaatacatccg

SEQ ID NO: 39807 - DNA, 637 bp, Artificial Sequence
  chemically treated genomic DNA (Homo sapiens) CpG-island No: 39807
  misc_feature (499)..(499): n is either a, c, g or t
cggggtcggaggtagggtttaaggtagtatttataggaggattttttgtttcgttaggaacgttaagttttggaaggtaaagttagagcggggattagcggatcgttgggaggtcgcggcgttttcgtagttagttttcggattttgttttcgagaagaggttcgtacgcgagttttttagggttaggcgtttcgcgtatttggtattcggttagtagttttttggataggcgattgttcgagttttttatcgtttcgtcgcgttatagtttcgttaattcgtttcgagacgtagataatttttttattttcgtttttgggcgcgttattgttcggttttcgcggtaatcgtttttggggttattattttcgggttcgttttttttaaaagttgttaggcgtttttagtcgggtttggtaggcgagttgcggttttaagcggttttaggcgagttggaggcggggttcggggagggcgtacgtttcggggcggacgganatttacggtttcgtttcggggtgggaggggggggcgggttacgcgcgcgcgtgcgtgttggttgcgtatgcgttacgggcgttatgatttcgttgtggtttcggtagcggttgcggggaaagtcgcgaggtgtattcg

SEQ ID NO: 39808 - DNA, 637 bp, Artificial Sequence
  chemically treated genomic DNA (Homo sapiens) CpG-island No: 39808
  misc_feature (139)..(139): n is either a, c, g or t
cgaatacacctcgcgactttccccgcaaccgctaccgaaaccacaacgaaatcataacgcccgtaacgcatacgcaaccaacacgcacgcgcgcgcgtaacccgcccccccctcccaccccgaaacgaaaccgtaaatntccgtccgccccgaaacgtacgccctccccgaaccccgcctccaactcgcctaaaaccgcttaaaaccgcaactcgcctaccaaacccgactaaaaacgcctaacaacttttaaaaaaaacgaacccgaaaataataaccccaaaaacgattaccgcgaaaaccgaacaataacgcgcccaaaaacgaaaataaaaaaattatctacgtctcgaaacgaattaacgaaactataacgcgacgaaacgataaaaaactcgaacaatcgcctatccaaaaaactactaaccgaataccaaatacgcgaaacgcctaaccctaaaaaactcgcgtacgaacctcttctcgaaaacaaaatccgaaaactaactacgaaaacgccgcgacctcccaacgatccgctaatccccgctctaactttaccttccaaaacttaacgttcctaacgaaacaaaaaatcctcctataaatactaccttaaaccctacctccgaccccg

SEQ ID NO: 39809 - DNA, 539 bp, Artificial Sequence
  chemically treated genomic DNA (Homo sapiens) CpG-island No: 39809
cggttattttcgtacgaggtacgttttcggtagttttttttttttcggttcgcgttttcgggttttcggtatttatttagaggtaggttgtattcgggggttgagcgttaggatcggaggcggcggttttatttgagttgtaatgagcgagtagtagttcgttgcgcgatagttattcgtttttttggggatgtttatattttattagtttatcgcgttggtatattcggagagttcgatatcgttgttcgttgtttattttattttgttatcgttttttattttcgtattacgttttcgtttcgttttcgattcgttcgcgttcgtcgtttttcgttttcgcgtttttatttcgtatttacgttatcgttttttttttatatttttttttatttttgtattcgtttttttttttttggttatttttcgtttattatttatttttttatattcgttattaagtcgttacgcgttgttagtttatttttattttcgcgttcgtcgcgttttttcgtttatttttttttgtcgaggcgcgt

SEQ ID NO: 39810 - DNA, 539 bp, Artificial Sequence
  chemically treated genomic DNA (Homo sapiens) CpG-island No: 39810
acgcgcctcgacaaaaaaaaataaacgaaaaaacgcgacgaacgcgaaaataaaaataaactaacaacgcgtaacgacttaataacgaatataaaaaaataaataataaacgaaaaataaccaaaaaaaaaaaaacgaatacaaaaataaaaaaaaatataaaaaaaaaacgataacgtaaatacgaaataaaaacgcgaaaacgaaaaacgacgaacgcgaacgaatcgaaaacgaaacgaaaacgtaatacgaaaataaaaaacgataacaaaataaaataaacaacgaacaacgatatcgaactctccgaatataccaacgcgataaactaataaaatataaacatccccaaaaaaacgaataactatcgcgcaacgaactactactcgctcattacaactcaaataaaaccgccgcctccgatcctaacgctcaacccccgaatacaacctacctctaaataaataccgaaaacccgaaaacgcgaaccgaaaaaaaaaaaactaccgaaaacgtacctcgtacgaaaataaccg

SEQ ID NO: 39811 - DNA, 539 bp, Artificial Sequence
  chemically treated genomic DNA (Homo sapiens) CpG-island No: 39811
gcgcgtttcggtagggagagatgagcgagggagcgcggcgagcgcgagggtgggggtggattggtagcgcgtggcggtttgatggcgggtgtgggggggtgagtggtgggcggggagtggttaggggggaggaagcgggtgtaggggtaggggggagtgtggagggggagcggtagcgtgggtgcgaggtgggggcgcgagggcgggaggcggcggacgcgggcgagtcgggggcgggacgggggcgtagtgcgagagtgagggacggtagtaggatggggtgggtagcggataacggtgtcgggtttttcgaatgtgttagcgcgatgggttgatggagtgtgggtatttttagaggggcgagtggttgtcgcgtaacgggttattgttcgtttattgtagtttaggtggagtcgtcgttttcgattttggcgtttagttttcggatgtagtttgtttttgggtgagtgtcggggattcggggacgcgggtcgggggaaggaaggttgtcggggacgtgtttcgtgcggaggtggtcg

SEQ ID NO: 39812 - DNA, 539 bp, Artificial Sequence
  chemically treated genomic DNA (Homo sapiens) CpG-island No: 39812
cgaccacctccgcacgaaacacgtccccgacaaccttccttcccccgacccgcgtccccgaatccccgacactcacccaaaaacaaactacatccgaaaactaaacgccaaaatcgaaaacgacgactccacctaaactacaataaacgaacaataacccgttacgcgacaaccactcgcccctctaaaaatacccacactccatcaacccatcgcgctaacacattcgaaaaacccgacaccgttatccgctacccaccccatcctactaccgtccctcactctcgcactacgcccccgtcccgcccccgactcgcccgcgtccgccgcctcccgccctcgcgcccccacctcgcacccacgctaccgctccccctccacactcccccctacccctacacccgcttcctcccccctaaccactccccgcccaccactcacccccccacacccgccatcaaaccgccacgcgctaccaatccacccccaccctcgcgctcgccgcgctccctcgctcatctctccctaccgaaacgcgc

SEQ ID NO: 39813 - DNA, 668 bp, Artificial Sequence
  chemically treated genomic DNA (Homo sapiens) CpG-island No: 39813
gcggtcgtggggaggcggattcgataggttagggtggtcgtggtatcgagtttatcgttggtgtaaaatgtcgggggtcggtggcggtggtggggcgggggtacggttcgtattaggtaaatttcggaggcgttttttggataattttcgtaaatacgggtagagcggggcggggttgggcggggtttggcgggggtttagtattttcggggacgtcgcgtcggattgaggttgtgcgttcgagatttcgggtttttaggggttgcgcgggtcggtttggtaagggggacgagttagtggatattttaggaagagcggtttcgcggggggaatgtatcgtgcgttgattttgatttattttaggtaggcgcggggggtgtttggcgaggtgggagtcgttgttcgggaggtggcggattaggcgaaaatcgtcgcgtagcggttgtttttatttttggattcgtatttatcgatcggtttttttttttagaaggcgttatttgtacgttttgatgggtattggggtcgtcgttcggggagtttgttgttatagtacgtaggaggttgggtcgcgtttttatagttatcgggggtttttgagtagcgtttatatcgcgttagtgtattatttttatttttaaattcgggatttggtattggggggaagt

SEQ ID NO: 39814 - DNA, 668 bp, Artificial Sequence
  chemically treated genomic DNA (Homo sapiens) CpG-island No: 39814
acttccccccaataccaaatcccgaatttaaaaataaaaataatacactaacgcgatataaacgctactcaaaaacccccgataactataaaaacgcgacccaacctcctacgtactataacaacaaactccccgaacgacgaccccaatacccatcaaaacgtacaaataacgccttctaaaaaaaaaaaccgatcgataaatacgaatccaaaaataaaaacaaccgctacgcgacgattttcgcctaatccgccacctcccgaacaacgactcccacctcgccaaacaccccccgcgcctacctaaaataaatcaaaatcaacgcacgatacattccccccgcgaaaccgctcttcctaaaatatccactaactcgtcccccttaccaaaccgacccgcgcaacccctaaaaacccgaaatctcgaacgcacaacctcaatccgacgcgacgtccccgaaaatactaaacccccgccaaaccccgcccaaccccgccccgctctacccgtatttacgaaaattatccaaaaaacgcctccgaaatttacctaatacgaaccgtacccccgccccaccaccgccaccgacccccgacattttacaccaacgataaactcgataccacgaccaccctaacctatcgaatccgcctccccacgaccgc

SEQ ID NO: 39815 - DNA, 668 bp, Artificial Sequence
  chemically treated genomic DNA (Homo sapiens) CpG-island No: 39815
atttttttttagtattaggtttcgggtttaggagtaggggtggtgtattggcgcgatgtgaacgttgtttaaaggttttcggtggttatgggaacgcggtttagttttttgcgtgttatggtaataggtttttcgggcggcggttttagtgtttattagagcgtgtaggtggcgttttttggggagagggatcggtcggtaggtgcgagtttaagaatgggggtagtcgttgcgcggcggttttcgtttggttcgttatttttcgggtagcggtttttatttcgttaggtatttttcgcgtttatttggagtgagttagggttagcgtacggtatatttttttcgcggggtcgttttttttggagtgtttattgattcgttttttttgttaggtcggttcgcgtagtttttggggattcggagtttcgggcgtatagttttagttcggcgcggcgttttcggaaatgttgggttttcgttaagtttcgtttagtttcgtttcgttttgttcgtgtttacgggaattgtttagagggcgttttcgggatttgtttgatgcgggtcgtgttttcgttttattatcgttatcggttttcggtattttgtattaacgatggattcgatgttacgattattttggtttgtcgggttcgtttttttacgatcgt

SEQ ID NO: 39816 - DNA, 668 bp, Artificial Sequence
  chemically treated genomic DNA (Homo sapiens) CpG-island No: 39816
acgatcgtaaaaaaacgaacccgacaaaccaaaataatcgtaacatcgaatccatcgttaatacaaaataccgaaaaccgataacgataataaaacgaaaacacgacccgcatcaaacaaatcccgaaaacgccctctaaacaattcccgtaaacacgaacaaaacgaaacgaaactaaacgaaacttaacgaaaacccaacatttccgaaaacgccgcgccgaactaaaactatacgcccgaaactccgaatccccaaaaactacgcgaaccgacctaacaaaaaaaacgaatcaataaacactccaaaaaaaacgaccccgcgaaaaaaatataccgtacgctaaccctaactcactccaaataaacgcgaaaaatacctaacgaaataaaaaccgctacccgaaaaataacgaaccaaacgaaaaccgccgcgcaacgactacccccattcttaaactcgcacctaccgaccgatccctctccccaaaaaacgccacctacacgctctaataaacactaaaaccgccgcccgaaaaacctattaccataacacgcaaaaaactaaaccgcgttcccataaccaccgaaaacctttaaacaacgttcacatcgcgccaatacaccacccctactcctaaacccgaaacctaatactaaaaaaaaat

SEQ ID NO: 39817 - DNA, 546 bp, Artificial Sequence
  chemically treated genomic DNA (Homo sapiens) CpG-island No: 39817
  misc_feature (228)..(229): n is either a, c, g or t
ttttgtagtttttcggttcgttttcgcgtttttttttacgtttcgtgtttgtttttttttttatttttgtagcgaggaggttaagagtattatttggttgtatttcgttatcggcgaggcggtggttatcggatatcggcggtagagtataggtaacgtcgggtttaaacggagttggttcgtttggaggaggcggtagagttcgggcgttcggtttttcgtaatttnngttttcgcgggtttcgggaggcggcgaggcggggcggaggtcgggcgggagcggtcgtaggtagaggggttacggggatttcgtcgtcgggagttttttttagtttcggggcgtttttttttttttagttttttattagtatttggagacggcgttttttttttgcgttttttttttttattttagtttagacgattttcgcgattttagagtggcgacgtttttttttttgaaatttggagttttgagtttttttttcgcggtcgttatttatttttcggtgatttttagttgtcgttttgttttttagtaatttt

SEQ ID NO: 39818 - DNA, 546 bp, Artificial Sequence
  chemically treated genomic DNA (Homo sapiens) CpG-island No: 39818
  misc_feature (318)..(319): n is either a, c, g or t
aaaattactaaaaaacaaaacgacaactaaaaatcaccgaaaaataaataacgaccgcgaaaaaaaaactcaaaactccaaatttcaaaaaaaaaaacgtcgccactctaaaatcgcgaaaatcgtctaaactaaaataaaaaaaaaaaacgcaaaaaaaaaacgccgtctccaaatactaataaaaaactaaaaaaaaaaaaacgccccgaaactaaaaaaaactcccgacgacgaaatccccgtaacccctctacctacgaccgctcccgcccgacctccgccccgcctcgccgcctcccgaaacccgcgaaaacnnaaattacgaaaaaccgaacgcccgaactctaccgcctcctccaaacgaaccaactccgtttaaacccgacgttacctatactctaccgccgatatccgataaccaccgcctcgccgataacgaaatacaaccaaataatactcttaacctcctcgctacaaaaataaaaaaaaaaacaaacacgaaacgtaaaaaaaaacgcgaaaacgaaccgaaaaactacaaaa

SEQ ID NO: 39819 - DNA, 546 bp, Artificial Sequence
  chemically treated genomic DNA (Homo sapiens) CpG-island No: 39819
  misc_feature (318)..(319): n is either a, c, g or t
aagattgttggggggtaagacggtagttgggggttatcggggagtgagtagcggtcgcggaggaaaaatttaggattttaggttttagggaggggagcgtcgttattttagggtcgcgagggtcgtttaggttgggatggggggagaaggcgtaggaagagggcgtcgtttttaagtgttgatgaaaggttgaggagaaagaggcgtttcgagattggagagaattttcggcggcggagttttcgtggtttttttatttgcggtcgttttcgttcggttttcgtttcgtttcgtcgtttttcggggttcgcgggggtnnaggttgcggggagtcgggcgttcgggttttgtcgttttttttaggcgagttaatttcgtttgggttcggcgttatttgtgttttgtcgtcggtgttcggtgattatcgtttcgtcggtgacggggtgtagttaggtggtgtttttggttttttcgttgtaggggtgagagaaggggtagatacggagcgtgagaggggacgcgggggcgagtcgaggggttgtagga

SEQ ID NO: 39820 - DNA, 546 bp, Artificial Sequence
  chemically treated genomic DNA (Homo sapiens) CpG-island No: 39820
  misc_feature (228)..(229): n is either a, c, g or t
tcctacaacccctcgactcgcccccgcgtcccctctcacgctccgtatctaccccttctctcacccctacaacgaaaaaaccaaaaacaccacctaactacaccccgtcaccgacgaaacgataatcaccgaacaccgacgacaaaacacaaataacgccgaacccaaacgaaattaactcgcctaaaaaaaacgacaaaacccgaacgcccgactccccgcaacctnnacccccgcgaaccccgaaaaacgacgaaacgaaacgaaaaccgaacgaaaacgaccgcaaataaaaaaaccacgaaaactccgccgccgaaaattctctccaatctcgaaacgcctctttctcctcaacctttcatcaacacttaaaaacgacgccctcttcctacgccttctccccccatcccaacctaaacgaccctcgcgaccctaaaataacgacgctcccctccctaaaacctaaaatcctaaatttttcctccgcgaccgctactcactccccgataacccccaactaccgtcttaccccccaacaatctt

SEQ ID NO: 39821 - DNA, 579 bp, Artificial Sequence
  chemically treated genomic DNA (Homo sapiens) CpG-island No: 39821
gcgagcgtttgaatttcgcgttgttttttagttttatcgagacgtaggttaaaatttggttttagaatcgtaggattaagtggaagaagtagaattcgggtgtcgatagcggcgtaggtggggggtggcgttttagttaggcggggggcggcggcggcggcggttcggggggtagttttggtttttcggtatcggcgttttgtatttttagattttttttttttatttcgcggttaatgtttttttttcgttcgtcgtttttttttcgttgacggttgtcgttttcgggagttttttcgcgtcgttttttgggtttttttatttgatttttttttacgtttcgcgtttatgaattcggagttttttggttttttttcgcgggatttacgagggattggtatcgtcgtgtgttttcggtttttttatcgggggtgtaggtgcgcgggtgttagcgtacgttcgtgttcgtcgcgttagacgattttcgcgggttattaaggggttagggatttgtcgttttttaaagtgttcggggacggaggttgattttaagttttgtcgtttttggattttgttgtt

SEQ ID NO: 39822 - DNA, 579 bp, Artificial Sequence
  chemically treated genomic DNA (Homo sapiens) CpG-island No: 39822
aacaacaaaatccaaaaacgacaaaacttaaaatcaacctccgtccccgaacactttaaaaaacgacaaatccctaaccccttaataacccgcgaaaatcgtctaacgcgacgaacacgaacgtacgctaacacccgcgcacctacacccccgataaaaaaaccgaaaacacacgacgataccaatccctcgtaaatcccgcgaaaaaaaaccaaaaaactccgaattcataaacgcgaaacgtaaaaaaaaatcaaataaaaaaacccaaaaaacgacgcgaaaaaactcccgaaaacgacaaccgtcaacgaaaaaaaaacgacgaacgaaaaaaaaacattaaccgcgaaataaaaaaaaaaaatctaaaaatacaaaacgccgataccgaaaaaccaaaactaccccccgaaccgccgccgccgccgccccccgcctaactaaaacgccaccccccacctacgccgctatcgacacccgaattctacttcttccacttaatcctacgattctaaaaccaaattttaacctacgtctcgataaaactaaaaaacaacgcgaaattcaaacgctcgc

SEQ ID NO: 39823 - DNA, 579 bp, Artificial Sequence
  chemically treated genomic DNA (Homo sapiens) CpG-island No: 39823
aatagtaaggtttagaaacggtaaggtttgaggttagttttcgttttcggatattttgaaggacggtagatttttgattttttggtggttcgcgagagtcgtttagcgcggcgggtacgggcgtgcgttgatattcgcgtatttgtattttcggtggaggagtcgagggtatacgacgatgttaatttttcgtgaatttcgcgaaagagggttagggggtttcggatttatagacgcggggcgtagaagggggttaggtaggaaggtttaaggaacggcgcgaaagggttttcgggggcggtagtcgttagcgggaaggaggcggcggacgggaagaggatattggtcgcggagtaggaggggaaagtttggaagtgtagagcgtcggtgtcgggaggttaggattgtttttcgagtcgtcgtcgtcgtcgtttttcgtttggttggggcgttattttttatttgcgtcgttgtcggtattcgggttttgttttttttatttggttttgcgattttggaattagattttgatttgcgtttcggtgaggttgagagatagcgcgaggtttaggcgttcgt

SEQ ID NO: 39824 - DNA, 579 bp, Artificial Sequence
  chemically treated genomic DNA (Homo sapiens) CpG-island No: 39824
acgaacgcctaaacctcgcgctatctctcaacctcaccgaaacgcaaatcaaaatctaattccaaaatcgcaaaaccaaataaaaaaaacaaaacccgaataccgacaacgacgcaaataaaaaataacgccccaaccaaacgaaaaacgacgacgacgacgactcgaaaaacaatcctaacctcccgacaccgacgctctacacttccaaactttcccctcctactccgcgaccaatatcctcttcccgtccgccgcctccttcccgctaacgactaccgcccccgaaaaccctttcgcgccgttccttaaaccttcctacctaacccccttctacgccccgcgtctataaatccgaaaccccctaaccctctttcgcgaaattcacgaaaaattaacatcgtcgtataccctcgactcctccaccgaaaatacaaatacgcgaatatcaacgcacgcccgtacccgccgcgctaaacgactctcgcgaaccaccaaaaaatcaaaaatctaccgtccttcaaaatatccgaaaacgaaaactaacctcaaaccttaccgtttctaaaccttactatt

SEQ ID NO: 39825 - DNA, 509 bp, Artificial Sequence
  chemically treated genomic DNA (Homo sapiens) CpG-island No: 39825
tatcggggtgggaagggggagatcgaggcggggttgcgcggtttttatgtcgtttcgttttttgtcggtagttagggagcgggttgagtttagagttcggcgattttagcggcgtttcggggtttatttatttggttatcgtttttatcgagtcggcgatggcgtgtcgtcgttcgcgtcgttgtcgtatagtacgttcgagatgttaagtagtatttcgcgtacgttagttagtcgtttgttttacggtgttatggcgttcggttttgttttttagtttcgcgttttaatcgacgtttgcgtcggcgtcgcggtcgcgtaggggcgtttgggaattgtagtttcgcgagcggggtagggtaagaagacgggtgtaaattcggaagttggggcgcggtttgggtatttacgcgttattcgtttttgaaacggtgtttttttcggaagttttttttttaggagattagcggataaagagtaggaaaagtagaaaataagtttttaagaaa

SEQ ID NO: 39826 - DNA, 509 bp, Artificial Sequence
  chemically treated genomic DNA (Homo sapiens) CpG-island No: 39826
tttcttaaaaacttattttctacttttcctactctttatccgctaatctcctaaaaaaaaaacttccgaaaaaaacaccgtttcaaaaacgaataacgcgtaaatacccaaaccgcgccccaacttccgaatttacacccgtcttcttaccctaccccgctcgcgaaactacaattcccaaacgcccctacgcgaccgcgacgccgacgcaaacgtcgattaaaacgcgaaactaaaaaacaaaaccgaacgccataacaccgtaaaacaaacgactaactaacgtacgcgaaatactacttaacatctcgaacgtactatacgacaacgacgcgaacgacgacacgccatcgccgactcgataaaaacgataaccaaataaataaaccccgaaacgccgctaaaatcgccgaactctaaactcaacccgctccctaactaccgacaaaaaacgaaacgacataaaaaccgcgcaaccccgcctcgatctcccccttcccaccccgata

SEQ ID NO: 39827 - DNA, 509 bp, Artificial Sequence
  chemically treated genomic DNA (Homo sapiens) CpG-island No: 39827
ttttttagggatttgttttttgttttttttgttttttgttcgttgattttttgggaagaaagttttcgaaaaggatatcgttttaggggcgagtgacgcgtgggtgtttaggtcgcgttttagttttcgggtttgtattcgtttttttgttttgtttcgttcgcgggattatagtttttaggcgtttttgcgcggtcgcggcgtcggcgtaggcgtcggttgggacgcggagttgaggagtagggtcgggcgttatggtatcgtggggtaagcggttggttggcgtgcgcggggtgttgtttgatatttcgggcgtgttgtacgatagcggcgcgggcggcggtacgttatcgtcggttcggtggaggcggtggttaggtgagtgggtttcgggacgtcgttggggtcgtcgagttttaagtttagttcgttttttggttgtcggtagggggcggggcggtatgagggtcgcgtagtttcgtttcggtttttttttttttatttcggtg

SEQ ID NO: 39828 - DNA, 509 bp, Artificial Sequence
  chemically treated genomic DNA (Homo sapiens) CpG-island No: 39828
caccgaaataaaaaaaaaaaaaccgaaacgaaactacgcgaccctcataccgccccgccccctaccgacaaccaaaaaacgaactaaacttaaaactcgacgaccccaacgacgtcccgaaacccactcacctaaccaccgcctccaccgaaccgacgataacgtaccgccgcccgcgccgctatcgtacaacacgcccgaaatatcaaacaacaccccgcgcacgccaaccaaccgcttaccccacgataccataacgcccgaccctactcctcaactccgcgtcccaaccgacgcctacgccgacgccgcgaccgcgcaaaaacgcctaaaaactataatcccgcgaacgaaacaaaacaaaaaaacgaatacaaacccgaaaactaaaacgcgacctaaacacccacgcgtcactcgcccctaaaacgatatccttttcgaaaactttcttcccaaaaaatcaacgaacaaaaaacaaaaaaaacaaaaaacaaatccctaaaaaa

SEQ ID NO: 39829 - DNA, 570 bp, Artificial Sequence
  chemically treated genomic DNA (Homo sapiens) CpG-island No: 39829
gcgtgtatattcggcgagatttttttaggaaagtcggggagtcgcgcgggatttagttttgcgtttagttcggcggacgttagttgtagtggtcgtattcgtcggttcgcgttggttggttttgtcgttacgtcgtgcgggataatttcgggcgtttattggtcggtcggcggggggggcgggacggggggcggaatcggaatcggtagtggtttgggggcgggatttcgcggattgttgtggcggtacgtggagcggcggtcgcgatggtagaatcgggggcggttttgtagtttggagttttatagtgcggggtcgcggtaggttataggaagagttcgaggttcgggcgtatcggttgagtgtgcggtttcgcggttcggagtcgcgtcgtttatcgagttttttcggcgcgaggtcggcgcgtatggggtttttgtttcggagcgagatatgtgtttggcgtattttttttgtagtcgggttacgattaacgagtgttttagcgattttgggtagaatagggttttttttagtttcggagagttgaatgttattcggggagaacgg

SEQ ID NO: 39830 - DNA, 570 bp, Artificial Sequence
  chemically treated genomic DNA (Homo sapiens) CpG-island No: 39830
ccgttctccccgaataacattcaactctccgaaactaaaaaaaaccctattctacccaaaatcgctaaaacactcgttaatcgtaacccgactacaaaaaaaatacgccaaacacatatctcgctccgaaacaaaaaccccatacgcgccgacctcgcgccgaaaaaactcgataaacgacgcgactccgaaccgcgaaaccgcacactcaaccgatacgcccgaacctcgaactcttcctataacctaccgcgaccccgcactataaaactccaaactacaaaaccgcccccgattctaccatcgcgaccgccgctccacgtaccgccacaacaatccgcgaaatcccgcccccaaaccactaccgattccgattccgccccccgtcccgccccccccgccgaccgaccaataaacgcccgaaattatcccgcacgacgtaacgacaaaaccaaccaacgcgaaccgacgaatacgaccactacaactaacgtccgccgaactaaacgcaaaactaaatcccgcgcgactccccgactttcctaaaaaaatctcgccgaatatacacgc

SEQ ID NO: 39831 - DNA, 570 bp, Artificial Sequence
  chemically treated genomic DNA (Homo sapiens) CpG-island No: 39831
tcgtttttttcgggtgatatttaatttttcggaattggaggaggttttattttgtttagggtcgttgaggtattcgttagtcgtggttcgattgtaggaagagtgcgttaggtatatgtttcgtttcggaatagggattttatgcgcgtcgatttcgcgtcggaggggttcgatgggcggcgcggtttcgagtcgcggggtcgtatatttagtcggtgcgttcgggtttcgagttttttttgtggtttgtcgcggtttcgtattatggggttttagattgtagggtcgttttcggttttgttatcgcggtcgtcgttttacgtgtcgttatagtagttcgcgaggtttcgtttttaagttattgtcggtttcggtttcgtttttcgtttcgtttttttcgtcggtcgattaatggacgttcgaggttgtttcgtacgacgtggcggtagggttaattagcgcgaatcggcgggtacgattattgtagttggcgttcgtcggattggacgtagagttaaatttcgcgcggtttttcggtttttttggaggagtttcgtcgagtgtgtacgt

SEQ ID NO: 39832 - DNA, 570 bp, Artificial Sequence
  chemically treated genomic DNA (Homo sapiens) CpG-island No: 39832
acgtacacactcgacgaaactcctccaaaaaaaccgaaaaaccgcgcgaaatttaactctacgtccaatccgacgaacgccaactacaataatcgtacccgccgattcgcgctaattaaccctaccgccacgtcgtacgaaacaacctcgaacgtccattaatcgaccgacgaaaaaaacgaaacgaaaaacgaaaccgaaaccgacaataacttaaaaacgaaacctcgcgaactactataacgacacgtaaaacgacgaccgcgataacaaaaccgaaaacgaccctacaatctaaaaccccataatacgaaaccgcgacaaaccacaaaaaaaactcgaaacccgaacgcaccgactaaatatacgaccccgcgactcgaaaccgcgccgcccatcgaacccctccgacgcgaaatcgacgcgcataaaatccctattccgaaacgaaacatatacctaacgcactcttcctacaatcgaaccacgactaacgaatacctcaacgaccctaaacaaaataaaacctcctccaattccgaaaaattaaatatcacccgaaaaaaacga
